United States Patent 11,098,302 (IDENTIFICATION OF POLYNUCLEOTIDES ASSOCIATED WITH A SAMPLE) - sequence listing, part 24

SEQ ID NO: 79047 - DNA, 587 bp, Homo sapiens
  misc_feature: GYAE6OF02G0XCD.37.26.C04.1.454.CMB.1.raw
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtgggtctcaggtattactggtagtggtaataccgcatactacgcagactccgtgacgggccgttcaccgtctccagagacaattccaagaatacggtctatctggaaatgaacagcctgagagccgaggacacggccctctattactgtgcgagagatcagacggagtatagcagcagctctgactacgtggggccacggaaccctggtcaccgtctcctcagcctccaccaacggcccatccggtccttccccgtcggccacccctccctaccaacgacgccacctcgtcggggccacgacgccggcccgtcgggctcgccgtcggtacgaacggtacctaccttccacttcctaacctaaccttacgtcggacggccggggacgttcgggaccgtaacgggccgaccgtagtacg

SEQ ID NO: 79048 - DNA, 540 bp, Homo sapiens
  misc_feature: GYAE6OF02FKUJ1.37.26.C04.1.454.CMB.1.raw
  modified_base (446)..(446): a, c, t, g, unknown or other
  misc_feature (446)..(446): n is a, c, g, or t
  modified_base (461)..(461): a, c, t, g, unknown or other
  misc_feature (461)..(461): n is a, c, g, or t
  modified_base (468)..(468): a, c, t, g, unknown or other
  misc_feature (468)..(468): n is a, c, g, or t
  modified_base (531)..(532): a, c, t, g, unknown or other
  misc_feature (531)..(532): n is a, c, g, or t
  modified_base (534)..(534): a, c, t, g, unknown or other
  misc_feature (534)..(534): n is a, c, g, or t
  modified_base (537)..(537): a, c, t, g, unknown or other
  misc_feature (537)..(537): n is a, c, g, or t
  modified_base (540)..(540): a, c, t, g, unknown or other
  misc_feature (540)..(540): n is a, c, g, or t
tcagtagtgtagatcacgaccggtgctcgatttagtctagcgactttgggtttgggggaggcttggtacagcctggggggtccctgagactctcctgtgtagcctctgaattcccctttacggcttattggatgagctgggtccgccagggctccagggaaggggtctggagtgggtggccaacataaagcaagatggaagtaagaaggagtatgtggactctgtgaagggccgtttcaccgatctccagagacaacgccaagactccgtgcatctgcaaatgaacagtctgagagccgaggacacggctaatttatacgtgcgcgaggagaaggactgggcgttttcgactacgtggggaccaggggaaccctggtcaccgtctcctcacgcctccaccgaagggcccagtccggtcttccccgtgccgccctgcctccaggacncacctcgagagcacncgcgccnggctgcctgtcaagactacttcatctacactacgtcgaggcggctggcgaacggcacgatagnngngcngtn

SEQ ID NO: 79049 - DNA, 630 bp, Homo sapiens
  misc_feature: GYAE6OF02H9JGT.37.26.C04.1.454.CMB.1.raw
  modified_base (243)..(243): a, c, t, g, unknown or other
  misc_feature (243)..(243): n is a, c, g, or t
  modified_base (295)..(295): a, c, t, g, unknown or other
  misc_feature (295)..(295): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccgagggaaggggctggagtgggtctcaggtattactggtagtggtaaatccgcatactacgcagactccgtgacgggccgttcaccgtcnccagagactaattccaaagatacggtctaatctaggaaatgaacagcctganagccgaggacacggccctctattactgtgcgaagagtatcagacggtagtatacgcagcaagtctctgactactgggggacccaacgggaaacccttgggtaccacccggttctcccgcgaacgccctacccaaccgaaacgggtccccaatccgggttcccttcccccgtaggcccaacccctcctaccaaacgacgccaaccgttcgtagggggccaacgacgccgcccgtttgggctcgccgttggacaaacggacttacctccctaatccttaaccacttaacctcggaacggccgggcgtacggaccgaaagggccggttaccaagtagg

SEQ ID NO: 79050 - DNA, 589 bp, Homo sapiens
  misc_feature: GYAE6OF02JV0KR.37.26.C04.1.454.CMB.1.raw
  modified_base (477)..(477): a, c, t, g, unknown or other
  misc_feature (477)..(477): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtgggtggccaacatacagggaggtggtggtacgaaaaactatgtggactctgtgcggggccgattcaccatctccagagacaacgaccaaaaactcactgtatctgcaaatggacggcctgagatccgaggacacggctgtgtattatgtgcgagagatttagactacaaagtttcgagtgactggtatgatgcttatgataccgtggggaccaagggaccatcggtacacccgtctcttacacgcctaccaccgaacggccctacgtcggtccttcccctgggcccgccctgcctaccgacggacnccaccctccggagtacgactacgacggccggccgtacgggctcgtcccgtgggtaccaaggacccttacgttacccgattccgtaaccaccgttacgtcggaggtcccgggg

SEQ ID NO: 79051 - DNA, 587 bp, Homo sapiens
  misc_feature: GYAE6OF02FTKD2.37.26.C04.1.454.CMB.1.raw
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtgggtctcaggtattactggtagtggtaataccgcatactacgcagactccgtgacgggccggttcaccgtctccagagacaattccaagaatacggtctatctggaaatgaacagcctgagagccgaggacacggccctctattactgtgcgagagatcagacggagtatagcagcagctctgactacgtcggggccaacggaaccctgggtcacccggttctccctcacgccctcccaccgaacgggccccacgtccggtccttcccccgtcggtcccacccctccctacccaacgacgaccacccgtcgtcggggccacgacggccgggcccgtgggcctcgccgtcggtaccgaaggtacctacttccactctaacactacctgacggcgggctcggacgaacggcgcatacg

SEQ ID NO: 79052 - DNA, 557 bp, Homo sapiens
  misc_feature: GYAE6OF02F2XDJ.37.26.C04.1.454.CMB.1.raw
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtgggtctcaggtattactggtagtggtaataccgcatactacgcagactccgtgacgggccggttcaccgtctccagagacaattccaagaatacggtctatctggaaatgaacagcctgagagcccgaggacacggccctctattactgtgcgagagatcagacggagtatagcagcagctctgactactggggccacggaccctggtcacgtctcctcagcctccaccaacgggcccatcggtccttcccctggccaccctcctccaacgacgccacctcgtcggggccacgacgccggcccgtcggggcctcgccgtggtccgaaagggacctacgttccactcctacacctactgacgcgggctcgggccaaggcgcagtacg

SEQ ID NO: 79053 - DNA, 563 bp, Homo sapiens
  misc_feature: GYAE6OF02FUWAE.37.26.C04.1.454.CMB.1.raw
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtgggtctcaggtattactggtagtggtaataccgcatactacgcagactccgtgacgggccggttcaccgtctccagagacaattccaagaatacggtctatctggaaatgaacagcctgagagccgaggacacggccctctattactgtgcgagagatcagacggagtatagcagcagctctgactactggggccacggaaccctggtcaccgtctcctcagcctcaccaaggcccatcggtcttcccctgccaccctcctaccagacgccacctcgtggggccacgacgaccggccctggggcctcggtcccgtggtaccaacgggaccttaccgttccacttcctaacaccttacgtgacgcgggctcgggaccacgggcgtccagtacg

SEQ ID NO: 79054 - DNA, 580 bp, Homo sapiens
  misc_feature: GYAE6OF02G3W9G.37.26.C04.1.454.CMB.1.raw
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtgggtctcaggtattactggtagtggtaataccgcatactacgcagactccgtgacgggccgttcaccgtctccagagacaattccaagaatacggtctatctggaaatgaacagcctgagagccgaggacacggccctctattactgtgcgagagatcagacggagtatagcagcagctctgactacgtggggccacggaaccctggtccaccgtctcctcacgcctccaccaacgggcccacgtccggtccttccccgtcggccacccctcctccaagacgccacccttcgtcgggggccacgacgccggcccgtggggcctcggccgtggtaccgaacgggaccttaccttccacttcctaaccaccttaccgtggacgccgggctcgggaccgaaggcgcgatacg

SEQ ID NO: 79055 - DNA, 613 bp, Homo sapiens
  misc_feature: GYAE6OF02ITGA2.37.26.C04.1.454.CMB.1.raw
  modified_base (362)..(362): a, c, t, g, unknown or other
  misc_feature (362)..(362): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtgggtctcaggtatttactggtagtggtaataccgcatactacgcagactccgtgacgggccggttcaccgtctccagagacaattccaagaatacggtctatctggaaatgaacagcctgagagccgaggacacggccctctattactgtgcgagagatcgagacggagtatagcagcagctctgactacnggggccacggaaccctggtcacccgtctcctcagccctccaacccgaacgggcccagtccggtccttccccgtcggccacccctccctccaacgacgccacctccgtcggggccacgacggcccggcccgtcgggccgtcgccgttggtaccgaaacgggtacctaccgttccaacttacctaccctaaccgttacgtacggaacggtccggggaccgttcgggaccgtaaacgggccggacgtagtacgg

SEQ ID NO: 79056 - DNA, 646 bp, Homo sapiens
  misc_feature: GYAE6OF02JPFXA.37.26.C04.1.454.CMB.1.raw
  modified_base (391)..(391): a, c, t, g, unknown or other
  misc_feature (391)..(391): n is a, c, g, or t
tcagtagtgtagatcacgaccggtgctcgatttagtctagcgactttgggtttgggggagggcgttggtacgaggccgtggggggtcccgtgagactctcctgtgcagcctctggtttcatctttagcaactacgccatgagctgggtccgccaggctccgaggggaaggggctgggagtgggtctcaggtattacgtggtagtggtaactaccgcatactacgcagactccgtgacgggccgttcaccgtctccagagacaattccaaagaatacggtctatctaggaaatgaaacagcctagagaagccgtaaggaccacggtccctatagttaactgtgacgagagatcgagacggagtataggcaggcaagtctcgtagacttacgnggggacccacgggaaccctgggtaccaccgtctccgtcacgcctccaacgaacgggtccacgtccggtcccttccccgtcggccacccgtccaccaacgacgccacctcggtcgggccacgacgcccggccgtcggaccgtcgtcccgttcggaccaacgggtacctaaccgttccgaaccttaccgtaactaaccgttacgtacggtaacgggtccggtacgtaccgggtagaccgggaccgacgtaagtacgg

SEQ ID NO: 79057 - DNA, 665 bp, Homo sapiens
  misc_feature: GYAE6OF02JGEMJ.37.26.C04.1.454.CMB.1.raw
  modified_base (212)..(212): a, c, t, g, unknown or other
  misc_feature (212)..(212): n is a, c, g, or t
  modified_base (255)..(255): a, c, t, g, unknown or other
  misc_feature (255)..(255): n is a, c, g, or t
  modified_base (371)..(371): a, c, t, g, unknown or other
  misc_feature (371)..(371): n is a, c, g, or t
tcagtagtgtagatcacgaccggtgctcgatttagtctagcgactttgggtttgggggtagggcgttggtacagcctggggggtcccgtggagactctcctgtgcagcctctggtttcatctttagcaactacgccatgagctgggtccgccaggctccagggaaggggctgggagtggggtctcaggtattactggtagtggtaataccgnatactacgcagactccgtgacgggccggttcaccgtctccagngacaattccaagaatacggtctatctggaaatgaacagcctgagagccgaggactacgggccctctacttactagttgcgtagaggatccagaccgggatacgtagcagcaagctntgaactacgtcgggggcccacgggaacctcggtacaacccgtctccctcagtcctaccctaaccaaccgggcccaacgtccgggtccttaccccccgtcgggcccgtaacccctcccgtacccaaacggtaccgacccgtaacccgtccgtccggggggacctacgaccggtccgggccccgtggggccgtcgccgtcggtacaacgggactaaccgtttcccaagtcccttaaccgacttacgttacgaacggtccgggaccgttcgggaccaaggggaccgctacggtaacg

SEQ ID NO: 79058 - DNA, 586 bp, Homo sapiens
  misc_feature: GYAE6OF02HWBG0.37.26.C04.1.454.CMB.1.raw
  modified_base (585)..(585): a, c, t, g, unknown or other
  misc_feature (585)..(585): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtgggtctcaggtattactggtagtggtaataccgcatactacgcagactccgtgacgggccggttcaccgtctccagagacaattccaacagcacgctgtatttgcacatgaacagcctgagagccgaggacacggccatatattattgtgcgaaactttccttttgactggtttattactcccctagtcgaccacgtgggccagggaaccctggtacaccgtctcctcacgccctccaccaacgggcccacgtccggtccttcccccgtggcctacccctcccttacccaacgacgccaccctccgtcgggggccaccgacggccggcccgtcgggcctcgccgtcggtaccaacggtactaccttccgactcctacactactggacgcggcgtggcgaacggcgacgagtagnc

SEQ ID NO: 79059 - DNA, 603 bp, Homo sapiens
  misc_feature: GYAE6OF02GXP4L.37.26.C04.1.454.CMB.1.raw
  modified_base (354)..(354): a, c, t, g, unknown or other
  misc_feature (354)..(354): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtgggtctcaggtattactggtagtggtaataccgcatactacgcagactccgtgacgggccggttcaccgtctccagagacaattccaagaatacggtctatctggaaatgaacagcctgagagccgaggacacggccctctattactgtgcgagagatcagacggagtatagcagcagctctnactacgtcggggccacggaaccctggtccaccggtctcctcacgccctcccaccgaacgggcccaagtccggtccttcccccgtggcccacccctccctccaacgacgccaccctcgtcggggccacgacgccggcccgtgggcctcggccgtgggtccaacgggaccttaccgttccctagttcccgtaaccaaccttacgtcggacggccgggacgtcgggaccgtaacgggccgtaccgagtacgg

SEQ ID NO: 79060 - DNA, 619 bp, Homo sapiens
  misc_feature: GYAE6OF02HO1I2.37.26.C04.1.454.CMB.1.raw
  modified_base (350)..(350): a, c, t, g, unknown or other
  misc_feature (350)..(350): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtgggtctcaggtattactggtagtggtaataccgcatactacgcagactccgtgacgggccgttcaccgtctccagagacaattccaagaatacggtctatctggaaatgaacagcctgagagccgaggacacggccctctaatctgtgcgagagatcagacggagtatagcagcagctngactacgtggggacccaacggaaccctggtcacccgtctcctcacgccctccaccgaacggcccacgtccgtcccttccccgtcggccacccctccctaccgaacgacgcctaccgtcggtcgggggaccacgacggcccggtcccgtcggggcctcgtcccgtcgggtaccgaaacggtaccttaccgttaccctacttaccgtaacctaaccttacgtcggaaccggtccggggtccgtacgggaccgaacgggccgtacgagtacg

SEQ ID NO: 79061 - DNA, 600 bp, Homo sapiens
  misc_feature: GYAE6OF02I7LYH.37.26.C04.1.454.CMB.1.raw
  modified_base (316)..(316): a, c, t, g, unknown or other
  misc_feature (316)..(316): n is a, c, g, or t
  modified_base (323)..(323): a, c, t, g, unknown or other
  misc_feature (323)..(323): n is a, c, g, or t
  modified_base (361)..(361): a, c, t, g, unknown or other
  misc_feature (361)..(361): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccaggggaaggggctgggagtgggtctcaggtattactggtagtggtaataccgcatactacgcagactccggtgacgggccgttcaccgtctccagagacaattccaaagaatacggtctatctaggaaatgaacagcctagagagccgaggacacggccctntattacngtgacgagaagatcgagacggagtatagcagcagctcngactacgtaggggacaccggaacctggtcacccgtctcctcacggtcctaccaccgaacgggcccacgtccggtccttcccgtcgtaccaccctcctccgaacgacgacctacctcgtcggggccacgacgccggcccgtacgggccgtcgccgtcggtacgaacggacctaccgttaccacgtccgtaacctactacctcgacggccggtcgacggacgaagggtccgacgacgtacg

SEQ ID NO: 79062 - DNA, 624 bp, Homo sapiens
  misc_feature: GYAE6OF02HXGMW.37.26.C04.1.454.CMB.1.raw
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtgggtctcaggtattactggtagtggtaataccgcatactacgcagactccgtgacgggccggttcaccgtctccagagacaattccaagaatacggtctatctggaaatgaacagcctgagagccgaggacacggccctctattactgtgcgagagatcagacggagtatagcagcagctctgactacgtggggccacggaaccctggtaccacccgtctcctcacgcctccaccgaacgggccccagtccggtccttccccgtcggcccacccctcctaccgaacgacgccaacccgtcgtcggggccacgacggccggtcccgtcggggcctcgccgttacgggtaccgaaacgggtaccttaaccgttaccctaacgttacccgtaacctaaccgttacgtacggaacggccggggtcgtcggggaccgaacggggccgacgaagtacgg

SEQ ID NO: 79063 - DNA, 589 bp, Homo sapiens
  misc_feature: GYAE6OF02ISLYZ.37.26.C04.1.454.CMB.1.raw
  modified_base (396)..(396): a, c, t, g, unknown or other
  misc_feature (396)..(396): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtgggtctcaggtattactggtagtggtaataccgcatactacgcagactccgtgacgggccggttcaccgtctccagagacaattccaaagaatacggtctatctggaaatgaacagcctgagagccgaggacacggccctctattactgtgcgagagatcagacggatatagcagcagctctgactagtcggggaccacggaaccctggtccacccgtctcctcncgcctccgaccaacgggcccacgtccggtccttccccgcggccctacccctccctaccgaacgacgccacccgtcgtcggggccacgacggccggcccgtgggcctcgccgtcggtacgaacggtacctaccttaccacttacctaaccaccttacgtcgacggccgggtcgtcgggaccacgggccagatag

SEQ ID NO: 79064 - DNA, 595 bp, Homo sapiens
  misc_feature: GYAE6OF02I5GQ0.37.26.C04.1.454.CMB.1.raw
  modified_base (353)..(353): a, c, t, g, unknown or other
  misc_feature (353)..(353): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtgggtctcaggtattactggtagtggtaataccgcatactacgcagactccgtgacgggccggttcaccgtctccagagacaattccaagaatacggtctatctaggaaatgaacagcctgagagccgaggacacggccctctattactgtgcgagagatcagacggagtatagcagcagctntgactacgtggggccacggaacctggtcaccgtctcctcacgcctccaaccgaacgggcccacgtccggttcccttcccccgtcggtcccaccccttccctacccgaaacgacgccaccgttccggtcggggaccacgacggccggcccgtcgggctcgccgttggtacgaacggtaccttaccttacctataccgtactaaccgtactcggtacggcggcgtcggacgacggcgcgatacg

SEQ ID NO: 79065 - DNA, 682 bp, Homo sapiens
  misc_feature: GYAE6OF02G2K5Q.37.26.C04.1.454.CMB.1.raw
  modified_base (316)..(316): a, c, t, g, unknown or other
  misc_feature (316)..(316): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccgagggaaggggctggagtgggtctcaggtattactggtagtggtaataccgcatactacgcagactccgtggaccgggtccgttcaccgtctccagagacaattccaaagaatacggtctatctaggaaatgaacagcctgagagccgaggacacggccctntattacgtgtgcgagagatcgagacgagtatagcagcagctctgaactacggtcgggaccaaccggaaccctggtcccaccggttcctccctacaccgccctacccaacccgaccgggaccccgtacgtcccgggttccccttccccgtcggacccctacccccgttcccaacccgaacgtaccgaccctacccgtcgggtacggggaccacgacgggcccggtcccgtcggggccttccggcccgttcgggtaccaaacgggtacccttacccttacccgtacgttaccctaaactacccttaaacggtcgggtaccggtccggggacccgttacgggaccggaacgggccggacgtaagtacgg

SEQ ID NO: 79066 - DNA, 583 bp, Homo sapiens
  misc_feature: GYAE6OF02FUZT0.37.26.C04.1.454.CMB.1.raw
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtgggtctcaggtattactggtagtggtaataccgcatactacgcagactccgtgacgggccggttcaccgtctccagagacaattccaagaatacggtctaatctggaaatgaacagcctgagagccgaggacacggccctctattactgtgcgagagatcagacggatatagcagcagctctgactacgtggggccacggaaccctggtcaccgtctcctcacgccctccaccgacggccactccggtcttccccgtcggccaccctccctccgaacgacgccacctcgtcggggcacgacgccggcccgtcgggcgtcgccgtcggtaccgtaaggaccgttaccttaccgactacctaaccacctaccgtacgacggccgggtcgtcgggaccgacggccgactagtacg

SEQ ID NO: 79067 - DNA, 584 bp, Homo sapiens
  misc_feature: GYAE6OF02JZ44N.37.26.C04.1.454.CMB.1.raw
  modified_base (313)..(313): a, c, t, g, unknown or other
  misc_feature (313)..(313): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtgggtctcaggtattactggtagtggtaataccgcatactacgcagactccgtgacgggccgttcaccgtctccagagacaattccaaagaatacggtctatctggaaatgaacagcctgagacgccgaggaccacggccctntattactgtgcgagagatcagacggagtatagcagcagctctgacctcgtggggcccacggtaaccctggtccaccgtcctcctcacgcctccacgacggccactccgtccttcccgtcgccaccctcctaccaagacgccaccgtcgtcgggaccacgacggccggccgtcgggtctccgtccgtcggtacgaacgtaccttaccttccgactaccgtactaaccttacgtacggacgtccgggacgttcggacgaacggcgtacagtcg

SEQ ID NO: 79068 - DNA, 590 bp, Homo sapiens
  misc_feature: GYAE6OF02I2SCM.37.26.C04.1.454.CMB.1.raw
  modified_base (326)..(326): a, c, t, g, unknown or other
  misc_feature (326)..(326): n is a, c, g, or t
  modified_base (336)..(336): a, c, t, g, unknown or other
  misc_feature (336)..(336): n is a, c, g, or t
  modified_base (498)..(498): a, c, t, g, unknown or other
  misc_feature (498)..(498): n is a, c, g, or t
  modified_base (542)..(542): a, c, t, g, unknown or other
  misc_feature (542)..(542): n is a, c, g, or t
tcagtagtgtagatcacgaccggtgctcgatttagtctagcgactttgggtttgggggtagggcgttggtacagcctggggggtcccgtggagactctcctgtgcagcctctggtttcatctttagcaactacgccatgagctgggtccgccaggctccaggggaaggggctgggagtggggtctcgaggtattactgggtagtggtaataccgcatactacgcagactccgtgacgggtccggttcaccgtctccagagacaattccaagaatacggtcatctagaaatgaacagctgagagccgagacacggccctctattacngtgcgagagntcagacggatataggcagcagcttcgtgactacgtcggggacccacggggaaccctggtccaccgtctcccacgacgccctaccaccgaacggccccagtccgttacccgttccccgtcggtcccaccctccctaccaacgacgccaccgtcgcggggaccncgacgccggccgcggtccgcgccgtgaccgacggacttcgtccntaccacgtacctcgtcgacgccggtcgcgggacgaggccgacacgtag

SEQ ID NO: 79069 - DNA, 633 bp, Homo sapiens
  misc_feature: GYAE6OF02IZ6W4.37.26.C04.1.454.CMB.1.raw
  modified_base (312)..(312): a, c, t, g, unknown or other
  misc_feature (312)..(312): n is a, c, g, or t
  modified_base (357)..(357): a, c, t, g, unknown or other
  misc_feature (357)..(357): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaagggctggagtgggtctcaggtattactggtagtggtaataccgcatactacgcagactccgtgacgggccggttcaccgtctccagagacaattccaaagaatacggtctatctggaaatgaacagcctgagagcccgaggacacggccctntattactgtgcgagagatcgaggacggagtataggcagcagctcngactacgcggggaccacggaaccctggtaccaccgttctacctcgacgtccctacccaacccgaacgggccccacgtcccggttcccttcccccgtcggaccctacccctccctaccgaaacgaccgtccacccgtccggtcggggccacgacggccggacccgtgggcctcggccttacgggacctaacgggtaccttaccgttaccacgttaccgtaacgaccttacgtacggacggtcgggtacgtcgggaccaacgggccgtaccgagtacg

SEQ ID NO: 79070 - DNA, 576 bp, Homo sapiens
  misc_feature: GYAE6OF02F1LLN.37.26.C04.1.454.CMB.1.raw
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtgggtctcaggtattactggtagtggtaataccgcatactacgcagactccgtgacgggccggttcaccgtctccagagacaattccaagaatacggtctatctggaaatgaacagcctgagagccgaggacacggccctctattactgtgcgagagatcagacggagtatagcagcagctctgactactggggccacggaaccctggtcaccgtctcctcacgcctccaccaacggcccagtcggtccttccccctcggccacccctccctccaacgacgccaccctcgtcgggggccaccgacggaccggcccgtcggggccgtcgccgtcggtacgaacggaccttaccttccatcctaaccactactcgacgcgggcgtcggtacggacggacggcagtacg

SEQ ID NO: 79071 - DNA, 740 bp, Homo sapiens
  misc_feature: GYAE6OF02G4P2G.37.26.C04.1.454.CMB.1.raw
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtgggtctcaggtattactggtagtggtaataccgcatactacgcagactccgtgacgggccgttcaccgtctccagagacaattccaagaatacggtctatctggaaatgaacagccgtgagagccgaggacacggccctctattactgtgcgagagatcgagacggagtatagacagcagctcgtagactacgtggggcccaaccggtaacccgtggtacctacccgtccttcccgtacaaccgtcccctacccgaacccgtaaacggggaccccctaacggttccccgggtttacccctttccccccggtaccgggtaccctaacccccccgttccccttaacccgtaaacggacccggtacccgttaaccccgttccgggtacggggggacccaaccggtaccgggacccgggttccccgggtcggggtccctaccgggtcccgttacggggaaccttaaaccggggtaaccctaaccgtttccccgaacttcccggttaaactacccgttaacgttcgggtaccggccgggtacgttaccgggacaaccgggtccgaccgtaatgg

SEQ ID NO: 79072 - DNA, 611 bp, Homo sapiens
  misc_feature: GYAE6OF02HSXK8.37.26.C04.1.454.CMB.1.raw
  modified_base (246)..(246): a, c, t, g, unknown or other
  misc_feature (246)..(246): n is a, c, g, or t
  modified_base (290)..(290): a, c, t, g, unknown or other
  misc_feature (290)..(290): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggcctccgaggggaaggggctggagtgggtctcaggtattactggtagtggtaataccgcatactacgcagactccgtgacgggccggttcaccgtcnccagagacaattccaaagatacggtctatctggaaatgaacgancctgagagccgaggacaccggccctctattactgtgacgagagatcaggacggagtatacgcgagcagctcgtgacgtacgtcggggacccacgggtaacccgtggtccacccggttctccctcacgccctaccacccgacggacccacgtccggtcccttcccgtcggtcctacccctccctaccgaacgacgccaccgtcgtcggggccacgcgccggcccgtcgggtcgcgccgtggtacgaacggtcctacgttccactacctcaccgttacgtacggacggccgggtacgtcggaccgtaggaccggacgtagtag

SEQ ID NO: 79073 - DNA, 582 bp, Homo sapiens
  misc_feature: GYAE6OF02IWVWS.37.26.C04.1.454.CMB.1.raw
  modified_base (393)..(393): a, c, t, g, unknown or other
  misc_feature (393)..(393): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtgggtctcaggtattactggtagtggtaataccgcatactacgcagactccgtgacgggccgttcaccgtctccagagacaattccaagaatacggtctatctggaaatgaacagcctgagagccgaggacacggccctctattactgtgcgagagatcagacggatatagcagcagctctgactacgtggggccacggaaccctggtccacccgtctccctnacgccctccaccaacggcccatcggtccttcccctcgccaccctcctccaacgacgccacctcgtcggggccacgacgccggcccgtcggggcctcggtccgtggtccaaacggtacctaccttaccacttacttaaccacttacgtcggacggtccgggcgtcgggaccgaagggcccgagagtacgg

SEQ ID NO: 79074 - DNA, 830 bp, Homo sapiens
  misc_feature: GYAE6OF02I77VX.37.26.C04.1.454.CMB.1.raw
tcagtagtgtagatcacgaccggtgctcgatttagtctagcgactttgggtttgggggagcttggtacagcctgggggtccctgagactctcctgtgcagcctcgtggttcatctttagctaactacgccagtgagcgtgggtccgccgaggctaccgaggggaaggggtctgggagtgggttctacgaggttattacgtggtagtggtaactaccgctatactacgcagacctccggtggaccgggtccggttaccacccggttctacccgaggacgaacctaacttacccgaaagtaacgtaccgggtctattccgtagggaaatcgaacgacgcctggacgacgccggaagggaccaaccggtccccttattaacgttacgtcggttacgaccggaagtcgaagtccgaaggtacggtaagtatacggacagacctagccttcgagaccgttacggtacggggacccctaacgggacccgtgggtccctaccggttccttccggcccgacgtcccctacccgaacccggaccgggtaccccttaccgtcccggtttccccgttacccccggtccggtacccccgtaccccgttaccctacccgaaaccggtccgacccttaacccggttcgtacccgggggacccaaaccgcccgggtacccggtccccgggttacgggcccgttccggtcccgggtaccggttacggaaacccgttaccgttacccgttaccaccgtttaaccgtaacctacgttacccggtcggaaccggggttcccgggtacggtttaccgggaaccggtacgggaaccggccgttaaggtacg

SEQ ID NO: 79075 - DNA, 529 bp, Homo sapiens
  misc_feature: GYAE6OF02FWFZT.37.26.C04.1.454.CMB.1.raw
  modified_base (505)..(505): a, c, t, g, unknown or other
  misc_feature (505)..(505): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtgggtctcaggtattactggtagtggtaataccgcatactacgcagactccgtgacgggccggttcaccgtctccagagacaattccaagaatacggtctatctggaaatgaacagcctgagagcccgaggacacggccctctattactgtgcgagagatcagacggagtatagcagcagctctgactactggggccacggaaccctggtcacgtctcctcagcctccaccaacggcccatcggtcttcccctggccaccctcctccaagacgcacctcgtggggcacgagcggccctgggctgcctggtcaaggactactccatctacactacngagcgggctggcaaggcgcgatag

SEQ ID NO: 79076 - DNA, 564 bp, Homo sapiens
  misc_feature: GYAE6OF02JFM4F.37.26.C04.1.454.CMB.1.raw
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtgggtctcaggtattactggtagtggtaataccgcatactacgcagactccgtgacgggccgttcaccgtctccagagacaattccaagaatacggtctatctggaaatgaacagcctgagagccgaggacaccggccctctattactgtgcgagagatcagacggagtatagcagcagctctgactacgtggggccacggaaccctggtcaccgtctcctcacgcctctaccgaacggcccagtccggtccttccccgtcggcccacccctcctaccgaacgcgacacccgtcgtcggggaccacgacggccggcccgtgggctcgcctcggtcaacggtctaccttccactacctactactactggacgcgggctggcaacggcgacatacg

SEQ ID NO: 79077 - DNA, 535 bp, Homo sapiens
  misc_feature: GYAE6OF02G2R5G.37.26.C04.1.454.CMB.1.raw
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtgggtctcaggtattactggtagtggtaataccgcatactacgcagactccgtgacgggccggttcaccgtctccagagacaattccaagaatacggtctatctggaaatgaacagcctgagagccgaggacacggccctctattactgtgcgagagatcagacggagtatagcagcagctctgactactggggccacggaaccctggtcaccgtctcctcagcctccaccaggcccatcggtcttcccctggccaccctcctccaacgacgccacctcgtcggggcacgacgccggcccgtgggcctgcctggtcaaggctactccatcctacactactgacgcgggctcggcaggcgcatacg

SEQ ID NO: 79078 - DNA, 605 bp, Homo sapiens
  misc_feature: GYAE6OF02I8AFC.37.26.C04.1.454.CMB.1.raw
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtgggtctcaggtattactggtagtggtaataccgcatactacgcagactccgtgacgggccggttcaccgtctccagagacaattccaagaatacggtctatctggaaatgaacagcctgagagccgaggaccacggccctctacttactgtcgcgagagatcagacggagtatagcagcaagctctgactacgtcggggccaacggaacctgcaccgtctcctcacgcctaccaccgaacgggccctacgtccgtccttccccgtggaccacccctccctaccgaacgacgaccctaccgtacgtccggggccaacgacggcccggacccgtgggccgtcgtccgtgggtaccaaacggtccttaccttccacttaccgtacaaccgttcgacggacggtcgggacgtcgggacaacgggccgtaccgagtacg

SEQ ID NO: 79079 - DNA, 558 bp, Homo sapiens
  misc_feature: GYAE6OF02GO2LX.37.26.C04.1.454.CMB.1.raw
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtgggtctcaggtattactggtagtggtaataccgcatactacgcagactccgtgacgggccggttcaccgtctccagagacaattccaagaatacggtctatctggaaatgaacagcctgagagccgaggacacggccctctattactgtgcgagagatcagacggagtatagcagcagctctgactactggggccacggaaccctggtcaccgtctcctcacgcctccaccaagggccccagtccggtccttccccgtggccacccctcctccgaacgacgaccgaccctcgtcggggaccacgacgccggccctggggcctcggcctggtaccgaaggtacctacttccgatccgtaacactactgagcggctcggcaggcgcatg

SEQ ID NO: 79080 - DNA, 653 bp, Homo sapiens
  misc_feature: GYAE6OF02H7VLG.37.26.C04.1.454.CMB.1.raw
  modified_base (306)..(306): a, c, t, g, unknown or other
  misc_feature (306)..(306): n is a, c, g, or t
  modified_base (331)..(331): a, c, t, g, unknown or other
  misc_feature (331)..(331): n is a, c, g, or t
  modified_base (359)..(359): a, c, t, g, unknown or other
  misc_feature (359)..(359): n is a, c, g, or t
tcagtagtgtagatcacgaccggtgctcgatttagtctagcgactttgggtttgggggaggcttggtacagcctggggggtccctgagactctcctgtgcagcctctggtttcattctttagcaactacgccatgagcgtgggtccgccaggcctccgaggggaaggggctgggaggtgggtctcgaggtattacgtggtagtggtaataccgcatactacgcagactccggtgacgggccgttcaccgtctccagagaacaattccaaagaatacggtctatctaggaaatgaaacagctagagngccgaggacacggccctatattacnggtcgacgaagagatcgaagacggatanagcagtcagcctcgtagactacggcggggacccaacgggtacccctggtaccacccgttccgtccctacgaccgtccctaccgaaacccggaaccgggtcccctacggttcccggttcccttcccccggtcgggcccctcccgtcgacctccgaagcgccctaccgcgagacgaccaacgccgccgggtcccgtgggcctaccggcgtacgggttacgaacggtacccttaaccttccgacttactacctaaccgtacgtcgggacggccgggtctcgggacgacgggtcgacg

SEQ ID NO: 79081 - DNA, 616 bp, Homo sapiens
  misc_feature: GYAE6OF02JIIUL.37.26.C04.1.454.CMB.1.raw
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtgggtctcaggtattactggtagtggtaataccgcatactacgcagactccgtgacgggccggttcaccgtctccagagacaattccaagaatacggtctatctggaaatgaacagcctgagagccgaggacacggccctctattactgtgcgagagatcagacggagtatagcagcagctctgactacgtcggggcccaacggaaccctggtccaccgtctccctcacgccctccaccgaacgggccccacgtccggtccttccccgtcggccctaccccgtccctccgaacgacgccaccgtccgtcggggccacgacggcccggcccgtcgggcctcgccgtcggtaccgaacggtaccttaccgttacccactacccgtaacctaccttaccgtacggacggccgggtccgtacgggaccgaacgggccgtacgaagtacgg

SEQ ID NO: 79082 - DNA, 624 bp, Homo sapiens
  misc_feature: GYAE6OF02FSP8K.37.26.C04.1.454.CMB.1.raw
  modified_base (360)..(360): a, c, t, g, unknown or other
  misc_feature (360)..(360): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtgggtctcatccattagtagtagtggtacttacatatactacgcagactcagtgaggggccgattcaccatctccagagacaacgccaagaactcactgtatctgcaaatgaacagcctgagagccgaggacacggctgtgtattactgtgcgagacgcccctccacctcagcagcagcggtgacttcgnggggccaggggaccctggtccaccgtctcctcacgcctcccaccgaacgggccccacgtccggtcccttcccccgtcggtcccaccccttccccgtacccaaacggacgcccacccgttccggtacgggggccaccgaccgggcccgggccccgtcggggccgtcggcccgttcgggtaccgtaacgggtacccgttaacccgttacccacttccctaaccgtaccgttacgtcggacggtaccgggcgtacggaccgaacggg

SEQ ID NO: 79083 - DNA, 727 bp, Homo sapiens
  misc_feature: GYAE6OF02H3R95.37.26.C04.1.454.CMB.1.raw
  modified_base (241)..(241): a, c, t, g, unknown or other
  misc_feature (241)..(241): n is a, c, g, or t
  modified_base (337)..(337): a, c, t, g, unknown or other
  misc_feature (337)..(337): n is a, c, g, or t
tcagtagtgtagatcacgaccggtgctcgatttagtctagcgactttgggtttgggggaggcttggtacagcctggggggtccctggagactcgtcctgtgcagcctctggtttcatctttagcaactacgccatgagctgggtccgccaggtctccgaggggaagggctggagtgggtctcaggtattactggtagtggtaataccgcatactacgcagactccggtgacgggccggttnaccgtctccagacgacaattccaagtaactacggtctaatcgtggaaaatggaaactcgcctggacgacgcccggaagggaccaaccgggcccttntaactttacctggttacgcggaaggagactcaacggacggagtatagcaggcaggctcgtgactacggtcggggacccaacgggtaaccctgggtaccaacccggttctcccgtacgaccgccctaccgaacccgaacgggtcccgacgttccggttaccctttcccgtacggtcctacccgtaccctaccgtaacgtacgtaccgtaccgttcggtcgggggacctaccgaccggacccgggtcccgtacggggtccgttacgggtcccgtcgggtacgtaacgggtaccttaacccgttaccgtaacgtaccgttaaccgtaccgttaccgtacggtaacggtccgggtaccggtcgggaccgtaacgggacctaccggtataaccgg

SEQ ID NO: 79084 - DNA, 587 bp, Homo sapiens
  misc_feature: GYAE6OF02IQHR4.37.26.C04.1.454.CMB.1.raw
  modified_base (343)..(343): a, c, t, g, unknown or other
  misc_feature (343)..(343): n is a, c, g, or t
  modified_base (350)..(350): a, c, t, g, unknown or other
  misc_feature (350)..(350): n is a, c, g, or t
  modified_base (467)..(467): a, c, t, g, unknown or other
  misc_feature (467)..(467): n is a, c, g, or t
  modified_base (496)..(496): a, c, t, g, unknown or other
  misc_feature (496)..(496): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtgggtctcaggtattactggtagtggtaataccgcatactacgcagactccgtgacgggccgttcaccgtctccagagacaattccaaagatacggtctaatctagaaatgaacagcctgagagccgaggacacggccctctattactgtgcgagagatcagacgagtatagnagcagcntacgactacgtggggacccaacggaacccgtgggtcaaccggtcctacccgtcacgccctccaaccaacgggacccacgtccgtccttccccgtcggccaccctacctccaacgacncctaccgtcgtagggccacgagccggccncggcgtcgccgtcggtacgaacgtactacgtccagtacctacactacgtcgtacggccgggtacgtcggaccgtaacggccgactacgtag

SEQ ID NO: 79085 - DNA, 517 bp, Homo sapiens
  misc_feature: GYAE6OF02GAHQJ.37.26.C04.1.454.CMB.1.raw
  modified_base (361)..(361): a, c, t, g, unknown or other
  misc_feature (361)..(361): n is a, c, g, or t
  modified_base (424)..(424): a, c, t, g, unknown or other
  misc_feature (424)..(424): n is a, c, g, or t
  modified_base (430)..(430): a, c, t, g, unknown or other
  misc_feature (430)..(430): n is a, c, g, or t
  modified_base (447)..(447): a, c, t, g, unknown or other
  misc_feature (447)..(447): n is a, c, g, or t
  modified_base (456)..(456): a, c, t, g, unknown or other
  misc_feature (456)..(456): n is a, c, g, or t
  modified_base (460)..(460): a, c, t, g, unknown or other
  misc_feature (460)..(460): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtgggtctcaggtattactggtagtggtaataccgcatactacgcagactccgtgacgggccggttcaccgtctccagagacaattccaagaatacggtctatctggaaatgaacagcctgagagccgaggacacggccctctattactgtgcgagagatcagacggagtatagcagcagctctgactacgnggggccacggaacctggtcaccgtctcctcagcctccaccacggccagtcgtctcccctgccncctccncagagcacctctgggcncagcgccgnggcngcctggtcaagactactccatctacactctgacggcggctcggctacggcgcatacg

SEQ ID NO: 79086 - DNA, 584 bp, Homo sapiens
  misc_feature: GYAE6OF02GTJW5.37.26.C04.1.454.CMB.1.raw
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtgggtctcaggtattactggtagtggtaataccgcatactacgcagactccgtgacgggccggttcaccgtctccagagacaattccaaagaatacggtctatctggaaatgaacagcctgagagccgaggacacggccctctattactgtgcgagagatcagacggagtatagcagcagctctgactacgtggggccacggaaccctgggtccaccgtctcctcacgcctccaaccaacgggcccactccggttccttcccccgtcggccacccctccctaccaaacgacgccaccgtcgcggggcacgacgccgggcccgtcgggctcggccgtggtcgaaacggtacctaccttaccgacttacctacaacctacgtcgacggtcgggcgtcggacgaaggccgcagtacg

SEQ ID NO: 79087 - DNA, 599 bp, Homo sapiens
  misc_feature: GYAE6OF02IQ7JK.37.26.C04.1.454.CMB.1.raw
tcagtagtgtagatcacgaccggtgctcgatttagtctagcgactttgggtttgggggaggcttggtacagcctggggggtccctgaggctctcctgtgcagcctctggtttcatctttagcaactacgccatgagctgggtccgccaggctccagggaaggggctggagtgggtctcaggtattactggtagtggtaataccgcatactacgcagactccgtgacgggccggttcaccgtctccagagacaaattccaagaatcggtctatctggaaatgaacagcctgagagccgaggacacggccctctattactgtgcgagagatcagacggatatagcagcagctctgactacgtggggaccacggaaccctggtcaccgtctcctcacgccctccaccgaacggcccatccggtcccttccccgtcggccctacccctccctacccgaacgacgaccgacctcggtacggggccacgacggccggcccgtcggggtcctcggcccgtcggtacgaacggtaccttaccgttaccactacctaacctacctacgtcggacggtcgggcgtcggaccgaacgggcgacgagtacg

SEQ ID NO: 79088 - DNA, 696 bp, Homo sapiens
  misc_feature: GYAE6OF02J0FU3.37.26.C04.1.454.CMB.1.raw
  modified_base (684)..(684): a, c, t, g, unknown or other
  misc_feature (684)..(684): n is a, c, g, or t
  modified_base (693)..(693): a, c, t, g, unknown or other
  misc_feature (693)..(693): n is a, c, g, or t
tcagtagtgtagatcacgaccggtgctcgatttagtctagcgactttgggtttgggggaggcttggtacagcctgggggtccctgagactctcctgtgtagcctctgaattcccctttacggcttattggatgagctgggtccgccaggctccagggaaggggctggagtgggtggccaacataaagcaagatggaagtaagaaggagtatgtggactctgtgaagggccgtttcgccatctccagagacaacgccaagaacctcctgcatctgacaaatgaacagtctgagagccgaggacacggtactaagttttactactcgacgacgagaggaagggactggggtacggttaccgacgtacgtgggggaccctaacggggaaccctggtacccaccgtcctacctgacgtccctaccgacgaaaccgggcccacgttccgggtcccttaccccgtcggtacccgcccgtccgtccgtaccgacggtaacgcccgtaaccgtcccgagacgaccgacgacggcccggaccccgtgggcccgtcggtcccgtacgggtaccgaaccgggtaaccttacccgttaccgtaaccgttaccctaaaccgtaccttaccgacgggtaccggtaccggggtccgtacgggtaacggaaaccgggtccgaacgtaacggtacgaccgngtacgacgngcg

SEQ ID NO: 79089 - DNA, 639 bp, Homo sapiens
  misc_feature: GYAE6OF02JCXKX.37.26.C04.1.454.CMB.1.raw
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtgggtctcaggtattactggtagtggtaataccgcatactacgcagactccgtgacgggccggttcaccgtctccagagacaattccaagaatacggtctatctggaaatgaacagcctgagagccgaggacacggccctctattactgtgcgagacgatcgagacggagtatagcagcagctctgactacgtggggccacggaacccgtggtccaccgtctcctcacgccctccaacccgaacgggccccaagttccggtccttcccccgtgggaccctacccctcccgtacccaaacggaccgcctaacccgtccggtacgggggccaaccgacgggcccggcccgtcgggggtcctcggcccgttgggtaccgaaggtcccttaacgttcccaacgttaccgtaaccaaccgtttacgaggacggtacggggtccgtgggacccgacgggcccgtacgtgtaacgg

SEQ ID NO: 79090 - DNA, 653 bp, Homo sapiens
  misc_feature: GYAE6OF02GYVDO.37.26.C04.1.454.CMB.1.raw
  modified_base (250)..(250): a, c, t, g, unknown or other
  misc_feature (250)..(250): n is a, c, g, or t
  modified_base (316)..(316): a, c, t, g, unknown or other
  misc_feature (316)..(316): n is a, c, g, or t
tcagtagtgtagatcacgaccggtgctcgatttagtctagcgactttgggtttgggggaggcttggtacagcctgggggggtccctgagactctcctgtgcagccctctggtttcatctttagcaactacgccatgagctgggtccgccaggctccagggaaggggctggagtgggtctcaggtattactggtagtggtaataccgcatactacgcagactccgtgacgggccgttcaccgtctccaganacaattccaaagaatacggtctatctaggaaatgaacagcctggagagccgaggacaccggccctntattactgtgcgagagatcgagacggagtatagcagcacgctctagactacgtcggggacccaaccggaaccctggtacctaacccggttcctacccgtccaacgtcccctacccgaacccgaaccgggacccaacgtccggtacccttcccccgcggtcccacccctccctaccgaaacgacgaccaccgtccgcggggaccacgacggccgggtacccgtcgggtccgtcgtccgttcggtacgaaacgggtaccttaaccgttaccctacgtacctaacctaaccttaacgtacggacggcggtacggtacgggaccgaacggcgactagtacg

SEQ ID NO: 79091 - DNA, 599 bp, Homo sapiens
  misc_feature: GYAE6OF02HQCIX.37.26.C04.1.454.CMB.1.raw
  modified_base (353)..(353): a, c, t, g, unknown or other
  misc_feature (353)..(353): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtgggtctcaggtattactggtagtggtaataccgcatactacgcagactccgtgacgggccgttcaccgtctccagagacaattccaaagaatacggtctatctggaaatgaacagcctagagagccgaggacacggccctctattactgtgcgagagatcagacggagtatagcagcagctntgactacgtggggaccacggaaccctggtccaccgtctccctcacgccctccaaccgaacgggaccccagtccggttccttcccccgtcgggcccacccctccctacccaaacggacgacctacctcggtcggggaccacgacggccggcccgtcgggcctcgccgtcggtacgaacggtactaccttaccactccgtactacctactggacggccgggacgtcggacctagggacgacgagtacg

SEQ ID NO: 79092 - DNA, 762 bp, Homo sapiens
  misc_feature: GYAE6OF02HTNHF.37.26.C04.1.454.CMB.1.raw
  modified_base (141)..(141): a, c, t, g, unknown or other
  misc_feature (141)..(141): n is a, c, g, or t
  modified_base (252)..(252): a, c, t, g, unknown or other
  misc_feature (252)..(252): n is a, c, g, or t
  modified_base (507)..(507): a, c, t, g, unknown or other
  misc_feature (507)..(507): n is a, c, g, or t
  modified_base (712)..(712): a, c, t, g, unknown or other
  misc_feature (712)..(712): n is a, c, g, or t
tcagtagtgtagatcacgaccggtgctcgatttagtctagcgactttgggtttgggggaggcttggtacagcctgggggtccctgagactctcctgtgcgacgcctcgttggtttcattctttagctaactacgccagtgngtcgtcgggtcccgaccgaggcctaccggaagggggaacggggtcgttgggagggtcgggttcctacggtaaggttatttacggtgggtaggtacgggtaaactacccggntaatacgtaccgacgaagaccgtccggtacggaccggggtcccggtttacaccggttcctaccgaagacgaactaacttacccgaaagtaaacgttcgggtacttaacgttcgaaggtaaaagtacgaaaacgaacggtccttaagggaacgaacggaccgggaaacggaccgaacccgggttccccttaagttactttaacgtcggtagacggaagtagatacgagggaagaagtagtagacgagacttagctntacgaactgggaccgggaccgaaccggaaccgttcggaactccggtctacccgacgaccgtcccaccgaaccggaccggaccctaacgtccggttacccttcccgacggaccctacccgttccaaccgaaggaccaccgcctcgggcggaccgacgacggttcccgccggcgctccgtcgcggtacaacgtaccgttaccttacncgttacgacttacctagacgacggcgtgacggacgaacggcgttacagag

SEQ ID NO: 79093 - DNA, 174 bp, Homo sapiens
  misc_feature: GYAE6OF02FNT1D.37.26.C04.1.454.CMB.1.raw
  modified_base (174)..(174): a, c, t, g, unknown or other
  misc_feature (174)..(174): n is a, c, g, or t
tcagtagtgtagatcacgaccggtgctcgatttagtctagcgactttgggtttggggggaagaggaagactgacggtcccccaggagttcaggtgctgggcacagcggccctgggctgcctggtcaaggactacttccatctacactactgagcgggctggcaaggcgcatagn

SEQ ID NO: 79094 - DNA, 633 bp, Homo sapiens
  misc_feature: GYAE6OF02F22YA.37.26.C04.1.454.CMB.1.raw
  modified_base (312)..(312): a, c, t, g, unknown or other
  misc_feature (312)..(312): n is a, c, g, or t
  modified_base (449)..(449): a, c, t, g, unknown or other
  misc_feature (449)..(449): n is a, c, g, or t
  modified_base (500)..(500): a, c, t, g, unknown or other
  misc_feature (500)..(500): n is a, c, g, or t
  modified_base (511)..(511): a, c, t, g, unknown or other
  misc_feature (511)..(511): n is a, c, g, or t
  modified_base (590)..(590): a, c, t, g, unknown or other
  misc_feature (590)..(590): n is a, c, g, or t
tcagtagtgtagatcacgaccggtgctcgattttagtctagcgactttgggtttggggggtagggccttaaggtacacgcccttgggggggtccctagacgactctcctgtgcacgcctctggtttcattcgtttacgcaactacgccattcgaggtcgtgggtccgccaggcctaccgaggggtaaggggcctggagtgggttctcaggtatttaagtggtagtggtaactaccggcatactacggcaaggactccggtggaccgggccggttcaccggtctccagagacaagttccaagaatacgtctanctagtaaatgaacagccttgagacgccgaggaccacgggccctactacttacgtgtaggcgagaggatacgagaacggagtatagacagacaacgctactagactacgtcgggacaaccggaccttggacaccgtcncctcacgccctaccacgaacggccacgtcgtcctccctcgccaccctaccncaacgcgtacnccgtcgtcgggacacgcgcgccgtcggctcgtccgtcgtacgacgttaccttacttcgacgtaccgtaacaccgttacncggtacgtcggtacgtacggacgaacggccggtagacgtacgg

SEQ ID NO: 79095 - DNA, 627 bp, Homo sapiens
  misc_feature: GYAE6OF02F15ZG.37.26.C04.1.454.CMB.1.raw
  modified_base (310)..(310): a, c, t, g, unknown or other
  misc_feature (310)..(310): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtgggtctcaggtattactggtagtggtaataccgcatactacgcagactccgtgacgggccgttcaccgtctccagagacaattccaagaatacggtctatctggaaatgaacagcctgagagccgaggacacggccctntattactgtgcgagagatcgagacggagtatagcagcagctctgactacgtggggacccaacgggtaaccctgggtacacccggtctcccgtccacgccctacccgaaccgaaccgggccccaacgttcccggttcccttacccccgtcggtaccctacccccgtccctacccaaacgaccgaccacccgtcgtcggggaccacgacgccgggcccgtgggccgtcgaccgtcggtacgaacggtaccttaccttccgtacgtccgtaacctactacgtcggacggcgggtctacgggacgtacggcgacgagtacg

SEQ ID NO: 79096 - DNA, 606 bp, Homo sapiens
  misc_feature: GYAE6OF02IVOJS.37.26.C04.1.454.CMB.1.raw
  modified_base (311)..(311): a, c, t, g, unknown or other
  misc_feature (311)..(311): n is a, c, g, or t
  modified_base (351)..(351): a, c, t, g, unknown or other
  misc_feature (351)..(351): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaagggctggagtgggtctcaggtattactggtagtggtaataccgcatactacgcagactccgtgacggccgttcaccgtctccagagacaattccaagaatacggtctatctggaaactgaacagcctgagacgccgaaggacacggccctntatactgtgcgagagatcagacggatatagcagcagctcngacctacgtcggggaccacgggtaaccctgggtaccaccgtctccttcgacgcctccaccgacggacccacgtaccggtccttccccgtggccctaccctccctaccgaacgacgcctacctcggtcggggtaccacgacggacccgccgtcggtccgtcgtccgtcggtacgaacggtaccttacctacctacgtaccgtacctacctacgtacggacgtcgggtacgtcgggactaacggccgtactagtacg

SEQ ID NO: 79097 - DNA, 564 bp, Homo sapiens
  misc_feature: GYAE6OF02HSCIH.37.26.C04.1.454.CMB.1.raw
  modified_base (451)..(451): a, c, t, g, unknown or other
  misc_feature (451)..(451): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtgggtctcagttattagtggtagtggtagtagcacagattacgcagactccgtgaagggccggttcaccatctccagagacaattccaacagcacgctgtatttgcacatgaacagcctgagagccgaggacacggccatatattatgtgcgaaacttcttttgacttggttattatcccctagtgaccaacgtggggccagggaaccctggtcaccgtctcctcacgccctcaccgaacggcccatccgtccttccccgcgccaccctcctccaacgacnccacctcgtggggccacgacgccggcccgtgggctcgccgtcggtacaacggtacctacgttccactccgtacactactcgacgcgggcgtcggacgtaacggcgtcagtacg

SEQ ID NO: 79098 - DNA, 633 bp, Homo sapiens
  misc_feature: GYAE6OF02HPD2V.37.26.C04.1.454.CMB.1.raw
  modified_base (363)..(363): a, c, t, g, unknown or other
  misc_feature (363)..(363): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtgggtctcaggtattactggtagtggtaataccgcatactacgcggactccgtgacgggccggttcaccgtctccagagacaattccaagaatacggtctatctaggaaatgaacagcctgagagccgaggacacggccctctattactgtgcgagagatcgagacggagtatagcagcagctctgactacgngggccacggaacctggtcaccgtctcctcacgccctaccaccgaacgggcccagtccggtcccttcccccgtgcctacccctccctacccgaagacgccacccgttccgtcgggggaccaccgacggcccggcccgtcggggccgtcggtccgttcgggtaccgaaacggtaccttaccgttccctacgttccgtaacctaaccgttaccgtacggtaccggtccggggtaccgttcggggaccgtaacgggccgaccgtacgtacggcg

SEQ ID NO: 79099 - DNA, 639 bp, Homo sapiens
  misc_feature: GYAE6OF02IKPWX.37.26.C04.1.454.CMB.1.raw
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtgggtctcaggtattactggtagtggtaataccgcatactacacagactccgtgacgggccggttcaccgtctccagagacaattccaagaatacggtctatctaggaaatgaacagcctgagagccgaggacacggccctctattactgtgcgagagatcgaggacggagtatagcagcagctctgactacgtggggacccacggaaccctggtccaccgttcctccctcacgccctacccgaaccgaaccgggccccacgtcccggttccctttcccccgtcggaccctaccccctacccgtacccgaaacgaccgcctacccgtcggtcggggaccacgaccggccggcccgtcgggccgtcgccgttcgggtaccgaacggtaccttacccgttaccacttacctaacctaaccttaccgtcggaccggccgggtccgtcgggaccgaacgggcgtacgagtacg

SEQ ID NO: 79100 - DNA, 545 bp, Homo sapiens
  misc_feature: GYAE6OF02GHVRV.37.26.C04.1.454.CMB.1.raw
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtgggtctcaggtattactggtagtggtaataccgcatactacgcagactccgtgacgggccggttcaccgtctccagagacaattccaagaatacggtctatctggaaatgaacagcctgagagccgaggacacggccctctattactgtgcgagagatcagacggagtatagcagcagctctgactactggggccacggaaccctggtcaccgtctcctcagcctccaccaggcccatcggtctcccctggccaccctcctccaagacgccacctccgagacgcacagccggcccgtgggctcgcctggacaacgggacctacttccattctaacctactactgaggcgggtcgtcggacgaacggcgctaacg

SEQ ID NO: 79101 - DNA, 703 bp, Homo sapiens
  misc_feature: GYAE6OF02II2RC.37.26.C04.1.454.CMB.1.raw
tcagtagtgtagatcacgaccggtgctcgatttagtctagcgacttttgggtttggggggaggcttggtacagcctgggggggtccctgagactctcctgtgcagcctctggtttcatctttagcaactacgccatgagctgggtccgccaggctccagggaaggggctggagtgggtctcaggtattactggtagtggtaataccgcatactacgcagactccgtgacgggccgttcaccgtctccagagacaattccaagaatacggtctatctggaaatgaacagcctgagagccgaggacacggccctctattactgtgcgagagatcgagacggagtatagcagcagctcgtgtactacgtcggggcccaacgggaacccttggtacctaccgttcctccctccacgtccctacccaaccgaacgggcccaacgtccggttcccttccccgtcggccctacccctcccgtacccaacggaccgacccgtacccgttccggtacgggggaccaccgaaccggtcccgggtccccgtcggggtccgttcgggtccccgttacgggtaacccggtaaacgggtaccctttaacccgttacccgtaaccgtttaccgtaaccctaaccgttaccgtaccgggtaccgggtaccgggggtaccttccggggaaccgtaacggggaccggtaccgtagtaacgg

SEQ ID NO: 79102 - DNA, 575 bp, Homo sapiens
  misc_feature: GYAE6OF02F2PP4.37.26.C04.1.454.CMB.1.raw
  modified_base (463)..(463): a, c, t, g, unknown or other
  misc_feature (463)..(463): n is a, c, g, or t
tcagtagtgtagatcacgaccggtgctcgatttagtctagcgactttgggtttgggggaggcttggtacagcctgggggggtccctgagactctcctgtgaagcctctggattcacctttgacaagtgtgccatgacctgggtccgccaggctccagggaaggggctggagtgggtctcagttattagtggtagtggtagtagcacagattacgcagactccgtgaagggccggttcaccatctccagagacaattccaacagcacgctgtatttgcacatgaacagcctgagagccgaggacacggccatatattattgtgacgtaaactttccttttagacttggtttattactccctagtcaccacgtcgggccacgggaacctggtcaccgtctcctcacgccctccaccgaacgggcccagtccggtcccttcccctcgccaccctccctccaacgcnccacctcgcggggccacgacgccggccgtgggcctcgccgtggtccaacggtactaccttccactcctactacgtactcggacgcggtcgtcggacgaacggcgacagtagc

SEQ ID NO: 79103 - DNA, 577 bp, Homo sapiens
  misc_feature: GYAE6OF02FZA77.37.26.C04.1.454.CMB.1.raw
  modified_base (350)..(350): a, c, t, g, unknown or other
  misc_feature (350)..(350): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtgggtctcaggtattactggtagtggtaataccgcatactacgcagactccgtgacgggccgttcaccgtctccagagacaattccaagaatacggtctatctggaaatgaacagcctgagagccgaggacacggccctctattactgtgcgagagatcagacggatatagcagcagctntgactacgtggggccacggaacctggtaccaccgtctcctcacgccctccaaccgaacgggcccacgtccggttccttccccgtcggccaccctccgtaccaacgacgacaccgtcgtacggggcaacgcggaccggcccgtcgggcgtcgccgtcgggtacaacggtacctaccttccgactcctactacctactcgacgcggcgtcggcgaacggcgacagtacg

SEQ ID NO: 79104 - DNA, 602 bp, Homo sapiens
  misc_feature: GYAE6OF02GHV66.37.26.C04.1.454.CMB.1.raw
  modified_base (138)..(138): a, c, t, g, unknown or other
  misc_feature (138)..(138): n is a, c, g, or t
  modified_base (230)..(230): a, c, t, g, unknown or other
  misc_feature (230)..(230): n is a, c, g, or t
  modified_base (254)..(254): a, c, t, g, unknown or other
  misc_feature (254)..(254): n is a, c, g, or t
  modified_base (337)..(337): a, c, t, g, unknown or other
  misc_feature (337)..(337): n is a, c, g, or t
  modified_base (383)..(383): a, c, t, g, unknown or other
  misc_feature (383)..(383): n is a, c, g, or t
  modified_base (419)..(419): a, c, t, g, unknown or other
  misc_feature (419)..(419): n is a, c, g, or t
  modified_base (425)..(425): a, c, t, g, unknown or other
  misc_feature (425)..(425): n is a, c, g, or t
  modified_base (491)..(491): a, c, t, g, unknown or other
  misc_feature (491)..(491): n is a, c, g, or t
  modified_base (494)..(494): a, c, t, g, unknown or other
  misc_feature (494)..(494): n is a, c, g, or t
tcagtagtgtagatcacgaccggtgctcgatttagtctagcgactttgggtttgggggtaggcgttggtacagcctgggggtcccgtgagactctcctgtgcagcctctggttcatctttagctaactacgccatgancgtgggtccgccaggctccgagggaaggggctgggagtgggtctcaggtattacgtggtagtcggtaataccgcatactacgcagtactcgngacgggcggtcaccgtctccaganaacaattccaagaactacggtctatctaggaaaatgaacagtcctaggagacgcgaacggacacggccatctatactgtacgnaagagatcaaggacggtataacgtgacaagctaagcttcagtaacncgtcggggaccaacggtaaccctggcctacccggtntccctnaccgtccaccaccaacgggcccacgttaccggccttccccgtacgcgaccctcccgtacaccgacnccncctcgcgggcacgcgtccggcctcggctcggcctcggtcaacggaccttccgactactcctacaccgtactacggagtcgggaccgtggacggtaacgcgacgtaacg

SEQ ID NO: 79105 - DNA, 598 bp, Homo sapiens
  misc_feature: GYAE6OF02FSCUP.37.26.C04.1.454.CMB.1.raw
  modified_base (250)..(250): a, c, t, g, unknown or other
  misc_feature (250)..(250): n is a, c, g, or t
tcagtagtgtagatcacgaccggtgctcgatttagtctagcgactttgggtttggggggaggcttggtacagcctggggggtccctgagactctcctgtgcagcctctggtttcatctttagcaactacgccatgagctgggtccgccaggctccaggggaaggggctggagtgggtctcaggtattactggtagtggtaataccgcatactacgcagactccgtgacgggccgttcaccgtctccaganacaattccaaagaatacggtctatctggaaatgaacagcctgagagccgaggacacggccctctattactgtgcgagagatcagacggagtatagcagcagctctgactacgtggggccacgggaaccctggtcaccgtctcctcagcctccaccaacggccacgtcggtcccttcccctcgcctaccctcctaccaacgacgccaacctcgtcgggggacacgacggaccggtccccgtgggcctcggccgttcggtacgaacgggtaccttaaccttaccgaacttaccgtaacctacttaccgtagacggaccgggcggttcgggaccgaacggcggacagtacg

SEQ ID NO: 79106 - DNA, 600 bp, Homo sapiens
  misc_feature: GYAE6OF02HS13I.37.26.C04.1.454.CMB.1.raw
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtgggtctcaggtattactggtagtggtaataccgcatactacgcagactccgtgacgggccggttcaccgtctccagagacaattccaaagaatacggtctatctggaaatgaaacagcctgagagccgaggacacggccctctattactgtgcgagagatcagacggagtatagcagcagctctagactacgtcggggaccacggaaccctggtaccaccgtctccctcacgccctaccaccgaacggcccacgtccggttccttaccccgtcggccacccgtccctaccaacgacaccacctcgtcggggcacgacgccggcccgtcgggccgtcgccgtcggtacgaacggtacctaccttacctacttacctaacctaaccttacgtcggtacggccgggcgtcggaccgaacgggcgacgatacg

SEQ ID NO: 79107 - DNA, 647 bp, Homo sapiens
  misc_feature: GYAE6OF02IGF6E.37.26.C04.1.454.CMB.1.raw
tcagtagtgtagatcacgaccggtgctcgatttagtctagcgactttgggtttggggggaggcttggtacagcctgggggggtccctgagactctcctgtgcagcctctggtttcatctttagcaactacgccatgagctgggtccgccaggctccagggaaggggctggagtgggtctcaggtattactggtagtggtaataccgcatactacgcagactccgtgacgggccgttcaccgtctccagagacaattccaagaatacggtctaatctggaaatgaacagcctgagagccgaggacacggccctctattactgtgcgagagatcagacggagtatagcagcagctctgactacgtcggggacccacggaacccgtggtccaccgtctcctcacgccctccaccgaacgggccccagtccggtccttcccctcggcccaccccttccctaccaacgacgacctacccgtcgtcggggaccacgacggcccgggtacccgtcggggctcggacccgttgggtaccgtaaacgggtaccgttacccttacccgaacgttaccttaaccgaacccttaaccgtacgggaaccggtccggggtccggtacggggacccgtaaacggggccgaccgacgtaacgg

SEQ ID NO: 79108 - DNA, 563 bp, Homo sapiens
  misc_feature: GYAE6OF02I0ILO.37.26.C04.1.454.CMB.1.raw
  modified_base (547)..(547): a, c, t, g, unknown or other
  misc_feature (547)..(547): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtgggtctcaggtattactggtagtggtaataccgcatactacgcagactccgtgacgggccgttcaccgtctccagagacaattccaagaatacggtctatctggaaatgaacagcctgagagccgaggacacggccctctattactgtgcgagagatcagacggagtatagcagcagctctgactactggggccacgtgaaccctggtccaccgtctcctcacgcctcccaccaacgggccccacgtccggtccttaccccctcgggccctacccctccctacccaagacgccacctcgtcggggccacgacggccggcccgtgggcctcgcctcggcgaagacctacttccatctacactactgacgcgggtacnggaccgaggcgctaag

SEQ ID NO: 79109 - DNA, 604 bp, Homo sapiens
  misc_feature: GYAE6OF02IJZ7Q.37.26.C04.1.454.CMB.1.raw
  modified_base (391)..(391): a, c, t, g, unknown or other
  misc_feature (391)..(391): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtgggtctcaggtattactggtagtggtaataccgcatactacgcagactccgtgacgggccggttcaccgtctccagagacaattccaaagaatacggtctatctaggaaatgaacagcctgagagccgaggacacggccctctattactgtgcgagagatcagacggagtatagcagcagctctgactagtcgggccacggacctggtcaccgtctcctnacgcctccaccgaacgggccacgtccggtccttcccccgtggcccaccctccctcccaacgacgaccaccctcgtcggggaccacgacgaccggcccgtgggccgtcggtccctcgggtaccaaacgggtacctaaccgttccctacgtaccctaacctaccttacgtacggacggccgggcgtacgggaccgaacggccggtactagtacgg

SEQ ID NO: 79110 - DNA, 634 bp, Homo sapiens
  misc_feature: GYAE6OF02GR4PD.37.26.C04.1.454.CMB.1.raw
  modified_base (285)..(285): a, c, t, g, unknown or other
  misc_feature (285)..(285): n is a, c, g, or t
  modified_base (311)..(311): a, c, t, g, unknown or other
  misc_feature (311)..(311): n is a, c, g, or t
  modified_base (318)..(318): a, c, t, g, unknown or other
  misc_feature (318)..(318): n is a, c, g, or t
  modified_base (354)..(354): a, c, t, g, unknown or other
  misc_feature (354)..(354): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtgggtctcaggtattactggtagtggtaataccgcatactacgcagactccgtgacgggccgttcaccgtctccagagacaattccaagaatacggtctatctaggaaatgaacngcctgagagccgaggacacggccctntattacngtgcgagagatcgagacggagtatagcagcagtctntagactacggtcggggacccaaccgggtaacccgtgggtacccacccggttccttcccgtacacgtcccctacccgaacccgaacgggccccacgtccggttcccttccccgtcggccctacccctccctaccaacgaccgaccaccgttcgtcggggaccacgacggcccggcccgtcgggcgtcgtccgtcggtacgaacgtacctaccttcctactacctaacctacctacgtacggaccggcgggtaccgtcggaccgaacgggcgacgtagtacg

SEQ ID NO: 79111 - DNA, 583 bp, Homo sapiens
  misc_feature: GYAE6OF02FQNIA.37.26.C04.1.454.CMB.1.raw
  modified_base (582)..(583): a, c, t, g, unknown or other
  misc_feature (582)..(583): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtgggtctcaggtattactggtagtggtaataccgcatactacgcagactccgtgacgggccggttcaccgtctccagagacaattccaagaatacggtctatctggaaatgaacagcctgagagccgaggacacggctgtgtattactgtgcgagagcccctccacctcagcagcagcggtgacttcgtggggccagggacccctggtcaccgtctcctcagccctccgaccacgggcccagtccggtccttcccccgtggcctacccctcctacccaacgacgccacccgttcgtcgggggccacgacggccggcccgtgggcctcggccgtcggtccgaaggtaccctaaccttccacttcctacctaccgtactgacggccgggctcgggacgacgggccacgatacgnn

SEQ ID NO: 79112 - DNA, 574 bp, Homo sapiens
  misc_feature: GYAE6OF02IOAGK.37.26.C04.1.454.CMB.1.raw
  modified_base (239)..(239): a, c, t, g, unknown or other
  misc_feature (239)..(239): n is a, c, g, or t
  modified_base (314)..(314): a, c, t, g, unknown or other
  misc_feature (314)..(314): n is a, c, g, or t
  modified_base (326)..(326): a, c, t, g, unknown or other
  misc_feature (326)..(326): n is a, c, g, or t
tcagtagtgtagatcacgaccggtgctcgatttagtctagcgactttgggtttgggggaggcttggtacagcctggggggtccctgagactctcctgtgcagcctctggttcatctttagcaactacgccatgagctgggtccgccaggctccagggaaggggctggagtgggtctcgaggtattactggtagtggtaataccgcatacacgcagactcgtgacgggccgttcaccgtnccagagacaattccaagatacggctatctggaaatgaacagcctgagagccgaggacacggccctatatttacgngtagcgagagancgaaggacggatagtacgcacgcagtctacgtgaactacggcgggacccaacggaaccctggtaccaccgttctccacgcgccctaccacgacggccacgtccgttcctcccgcgccacctccaccagacacaccgtcggcggacacgacgccgccgcggcgtcgcgtacggtcgaacgtacctactactacgtaccgtaactaccgtacgtggaccgcggtacgtcggaccgaacggcgacagtacg

SEQ ID NO: 79113 - DNA, 622 bp, Homo sapiens
  misc_feature: GYAE6OF02G3I2B.37.26.C04.1.454.CMB.1.raw
  modified_base (312)..(312): a, c, t, g, unknown or other
  misc_feature (312)..(312): n is a, c, g, or t
  modified_base (353)..(353): a, c, t, g, unknown or other
  misc_feature (353)..(353): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtgggtctcaggtattactggtagtggtaataccgcatactacgcagactccgtgacgggccggttcaccgtctccagagacaattccaagaatacggtctatctggaaatgaacagcctgagacgccgaggacacggccctntattactgtgcgagagatcgagacggatatagcagcagctngactacgtgggccaacggaccctggtccaccgtctcctcacgccctccgaaccgaacggccctacgtccggttcccttcccccgtcggccctaccccgtccctacccgaaacggacgacctaccgttcggtacggggacctaccggacggcccggtcccgtcgggtacctccggtccgtcgggtaaccgaacggtaccttaccgttaccacttaccgtaacctaccttacgtcggtacggcggtcgtcggacgaacggcgacgagtacg

SEQ ID NO: 79114 - DNA, 756 bp, Homo sapiens
  misc_feature: GYAE6OF02I1OLR.37.26.C04.1.454.CMB.1.raw
  modified_base (265)..(265): a, c, t, g, unknown or other
  misc_feature (265)..(265): n is a, c, g, or t
  modified_base (715)..(715): a, c, t, g, unknown or other
  misc_feature (715)..(715): n is a, c, g, or t
tcagtagtgtagatcacgaccggtgctcgatttagtctagcgactttgggtttggggggtaggggcttgggtacacgcctggggggtccctggagtacctcgttccttcgtgtccgagccttctgggtttccatctttaagccaaactacggcccatacgaagtcgttggggttcccggacctagggtcctccgtagggggttaacggggtcttgggagtgggttctaacgaggttacttacgttgggtagtgggtaactaccgntagttacgtacgcaggacgtcggtgtacgggccgttcaccgtcgtccggacgtagaacaacttccgaagtagtaccggtctagtccgtaggtaattcgaacaggtccgtaggaactacgccggaggaccaccggggtccctaccgtattacgtggtacggacggagacgagtcgaggtacggtatactacggctagcgtagtccttacacgtaccttacggcgggacccaacggtacctcgggtaaccctaccggtccttaccctcgacccgtcctaccgaccgacggaccctagtcccggtccttaccccggtagtaccctccctaccgtactaacggtacctacgtaaccgtccggtacgggaccctagaaccggccggtaccgtcgggtctcggtccgttacggtacaacggtccttgtaccgtacttacgtaacgtaccgtacggngggccggtaccgtcggtaccgaccgtacgccgttacagtcg

SEQ ID NO: 79115 - DNA, 573 bp, Homo sapiens
  misc_feature: GYAE6OF02GQT2S.37.26.C04.1.454.CMB.1.raw
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtgggtctcaggtattactggtagtggtaataccgcatactacgcagactccgtgacgggccggttcaccgtctccagagacaattccaagaatacggtctatctggaaatgaacagcctgagagccgaggacacggccctctattactgtgcgagagatcagacggagtatagcagcagctctgactactggggccacggaaccctggtcaccgtctcctcagcctccaccacgggcccatcggtccttcccctggccaccctcctccaagacgccacctcgtcgggggccacgaggccggcccgtggggcctcgccgttgggtccgaaggaccttaccttcccacttcctaactaccttactacggacgccgggtcgtcgggaccgaagggccgacagtacg

SEQ ID NO: 79116 - DNA, 570 bp, Homo sapiens
  misc_feature: GYAE6OF02I9LAQ.37.26.C04.1.454.CMB.1.raw
  modified_base (314)..(314): a, c, t, g, unknown or other
  misc_feature (314)..(314): n is a, c, g, or t
  modified_base (401)..(401): a, c, t, g, unknown or other
  misc_feature (401)..(401): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccgagggaaggggctggagtgggtctcaggtattactggtagtggtaataccgcatactacgcagacctccggtgacgggccgttcaccgtctccagacgacaattccaaagatacggtctatctggaaatgaacagtctgagagccgaggacacggccctntattactgtgcgagagatcaggacggagttatagcagcagtctcgtagactcgtggggaccacggtaacctggtccaccgttctccncacgccctccgaaccgaacggcccacgtccgtccctcccgtgcccaccctcctaccaagcgccaccgtcgtcgggaccacgcggccgaccgtcgggctcgtccgtcggtacacggtacttactccatccgactactacgcgacgcggcgtcggacgacggcactagtag

SEQ ID NO: 79117 - DNA, 589 bp, Homo sapiens
  misc_feature: GYAE6OF02HPGPW.37.26.C04.1.454.CMB.1.raw
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaagggctggagtgggtctcaggtattactggtagtggtaataccgcatactacgcagactccgtgacgggccggttcaccgtctccagagacaattccaagaatacggtctatctggaaatgaacagcctgagagccgaggacacggccctctattactgtgcgagagatcagacggagtatagcagcagctctgactactggggccacggaacctggtcaccgtctcctcacgccctccaccgaacggcccagtccggtccttccccgtcggccctaccctcctaccaacgacgcctacctcgtcggggccacgacggccggcccgtgggcctcggcccgttgggtacaaacgggtacctaccgttccacttccgtaacctaccttacgtggacggcgggacgtcgggacgtaacgggcgacgagtacgg

SEQ ID NO: 79118 - DNA, 599 bp, Homo sapiens
  misc_feature: GYAE6OF02JG6DV.37.26.C04.1.454.CMB.1.raw
  modified_base (346)..(346): a, c, t, g, unknown or other
  misc_feature (346)..(346): n is a, c, g, or t
  modified_base (438)..(438): a, c, t, g, unknown or other
  misc_feature (438)..(438): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtgggtctcaggtattactggtagtggtaataccgcatactacgcagactccgtgacgggccggttcaccgtctccagagacaattccaaagaatacggtctatctggaaatgaacagcctgagagccgaggacacggccctactattacctggtgacgagacgatcagacggatanagcagcagctctgactagtcggggccaacggaacctggtcaccgtctcctcacgccctaccaccgaacggcccacgtccggtccttccccgngcccaccctcctaccaacgacgccaccctcggtcggggccacgacgccggccccgtgggcctcgccgtacggtaccgaaggtcccttaaccgtcccgtaacttaccgtaaccacttacgtacgacggtccggtccggtggaccgaggtccgaccaagtcgg

SEQ ID NO: 79119 - DNA, 574 bp, Homo sapiens
  misc_feature: GYAE6OF02JWMY0.37.26.C04.1.454.CMB.1.raw
  modified_base (232)..(232): a, c, t, g, unknown or other
  misc_feature (232)..(232): n is a, c, g, or t
  modified_base (453)..(453): a, c, t, g, unknown or other
  misc_feature (453)..(453): n is a, c, g, or t
  modified_base (553)..(553): a, c, t, g, unknown or other
  misc_feature (553)..(553): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtgggtctcgtctattagtggaagtggtgcttatacaaactacgcagcctccgtgaagggccncttcaccatctccagagactattccaagagcactctgtatctgcaaatgaacagcctgagtgccgaggacacggccctatattatgtgcgaaatggtgggggagtgggggctactccgtggtcgttttgacttacgtggggaccagggacgcccgtggtccaccgtctcctcacgcctccaccgaacgggcccacgtccggttccttcccccgtgggcccncccgtcgccttccgaggaccgccacccgtccgagacgccacgacgccggcccgtgggctcggcctggacacggtacctaccgtccatcctaccacgtacncggagccggctaggcgaggcg

SEQ ID NO: 79120 - DNA, 650 bp, Homo sapiens
  misc_feature: GYAE6OF02F22N8.37.26.C04.1.454.CMB.1.raw
  modified_base (315)..(315): a, c, t, g, unknown or other
  misc_feature (315)..(315): n is a, c, g, or t
  modified_base (349)..(349): a, c, t, g, unknown or other
  misc_feature (349)..(349): n is a, c, g, or t
  modified_base (361)..(361): a, c, t, g, unknown or other
  misc_feature (361)..(361): n is a, c, g, or t
  modified_base (410)..(410): a, c, t, g, unknown or other
  misc_feature (410)..(410): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtgggtctcaggtattactggtagtggtaataccgcatactacgcagactccgtgacgggccgttcaccgtctccagagacaattaccaagaatacggtctatctaggaaatgaacagcctgagagccgaggaccaccggcccttntaacttactgtgacgagagatcgaagacggatangcagcagccttnagacgtacgcggggacccacggtaacctggtccctaaccggtctacccncaccgccctacccgaaccgaacggcccctagtccgttccctccccgtcgccctcccctcccaccgaacgccaccgtacccgtcgggtccgggactaccgacggtccggccgtcggtctcggtccgtcggtaactaacggtaccttaccgttacctacgtacctaaccgaacgttaccggtacggacgggtaccggttccggtacgggtaacccggaacgggacccgtacggaacgtacgg

SEQ ID NO: 79121 - DNA, 548 bp, Homo sapiens
  misc_feature: GYAE6OF02IRFK6.37.26.C04.1.454.CMB.1.raw
  modified_base (292)..(292): a, c, t, g, unknown or other
  misc_feature (292)..(292): n is a, c, g, or t
  modified_base (311)..(311): a, c, t, g, unknown or other
  misc_feature (311)..(311): n is a, c, g, or t
  modified_base (541)..(541): a, c, t, g, unknown or other
  misc_feature (541)..(541): n is a, c, g, or t
  modified_base (544)..(544): a, c, t, g, unknown or other
  misc_feature (544)..(544): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtgggtctcaggtattactggtagtggtaataccgcatactacgcagacctccgtgacgggccgttcaccgtctccagagacaattccaagaatacggtctatctggaaatgaacagcctganagccgaggacacggccctntatactgtgcgagagatcagacggagtatagcagcagctctgactacgtgggaccacggaccctggtcaccgtctccgtcagccctccaccgaaggcccactcggtcttccccgtggcctaccctcctccaagacgcacctcgtgggcagacgccggtccgtgggctgccgtcggacaagtacctactccattccaactactactgacggtcgggactcggacaggccgntanacgg

SEQ ID NO: 79122 - DNA, 766 bp, Homo sapiens
  misc_feature: GYAE6OF02F5ZEC.37.26.C04.1.454.CMB.1.raw
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtgggtctcaggtattactggtagtggtaataccgcatactacgcagactccgtgaccgggccggttcaccgtctccagagacaattccaaagaatacggtctatctaggaaatgaaacacggtcctaggaagacggacccggagggtaaccacccgggtccccttattaacgtttacctggtcggacgaaggaggactacgaaggacggacgtaatacgcaagcaaggtctcgtagacttacggtcggggacccaaccgggtaaccctggtaccctacccgttcctaccctacgaccgtcccctacccgaaacccggaccgggtacccctaccggtttcccggttaccccttcccccggtcgtacccctacccccttccctaaccgaaacgccgtacccgtacccgtaccggggtcggggacccaaccgggtaccgggtacccggggcccgtttacggggcccttaccgggtccggttacggtaaccggtaacccgggtaaccctttacccgttaccgtaaccttacccttaacccgtaacttacggtccgggtaacggcggttccggtacggacggtaaccggcgacctagtacg

SEQ ID NO: 79123 - DNA, 667 bp, Homo sapiens
  misc_feature: GYAE6OF02JLTD9.37.26.C04.1.454.CMB.1.raw
  modified_base (244)..(244): a, c, t, g, unknown or other
  misc_feature (244)..(244): n is a, c, g, or t
  modified_base (325)..(325): a, c, t, g, unknown or other
  misc_feature (325)..(325): n is a, c, g, or t
  modified_base (496)..(496): a, c, t, g, unknown or other
  misc_feature (496)..(496): n is a, c, g, or t
tcagtagtgtagatcacgaccggtgctcgatttagtctagcgactttgggtttgggggagggcttggtacagcctggggggtccctgagactctcctgtgcagcctctggtttcatctttagcaactacgccatgagctgggtccgccaggctccaggggaaggggctggagtggggtctcaggtatactggtagtggtaataccgcatactacgcagactccgtgacgggccgttcaccgtcnccagagacaatccaagaatcggtctatctggaaatgaacagcctgagacgccgaggaccacgggcccctacgtattaccgngttagccgagagtaatccgaggaccggagtataggacagcagactcgtagaccttcggacggggcccaacgggtaaccctgggtacccgtacccgtctaccccgtcgacgtcccgtccccaaccgaaccgggtaccccacgtcccggttacccttccccgtcggtaccccnccccgtccctacccgaacgaccgcacccgtccggacggggccacggacggcccgggccggttacgggccgtcggtccgtcgggacgaacgggtacttaccgtcctacgtacctaacgtacccttacgtcggaacgtcgggacgtcggacggtaccggcgacccgtagtacg

SEQ ID NO: 79124 - DNA, 819 bp, Homo sapiens
  misc_feature: GYAE6OF02J1LNJ.37.26.C04.1.454.CMB.1.raw
  modified_base (246)..(246): a, c, t, g, unknown or other
  misc_feature (246)..(246): n is a, c, g, or t
  modified_base (251)..(251): a, c, t, g, unknown or other
  misc_feature (251)..(251): n is a, c, g, or t
tcagtagtgtagatcacgaccggtgctcgatttagtctagcgactttgggtttgggggtaggcgttggtacgagccgtgggggtcccgtgagactctcctgtgcagcctctggtttcatctttagcaactacgccatgagctgggtccgccaggctccagggaagggctggagtgggtctacgaggtattactggtagtggtaataccgcatactacgcagactccgtgacgggccgttcacgtcnccganagacaattccaagactacggtctaatcgtaggaaatgaacagcctaggaagacgacccggaggaactaccgggccccttataagttacctggtgacggacgaggactcgaacgggaacggaggtaaattcgggacagggacctaaacggccttacctagggtaaccttaaccggtcggggggaccccaaaaccgggtaaacccccgttgggttacccaaccccggtcccgttccccgtaaccgtcggtaccccctaccctaaccccggaaaccgggtacccccgtaaccgttacccgggttccccgttacccccgtcggtacccctaaccccgtcccgtaaccgaacgtaccgcccgacccgtccggtcggggtaccaaccgtaccgggacccggtacccggtcgggtacccgtcgggtcccgttaccgggtaaccgtaaccggtaaccgtttaccccgttaccgtaacctttacccgtaaccgttaacccgttacccgtacgggtaaccgtccggggtaacctccggggtaaacccgagggaccccggtacgttaacccgtaacggg

SEQ ID NO: 79125 - DNA, 731 bp, Homo sapiens
  misc_feature: GYAE6OF02H9LU4.37.26.C04.1.454.CMB.1.raw
  modified_base (365)..(365): a, c, t, g, unknown or other
  misc_feature (365)..(365): n is a, c, g, or t
  modified_base (373)..(373): a, c, t, g, unknown or other
  misc_feature (373)..(373): n is a, c, g, or t
  modified_base (400)..(400): a, c, t, g, unknown or other
  misc_feature (400)..(400): n is a, c, g, or t
tcagtagtgtagatcacgaccggtgctcgatttagtctagcgactttgggtttgggggaggcttggtacagcctgggggggtccctgagactctcctgtgcagcctctggtttcatctttagcaactacgccatgagctgggtccgccaggctccgagggaaggggctggagtgggtctcaggtattactggtagtggtaataccgcatactacgcagactccgtgacgggccgttcaccgtctccagagacaattccaagaatacggtctatctaggaaatgaacagcctagagacgccgaaggacacggcccctatagtttactgtcgcgagagactcgagacggagtatagcagcagctcgngactacgngggaccacggaacctgacaccgtctcncacgcctccgaccgacggcccacgtcccggtccttccccgtacggccctaccccgtccctaccgaaccggacgacccgacccgttaccgggtccgggggaaccaccgtaacggccccggggtaccccgtcggggtacccgtcgggtaccccgtttcgggtaccggtaaaacgggtaacccttaacccgttttaccccgtaaccgtttacccgttaaacccgtaacccgtttaaaccggtacggggtaacccggggtacccgggggttacccggttaaaccgggggtaccggtaaaccgggggacccggtaccccgttaagggttaacccgg

SEQ ID NO: 79126 - DNA, 632 bp, Homo sapiens
  misc_feature: GYAE6OF02JG5FS.37.26.C04.1.454.CMB.1.raw
  modified_base (309)..(309): a, c, t, g, unknown or other
  misc_feature (309)..(309): n is a, c, g, or t
  modified_base (316)..(316): a, c, t, g, unknown or other
  misc_feature (316)..(316): n is a, c, g, or t
  modified_base (326)..(326): a, c, t, g, unknown or other
  misc_feature (326)..(326): n is a, c, g, or t
  modified_base (340)..(340): a, c, t, g, unknown or other
  misc_feature (340)..(340): n is a, c, g, or t
  modified_base (352)..(352): a, c, t, g, unknown or other
  misc_feature (352)..(352): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtgggtctcaggtattactggtagtggtaataccgcatactacgcagactccgtgacgggccgttcaccgtctccagagacaattccaagaatacggtctatctaggaaatgaacagcctgagagccgagacacggcctntattacngtgacgaganatcgagacggatanagcagcagctcngactacgcgggaccacggaccctggccaccgtctcctacacgtccctaccgaaccgaacgggcccacgtccggttcccttccccgtcggtacccacccctcctaccgaagaccgaccaccgtcggtacgggccacgacggcccggtcccgtacgggtccgtcggcccgtacggtaccgtaacggtaccttacccgttctaacgtacccttaaccgtaactaccggtaccggaaccggtccgggaccgttcgggacccgaacggtccgtaccgtagtacgg

SEQ ID NO: 79127 - DNA, 616 bp, Homo sapiens
  misc_feature: GYAE6OF02I8LPK.37.26.C04.1.454.CMB.1.raw
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtgggtctcaggtattactggtagtggtaataccgcatactacgcagactccgtgacgggccgttcaccgtctccagagacaattccaaagaatacggtctatctggaaatgaacagcctgagagccgaggacacggccctctattactgtcgcgagagatcagacggagtatagcagcagctctgactacgtggggccacggaaccctgggtccaccgtcctcctcacgccctcccgaccaacgggccccaacgtccggtcccttcccccgtcggaccctacccctccctacccaaacgacgacccacctccggtcggggaccacgacgcccgggcccgtcggggccgtcggcccgttcggtaccgaacggtaccttaccgttaccacgtacctaacctacctacgtcggacggccgggtcgcggaccgaacggccgacgagtacg

SEQ ID NO: 79128 - DNA, 520 bp, Homo sapiens
  misc_feature: GYAE6OF02HBGWO.37.26.C04.1.454.CMB.1.raw
  modified_base (426)..(426): a, c, t, g, unknown or other
  misc_feature (426)..(426): n is a, c, g, or t
  modified_base (483)..(483): a, c, t, g, unknown or other
  misc_feature (483)..(483): n is a, c, g, or t
  modified_base (488)..(488): a, c, t, g, unknown or other
  misc_feature (488)..(488): n is a, c, g, or t
  modified_base (513)..(520): a, c, t, g, unknown or other
  misc_feature (513)..(520): n is a, c, g, or t
tcagtagtgtagatcacgaccggtgctcgatttagtctagcgactttgggtttgggggaggcttggtacagcctggggggtcccgtgagactctcctgtgcagcctctggtttcatctttagcaactacgccatgagctgggtccgccaggctccagggaaggggctggagtgggtggccaacataaagcgagatggaagcgagaaatactatgtggactctgtgaggggccgattcaccatctccacagacaacgccaagaaatcaatcttttgcaaatgaacagtctgagagtcgaggacacggccatgtattactgtacgagagaacagacgttggggccgagggaacccgtggtccaccgtctcctcagcctccaccaagggcccatcggtccttcccctcgggccaccctccctccaacgngccactcgtggggcacagccggccctgggctcgcctggtcaagcctactccatcacnctacngacgcggctggacaaggcacatagnnnnnnnn

SEQ ID NO: 79129 - DNA, 569 bp, Homo sapiens
  misc_feature: GYAE6OF02JBRPW.37.26.C04.1.454.CMB.1.raw
  modified_base (311)..(311): a, c, t, g, unknown or other
  misc_feature (311)..(311): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtgggtctcaggtattactggtagtggtaataccgcatactacgcagactccgtgacgggccggttcaccgtctccagagacaattccaagaatacggtctatctggaaatgaacagcctgagagccgaggacacggccctntattactgtgcgagagatcagacggagtatagacaggcagctactgaactacgtggggcccaacgggaaccctggtaccaccgtctcctcacgccctccaccaacggcccacgtcgtccttcccctcggccaccccgtcctccaacgacgaccacctcgtggggccacgcgccgcccgtcgggctcgccgtgtaccgaagtactacttccactacgtaacactacgtgacgccggacgtcgacgaacggcgcgatcgg

SEQ ID NO: 79130 - DNA, 599 bp, Homo sapiens
  misc_feature: GYAE6OF02I2EWG.37.26.C04.1.454.CMB.1.raw
  modified_base (392)..(392): a, c, t, g, unknown or other
  misc_feature (392)..(392): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccaggggaaggggctggagtgggtctcaggtattactggtagtggtaataccgcatactacgcagactccgtgacgggccgttcaccgtctccagagacaattccaagaatacggtctatctaggaaatgaacagcctgagagcccgaggacacggccctctattactgtgcggagagatcagacggagtatagcagcagctctagactactggggccacggaaccctggtccaccgtcncctcacgcctaccaccagggcccatccggtccttccccgtcggcctaccccgtccctaccgaacgtacgccacctcgtcgggggtaccacgacggaccggcccgtgggtacctcggcccgttcggtaccaacggaccttaccgttccgactccgtaacgaccttacgtacgtggccgggcgttcggaccgacggccgtacgatacgg

SEQ ID NO: 79131 - DNA, 731 bp, Homo sapiens
  misc_feature: GYAE6OF02G4J8L.37.26.C04.1.454.CMB.1.raw
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccaggggaagggactgggagtgggtctcgaggtattggtggcagtggtgagaccacatactacgcagactccgtgaagggccggttcaccatctccagagacaattccaagaaccaccctgtctctgcaaatgaacaacctgagagccgaggacacggccctatacttactgtaacaaaagtggacctacggatatgactactatgggactaggtactcgatctgtcggggccgtcggcctacccgtgggtcctacttcggtccttcccgactacgtccctacccaacccggaacgggtccccaacggttcccggttacccctttccccccgtagggtacccgtccccgttacggtccctacccggtaacgggaccggtacccctaccccggtcccggaacggtaccggacccgaaccggaccggtccccggggaccccgttcggggcccgttacggcccggttagggttaaccccggaaacgggttaacccgtttaaccgttaccccgtaacgttacccgttaacccgtaacgttaacccggttgggaacccgggtcgggggtacccggttaccgggg

SEQ ID NO: 79132 - DNA, 566 bp, Homo sapiens
  misc_feature: GYAE6OF02GD9IO.37.26.C04.1.454.CMB.1.raw
  modified_base (355)..(355): a, c, t, g, unknown or other
  misc_feature (355)..(355): n is a, c, g, or t
tcagtagtgtagatcacgaccggtgctcgatttagtctagcgactttgggtttgggggaggcttggtacagcctgggggggtccctgagactctcctgtgcagcctctggtttcatctttagcaactacgccatgagctgggtccgccaggctccagggaaggggctggagtgggtctcaggtattactggtagtggtaataccgcatactacgcagactccgtgacgggccggttcaccgtctccagagacaattccaagaatacggtctatctggaaatgaacagcctgagagccgaggacacggccctctattactgtgcgagagatcagacggagtatagcagcagctctnactacgtggggccacggaaccctggtcaccgtctcctcacgcctccaccaacggccccatccggtcccttcccccgtcgccacccctccctccaacgacgccacccgtccgtcgggggccacgacgccggcccgtcgggccgtcgccgtcggtacaacggacctctccgactctaccactacgtgacgcgggctcggcgaggcgcagtacg

SEQ ID NO: 79133 - DNA, 590 bp, Homo sapiens
  misc_feature: GYAE6OF02GZT62.37.26.C04.1.454.CMB.1.raw
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtgggtctcaggtattactggtagtggtaataccgcatactacgcagactccgtgacgggccggttcaccgtctccagagacaattccaagaatacggtctatctggaaatgaacagcctgagagccgaggacacggccctctattactgtgcgagagatcagacggagtatagcagcagctctgactacgtggggcccacggaaccctggtccaccgtctcctcacgcctcccaccaacgggccccacgtccggttcccttccccgtcggccacccctccctcctaacgacgccgaccctcgtcggggcacgacgccggcccgtgggcctcgccgtggtacgaacggtaccttaccttccactacctactaaccgtacgtacggacggccgggtctcgggaccaagggccgacagtacgg

SEQ ID NO: 79134 - DNA, 612 bp, Homo sapiens
  misc_feature: GYAE6OF02GF0PO.37.26.C04.1.454.CMB.1.raw
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtgggtctcaggtattactggtagtggtaataccgcatactacgcagactccgtgacgggccggttcaccgtctccagagacaattccaagaatacggtctatctggaaatgaacagcctgagagccgaggacacggccctctatactgtgcgagagatcaggacggagtagtagcagcagctctgactacgtggggccacggaaccctggtcaccgtctcctcacgcctccaccaacggaccacgtcggttccttcccctcggccaccccgtcccttccgaacgacgccacccgtccgtacgggggtccacgacgcccgggcccgtcgggtccgtcggcccgttcggtaccgaacggtaccttaccgttaccgtacttaccgtaacctaccgttaactcggtaacgtccgggacttcgggcgaacgggccgtaccgatacgg

SEQ ID NO: 79135 - DNA, 613 bp, Homo sapiens
  misc_feature: GYAE6OF02FMB2N.37.26.C04.1.454.CMB.1.raw
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtgggtctcaggtattactggtagtggtaataccgcatactacgcagactccgtgacgggccggttcaccgtctccagagacaattccaagaatacggtctatctggaaatgaacagcctgagagccgaggacacggccctctattactgtgcgagagatcgagacggagtatagacagcagctctgactacgtggggaccacggaccctggtcaccgtctcctcacgccctccaccgaacggcccagtccggttcccttcccccgtcggaccctacccctccctacccgaacgaccgcctacccgttcgtcgggggaccaccgacggcccggcccgtcggggtccgtcgtcccgtcgggtacgaaacggtaccttaccgttcccagtacctaaccaccttaccgtagacggccgggtcgtcgggaccgaaggccgtcagtacg

SEQ ID NO: 79136 - DNA, 644 bp, Homo sapiens
  misc_feature: GYAE6OF02IRBT7.37.26.C04.1.454.CMB.1.raw
  modified_base (209)..(209): a, c, t, g, unknown or other
  misc_feature (209)..(209): n is a, c, g, or t
  modified_base (633)..(633): a, c, t, g, unknown or other
  misc_feature (633)..(633): n is a, c, g, or t
  modified_base (636)..(636): a, c, t, g, unknown or other
  misc_feature (636)..(636): n is a, c, g, or t
  modified_base (639)..(640): a, c, t, g, unknown or other
  misc_feature (639)..(640): n is a, c, g, or t
  modified_base (642)..(642): a, c, t, g, unknown or other
  misc_feature (642)..(642): n is a, c, g, or t
  modified_base (644)..(644): a, c, t, g, unknown or other
  misc_feature (644)..(644): n is a, c, g, or t
tcagtagtgtagatcacgaccggtgctcgatttagtctagcgactttgggtttggggggaggcttggtacagcctgggggggtccctgagactctcctgtgcagcctctggtttcatctttagcaactacgccatgagctgggtccgccaggctccaggggaaggggctgggagtgggtctcaggtattactggtagtggtaataccgnatactacgcagactccgtgacgggccgttcaccgtctccagagacaattccaagaaccacgctctatctgacaaatgaaacagcctagagagccgaagacacggccgtatattactgtgtagaaaggcgtgggggagtggggggactacggtggggaccgaagggaccctggtccaccggtctcctcagcctaccgaaccaacgggccctacgtccggttcccttcccccgtggccctacccctccctaccgaaacgcgccacccgttcggtacgggggccaccgacgggtcccggcccggtcgggcctccggccgttcgggtaccgaacgggacccttacccgttcctaacgttaccttaaccacttaccgtaggacggccggggtacgtgggacctaagggggcctacgtaagtacggactncgngannangn

SEQ ID NO: 79137 - DNA, 594 bp, Homo sapiens
  misc_feature: GYAE6OF02JFV6U.37.26.C04.1.454.CMB.1.raw
  modified_base (310)..(310): a, c, t, g, unknown or other
  misc_feature (310)..(310): n is a, c, g, or t
  modified_base (455)..(455): a, c, t, g, unknown or other
  misc_feature (455)..(455): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtgggtctcaggtattactggtagtggtaataccgcatactacgcagactccgtgacgggccgttcaccgtctccagagacaattccaagaatacggtctatctggaaatgaacagcctgagagccgaggacacggccctntattactgtgcgagagatcagacggagtatagcagcagctctgactacgtgggccacggacctggtccaccgtctcctcacgcctccaccgacgggcccagtccggtccttccccgtggcccgtccctcgcctacccgagggacncccacccgtccgacgacgccacgcggccggcccgtgggcctcggcccgtgggtaccaacggtaccttaccgttaccgtaacttacctaactaccttacgtaggacggtccgggtacgtagggaccgaacgggccgtacg

SEQ ID NO: 79138 - DNA, 570 bp, Homo sapiens
  misc_feature: GYAE6OF02I28FY.37.26.C04.1.454.CMB.1.raw
  modified_base (353)..(353): a, c, t, g, unknown or other
  misc_feature (353)..(353): n is a, c, g, or t
  modified_base (440)..(440): a, c, t, g, unknown or other
  misc_feature (440)..(440): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtgggtctcaggtattactggtagtggtaataccgcatactacgcagactccgtgacgggccggttcaccgtctccagagacaattccaagaatacggtctatctggaaatgaacagcctgagagccgaggacacggccctctattactgtgcgagagatcagacggagtatagcagcagctcngactactggggccacggaaccctggtcaccgtctcctcagcctccaccaaggcccatcggtctcccctgccaccctcctccaagacncacctcgtcggggcacgagccggccctcgggctcgccgttggacctaacgggaccttaccgttccaacttcctaactaacctacgtaggacggtccgggcgtcgggaccgtaacgggccgtacgagtacg

SEQ ID NO: 79139 - DNA, 578 bp, Homo sapiens
  misc_feature: GYAE6OF02F7LF1.37.26.C04.1.454.CMB.1.raw
  modified_base (360)..(360): a, c, t, g, unknown or other
  misc_feature (360)..(360): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtgggtctcaggtattactggtagtggtaataccgcatactacgcagactccgtgacgggccggttcaccgtctccagagacaattccaagaatacggtctatctggaaatgaacagcctgagagccgaggacacggccctctattactgtgcgagagatcagacggagtatagcagcagctctgactacnggggccacggaaccctggtcaccgtctcctcagccctccaccacgggcccactcggtccttccccgtcggccacccctcctccaacgacgcaccctcgtcggggccacgacggccggcccgtcggggcgtcgccgtcggtacgaacggtaccttacttccactcctacaccttacgtcggacgcgggtcgttcgggaccgtaagggccgacgagtagg

SEQ ID NO: 79140 - DNA, 666 bp, Homo sapiens
  misc_feature: GYAE6OF02HWXJT.37.26.C04.1.454.CMB.1.raw
  modified_base (311)..(311): a, c, t, g, unknown or other
  misc_feature (311)..(311): n is a, c, g, or t
  modified_base (328)..(328): a, c, t, g, unknown or other
  misc_feature (328)..(328): n is a, c, g, or t
  modified_base (405)..(405): a, c, t, g, unknown or other
  misc_feature (405)..(405): n is a, c, g, or t
tcagtagtgtagatcacgaccggtgctcgatttagtctagcgactttgggtttgggggaggcttggtacagcctgggggggtccctgagactctcctgtgcagcctctggtttcatctttagcaactacgccatgagctgggtccgccaggctccagggaaggggctggagtgggtctcaggtattactggtagtggtaataccgcatactacgcagactccgtgacgggccgttcacgtctccagagacaattccaagaatacggtctaatctggaaatgaacagcctgagagccgaggacacggccctntattactgtgacgaganatcagacggatatagcagcagctctgactacgtggggacccaacggaaccctgggtaccacccggtccttcccgtanacgtccctaccaacccgaaacgggccccaacgtccggttccctttcccccgtcggaccctaccccctcctacccaaacgacgacctacccgtcgtacgggggaccacgacggaccgggtcccgtcgggtaccgtcgcccgttcgggtaccgaaacggtaaccgttaaccttaccctaacgtaccgtaaacctaaccgttaacgtcggaacggtaccgggtaccgttcgggaaccgtaacgggaccgtaccgtaagtaacgg

SEQ ID NO: 79141 - DNA, 700 bp, Homo sapiens
  misc_feature: GYAE6OF02FJ3Y4.37.26.C04.1.454.CMB.1.raw
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtgggtctcaggtattactggtagtggtaataccgcatactacgcagactccgtgacgggccgttcaccgtctccagagacaattccaagaatacggtctatctggaaatgaacagcctgagagccgaggacacggccctctattactgtgcgagagatcaggacggagtatagcagcagctcgtgacttacgtggggaccaacgggtaaccctggtccacccgttcctccctcgacggtcccctaccgaacccgaaacggggcccctaacgttcccgggttacccctttccccccggtacgggtccccgtccccgtcggtcccgttcccgaacgggaccgaccgtaccccgttcccggaacggtacgacccgaaccggacgggccccgggtacccggtcggggtccttcggtcccgttacgggaaccgtaacgggtacccttacccgttacccgtaacgttacctaaaccgtaaccgttaccgtacggtacgggccgggtaccgttacgggaccgtaacgggcctaacgg

SEQ ID NO: 79142 - DNA, 583 bp, Homo sapiens
  misc_feature: GYAE6OF02HKPNH.37.26.C04.1.454.CMB.1.raw
  modified_base (208)..(208): a, c, t, g, unknown or other
  misc_feature (208)..(208): n is a, c, g, or t
  modified_base (551)..(551): a, c, t, g, unknown or other
  misc_feature (551)..(551): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccgaggggaaggggctggagtgggtctcaggtattactgggtagtggtaataccgnatactacgcagactccgtgacgggccggttcaccgtctccagagacaattccaaagaatacggtctatctaggaaatgaaacagcctagagagcgaggacacggccctctattactgtgcgagagatcagacggagtatagcagcagctctgactacgtcgggggaccaacgggaaccctggtaccaccgtctcctcacgccctaccaccgaacgggccccagtcccgggtccttcccccgtggcccaccccttcctaccgaagcgcctaccctcggtcggggccacgacgccggcccgtgggctcgccgtggtacacggtactcgtacacgtctacactacngacggtcgcgtcggacgtaacggctacagtag

SEQ ID NO: 79143 - DNA, 568 bp, Homo sapiens
  misc_feature: GYAE6OF02IPES1.37.26.C04.1.454.CMB.1.raw
  modified_base (355)..(355): a, c, t, g, unknown or other
  misc_feature (355)..(355): n is a, c, g, or t
tcagtagtgtagatcacgaccggtgctcgatttagtctagcgactttgggtttgggggaggcttggtacagcctgggggggtccctgagactctcctgtgcagcctctggtttcatctttagcaactacgccatgagctgggtccgccaggctccagggaaggggctggagtgggtctcaggtattactggtagtggtaataccgcatactacgcagactccgtgacgggccggttcaccgtctccagagacaattccaagaatacggtctaatctggaaatgaacagcctgagagccgaggacacggcctctattactgtgcgaggagatcagacggagtatagcagcagctcngactacgtgggccacggaaccctggtccacgtctcctcacgccctcaccgaacggccagtccggttccttccccgtcggccacccctcctaccaacgacgccaccgtcgtcggggccacgacgccggtacccgtggggccgtcgccgtcggtacgaacggactaccttcactctacactacgtcgaggcggacgtcggacgaggcgacagtag

SEQ ID NO: 79144 - DNA, 623 bp, Homo sapiens
  misc_feature: GYAE6OF02GTH0D.37.26.C04.1.454.CMB.1.raw
tcagtagtgtagatcacgaccggtgctcgatttagtctagcgactttgggtttgggggaggcttggtacagcctgggggggtccctgagactctcctgtgcagcctctggtttcatctttagcaactacgccatgagctgggtccgccaggctccagggaaggggctgggagtgggtctcaggtattactggtagtggtaataccgcatactacgcagactccgtgacgggccgttcaccgtctccagagacaattccaagaatacggtctaatctggaaatgaacagcctgagagccgaggacacggccctctattactgtgcgagagatcagacgagtatagcagcagctctgactacgtggggccaaggggaaccctggcaccgtcgtcctcacgtcctaccaacccgaagggccccaagtccggtcccttcccccgtggtcccacccctcctaccaagacgccacctcgtcggggccacgacggcccggcccgtggggtcctcggtcccgtcgggtaccgaaacggggtacctaaccgtttacccaacttcccgtaactaacccgttacctacggaccggtaccgggtcgtcgggaccgtaacgggcgtacgagtacgg

SEQ ID NO: 79145 - DNA, 627 bp, Homo sapiens
  misc_feature: GYAE6OF02HR507.37.26.C04.1.454.CMB.1.raw
  modified_base (206)..(206): a, c, t, g, unknown or other
  misc_feature (206)..(206): n is a, c, g, or t
  modified_base (341)..(341): a, c, t, g, unknown or other
  misc_feature (341)..(341): n is a, c, g, or t
  modified_base (453)..(453): a, c, t, g, unknown or other
  misc_feature (453)..(453): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccgagggaaggggctggagtgggtctcagctattaatgggaatggtgataccanatactacgcagactccgtgaagggccgttcaccatctcaggacaattccaagaacacactgtactctgcaatgaacagcctgagagtcgaggacacggccttagtattactgtgtgaaggctctagtccccttanagcagcgtctggtctggtactttgacgtacgtggggaccgagggaaccctggtcacccgtcgtacctcgacgtccctccaccgaacggacccacgtccggtcccttaccccnggcccgtccccgtacgtcctccgtacggaccgccgacccgtccggacggacgccgaacgacgtcccgggacccgtcgggccgtccgccgttgggtaccgaaacgggtaccttaacccgtccgtacttaccgtaacctaccgttccgtacggaacggtccgggtccgtaccgggg

SEQ ID NO: 79146 - DNA, 640 bp, Homo sapiens
  misc_feature: GYAE6OF02F8Y8V.37.26.C04.1.454.CMB.1.raw
  modified_base (488)..(488): a, c, t, g, unknown or other
  misc_feature (488)..(488): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtgggtctcaggtattactggtagtggtaataccgcatactacgcagactccgtgacgggccggttcaccgtctccagagacaattccaaagaatacggtctatctaggaaatgaaacagcctgagagccgaggacaccggccctctattactgtgcgagagatcagacggatatagcagcagctctgactacgtggggcccaacggaaccctggtaccaccgtctcctcacgccctccaccgaacgggccccaagtccggtcccttcccccgtggcccgtccccgtgccttccgacggacgccacccgtccgaggacnccaaccgtacggcccgggtacccgtggggtccctacgggtcccgttacgggtaccgaaacgggtacccttaaccgttacccgtaacttacccgttaacctaaccgttaccgttaggacggtccgggaccgtcgggaccgtaacgggcctacg

SEQ ID NO: 79147 - DNA, 545 bp, Homo sapiens
  misc_feature: GYAE6OF02HRTXI.37.26.C04.1.454.CMB.1.raw
  modified_base (311)..(311): a, c, t, g, unknown or other
  misc_feature (311)..(311): n is a, c, g, or t
  modified_base (390)..(390): a, c, t, g, unknown or other
  misc_feature (390)..(390): n is a, c, g, or t
  modified_base (421)..(421): a, c, t, g, unknown or other
  misc_feature (421)..(421): n is a, c, g, or t
  modified_base (426)..(426): a, c, t, g, unknown or other
  misc_feature (426)..(426): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtgggtctcaggtattactggtagtggtaataccgcatactacgcagactccgtgacgggccgttcaccgtctccagagacaattccaagaatacggtctatctaggaaatgaacagcctgagagccgaggacacggccctntattactgtgcgagagatcagacggagtatagcagcagctctgactacgtggggccaacggaccctggccacgtctccnacgcctccacacggccagtccgtccttcccncgccnccctcctaccaacgcgcacctcgcgggacacgacgccgccgtgggcctcgccgtggtacgaagtacctacttccatcctaacacctacgtcgacgcggcgtggacgaggcgacagtacg

SEQ ID NO: 79148 - DNA, 608 bp, Homo sapiens
  misc_feature: GYAE6OF02FS5KH.37.26.C04.1.454.CMB.1.raw
  modified_base (366)..(366): a, c, t, g, unknown or other
  misc_feature (366)..(366): n is a, c, g, or t
  modified_base (460)..(460): a, c, t, g, unknown or other
  misc_feature (460)..(460): n is a, c, g, or t
tcagtagtgtagatcacgaccggtgctcgatttagtctagcgactttgggtttgggggaggcttggtacagcctggggggtccctgagactctcctgtgcagcctctggtttcaactttggtagctattggatggactgggtccgccagtctccagggaagggctggagtgggtggccaacatacagggaggtggtggtacgaaaaactatgtggactctgtgcggggccgattcaccatctccagagacaacgccaaaaactcactgtatctgcaaatggacgcctgagatccgaggacacggctgtgtattattgtgcagagatttagactaacaaagtttcgagtgactggtatgatgcttangactaccgtggggaccaagggacctagtcggtaccaccgttctcttcacgcctaccaccgaacgggccctacgtccggtcctcccccgtggccnccctcgcctccgacggacgcaccgtccgacgcgacgacacgccggtcccgtacgggccgtcgtccgtacggtaccgaacgggtaaccttacccgttaccctaacgttaccttaacctacttaccgtacggacggccgggtcgtacggg

SEQ ID NO: 79149 - DNA, 715 bp, Homo sapiens
  misc_feature: GYAE6OF02IDS8C.37.26.C04.1.454.CMB.1.raw
  modified_base (337)..(337): a, c, t, g, unknown or other
  misc_feature (337)..(337): n is a, c, g, or t
  modified_base (370)..(370): a, c, t, g, unknown or other
  misc_feature (370)..(370): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaagggctggagtgggtctcaggtattacgtggtagtggtaataccgcatactacgcagactccggtgacgggccgttcaccgtctccagagacaattccaaagatacggtctatcgtaggaaatgaaacagcctggagacgccgaggtacacggccctagtacttactggtagcgaganactcgagacggagtaatagcagcagtcctgtanaacgtacggtcgggaccctaaccgggtaacccttcgggtacctaaccggttcctacccgtcaaccgggtcccctaccgaaaccggtaaccgggaccccgtaagttcccggtttaccctttcccccgtacgggtacccctaccccgttacccaaccgaaacgaccgacctaacccgttcgggtcggggacctacggaccggtcccgggtccgtccggggtcctacggaccgttacggtaacgaacggtaaccgtttacctaccgtaccgttacgtaccggtaaccttaccggacggtaccgggtcgggtccgtacgggtaccgtacggaccgtaccgtagtaacgg

SEQ ID NO: 79150 - DNA, 617 bp, Homo sapiens
  misc_feature: GYAE6OF02G40DB.37.26.C04.1.454.CMB.1.raw
  modified_base (368)..(368): a, c, t, g, unknown or other
  misc_feature (368)..(368): n is a, c, g, or t
tcagtagtgtagatcacgaccggtgctcgatttagtctagcgactttgggtttgggggaggcttggtacagcctgggggggtccctgagactctcctgtgcagcctctggtttcatctttagcaactacgccatgagctgggtccgccaggctccaggggaaggggctggagtgggtctcaggtattactggtagtggtaataccgcatactacgcagactccgtgacgggccgttcaccgtctcagagacaattccaagaatacggtctatctaggaaatgaaacagcctagagagaccgaggaccaccggtccctctaattactgtcgacgagagactcgaagacggagtatagcagcagtctctnactacgtcgggaccaacggacctggtaccaccgttctcctcacgccctaccaccgaacgggccctacgtccgtccttcccgtgtacccaccctcctaccacgacgccaccgtcggcgggacacgacggcccgccgtacgggcctcggtcccgtacgggtaccgaacggtacccttaccgtaccctagttaccctaacctaccttacgacggtacggacggtcgtacggaccgaacggtccgatacgacg

SEQ ID NO: 79151 - DNA, 756 bp, Homo sapiens
  misc_feature: GYAE6OF02JGW8O.37.26.C04.1.454.CMB.1.raw
  modified_base (313)..(313): a, c, t, g, unknown or other
  misc_feature (313)..(313): n is a, c, g, or t
  modified_base (344)..(344): a, c, t, g, unknown or other
  misc_feature (344)..(344): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccgagggaagggctggagtgggtctcgaggtattacgtggtagtggtaataccgcatactacgcagactccgtgacgggccgttcaccgtctcagagacattccaagactacggtctatcgtaggaaatgaacagcctgagcgccgaggaccacggccctntatactgtgcgagagatcaagacggagtaangacagcagctctagactacgtggggtacaaccggtaaccgttggtacccgacccgttccgtaccctcgaaccgtccccgtacccgaacccggtaaacgggtccccctaacggttccccggttaccccgtttcccccggtaccgggtacccctaaccccccgttccccgttaacccgaaacgggtacccgtacccgtaaccccgttccggggttaccggggaccccgaacgaaccgggtcccggtcccccggtaggggtcccgtccggtacccgtaccgggtaaccgtaaaccgggtaccttaacccggttcctaaccttaacccgtaacctaacccgttaccggtacggtaacccgggtaccggtaccgggttacgggaacccggtaacgggtacccgaacgtagtaaccgg

SEQ ID NO: 79152 - DNA, 550 bp, Homo sapiens
  misc_feature: GYAE6OF02HCKA5.37.26.C04.1.454.CMB.1.raw
  modified_base (321)..(321): a, c, t, g, unknown or other
  misc_feature (321)..(321): n is a, c, g, or t
  modified_base (540)..(543): a, c, t, g, unknown or other
  misc_feature (540)..(543): n is a, c, g, or t
  modified_base (545)..(550): a, c, t, g, unknown or other
  misc_feature (545)..(550): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccagggctccagggaaggggctggagtggggtctcaggtattactgggtagtggtaataccgcatactacgcagactccgtgacgggccggttcaccgtctccagagacaattccaagaatacggtctatctggaaatgaacagcctgagagccgaggacacggccctctattacngtgtgaaaaggctggggatggggggactactggggccaaggggaaccctgggtcaccgtctcctcagcctccaccaagggcccaatcggtacttccccctgggcaccctcccgtccaagacgacacctctgggggcacaacgcggcccgtgggctacgcctggtcaaagggctacgttaccatctacactactgagacgggctggcaaggcgacatagnnnncnnnnnn

SEQ ID NO: 79153 - DNA, 691 bp, Homo sapiens
  misc_feature: GYAE6OF02HPMS0.37.26.C04.1.454.CMB.1.raw
  modified_base (206)..(206): a, c, t, g, unknown or other
  misc_feature (206)..(206): n is a, c, g, or t
  modified_base (314)..(314): a, c, t, g, unknown or other
  misc_feature (314)..(314): n is a, c, g, or t
  modified_base (345)..(345): a, c, t, g, unknown or other
  misc_feature (345)..(345): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccgagggaaggggctggagtgggtctcaggtattactggtagtggtaataccgnatactacgcagactccgtgacgggccgttcaccgtctccagagacaattccaaagaactacggtctatctaggaaatgaacagcctgagagccgaggacacggccctntattactgtgcgagagatcgagacggagtanaggcagcagcctgtcgaactacggtcggggacccaacgggaaccctcggtaccgacccgttcctcctacgacgcccctacccgaacccggaaaccgggccccctaagttccccggttccctttcccccggtcgggccccgtaccccgtcgtacccgtacccgtacggaccgtacccacccgtaccggacgacgtaccaccgacggcccggacccgtcgggtccgtcggtcccgtcgggtaacccgaagggttacccttacccttaccgtaaccttacccgttaacctaccgttaccgtacgggtacggtacccggggcgttaccgggaccgtaacgggccgtaacg

SEQ ID NO: 79154 - DNA, 580 bp, Homo sapiens
  misc_feature: GYAE6OF02FSUWD.37.26.C04.1.454.CMB.1.raw
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtgggtctcaggtattactggtagtggtaataccgcatactacgcagactccgtgacgggccggttcaccgtctccagagacaattccaagaatacggtctatctggaaatgaacagcctgagagccgaggacacggccctctattactgtgcgagagatcagacggagtatagcagcagctctgactacgtggggccacggaaccctggtccaccgtctcctcacgccctccaccacggcccactcggtccttccccctcggccacccctccctccaaacgacgcctaccctcgtcgggggccacgacggccggcccgtcgggctcggcccgtcgggtacaacgggtaccttaccgttccactacctaaccactactgacgcgggcgtcggaccgacggcgtacagtacg

SEQ ID NO: 79155 - DNA, 803 bp, Homo sapiens
  misc_feature: GYAE6OF02JB740.37.26.C04.1.454.CMB.1.raw
tcagtagtgtagatcacgaccggtgctcgatttagtctagcgactttgggtttggggggtagggcttgggtacacgccgtggggggtccctggagtacctcgtccttcgtgtcgagcccttctgggttcattcgttaagccaaactacgccatcgacgcgtggggttccgtccaggtcctccgtaggggtaacgggtctgggagtcgggtctcgaggtattacgtggtagtggtaactaccggctaatacgtacggcagtactccggtggacgggtccgttcaccgtctccgaggtacgacctaacttccaagtaataccggtctagtccgtaggtaaagtcgaacacgcctgacgacgcccgtaggacctaccggtccctacgtagttacctggtcgccgtaggaacggtagtccggaaggtacgggtagtaagtacggtacgtaagtcgaggtccgtacgtaggtaaccttacgggtacggggtaccctaaccgggtaacccgtggggtacccgtacccggttcctaccctaccgaacgtccctacccgaaccggtaaccgggtccctaacgttcccggtacccgttaccccgtacgggtaccctaccccgtccgtaccgtaacggtaccgtaccgtacccgtaccgggtccggggacaccggacgggacccgggtccggtcgggtaccgtccggtaccgtacgggtaccgtaacggtaccgttaccgttacgtacgtaccgtacgtaacgtacggtcggtaggtccgggtacgacggacgacggccgtaggtcgtaacgg

SEQ ID NO: 79156 - DNA, 603 bp, Homo sapiens
  misc_feature: GYAE6OF02IL8HM.37.26.C04.1.454.CMB.1.raw
  modified_base (394)..(394): a, c, t, g, unknown or other
  misc_feature (394)..(394): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtgggtctcgaggtattactggtagtggtaataccgcatactacgcagactccgtgacgggccgttcaccgtctcagagacattaccaagaatacggtctatctaggaaatgaacagcctagagagccgagacacgccctatattactgtgcgagagatcgagacggagtatagcagcagtctcagactacgtcgggaccaacggtaccctggtaccaccgttcncctacacgccctaccgacccgaacggccctacgtccggtcccttccccgtcgaccaccctcctaccgacgacgcctaccgtcgtcggggacacgacgccgggtcccgcgggtccgtcgtccgtcggtacgaacggtacctaccttccgtacttaccgtaactactacgtaggacggtcgggtcgtcggaccgaacggcgacgtagtacg

SEQ ID NO: 79157 - DNA, 759 bp, Homo sapiens
  misc_feature: GYAE6OF02F0CSY.37.26.C04.1.454.CMB.1.raw
  modified_base (254)..(254): a, c, t, g, unknown or other
  misc_feature (254)..(254): n is a, c, g, or t
  modified_base (313)..(313): a, c, t, g, unknown or other
  misc_feature (313)..(313): n is a, c, g, or t
  modified_base (364)..(364): a, c, t, g, unknown or other
  misc_feature (364)..(364): n is a, c, g, or t
tcagtagtgtagatcacgaccggtgctcgatttagtctagcgactttgggtttgggggaggcttggtacagcctgggggggtccctgagactctcctgtgcagcctctggtttcatctttagcaactacgccatgagctgggtccgccaggctccgaggggaaggggctgggagtgggtctcaggtattactggtagtggtaataccgcatactacgcagactccggtgacgggtccgttcaccgtctccaganacattccaagatacggtctatctaggaaatgaacagcctgagagcgaggacacggcctntattactgtgcgagagatacgaggaacggagtaatagacgagtcaggtctntacgactaacggtcgggggacccaaccgggaacccgtgggtcccacccggttccttccgtaccacgtccccctacccgaacccggaaccgggtcccctaacgttcccggttccccgttaccccccgtcgggaccccctaccccgtccccttaccgaaacggtaccgacccgtacccggttaccgggtcgggggaccctaaccggacccgggtcccgggccccggttacggggtcccggtcggtccccgggttacgggtaacccggtaaacggttacccgttacccgtttacccgtaacctttacccgtaaccctaaacgttaacccggttcgggaaccgggttccggggtaccggtaccgggtaaccggaacgggtccccggtactacggtaagg

SEQ ID NO: 79158 - DNA, 626 bp, Homo sapiens
  misc_feature: GYAE6OF02G3X51.37.26.C04.1.454.CMB.1.raw
  modified_base (205)..(205): a, c, t, g, unknown or other
  misc_feature (205)..(205): n is a, c, g, or t
  modified_base (311)..(311): a, c, t, g, unknown or other
  misc_feature (311)..(311): n is a, c, g, or t
  modified_base (342)..(342): a, c, t, g, unknown or other
  misc_feature (342)..(342): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtgggtctcaggtattactggtagtggtaataccgnatactacgcagactccgtgacgggccgttcaccgtctcagagacaattccaagaatacggtctatctaggaaatgaacagcctgagagccggaggacacggccctntattactgtgcgagagatcgagacggattanagcagcagctcagactacgtgggacccacggaacccttggtaccaccgtctcccgtcacgtccctccgaaccgacggccctacgtcccgtccttccccgtcggaccctaccccgtccctaccgaacgaccgccctacccgtcggcggggccacggacgcccggcccgtcgggcctcgtcccgtacggtaccgaacgtaccttaccttaccctactaccgtaacctaacctacgtacggacggaccgggtacgtacgggaccggtaacggccgtacgtagtacgg

SEQ ID NO: 79159 - DNA, 536 bp, Homo sapiens
  misc_feature: GYAE6OF02FXE77.37.26.C04.1.454.CMB.1.raw
  modified_base (386)..(386): a, c, t, g, unknown or other
  misc_feature (386)..(386): n is a, c, g, or t
  modified_base (390)..(390): a, c, t, g, unknown or other
  misc_feature (390)..(390): n is a, c, g, or t
  modified_base (420)..(420): a, c, t, g, unknown or other
  misc_feature (420)..(420): n is a, c, g, or t
tcagtagtgtagatcacgaccggtgctcgatttagtctagcgactttgggtttgggggaggcttggtacagcctgggggggtccctgagactctcctgtgcagcctctggtttcatctttagcaactacgccatgagctgggtccgccaggctccagggaaggggctggagtgggtctcaggtattactggtagtggtaataccgcatactacgcagactccgtgacgggccgttcaccgtctccagagacaattccaagaatacggtctatctggaaatgaacagcctgagagccgaggacacggccctctattactgtgcgagagatcagacggagtatagcagcagctctgactactggggccacggaacctggtcaccgtcnctcngcctccacaggccatcgtcttccctcgccnccctcctccaagacgcacctcgtcgggggccacgacggcggcccgtcgggctcgccgtggtacgaaggactaccttccatctacactactgacgcgggctggcgaaggcgcatacg

SEQ ID NO: 79160 - DNA, 590 bp, Homo sapiens
  misc_feature: GYAE6OF02HOMGZ.37.26.C04.1.454.CMB.1.raw
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctgggagtgggtctcaggtattactggtagtggtaataccgcatactacgcagactccgtgacgggccggttcaccgtctccagagacaattccaaagaatacggtctatctggaaatgaacagcctgagagccgaggacacggccctctattactgtgcgagagatcagacggatatagcagcagctctgactacgtgggccaacggacctggtcaccgtctcctcacgccctaccaccgaacggcccacgtccggttcccttccccgtcggcccacccctcctacccgaacgacgccaccgtcgtcggggccacgacggccggcccgtgggcctcgccgtcggtacgaacggtaccttaccttcctactccgtaactaccttaccgtcggtacggcggcgtcggacgacggacgacgtagtacg

SEQ ID NO: 79161 - DNA, 734 bp, Homo sapiens
  misc_feature: GYAE6OF02H24T4.37.26.C04.1.454.CMB.1.raw
  modified_base (413)..(413): a, c, t, g, unknown or other
  misc_feature (413)..(413): n is a, c, g, or t
tcagtagtgtagatcacgaccggtgctcgatttagtctagcgactttgggtttgggggaggcttggtacagcctgggggtccctgagactctcctgtgcagcctctggtttcatctttagcaactacgccatgagctgggtccgccaggctccgaggggaaggggctggagtgggtctcaggtattacgtggtaggtggtaaataccgcatactaccgcagacctccgtggacgggcccggtttcaccgtctcccgagacgacaacgttccaaaggtaacttacgggtacctaattcgttagggaaaatcggaaacaggcctagaacgagcccggaaggaccgtaaccgggcccttacttaattaaccgttggtcgacgaggtaagacgtcaaggacggtaagtaacgagacnggacacggcttctacggacttacggtcggggacccaaacggaccttggacctaccgtcctcctacgaccgtccgtaccaccgaacgggacccacgtccggttcccttcccccgtcggacccaccccggttcccaccgttaaaccggacgacctaccccggttcggcgggggtacccacggacggccccgggtccccgttaggggcctaccgttcccgaggggtttacccgaaacggtaccctttaccgttacccttacgtacctaaccaccgttaccgacggaccggccgggtctcgggacgtaaccgggctacaagtcgg

SEQ ID NO: 79162 - DNA, 611 bp, Homo sapiens
  misc_feature: GYAE6OF02I2ARL.37.26.C04.1.454.CMB.1.raw
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctgggagtgggtctcaggtattactggtagtggtaataccgcatactacgcagactccgtgacgggccggttcaccgtctccagagacaattccaagaatacggtctatctggaaatgaacagcctgagagacccgaggacacggccctctattactgtgcggagagatcaggacggagtagtagcagcagctctgactacgtggggcccaacggaaccctggtcacccgtctccctcacgccgtacccaaccgaaccgggccccacgtccgggtcccttcccccgtcggccctacccctccctaccctaacgaccgccacccgtcgtcggggaccacgacgcccggccgtcgggctcgccgtggtcaacggaccttaccgttccacgttacctaccgtaccttacgtgacggccgggtcacgggccgaacgggcgtacgagtacgg

SEQ ID NO: 79163 - DNA, 790 bp, Homo sapiens
  misc_feature: GYAE6OF02GSPTK.37.26.C04.1.454.CMB.1.raw
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccgagggaaggggctggagtgggtctcaggtattactggtagtggtaataccgcatactacgcagactccgtgacgggccggttcaccgtctccagagacaattccaagaatacggtctatctaggaaatgaacagcctgagagccgaggacaccggccctctattactgtgcgagagatcgagacggagtataggcagcaggccttcgtagtaaccttacggtcgggggacccaaccggggtaaacccctggggtaccctaacccggttcccttccccgtaccgaaccgtccccgttaccccgaaccccgaaacccggggtacccccgtaccgtttccccgggttcccctttaccccccgtccgggtacccctacccccttcccgtaacccgaaacggtaccgtacccgtaaccccggtccgggtacgggggacctaacccggaccgggacccgggtccccggtcggggtcccgttaccggtcccggttacgggtacccgtaaaacggtacccttaacccgtttacccgtaaccttacccgttaaacccgtaacccgttaaccgtacgggtaaccgggtacccggggtacccggttacggggtaacccggaaccggggtccgtacggtaacgtacgg

SEQ ID NO: 79164 - DNA, 575 bp, Homo sapiens
  misc_feature: GYAE6OF02IS77K.37.26.C04.1.454.CMB.1.raw
  modified_base (235)..(235): a, c, t, g, unknown or other
  misc_feature (235)..(235): n is a, c, g, or t
  modified_base (575)..(575): a, c, t, g, unknown or other
  misc_feature (575)..(575): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtgggtctcaggtattactggtagtggtaataccgcatactacgcagactccgtgacgggccgttnaccgtctccagagacaattccaaagaatacggtctatctggaaatgaacagcctgagagccgaggacacggccctctattactgtgcgagagatcagacggagtatagcagcagctctgactactggggccacggaaccctggtcaccgtctcctcagcctccaccaaggcccatcggtccttccccgtcggccacccctcctacccaacgacgccacctccgtgggggaaccacggaccggcccgtccgggccgtcggtccgtcggtccgtaacggaacgtaccttacctactacgtacctaactacctcgtaagccggcgtcgcgagacgcacgtagn

SEQ ID NO: 79165 - DNA, 717 bp, Homo sapiens
  misc_feature: GYAE6OF02F5YFC.37.26.C04.1.454.CMB.1.raw
  modified_base (325)..(325): a, c, t, g, unknown or other
  misc_feature (325)..(325): n is a, c, g, or t
  modified_base (342)..(342): a, c, t, g, unknown or other
  misc_feature (342)..(342): n is a, c, g, or t
tcagtagtgtagatcacgaccggtgctcgatttagtctagcgactttgggtttgggggaggcgttggtacagcctggggggtccctgagactctcctgtgcagcctctggtttcatctttagcaactacgccatgagctgggtccgccaggctccagggaaggggctgggagtgggtctcgaggtattacgtggtagtggtaataccgcatactacgcagactccgtgacgggccgttcaccgtctccagagacaattccaaagaatacggtctatctaggaaaatgaacagtcctaggagacgaccggaggaccaccggccctntaattcctggtgcgaanagatcgaaggacggatatagcgagcacgctcgtacgacttacgcggggcccaaacggggtaacccctggggttactaccccggtcccttccccgtcgaaccgccctacccgtaacccggaaaccgggacccctagttaccggttcccctttacccccggtaccgtcccccgtacccctccccttaccgaaaccggaccgtaccctacccgtacgggtcgggggtaccacggaccggacccgggtcccggtccggggtaccgtcgggtacccgttcggtaccgtaaacggaccttacccgttactacccgttaactaccctaaccttccgacggtaccgcgggtacccgtacggaccgaacggccgacgtacgtag

SEQ ID NO: 79166 - DNA, 998 bp, Homo sapiens
  misc_feature: GYAE6OF02HLR5T.37.26.C04.1.454.CMB.1.raw
  modified_base (146)..(146): a, c, t, g, unknown or other
  misc_feature (146)..(146): n is a, c, g, or t
  modified_base (208)..(208): a, c, t, g, unknown or other
  misc_feature (208)..(208): n is a, c, g, or t
tcagtagtgtagatcacgaccggtgctcgatttagtctagcgacttttgggtttgggggaggcttggtacagcctggggggtccctgagactctcctgtgcagcctctggtttcatctttagcaactacgccatgagctgggtccnccaggctccgagggaagggctggagtgggtctcaggtattacgtggtagtaggtaataccgnacttacacgacagacctccggtggacgggtccgttcacccggtctccgagacgactaacttccgaaaaggtaagttaccggtactaagttaccgtaaggaaaattggaaacctacggaccctaggacggaacggcccggaaggaaccgacccgggccccttaccgttaatttaacccgtggttacgaccggtaaggtacgaaacttaccggaaaggtaaccgggtaaggtaacgtacggacgaacggtcacggtccttaccgtaggtaaccgttaccgggtaccgggggtaaccctaaaccccgggggttaacccgttaccggggtaccctaaccccgttccgttaccccgttaccggtaacccgcccgttaacccccgaaaccccgggtaaaccccggggtaccccgttaaccccgggttcccggggttttccccccgttaccccccgggttacccgggtaccccccgttaacccccccgttaccccgtttaacccggaaaacccggtacccggttaacccccggttaacccggttaccggggttaaccggggtacccgaaccggtaacccggggtaccccggggtcccgggtaccggggtcccgttcccgggtaccccgggttacgggtacccggttaaaaccgttaccgttaacccgtttacccgttaacccgttacccggttaaacctaacccggtttaacggtacccgggtaccgggggttaacccggtccgggttaaccgggacccggtaaaacggggtcccgttaacccggtaggtaacccgg

SEQ ID NO: 79167 - DNA, 785 bp, Homo sapiens
  misc_feature: GYAE6OF02I7PFH.37.26.C04.1.454.CMB.1.raw
  modified_base (313)..(313): a, c, t, g, unknown or other
  misc_feature (313)..(313): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtgggtctcaggtattactggtagtggtaataccgcatactacgcagactccgtgacgggccgttcaccgtctccagagacaattccaagaatcggtactatcgtaggaaatgaacagcctagagagccgaggacacggccctntatactgtgacgagagactacgaggaaccggtagtaagtacgacagacacggtcctacgtacgaactaccggtcggggacccgaaccgggtaacccgttcggtaccgtaacccgtcctcccgtaccacggcccctacccgaacccggtaaccgggacccctaaccggttcccggttccccgttaccccccgtacggtacccccgtacccccttaccccgtacccgtaaaccggaccgtacccgtacccgttaccgggtacgggggacccaccggtaaccgggtccccgggtacccggtcggggtcccgttacccgggtacccggttaccggggtaacccgaaaaccgggttaccctttaaccccgttaccctaaccgtttacccgttaacccgtaaccgttaccgggtacggaccgggtaccgggttcccgtacggggtaaccgaccggggtacccgtacggtacgtaacgg

SEQ ID NO: 79168 - DNA, 659 bp, Homo sapiens
  misc_feature: GYAE6OF02HBODC.37.26.C04.1.454.CMB.1.raw
  modified_base (301)..(301): a, c, t, g, unknown or other
  misc_feature (301)..(301): n is a, c, g, or t
  modified_base (449)..(449): a, c, t, g, unknown or other
  misc_feature (449)..(449): n is a, c, g, or t
  modified_base (486)..(486): a, c, t, g, unknown or other
  misc_feature (486)..(486): n is a, c, g, or t
  modified_base (649)..(649): a, c, t, g, unknown or other
  misc_feature (649)..(649): n is a, c, g, or t
tcagtagtgtagatcacgaccggtgctcgatttagtctagcgactttgggtttgggggggaggcttggtacagccgtccggggggtccctgagactctcctggtgcagcctctggttcatctttagcaactacgccatgagcgtgggtccgccaggccgtccgaggggaaggggctggagtgggtctcgaggtattactggtagtggtaactaccgcatacacgcagactccggtgacgggccggttcaccgtctccagagacaattccaagaatacggtactatctaggaaatgaaaccngtcctgagagccgagggaccaccggtccctattattacctggtcgacggaagagataccaggaacggtattaagaggcaagtcaggtacttcgacgacttacggcggggacccgaaccggtaccctgggtccacccgtctcctcgacnccctacaccgacggccaccgtccgttccccttacccncgtaccctccccgtcctaaccgaacgccaccgtaccgtcggtcgggccaacgtcggcccgtaccggtcgccggtcgaccgtcggacgtaaccgtacctaccgtcctctaaccgtctacgtacgtcggtccggtacgggtacgtacgggacaaccggggtaccncggtaagcgg

SEQ ID NO: 79169 - DNA, 539 bp, Homo sapiens
  misc_feature: GYAE6OF02G9BW1.37.26.C04.1.454.CMB.1.raw
  modified_base (439)..(439): a, c, t, g, unknown or other
  misc_feature (439)..(439): n is a, c, g, or t
  modified_base (460)..(460): a, c, t, g, unknown or other
  misc_feature (460)..(460): n is a, c, g, or t
  modified_base (509)..(509): a, c, t, g, unknown or other
  misc_feature (509)..(509): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtgggtctcaggtattactggtagtggtaataccgcatactacgcagactccgtgacgggccggttcaccgtctccagagacaattccaagaacacactgtctctgcaaatgaacagcctgagagtcgaggacacggccttatattactgtgtgaagggacctctagccccttatagcagcggctggtcctggtactttgacgactggggccagggaaccctggtccaccgtctcctcagccctccaccaagggcccatcgtcttccccnggccgccctgcctccgaggcncacctcgagcgcacagccgcctgggctgcctggtcaaggactacttccntcctacactactcgagcgggctggcaacgg

SEQ ID NO: 79170 - DNA, 582 bp, Homo sapiens
  misc_feature: GYAE6OF02GAK2O.37.26.C04.1.454.CMB.1.raw
tcagtagtgtagatcacgaccggtgctcgatttagtctagcgactttgggtttgggggaggcttggtacagcctgggggggtccctgagactctcctgtgcagcctctggtttcatctttagcaactacgccatgagctgggtccgccaggctccagggaagggggctgggagtggggtctcaggtattactggtagtggtaataccgcatactacgcagactccgtgacgggccggttcaccgtctccagagacaattccaaagaatacggtctatctggaaatgaacagcctgagagccgaggacacggccctctattactgtgcggagagatcagacggagtatagcagcagctctagactacgtcggggaccacggaaccctggtccaccgtcctcctcacgcctccacgaacggcccactccggtccttccccgtcggccaccctccctaccaacgacgccacctcgtcggggcacgacgccggcccgtcgggcctcgtccgtaggtcgaacggaccttaccttaccatacctaaccacttacgtgacggcgggcgtcggacgacggcgacagtacg

SEQ ID NO: 79171 - DNA, 677 bp, Homo sapiens
  misc_feature: GYAE6OF02FW4UW.37.26.C04.1.454.CMB.1.raw
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccaggggaaggggctggagtgggtctcgaggttattactggtagtggtaataccgcatactacgcagactccgtgacgggccgttcaccgtctccagagacaattccaagaatacggtctatctggaaatgaacagcctgagagccgaggacacggccctctattactgtgcgagagatcagacggagtagtacgacagcacgctcgtagaccttacggtcgggggaccaaccgggaaccctggtaccacccgttctccctccacgccctcccaacccgaacggccccaacgtcccggttacccttcccccgtcggtcccctaccccgttacccctacccgaaacgacgtccaacccgttcggtaccgggggacctaaccgacgggcccggtcccgtcggggtcctacgggtcccgttcgggtaccgaacggtaccgttaccgttacccacgttacctaaccgtaaccttaccggtacggaccgggtccggtcggttacggaccgaacgggtccgacgtagtacg

SEQ ID NO: 79172 - DNA, 660 bp, Homo sapiens
  misc_feature: GYAE6OF02HFPJY.37.26.C04.1.454.CMB.1.raw
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtgggtctcaggtattactggtagtggtaataccgcatactacacagactccgtgaagggccggttcacatctccaggacaattccaaagaacacactgtctctgcaaatgaacagcctgagagtcgaggacacggccttatattactgtgtagagggacctctacgcccttatagcagcgcgtggtcccgtggttacttcgacgtacgtcggggccgaacggggtaaccctggtaccacccggtcctcccgtccgaccgccctacccgaacccgaacgggcccctaacgttcccgggttacccgttcccccgtcgggccctacccccgtccctacccgaacgaccgacctacccgtcggtcggggtaccacgacggcccggcccgtcgggccgtccggccgtacggtaccgaacggtacccttacgtaccctactaccttaccacttaccgtaggaacggcgggtccgtagggaccgtacgggccgtacg

SEQ ID NO: 79173 - DNA, 625 bp, Homo sapiens
  misc_feature: GYAE6OF02IPXME.37.26.C04.1.454.CMB.1.raw
  modified_base (314)..(314): a, c, t, g, unknown or other
  misc_feature (314)..(314): n is a, c, g, or t
  modified_base (396)..(396): a, c, t, g, unknown or other
  misc_feature (396)..(396): n is a, c, g, or t
tcagtagtgtagatcacgaccggtgctcgatttagtctagcgactttgggtttggggggaggcttggtacagcctggggggtccctgagactctcctgtgcagcctctggtttcatctttagcaactacgccatgagctgggtccgccaggctccaggggaaggggctggagtgggtctcaggtattactggtagtggtaataccgcatactacgcagactccggtgacgggccgttcaccgtctccagagacaattccaagaactacggtctatctaggaaatgaacagcctgagagcgaggacacggccttntattctgtgcgagagacgtcagacggagtatagcagcagcctgctactcggtcgggaccacggaccctggtaccaccgtccncctcgcgcctccaccgtaacggccacgtcccgttcccttccccgtcgcccgtacccctcccgtacccgaacggacgacctaccgtccggtacggggccaccgcggacccggtcccggtcgggccgtcgtacccggtggtacgtaaccgtaccgttactccctactaccttaacctaaccgttacgcgtacgggccggtcggtacggccgacgggtaccgacgtagtagg

SEQ ID NO: 79174 - DNA, 722 bp, Homo sapiens
  misc_feature: GYAE6OF02HVUUQ.37.26.C04.1.454.CMB.1.raw
  modified_base (243)..(243): a, c, t, g, unknown or other
  misc_feature (243)..(243): n is a, c, g, or t
  modified_base (260)..(260): a, c, t, g, unknown or other
  misc_feature (260)..(260): n is a, c, g, or t
  modified_base (285)..(285): a, c, t, g, unknown or other
  misc_feature (285)..(285): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccgaggggaagggctggagtgggtctcgaggtattactggtagtggtaatccggcatactacgcagactcggagacggtccgtcaccgtcncgagagacaactcgaanagtacgtctatcgtaggaatcaacngctgagacgtcgagtaacgcgtccctattacttactggtcgacgagatactacgaggacggattagtacgacagacacgtccttagcgtaacgtcggaccgggtaccaaaccgggtaccgtggttacccgacccgttctacccgtacgacccgttcccgtaccgaacccggtaaccgggtaccccgttacggtttcccggttcccgtttaccccacgggaccccctaccccgtacctaacccggtaaacggaccgtacccgtaccggtcgggtacggggcccaacggtacccgggaccgtcccggtcgggcctacccggtccggttaccgggaacgtaaccggttacttaccgttacctacttacccgtaacctaaccgttacggtacggtaccgggcccggtacggtcggaaccggtaacggtccgagtacgtacg

SEQ ID NO: 79175 - DNA, 590 bp, Homo sapiens
  misc_feature: GYAE6OF02I3II5.37.26.C04.1.454.CMB.1.raw
  modified_base (245)..(245): a, c, t, g, unknown or other
  misc_feature (245)..(245): n is a, c, g, or t
  modified_base (251)..(251): a, c, t, g, unknown or other
  misc_feature (251)..(251): n is a, c, g, or t
  modified_base (309)..(309): a, c, t, g, unknown or other
  misc_feature (309)..(309): n is a, c, g, or t
  modified_base (317)..(317): a, c, t, g, unknown or other
  misc_feature (317)..(317): n is a, c, g, or t
  modified_base (323)..(323): a, c, t, g, unknown or other
  misc_feature (323)..(323): n is a, c, g, or t
  modified_base (325)..(325): a, c, t, g, unknown or other
  misc_feature (325)..(325): n is a, c, g, or t
  modified_base (333)..(333): a, c, t, g, unknown or other
  misc_feature (333)..(333): n is a, c, g, or t
  modified_base (347)..(347): a, c, t, g, unknown or other
  misc_feature (347)..(347): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccgaggggaaggggctggagtgggtctcaggtattactggtagtggtaataccgcatactacgcagacctccgtgacgggccgttcaccgtcnccaganacaattccaagaactacggtctatctaggaaatgaacagcctgagacgccgaggaccncggccctntattcngngacgaganatcgagacggatanagcagacagctacgtacgacgtacggcggggacccaacgggtaaccctggtaccctaccgtcctaccacgacgccctaccgaaccgacggccctacgtcccgtcccttcccgcggcccaccctccgtaccaacgcgcctaccgtcggcgggacacgacgccgccgtggctcgactcggacacgtactactcactactacacgtacgcggacggcggtacgacggacgtacggcgtacgagtcg

SEQ ID NO: 79176 - DNA, 645 bp, Homo sapiens
  misc_feature: GYAE6OF02IXORX.37.26.C04.1.454.CMB.1.raw
  modified_base (236)..(236): a, c, t, g, unknown or other
  misc_feature (236)..(236): n is a, c, g, or t
  modified_base (256)..(256): a, c, t, g, unknown or other
  misc_feature (256)..(256): n is a, c, g, or t
  modified_base (377)..(377): a, c, t, g, unknown or other
  misc_feature (377)..(377): n is a, c, g, or t
  modified_base (387)..(387): a, c, t, g, unknown or other
  misc_feature (387)..(387): n is a, c, g, or t
  modified_base (398)..(398): a, c, t, g, unknown or other
  misc_feature (398)..(398): n is a, c, g, or t
tcagtagtgtagatcacgaccggtgctcgatttagtctagcgactttggggtttgggggaggcttggtacagcctggggggtccctgagactctcctgtgcacgcctctggtttcattctttagccaactaccgccatgagcgtgggtccgccagggcctccgaggggaaggggctgggagtgggtctgaggtattacgtggtagtaggtaactaccgcatacacgcagactccgnggacgggccgttcaccgtcncagagacaattaccaagaatacggtctatcgtaggaaatgaacagcctggaagacgaccggaaggacctaccggcccttataattacgtgcggacgagtagactgaggacggagtacaganagcagtcctnagtactacggngggacccaacggtaaccctggccaccgtctccacgacgtccctaccaaccgacgggaccctacgtccggttccctcccgtcggccctaccctcctaccgaacgaccgccaccgtcgggtcgggaccaccgaccgggcccggtcccgcgggtcctacggtccgtcggtaaccgaaacggtacctacccttacgactacctaacctacctacgtcgacggtcggacgtcggacgacgggtccagacagg

SEQ ID NO: 79177 - DNA, 606 bp, Homo sapiens
  misc_feature: GYAE6OF02FGTBP.37.26.C04.1.454.CMB.1.raw
  modified_base (206)..(206): a, c, t, g, unknown or other
  misc_feature (206)..(206): n is a, c, g, or t
  modified_base (309)..(309): a, c, t, g, unknown or other
  misc_feature (309)..(309): n is a, c, g, or t
  modified_base (313)..(313): a, c, t, g, unknown or other
  misc_feature (313)..(313): n is a, c, g, or t
  modified_base (599)..(599): a, c, t, g, unknown or other
  misc_feature (599)..(599): n is a, c, g, or t
  modified_base (604)..(604): a, c, t, g, unknown or other
  misc_feature (604)..(604): n is a, c, g, or t
tcagtagtgtagatcacgaccggtgctcgatttagtctagcgactttgggtttgggggaggcttggtacagcctgggggtccctgagactctcctgtgtagcctctgaattcccctttacggcttattggatgagctgggtccgccaggctccagggaaggggctggagtgggtggcaacataaagcaagatggaagtaagaaggngtaatgtggactctgtgaagggccgtttcaccatctccagagacaacgccaagaactccgtgcatctgcaaatgaacagtctgagagccgaggcacgctattntacngcgcagagaaggctgggcgtttcgactacgtggggccaggggaccctggcaccgtctcccgcacgccctacgaaccgaacgggccccagtccggtcctcccccctggtccgccctgcctacccgacggacgccacccgtccgacgacggccaacgacggccggcccttggggcctcggccttacggggtaccaaacgggtacctaacgtttcccaataccctacctaacgttaccgtgaacgggtcgggtcctagggacccgtaagggcccgacgagttaacggcngcgtngc

SEQ ID NO: 79178 - DNA, 727 bp, Homo sapiens
  misc_feature: GYAE6OF02HUJ2O.37.26.C04.1.454.CMB.1.raw
  modified_base (367)..(367): a, c, t, g, unknown or other
  misc_feature (367)..(367): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccgaggggaaggggctggagtgggtctcaggcattagtattgatggtgataccacatactacgcagactccgtgaacgggtccgtttaccatctcagagacaagtccaagaacacgctgtatctgacaaaatgaacagcctagagagccgaggacacggccgtattattactgttacgaaagtataggtactgtggttcggcgttaactttttancgttcattcctttacgacctacgtcggggacctaacggggtaaccccttgggtccctaccgttccttaccctacgaccgtacccctaccgaacccgtaaccggggcccctaacggttcccggtcccctttcccccgtcgggtccccgccccgttcgtcccgtaccgacgggaccgacccgtaacccgtccggaacggaccgccgaacccgtaccggcccgggtcccggtacgggtcctaccggtcccgttacgggtaccggtaaaccggtaccttaacccgtttccaacccgtttaccgtaacccgtaacctttaccggaccgggtaccgggtccgggtaccggtaccgggtaacccggg

SEQ ID NO: 79179 - DNA, 746 bp, Homo sapiens
  misc_feature: GYAE6OF02IC12A.37.26.C04.1.454.CMB.1.raw
  modified_base (346)..(346): a, c, t, g, unknown or other
  misc_feature (346)..(346): n is a, c, g, or t
  modified_base (358)..(358): a, c, t, g, unknown or other
  misc_feature (358)..(358): n is a, c, g, or t
  modified_base (494)..(494): a, c, t, g, unknown or other
  misc_feature (494)..(494): n is a, c, g, or t
  modified_base (744)..(744): a, c, t, g, unknown or other
  misc_feature (744)..(744): n is a, c, g, or t
tcagtagtgtagatcacgaccggtgctcgatttagtctagcgactttgggtttgggggaggcgttggtacagcctggggggtccctgagactctcctgtgcagctctggttcatctttagcaactacgccatgacgctggggtccgccgaggctccgaggggaagggtctgggaggtgggtctacgaggttattactgggtagtggtaactaccggcattactacgcgagtacgtccggtgacgggccggttcaccgtctccaggtacacaattccaagtaactcggttactatcgtaggaaatgaaacacgtcctggagacgccgaaggaccgaccggtcccctnttaaactttcgngggtcgcggaaagcgacgtacgaagggaacgggattaggtacgacgacggactacgacgttacgtaaggtaccgtaacgggttcgggggaaccccttaaaccgggtaaccccgtttgtacccgtaacccccggttntacccctcgaaccggtccccacccggtaaccgtaaccggggacccctacgttcccggttaccctttccccgtacgggtaccctacccgtacccgttaccgaaaccggtacacccgtaccgtaccggtcgggaccgtaccgtaccgggccggtacccgtacgggtccgcgtcccgtacggtaacgaacggtacccgtacgtcctacgtacaccgtacgtacgtgtacggcggtgacgacgacggcacgtancg

SEQ ID NO: 79180 - DNA, 583 bp, Homo sapiens
  misc_feature: GYAE6OF02ITBN9.37.26.C04.1.454.CMB.1.raw
  modified_base (362)..(362): a, c, t, g, unknown or other
  misc_feature (362)..(362): n is a, c, g, or t
  modified_base (433)..(433): a, c, t, g, unknown or other
  misc_feature (433)..(433): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaaatacgccatgatctgggtccgccaggctccagggaaggggctggagtgggtctcagccatttccggcaatggtggtggcacgcactacgcagactccgtgaagggccggttcaccgtctccagagacaattccaggaacactctatatctgcaaatgaacagcctgagagccgacgacacggccatatattattgtgcgaaagaccccaaggtgaccacattggagtcttttgacttntcggggccaagggacaacggtcaccgtctcttcagcctccaccgaagggcccagtccggtccttcccccgnggccgtccctgcctcccgaggacgcctaccgtccgacgacgccaccacggccggcccgtgggccttcggccctgggtaccaagggtaccttaccttcccgattcctaacaccttacgtggcggacgggtcctcgggaccaacggtcgacg

SEQ ID NO: 79181 - DNA, 591 bp, Homo sapiens
  misc_feature: GYAE6OF02IPDKP.37.26.C04.1.454.CMB.1.raw
  modified_base (346)..(346): a, c, t, g, unknown or other
  misc_feature (346)..(346): n is a, c, g, or t
  modified_base (354)..(354): a, c, t, g, unknown or other
  misc_feature (354)..(354): n is a, c, g, or t
  modified_base (563)..(563): a, c, t, g, unknown or other
  misc_feature (563)..(563): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaagggctggagtgggtctcaggtattacgtggtagtggtaataccgcatactacgcagactccgtgacgggccgttcaccgtctccagagacaattccaaagaatacggtctatctaggaaatgaacagtcctgagacgccggaggacacggccatctattactgtgcgagagatcaggacggagtanagacagcngtctctagactacgtcgggaccaacggaccctggtccacgtcctctcgacgtccctaccgaccgaacgggacccacgtccggttccgttccccgtcggaccctacccctccgtaccgtaacgacgaccgtaccgtcggtcggggcaccgacgccggccgtcggcgtcgtcgtcggtacgacggtacctactcgacgtctaccactacgngacggtcggcgtcgacgtacggcgatag

SEQ ID NO: 79182 - DNA, 857 bp, Homo sapiens
  misc_feature: GYAE6OF02IOOI1.37.26.C04.1.454.CMB.1.raw
  modified_base (107)..(107): a, c, t, g, unknown or other
  misc_feature (107)..(107): n is a, c, g, or t
  modified_base (210)..(210): a, c, t, g, unknown or other
  misc_feature (210)..(210): n is a, c, g, or t
tcagtagtgtagatcacgaccggtgctcgattttagtctagcgactttgggtttggggggaggcttggtacagcctggggggtcctgagactctcctgtgcagcctntggttcatctttagcaactacgccatgagcgtgggtccgccaggtctccgaggggtagggcttggagtgggtctcgaggtattactggtagtggtaatccggntatacgtacggcagactccgtgaccgggtccggttacaccgtctaccaggacgactaacttccgaaagaattaccggtctatcgtaggtaaaactgaacagcctagagagccggagacaccgggcccttataacttaccgtggtacgacggtaagaggtacgttaccggaagggtaaccgggtaaggtttaacgtaagaccgtaaggcgtaaggtccttacgtacgtaaccgttacggttcggggaccctaacggggtaaccctggtacccaaccggttcgtacccgtacgaccgtaccccgtacccgaacccgtaaaccggtccccgtaacggttacccgggtttaccccgtttaccccccgtagggtaacccccgtaacccccgttacccgttaaccgtaaacggtaaccggtaccccttaacccggttcgggtacccgggggtacctaaccggtaaccgggtacccgggtccccgggtacgggaccggttacgggttacccgtttacgggttaaccgaaaacgggttacccgttaacccgtttacccgaacgttacccggtaaacgttacccggttaaccgttagggaccggtaccgggtaccggttaccgggtaacgaccgggtacccggttacgacgtacgg

SEQ ID NO: 79183 - DNA, 690 bp, Homo sapiens
  misc_feature: GYAE6OF02IHKI3.37.26.C04.1.454.CMB.1.raw
tcagtagtgtagatcacgaccggtgctcgatttagtctagcgactttgggtttgggggagggcttggtacagcctgggggggtccctgagactctcctgtgcagcctctggtttcatctttagcaactacgccatgagctgggtccgccaggctccagggaaggggctggagtgggtctcaggtattactggtagtggtaataccgcatactacgcagactccgtgacgggccggttcaccgtctccagagacaattccaaagaactacggtctatctaggaaatgaacagcctgagagcgaggtaccacggccctatacttactgtgcgagagatcaggacggtaatatagcagcagctctgacctacggtcgggaccaaccggtaacccgtcggtacccaccgttccgtccctacgaccgccctacccgaccgaaccgggcccctacggtcccgttcccgttacccccgtcggcccctaccccgttccctaacccgaacgtacgaccctacccgtaccggtcggggacctaccggccggacccgggtcccggtcgggtcctccggtacccgttaggtaccgtaaacggtacccttaccgttacccgtacttacccgtaacgtaccgttacggttacggaccgggtacgggtccgttacgggaccggaacgggcccgtacgtagtacgg

SEQ ID NO: 79184 - DNA, 598 bp, Homo sapiens
  misc_feature: GYAE6OF02FMF11.37.26.C04.1.454.CMB.1.raw
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtgggtctcaggtattactggtagtggtaataccgcatactacgcagactccgtgacgggccggttcaccgtctccagagacaattccaagaatacggtctatctggaaatgaacagcctgagagccgaggacacggccctctattactgtgcgagagatcagacggagtatagcagcagctctgactacgtggggccacggaaccctggtcaccggtctccctcacgccctccaccaacggcccacgtccggtccttcccccgtcggccctaccctccctacccaagacgccacccgtcgtcggggccacgacggccggtcccgtgggccgtcgtccgtcggtacgaacggtacgtaccttccactccgtaaccaccttacgtcggtaccgcggggtcgtacggaccgtaacgggccgtacgagtagg

SEQ ID NO: 79185 - DNA, 668 bp, Homo sapiens
  misc_feature: GYAE6OF02I82IT.37.26.C04.1.454.CMB.1.raw
  modified_base (342)..(342): a, c, t, g, unknown or other
  misc_feature (342)..(342): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtgggtctcaggtattactggtagtggtaataccgcatactacgcagactccgtgacgggccggttcaccgtctccagacgacaattccaagaatacggtctatcgtggaaatgaacagctgagagccgaggacacggccctctattctgtgcgagagatcgagacggagtanagcagcagctctgactacgtgggaccacggaccttggtaccaccgttcctaccctccgacgtcccctacccgaaccgaaccggcccctacgtcccggtacccttcccccgtacggccctaccccgtcccgtaccaacgacgcctacccgtccggtcggggacctaccggagggcccggtcccgacgggtccgtaccggtccgtaggtacccggaaacgggttaccttacccgttaccgtacgttacccgttaacctaaccgttacggtaacggttaccggccggggtaccgtcgggaccggttaacgggccgttacggaacgtacg

SEQ ID NO: 79186 - DNA, 848 bp, Homo sapiens
  misc_feature: GYAE6OF02H9MSM.37.26.C04.1.454.CMB.1.raw
  modified_base (484)..(484): a, c, t, g, unknown or other
  misc_feature (484)..(484): n is a, c, g, or t
  modified_base (491)..(491): a, c, t, g, unknown or other
  misc_feature (491)..(491): n is a, c, g, or t
  modified_base (515)..(515): a, c, t, g, unknown or other
  misc_feature (515)..(515): n is a, c, g, or t
  modified_base (558)..(558): a, c, t, g, unknown or other
  misc_feature (558)..(558): n is a, c, g, or t
  modified_base (669)..(669): a, c, t, g, unknown or other
  misc_feature (669)..(669): n is a, c, g, or t
tcagtagtgtagatcacgaccggtgctcgatttagtctagcgactttggggtttggggggaggcgttggtacgagccctggggggtccctgagacgtctccgtgttcgctaggcctctggttcatctttagacaactacgccgatgacgcgtggggtccgtccgaggctaccgaggggtacggggtctggaggtggtctagaggttattacgtgggtatcggtaaagtccgctaagtacgtacggcgtaggtacttccggggtaggacccggggtccgggttaccaccggttccaccgggtaacggtaccgaacgtaacttacccgaaaggtacttacgggtacctagtacgtcgggttaaaagtcggaaacctacggtacctttaggaacgtagggcccggtaagggtaaccgccgggtaccccttagtaacgtttacgtcggtcggaccgaagacgtacgacgaggaggggtacagtacggngacgacnggacttcgaggtaccttaacgggnggggtaacccaaaacgggttccgtggtaaccgtaacccggttntccccggttagaacccgtccgttacccgaaccggtaacggccccgtaagtcccgttaccgttcccctacgggtcccaccctaccaccgtaaacggacgtaccttaacccgnggtacccggcaaacggtcccggacccggtaccggcggtccgtccgtaccgtacggggtaccgaaaccggtccgttaaaccggtcctaccctaccgtaacggttaacgtcccggttaacgggtaccgtaccgggggtacgttcccggaaacggacgggtaccgttacgaccggtaaccgg

SEQ ID NO: 79187 - DNA, 605 bp, Homo sapiens
  misc_feature: GYAE6OF02I1GN7.37.26.C04.1.454.CMB.1.raw
  modified_base (360)..(360): a, c, t, g, unknown or other
  misc_feature (360)..(360): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccgagggaaggggctggagtgggtctcaggtattacgtggtagtggtaataccgcatactacgcagactccgtgacgggccgttcaccgtctccagagacaattccaagaatacggtctatctaggaaatgaacagcctgagacgccgaaggacacggccctgtattactgtgcgagagactcgaggacggagtatagcaagcagctntagactacgtcggggaccaacggtaaccgtggaccaccggtctccgtcacgtcctaccgaaccaacgggaccctacgtaccggtcccttcccgcggtccctacccctcctaccaacgacgccgtaccgtccgtcgggaccacgacggcccggtcccgtcggccgtcgccgtggtacaacggtacctactccatcctaacgtacctactacgacggcggacgtcggacaacgggcgtacgagtacg

SEQ ID NO: 79188 - DNA, 571 bp, Homo sapiens
  misc_feature: GYAE6OF02IMFJV.37.26.C04.1.454.CMB.1.raw
tcagtagtgtagatcacgaccggtgctcgatttagtctagcgactttgggtttgggggaggcttggtacagcctgggggggtccctgagactctcctgtgcagcctctggtttcatctttagcaactacgccatgagctgggtccgccaggctccagggaaggggctggagtgggtctcaggtattactggtagtggtaataccgcatactacgcagactccgtgacgggccggttcaccgtctccagagacaattccaagaatacggtctatctggaaatgaacagcctgagagccgaggacacggccctctattactgtgcgagagatcagacggagtatagcagcagctctgactacgtggggccacggaaccctggtcacccgtctccctcacgcctcccaccgaacgggcccagtaccggttcccttccccgtcggacccacccctccctaccaacgacgccacccttcgtcggggccacgcgccggccgtcgggctcgcctggtacaacggtctacttccattaccacactactacgtggcggcctgggccagggccacgagtcg

SEQ ID NO: 79189 - DNA, 645 bp, Homo sapiens
  misc_feature: GYAE6OF02JUXND.37.26.C04.1.454.CMB.1.raw
  modified_base (240)..(240): a, c, t, g, unknown or other
  misc_feature (240)..(240): n is a, c, g, or t
  modified_base (489)..(489): a, c, t, g, unknown or other
  misc_feature (489)..(489): n is a, c, g, or t
tcagtagtgtagatcacgaccggtgctcgatttagtctagcgactttgggtttggggtagggcgttggtacagccgtgggggtcccgtgagactctcctgtgcagcctctggtttcatctttagcaactacgccatgagctgggtccgccaggctccagggaaggggctggagtgggtctcaggtattactggtagtggtaataccggcattactacgcagactccgtgacgggccgttnaccgtctccagagcaatccaagatacgctatctacggaatgaacagcctagacgagccgaggacacggccctgtactactcgtgcgagagatacagaccggagtatagacacgcagctagcgtactacgtcgggacaacggacccgttgtacgaccgtcgtccctacgacgtccctaccgaaccgaccggacccacgtcggtacccttcccgacgtcccgtacccctcccttaccgaaccgcgtacccnccgtccgtacgggtccgaacgacggacccgcccgtaccgggcgttccggaccgttccggtacggaaaccgtaccgttaacctttcccggaacttaccgtaacctaccgtacgtcgaacggtccggtacgtcgggccgtaacggcgacgtctaacgg

SEQ ID NO: 79190 - DNA, 596 bp, Homo sapiens
  misc_feature: GYAE6OF02FYTJO.37.26.C04.1.454.CMB.1.raw
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtgggtctcaggtattactggtagtggtaataccgcatactacgcagactccgtgacgggccggttcaccgtctccagagacaattccaaagaatacggtctatctaggaaatgaacagcctgagagccgaggacacggccctctattactgtgcgagagatcagacggagtatagcagcagctctgactacgtggggccacggaaccctggtccaccgtcctcctcacgccctacccaccgaacggcccacgtccggtcccttccccgtcggcccacccctccctaccaacgacgccacccgtcgtcggggaccacgacggccggcccgtgggtcctcgccgtcggtacaacggtaccttaccttccactcctaacaaccttacgagacggcgggtccgtagggaccgaacgggccgacgtatacg

SEQ ID NO: 79191 - DNA, 624 bp, Homo sapiens
  misc_feature: GYAE6OF02G989N.37.26.C04.1.454.CMB.1.raw
  modified_base (145)..(145): a, c, t, g, unknown or other
  misc_feature (145)..(145): n is a, c, g, or t
  modified_base (307)..(307): a, c, t, g, unknown or other
  misc_feature (307)..(307): n is a, c, g, or t
  modified_base (314)..(314): a, c, t, g, unknown or other
  misc_feature (314)..(314): n is a, c, g, or t
  modified_base (323)..(323): a, c, t, g, unknown or other
  misc_feature (323)..(323): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccnccaggctccagggaaggggctggagtgggtctcaggtattactggtagtggtaataccgcatactacgcagactccgtgacgggccgttcaccgtctccagagacaattccaagaatacggtctatcaggaaatgaacagcctgagagcgagacacgccctntattacngtgcgaganatcagagatatgcagcagctctagactacggtcggggacccaaccggtaaccctgggtaccacccggtctcccgtcacgccctaccacgaaccggccctaacgtccggttacccttccccgtcggccctacccgtccctaccgtaaacgaccgacgacccgtcgtcggggccaacgccggcccggtcccgtcgggcctccggaccgtcggtacgaacgtaccgttaccgtcctactaccgtaacctaccttacgtacgtacggaccgggtcgacgggtaccgtaacgggccgtacgagtag

SEQ ID NO: 79192 - DNA, 734 bp, Homo sapiens
  misc_feature: GYAE6OF02IC96K.37.26.C04.1.454.CMB.1.raw
  modified_base (215)..(215): a, c, t, g, unknown or other
  misc_feature (215)..(215): n is a, c, g, or t
  modified_base (327)..(327): a, c, t, g, unknown or other
  misc_feature (327)..(327): n is a, c, g, or t
tcagtagtgtagatcacgaccggtgctcgatttagtctagcgactttgggtttgggggaggcttggtacagcctgggggggtccctgagactctcctgtgcagcctcttggtttcattctttagcaactacgccatgagcgtgggtccgccaggctccgaggggaaggggctggagtgggtctcgaggttattacgtggtagtggtaactaccgnatactacgcagactccggtgaccgggccgttcaccgtctccagagacaattccaagatacggtctatcgtaggaaatgaaacagcctgagacgccgaggaccacggcccctntacgttactgtcggacgaaggatactcgaaaggtaccgggagttaatacggacaaggacctaacggccttccgttacgaaccgttacgggccgggggaccccaaaccgggtaacccgttgggtacccctaacccgggtttccctacccgttaccaaccgtcccccgtacccgaacccggaaaccggggtccccctacggttacccgggttcccttacccccgtccggtaccctacccccgttccctacccgaacgacgcctaccgtcggtcggggaccaccgcggtacccggcccgtcgggcgtcggaccgttcggtacgaacggtaccttaccttaccgtaccttaccgtaaccgtacttacgtcggtacggccggtcgacgggtaccgaaggtcgacgtagtacg

SEQ ID NO: 79193 - DNA, 646 bp, Homo sapiens
  misc_feature: GYAE6OF02HI1TL.37.26.C04.1.454.CMB.1.raw
  modified_base (208)..(208): a, c, t, g, unknown or other
  misc_feature (208)..(208): n is a, c, g, or t
  modified_base (284)..(284): a, c, t, g, unknown or other
  misc_feature (284)..(284): n is a, c, g, or t
  modified_base (293)..(293): a, c, t, g, unknown or other
  misc_feature (293)..(293): n is a, c, g, or t
  modified_base (346)..(346): a, c, t, g, unknown or other
  misc_feature (346)..(346): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagcgtgggtccgccaggctccgagggaaggggctggagtgggtcccaggtattacgtggtagtggtaataccgnatactacgcagactccgtgacggccgttcacgtctcagagacaattccaagactacggtctatctaggaatgaacngcctagagngccgaggaccacggccctatatacgtgtcgacgagagactcgagaaccgggtnttaagcgacagtcagctgtagactaggcgggaccaacggtaccctggtcctaccgtctccgtacaccgtcctaccaccgaacggtccctaacggttccggtccccgttccccgcggtacccctacccgtacccgtacgaaacgtccgtaccctaccggttccggcgggtaccaccggtaccggcccggtccggtacgggtccgtcggtacccgttcggtaaccgaacggttaccttaccgtctacgtctaccgtaactcgtagacggccggtatacgggacaggtccgtacagtagtacg

SEQ ID NO: 79194 - DNA, 193 bp, Homo sapiens
  misc_feature: GYAE6OF02IJKHS.37.26.C04.1.454.CMB.1.raw
  modified_base (175)..(193): a, c, t, g, unknown or other
  misc_feature (175)..(193): n is a, c, g, or t
tcagtagtgtagatcacgaccggtgctcgatttagtctagcgactttgggtttgggggaagagggaagactgacggtccccccaggagttcaggtgctgggcacagcggccctgggctgcctggtcaaggactacttccatctacactactgagcgggctggcaaggcgcatagnnnnnnnnnnnnnnnnnnn

SEQ ID NO: 79195 - DNA, 597 bp, Homo sapiens
  misc_feature: GYAE6OF02FEKBQ.37.26.C04.1.454.CMB.1.raw
  modified_base (396)..(396): a, c, t, g, unknown or other
  misc_feature (396)..(396): n is a, c, g, or t
tcagtagtgtagatcacgaccggtgctcgatttagtctagcgactttgggtttggggggaggcttggtacagcctggggggtccctgagactctcctgtgcagcctctggtttcatctttagcaactacgccatgagctgggtccgccaggctccagggaaggggctggagtgggtctcaggtattactggtagtggtaataccgcatactacgcagactccgtgacgggccgttcaccgtctccagagacaattccaagaatacggtctatctggaaatgaacagcctgagagccgaggacacggccctctattactgtgcgagagatcagacggagtatagcagcagctctgactacgtggggcccacggacccgtggtccaccgtcctcctcncgccctccgacccgaacggccccaagtccggttcccttcccccgtcggtccgcccctgcctacccgaggacgccacccgtccgagacgcacgacggccgcccgtcgggcctcgtccgtggacgaacggtacctacctaccgtaacttcctaacctaaccgttacgtcggacggccgggtctcgggacctacgggccgtacg

SEQ ID NO: 79196 - DNA, 625 bp, Homo sapiens
  misc_feature: GYAE6OF02FJYVR.37.26.C04.1.454.CMB.1.raw
  modified_base (304)..(304): a, c, t, g, unknown or other
  misc_feature (304)..(304): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtgggtctcaggtattactggtagtggtaataccgcatactacgcagactccgtgacgggccgttcaccgtctccagagacaattccaagaatacggtctaatctaggaaatgaacagcctgagagccgaggacnccggccctctattactgtgcgagagatcgagacggagtaatagcagcagctctgactacgtcggggcccaacgggaaccctgggtcctacccgtctcctcacgccctccaaccgaacgggcccctagtcccggtccctttcccccgcggcccaccccctccctacccgacgggtacgaccctacccgtccgacgagacccgaacgacggccggcccgtcgggccgttcgcccgttacggtacgaacggtaccttaccttaccgactcctaacctaccgtacgtcgaacggtccgggactccgggacgaacgggcgacgtag

SEQ ID NO: 79197 - DNA, 195 bp, Homo sapiens
  misc_feature: GYAE6OF02GRLLU.37.26.C04.1.454.CMB.1.raw
  modified_base (176)..(195): a, c, t, g, unknown or other
  misc_feature (176)..(195): n is a, c, g, or t
tcagtagtgtagatcacgaccggtgctcgatttagtctagcgactttgggtttggggggaagagggaagactgacggtccccccaggagttcaggtgctgggcacagcggccctgggctgcctggtcaaggactacttccatctacactactgagcgggctggcaaggcgcatagnnnnnnnnnnnnnnnnnnnn

SEQ ID NO: 79198 - DNA, 616 bp, Homo sapiens
  misc_feature: GYAE6OF02GMU98.37.26.C04.1.454.CMB.1.raw
  modified_base (313)..(313): a, c, t, g, unknown or other
  misc_feature (313)..(313): n is a, c, g, or t
  modified_base (346)..(346): a, c, t, g, unknown or other
  misc_feature (346)..(346): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtgggtctcaggtattactggtagtggtaataccgcatactacgcagactccgtgacgggccggttcaccgtctccagagacaattccaaagaatacggtctatctggaaatgaacagcctggagagccgaggacacggccctntattactgtgcgagagatcagacggagtatagnagcagctctgactacgtggggccacggaaccctggtcaccgtcctcctcacgcctaccaccgaacgggccccagttcccggttcccttcccccgtcggtccctaccccctcccttacccgaaacgacgccacccgtccgtcgggggtccaccgacggccgggtcccgtcggggcctcggccgttcgggtacgaaacggtaccttacccttaccacgttcctaacctaacttaccgtagacggtccgggctcggacgacggcgacagtacg

SEQ ID NO: 79199 - DNA, 579 bp, Homo sapiens
  misc_feature: GYAE6OF02IFH57.37.26.C04.1.454.CMB.1.raw
  modified_base (372)..(372): a, c, t, g, unknown or other
  misc_feature (372)..(372): n is a, c, g, or t
  modified_base (410)..(410): a, c, t, g, unknown or other
  misc_feature (410)..(410): n is a, c, g, or t
  modified_base (569)..(569): a, c, t, g, unknown or other
  misc_feature (569)..(569): n is a, c, g, or t
  modified_base (572)..(572): a, c, t, g, unknown or other
  misc_feature (572)..(572): n is a, c, g, or t
  modified_base (576)..(579): a, c, t, g, unknown or other
  misc_feature (576)..(579): n is a, c, g, or t
tcagtagtgtagatcacgaccggtgctcgatttagtctagcgacttttggggtttggggggaggcttgggtacagcctgggggggtccctgagactctcctgtgcagcctctggtttcagttgtagtgattgttggatgggttgggtccgccaggctccagggaaggggctggagtgggtggccaacataaagcgagatggaagcgaagaaatactatgtggactctgtggaggggccattcacatctccacagacaaccgccaaagaaatcaattctttttgacaaatgaacagtctgagagtcgaggacacggccatgtatactgtacgagagaacagacgtgggccagggaccctggtcacgtctctcncgcctccacgaggcccatcggtccttccccctgggccncccgtcgcctcccgacggacgcacccgtcgacgagccacacgccggccgtcgggtctcgcctgggtcgaacggtaccttaccttacccgtactccgttaccaactaccgtaggtagccggggtctacgggtacgtaacggggccgtacgtaacgtagangcncgannnn

SEQ ID NO: 79200 - DNA, 638 bp, Homo sapiens
  misc_feature: GYAE6OF02HGIDF.37.26.C04.1.454.CMB.1.raw
  modified_base (310)..(310): a, c, t, g, unknown or other
  misc_feature (310)..(310): n is a, c, g, or t
  modified_base (352)..(352): a, c, t, g, unknown or other
  misc_feature (352)..(352): n is a, c, g, or t
tcagtagtgtagatcacgaccggtgctcgatttagtctagcgactttgggtttgggggaggcttggtacagcctggggggtccctgagactctcctgcgcagcctctggtttcatctttagcaactacgccatgagctgggtccgccaggctccagggaaggggctggagtgggtctcaggtattactggtagtggtaataccgcatactacgcagactccgtgacgggccgttcaccgtctccagagacaattccaagaatacggtctatctggaaatgaacagcctgagagccgaggacacggccctntattactgtgcgagagatcagacggagtatagcagcagctcngactacgtcggggccacggaaccctggtccaccgttctcctcacgccctaccgaccgaacgggcccacgtccggttcccttccccgtggccctacccctccctaccaacgcaccgacctccggtggggccacgacggcccggcccgtcgggccgtacggtcccgttgggtacccgaaacgggtacccttaaccgttacccgtactttaccccgtaactaacccttacggtcggtaacgggcccgggtacgtacggggtaaccgacgggtccgtaccgacgttacgg

SEQ ID NO: 79201 - DNA, 569 bp, Homo sapiens
  misc_feature: GYAE6OF02JJ16N.37.26.C04.1.454.CMB.1.raw
  modified_base (323)..(323): a, c, t, g, unknown or other
  misc_feature (323)..(323): n is a, c, g, or t
  modified_base (331)..(331): a, c, t, g, unknown or other
  misc_feature (331)..(331): n is a, c, g, or t
  modified_base (399)..(399): a, c, t, g, unknown or other
  misc_feature (399)..(399): n is a, c, g, or t
  modified_base (512)..(512): a, c, t, g, unknown or other
  misc_feature (512)..(512): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccaggggaagggggctgggagtggggtctcaggtattactgggtagtggtaataccggcatactacgcagactccgtgacgggccgttcaccgtctccagagacaattccaagatacggtctatctggaaatgaacagcctgagagccgaggacaccggccctctattacngtgcgagnatcagacggatatagcagcagctctagactcgtggggaccaacgaacctgtaccaccgtctccacacnccctaccacgacggccactccggtcctcccgcggccaccctctaccgacgaccgcacctcgtcgggccacgcggcggccgtcggctcgcgtcggtacgacgtaccttcctacnctaccgtactacctacgtcggaacgtccgggactcggacgacggtccgactagtacg

SEQ ID NO: 79202 - DNA, 590 bp, Homo sapiens
  misc_feature: GYAE6OF02GWX5H.37.26.C04.1.454.CMB.1.raw
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtgggtctcaggtattactggtagtggtaataccgcatactacgcagactccgtgacgggccgttcaccggtctccagagacaattccaagaatacggtctatctaggaaatgaacagcctgagagccgaggacacggccctatattactgtgacgagagatcgagacggatatagcagcagctcgtcgactacgtcggggaccacggaacccgtgtaccaccgttctcctcacgccctccgaccgacggcccacgtccggtccttccccgcgcctaccctcctaccaacgacgcacctcgtcgggcacgacggcgaccgtgggccgtcgccgtcggtacgaacggtactaccttactactacctacgacctacgtacgacggtccggtacgtcgggaccgtaacggcgtacgtagtacgg

SEQ ID NO: 79203 - DNA, 758 bp, Homo sapiens
  misc_feature: GYAE6OF02F40VB.37.26.C04.1.454.CMB.1.raw
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtgggtctcaggtattactggtagtggtaactaccgcatactacgcagactccgtgacgggccgttcaccgtctccagagacattccaaagaatacggtctatctggaaatgaacagcctgagagccgaggacacggccctctattactgtgcgagagatcaggacgagtatagcagcagctcgtgactacgtcggggacccacgtcggaaaccccgtggtacctacccggttcctccctacgccgccctacccaacccgaaacggggccccctaacggttcccgggttcccgtttccccccgtcgggccccctaacccccgttcccgttaacccgaaacggtaccgacccgtaacccgtcccgggtcggggggtacccaccggaaccgggtcccgggtccccggttcggggtacccgttcgggtcccggttacgggtacccgaaacggggttacccctttaaccgtttaaccccgtaccggtttaaccctttaaaccctaacccgtttaaccggtaaccggtaccggggtacccgggggtacccgggttaccggggaaccgttaaccggggaccgaccggttaaacgg

SEQ ID NO: 79204 - DNA, 596 bp, Homo sapiens
  misc_feature: GYAE6OF02FJD5A.37.26.C04.1.454.CMB.1.raw
tcagtagtgtagatcacgaccggtgctcgatttagtctagcgacttttgggtttgggggaggcttggtacagcctggggggtccctgagactctcctgtgcagcctctggtttcatctttagcaactacgccatgagctgggtccgccaggctccagggaaggggctggagtgggtctcaggtattactggtagtggtaataccgcatactacgcagactccgtgacgggccggttcaccgtctccagagacaattccaaagaatacggtctatctggaaatgaacagcctgagagccgaggacaccggccctctattactgtgcgagagatcgaggacggagtatagcagcagctctgactacgtcggggaccaccgggaaccctggtaccaccgttctcctcagccctccaccacggcccagtccggttcctccccgtcgccaccctcctccaagacgccacccgtcgtcggggccacgacgccggcccgtgggccgtcgccgttcggtaccgaacggtaccttaccttcctacgtccgttaacacttaccgcgtacggcgggtacgtcggaccgtacggccgtacgtagtacg

SEQ ID NO: 79205 - DNA, 592 bp, Homo sapiens
  misc_feature: GYAE6OF02G0P36.37.26.C04.1.454.CMB.1.raw
  modified_base (311)..(311): a, c, t, g, unknown or other
  misc_feature (311)..(311): n is a, c, g, or t
  modified_base (353)..(353): a, c, t, g, unknown or other
  misc_feature (353)..(353): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtgggtctcaggtattactggtagtggtaataccgcatactacgcagactccgtgacgggccggttcaccgtctccagagacaattccaagaatacggtctatctggaaatgaacagcctgagagccgaggacacggccctntattactgtgcgagagatcagacggagtatagcagcagctcngactacgtggggccacggaaccctggaccaccgtctcccgtcagtccctaccacccgaacgggcccaacgtccggttcccttccccgtcgcccacccctccctccaacgacgccacctcggtcggggcacgcgccggccgtcgggctcggccgttcggtacgaacgtacttaccgtcctactaccgtaacctaccgtactcggacggtccgggcttcgggacgaacggccgacgactag

SEQ ID NO: 79206 - DNA, 657 bp, Homo sapiens
  misc_feature: GYAE6OF02HNZ4C.37.26.C04.1.454.CMB.1.raw
  modified_base (316)..(316): a, c, t, g, unknown or other
  misc_feature (316)..(316): n is a, c, g, or t
  modified_base (331)..(331): a, c, t, g, unknown or other
  misc_feature (331)..(331): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccgaggggaaggggctggagtgggtctcgaggttattactggtagtggtaataccgcatactacgcagactccgtgacgggccggttcaccgtctccagagacaattccaaagatacggtctatctggaaatgaacagcctgacgagccgaggacacggccctntattactgtgcgagnatcagacggatatagcagcagctctagactacggtggggacccaacgggaaccccttggggacctacccggttcctacccgttaccacggcccctaccgaacccgaacgggacccctacgtccggttccccttccccgtcggaccctacccctacctaccgaacgacgcctacccgtcgtacggggaccacgacggccggaccgtcgggcgtcgtaccgttcgggtaccaacggtaccttaccttaccgtacttaccctaacctaccttacgtacggacggtacgggtccggtacggtaccggaaacgggtccgaccgtaagtacg

SEQ ID NO: 79207 - DNA, 657 bp, Homo sapiens
  misc_feature: GYAE6OF02I6MBC.37.26.C04.1.454.CMB.1.raw
  modified_base (208)..(208): a, c, t, g, unknown or other
  misc_feature (208)..(208): n is a, c, g, or t
  modified_base (300)..(300): a, c, t, g, unknown or other
  misc_feature (300)..(300): n is a, c, g, or t
  modified_base (324)..(324): a, c, t, g, unknown or other
  misc_feature (324)..(324): n is a, c, g, or t
  modified_base (335)..(335): a, c, t, g, unknown or other
  misc_feature (335)..(335): n is a, c, g, or t
  modified_base (384)..(384): a, c, t, g, unknown or other
  misc_feature (384)..(384): n is a, c, g, or t
tcagtagtgtagatcacgaccggtgctcgatttagtctagcgactttgggtttgggggaggcttggtacagcctggggggtccctgagactctcctgtgcagcctctggttcatctttagcaactacgccatgagctgggtccgccaggctccgaggggagggctggagtgggtctcgaaggtattacgtggtagtggtaactaccgnatactacgcagacctccgtagaccgggccggttcaccgtctaccagacgacattccaaagtaataccggtctatcgttaggaaatcgaaacncgcctaggagacgccggaggaccnccggacccttntaacttcgtggtagaggagagactacgaggacggatacagcagcagctnagactacgcgggacccaacggtaccctggtaccaccgtcctccgtacaccgtaccctaccgaccgaaccggacccacgtccggttcccttccccgcggtaccctaccccgtcctaaccgacacgcctacccgtcggtaccgggcaacgccgccggtccgtcgggtccgtacgtccgtcggtacgaacggtccttacgtccctacttaccgtaacctaacgtacggtacggacggtaccgggtccggtacggtacgacggtccgtacacgtacg

SEQ ID NO: 79208 - DNA, 559 bp, Homo sapiens
  misc_feature: GYAE6OF02JDOTY.37.26.C04.1.454.CMB.1.raw
  modified_base (236)..(236): a, c, t, g, unknown or other
  misc_feature (236)..(236): n is a, c, g, or t
  modified_base (451)..(451): a, c, t, g, unknown or other
  misc_feature (451)..(451): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtgggtctcaggtattactggtagtggtaataccgcatactacgcagactccgtgacgggccggttnaccgtctccagagacaattccaagaatacggtctatctggaaatgaacagcctgagagccgaggacacggccctctattactgtgcgagagatcagacggagtatagcagcagctctgactacgtggggccacggaaccctggtaccaccgtctcctcacgtcctccacaacgggcccagtcgtccttcccctggccaccctccctccaacgacncacctcgtcggggcacgacgccgcccgtggcctcgtccgtggtcgaaggaccttacctccatccgtaacactactagacggcggcgtggccgaacggcgacgtatacg

SEQ ID NO: 79209 - DNA, 374 bp, Homo sapiens
  misc_feature: GYAE6OF02I4BXY.37.26.C04.1.454.CMB.1.raw
  modified_base (249)..(249): a, c, t, g, unknown or other
  misc_feature (249)..(249): n is a, c, g, or t
  modified_base (322)..(322): a, c, t, g, unknown or other
  misc_feature (322)..(322): n is a, c, g, or t
  modified_base (341)..(341): a, c, t, g, unknown or other
  misc_feature (341)..(341): n is a, c, g, or t
  modified_base (360)..(374): a, c, t, g, unknown or other
  misc_feature (360)..(374): n is a, c, g, or t
tcagtagtgtagatcacgaccggtgctcgatttagtctagcgactttgggtttgggggaggcttggtacagcctgggggggtccctgagactctcctgtgcagcctctggttcatctttagcaactacgccatgagctgggtccgccaggctccagggaaggggcttggagtgggtctcaggtattactggtagtggtaataccgcatactacgcagactcgtgacgggccggttcaccgtctccaganacaattccaaagaactacggtctaatctaggaaaatgaaacagcctaggagagcccgaaggaccacggccctnttaatactgtgacggaganatcagaaggataatagcannnnnnnnnnnnnnn

SEQ ID NO: 79210 - DNA, 619 bp, Homo sapiens
  misc_feature: GYAE6OF02HO9GD.37.26.C04.1.454.CMB.1.raw
  modified_base (313)..(313): a, c, t, g, unknown or other
  misc_feature (313)..(313): n is a, c, g, or t
  modified_base (320)..(320): a, c, t, g, unknown or other
  misc_feature (320)..(320): n is a, c, g, or t
  modified_base (409)..(409): a, c, t, g, unknown or other
  misc_feature (409)..(409): n is a, c, g, or t
  modified_base (531)..(531): a, c, t, g, unknown or other
  misc_feature (531)..(531): n is a, c, g, or t
  modified_base (567)..(567): a, c, t, g, unknown or other
  misc_feature (567)..(567): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccgagggaaggggctggagtgggtctcgaggtattacgtggtagtggtaataccgcatactacgcagactccggtgacgggccgttcacgtctccagagacaattccaaagtataggtctatctaggaaatgaacagcctgagagccgagacacggccctntattacngtgcgagagatcaggacggagtatacgcagctagctcgtagacctaggtcgggaccacgggtaacctggtaccaccgtctcctacgacnccctaccaccgaacggtaccccacgtccgttcccgttccccgtcgggaccctaccccttacccgtaccgaaacgaccgacctaccgtccggtcggggaccaacggaccggccggtccccggngggtccgtcgcgttcggacgaacggtactcgtaccngtacctactaactcgtgaacggcggtcgcggacgaacggtcgaccagtaacg

SEQ ID NO: 79211 - DNA, 545 bp, Homo sapiens
  misc_feature: GYAE6OF02F99AF.37.26.C04.1.454.CMB.1.raw
  modified_base (282)..(282): a, c, t, g, unknown or other
  misc_feature (282)..(282): n is a, c, g, or t
  modified_base (317)..(317): a, c, t, g, unknown or other
  misc_feature (317)..(317): n is a, c, g, or t
  modified_base (341)..(341): a, c, t, g, unknown or other
  misc_feature (341)..(341): n is a, c, g, or t
  modified_base (345)..(345): a, c, t, g, unknown or other
  misc_feature (345)..(345): n is a, c, g, or t
  modified_base (360)..(360): a, c, t, g, unknown or other
  misc_feature (360)..(360): n is a, c, g, or t
  modified_base (424)..(424): a, c, t, g, unknown or other
  misc_feature (424)..(424): n is a, c, g, or t
  modified_base (450)..(450): a, c, t, g, unknown or other
  misc_feature (450)..(450): n is a, c, g, or t
  modified_base (460)..(460): a, c, t, g, unknown or other
  misc_feature (460)..(460): n is a, c, g, or t
  modified_base (520)..(520): a, c, t, g, unknown or other
  misc_feature (520)..(520): n is a, c, g, or t
  modified_base (529)..(529): a, c, t, g, unknown or other
  misc_feature (529)..(529): n is a, c, g, or t
  modified_base (542)..(542): a, c, t, g, unknown or other
  misc_feature (542)..(542): n is a, c, g, or t
tcagtagtgtagatcacgaccggtgctcgatttagtctagcgactttgggtttgggggaggcgttggtacagcctgggggtccctgagactctcctgtgcagcctctggtttcatctttagcaactacgccatgagctgggtccgccaggctccagggaaggggctggagtgggtctcaggtattactggtagtggtaataccgcatactacgcagactcgtgacgggccgttcaccgtctccagagacaattccaagatacggtctatctggaaatgaacngcctgagacgcgaaggcaccggccctctaattacngtagccgagagatcaagcggatangcancagctctgaactcgnggacccaggaaccctgggccacggtctccgtcacgccctcaccaacggccactcggtcctcccngccaccctcctaccagacgactaccncgtcgggacnccgacgtccgccggacggcgtcgccgtcgacgtaagactaccgtcactctaacactacgngagcggtcncggacaggccagntcg

SEQ ID NO: 79212 - DNA, 602 bp, Homo sapiens
  misc_feature: GYAE6OF02FIWNE.37.26.C04.1.454.CMB.1.raw
  modified_base (292)..(292): a, c, t, g, unknown or other
  misc_feature (292)..(292): n is a, c, g, or t
  modified_base (310)..(310): a, c, t, g, unknown or other
  misc_feature (310)..(310): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtgggtctcaggtattactggtagtggtaataccgcatactacgcagactccgtgacgggccgttcaccgtctccagagacaattccaagaatacggtctatctggaaatgaacagcctgagngccgaggacacggccctntattactgtgcgagagatcagacgagtatagcagcagctctgactacgtggggacccaacggaccctggtccacccggttctcctcacgccctacccaccgaacgggccccacgtcccggttcccttcccccgtcggcccacccctccctacccaacggacgcctacctcgtacggggcacgacgccggcccgtcgggtccgtcgccgtcggtacgaacggtaccttacttaccgactcctaacctactacgtacggtacggccgggcgtcggacgaacggcgacgagtacg

SEQ ID NO: 79213 - DNA, 202 bp, Homo sapiens
  misc_feature: GYAE6OF02FWJ78.37.26.C04.1.454.CMB.1.raw
  modified_base (183)..(202): a, c, t, g, unknown or other
  misc_feature (183)..(202): n is a, c, g, or t
tcagtagtgtagatcacgaccggtgctcgatttagtctagcgactttgggtttgggggggaagaggaagactgacggtccccccaggagttcaggtgctgggccacagcggccctgggctgccctggtcaaggacctacttccatcctacactactggagcgggtctggcaaggcgcaatagnnnnnnnnnnnnnnnnnnnn

SEQ ID NO: 79214 - DNA, 621 bp, Homo sapiens
  misc_feature: GYAE6OF02JQ7Y8.37.26.C04.1.454.CMB.1.raw
  modified_base (247)..(247): a, c, t, g, unknown or other
  misc_feature (247)..(247): n is a, c, g, or t
  modified_base (274)..(274): a, c, t, g, unknown or other
  misc_feature (274)..(274): n is a, c, g, or t
  modified_base (318)..(318): a, c, t, g, unknown or other
  misc_feature (318)..(318): n is a, c, g, or t
  modified_base (325)..(325): a, c, t, g, unknown or other
  misc_feature (325)..(325): n is a, c, g, or t
  modified_base (353)..(353): a, c, t, g, unknown or other
  misc_feature (353)..(353): n is a, c, g, or t
  modified_base (367)..(367): a, c, t, g, unknown or other
  misc_feature (367)..(367): n is a, c, g, or t
  modified_base (417)..(417): a, c, t, g, unknown or other
  misc_feature (417)..(417): n is a, c, g, or t
tcagtagtgtagatcacgaccggtgctcgatttagtctagcgactttgggtttgggggtaggcgttggtacgagccgtggggggtccctgagactctcctgtgcagcctctggtttcatctttagcaactacgccatgagctgggtccgccaggctccgagggaagggctgggagtgggtctcaggtattacgtggtagtggtaactacgcatacgtacgcagactccgtgacgggccgttcacctntccagagacaattccaagaataccgtntatcaggaaatgaacagctgacgacgacgtaggacacggccctntattacngtgacgagagactcgaagacggagtaangacagcagactcgngtaaccgtacgtggggaccctaacgggaacccttgggtacccaccgtccncctagactcccgtacccacgaacggtcccacgttccggtcccttccccgtgccctacccgttccaccgaagcctccacccgtggtaccggggccatacccggcgtcccgtgggctcgcccttgggacaacggtctacgtcccagtaccctaacgctaacgttcggaacgcggtacgtcggaacgtaacggcgtaccgagtaccg

SEQ ID NO: 79215 - DNA, 579 bp, Homo sapiens
  misc_feature: GYAE6OF02G47HT.37.26.C04.1.454.CMB.1.raw
  modified_base (352)..(352): a, c, t, g, unknown or other
  misc_feature (352)..(352): n is a, c, g, or t
  modified_base (574)..(574): a, c, t, g, unknown or other
  misc_feature (574)..(574): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtgggtctcaggtattactggtagtggtaataccgcatactacgcagactccgtgacgggccgttcaccgtctccagagacaattccaagaatacggtctatctggaaatgaacagcctgagagcgaggacacggccctctatactgtgcgagagatcagacggagtatagcaggcagctcgngactacgtggggaccacggtaaccctggtaccaccgttctcccgtcacgccctaccaccgaacggccctaagtccggttcccttccccgtggacccacccctccctaccgaacgtacgacccacctcgtacggggaccacgagaccggcccgtgggcctcgccgtggtacaaggtactactcactcgtacactacgtgacgtcgggctcggacgaggccganatacg

SEQ ID NO: 79216 - DNA, 875 bp, Homo sapiens
  misc_feature: GYAE6OF02HUJ36.37.26.C04.1.454.CMB.1.raw
  modified_base (291)..(291): a, c, t, g, unknown or other
  misc_feature (291)..(291): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaagggctggagtgggtctcaggtattacgtggtagtggtaataccgcatacctacgcagactccgtggacgggtccggttcaccgtctccagagacaattaccaagaatacggtctatctaggaaatgaaacngcctagagacgccggaggacaccggtcccttacttaagtttaaccttggtcgacggaacgaggtactcgaacggtacgggaagttaatacggacgtaagccgaacggtcccttacgtcggaaccgttaccgggtacgggggaccccgaaaccgggtaaccccgttcgggttacccgtacccgggttacccttccccgttaccgaccgtaccccctaccccgaaaccccggtaacccggggacccccgttaacgtttccccggggtttacccccttttccccccggtacccggacccccgttaaccccccgttccccgttaaaccccggaaacggtacccggtaccccgtaaccccggttaccgggtaccggggggcccttaaacccgggccgggtccccggggtaccccgtcggggtacccgttccgtcccgggttaaccgggtaaaccggtaaaccggtacccgtttaaccgtttaccccgtacttttaaccccgttaaaccgaacccgtttaaacggtcgggtaaccggtcccggggttacggttaccgggaaccggaaccgggtccgaccggtaagtacgg

SEQ ID NO: 79217 - DNA, 789 bp, Homo sapiens
  misc_feature: GYAE6OF02FVY35.37.26.C04.1.454.CMB.1.raw
tcagtagtgtagatcacgaccggtgctcgatttagtctagcgactttgggtttgggggaggcttggtacagcctggggggtccctgagactctcctgtgcagcctctggtttcatcttagcaactacgccatgagctgggtccgccaggctccagggaaggggctggagtgggtctacgaggtattactggtagtaggtaactaccgctataactacgacagacctccggtggaccgggtccgttcaccgtctaccagacactaacttccaaagtaacgtaccggtactactacgtaaggtaaatcgaaacgtagtccgtaggaacggacggtaccggaaggaaccgacccgggcccttacttatttaaccgtggtcggaccgtaggaacgtactacgaacgggacgtagttagtaacgcaggacagtcctcgtagaaccgttacggcgggtaccccaacgggtaacccgttggtacccgaccgttcctacccgtcgaaccgtccccgtacccgaaacccgggaaccgggacccctaaccggtttcccggttcccctttacccccggtccgggaccccttaacccccgtcccgttaacccgaaacggtacccgtacccgtaaccccggtccgggtaaccggggacccaacggccgggtacccggtcccggtacggtccgtccggttaccgtacggtaacgaacggttaccttaccgtaccgtactaccgtaaccctagtaaccggtaggacggtccggtacgtacggacggaacggcctacgtagacgg

SEQ ID NO: 79218 - DNA, 639 bp, Homo sapiens
  misc_feature: GYAE6OF02HH2IX.37.26.C04.1.454.CMB.1.raw
  modified_base (206)..(206): a, c, t, g, unknown or other
  misc_feature (206)..(206): n is a, c, g, or t
  modified_base (359)..(359): a, c, t, g, unknown or other
  misc_feature (359)..(359): n is a, c, g, or t
  modified_base (474)..(474): a, c, t, g, unknown or other
  misc_feature (474)..(474): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtgggtctcgaggtattactggtagtggtaataccgnatacacgcagactccgtgacgggccggttcacgtctccagagacaatccaagatacggtctatctaggaaatgaacagcctgagagccgagacacggccctactattactgtgcgagagatcagacggagtatagcagcagctctgactacgngggaccacggaaccctggtcacccggtctaccgtcaacgccctaccaccgaaacggcccctaactcggtccttaccccgtcgggccaccctcctaccgaaacgacgacgacccgngtcggggaccaccgaacggccggccccgtgggcctacgtccgtcggtacgaaacgggaaccttaacccgttccctaacgttaccctaaccgttaacccttaaccgttacgggaacggtcccgggggtaacttcgggaaaccgaacgggaccgaccgtaataacgg

SEQ ID NO: 79219 - DNA, 639 bp, Homo sapiens
  misc_feature: GYAE6OF02G0P9Y.37.26.C04.1.454.CMB.1.raw
  modified_base (291)..(291): a, c, t, g, unknown or other
  misc_feature (291)..(291): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccaggggaaggggctggagtgggtctcaggtattactggtagtggtaataccgcatactacgcagactccgtgacgggccgttcaccgtctccagagacaatccaagaatacggtctatctggaaatgaacagcctganagcgagacacggcctctattactgtgacgagagatacaggacgatatagcagcagctctagaactacgtggggaccaaccgggtaacccgtggtaccgaacccgttcctacccgtacgacgtcccctacccaacccgtaaccgggacccctacgttccggttcccctttccccgtcgggaccctaccccctccctacccgaacgacgacctacccgtccgcggggaccacgacggcccggcccgtcgggcctcggccgtcggtaccgaacggtacttaccttccgtactacgtaacctaacctacgtacggacggcggacgtacgggacgaacgggcgtacgagtacg

SEQ ID NO: 79220 - DNA, 665 bp, Homo sapiens
  misc_feature: GYAE6OF02G6HVS.37.26.C04.1.454.CMB.1.raw
  modified_base (368)..(368): a, c, t, g, unknown or other
  misc_feature (368)..(368): n is a, c, g, or t
  modified_base (487)..(487): a, c, t, g, unknown or other
  misc_feature (487)..(487): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccgagggaggggctggagtgggtctcaggtattactggtagtggtaataccgcatactacgcagactccgtgaccgggccgttcaccgtctccagagacaattccaagaactacggtctatctaggaaatcgaaacagcctgagacgccgaggacaccggtccctactattactggtcgcgaagagatccgaggacggagtatagcagcagctcgngactcgtcgggacccaacggaccctggtaccacccgttcctcctacacgtccctaccaacccgaacgggcccaacgtccgttacccttccccgcgtcccacccctccaccgtaacgacnccgaacctcggtaccgggcaccgacgggcccggaccgtcgggccgtccgtacccgtggtacccgtaaacggtccccttaccgttacccgtaacgttccctaaccgtaaccgttaaccgtcgggtaccgggaccgggtaccggtacggaaccggaaccgggtaccacgttaacgtacgg

SEQ ID NO: 79221 - DNA, 578 bp, Homo sapiens
  misc_feature: GYAE6OF02FSEKR.37.26.C04.1.454.CMB.1.raw
tcagtagtgtagatcacgaccggtgctcgatttagtctagcgactttgggtttgggggaggcttggtacagcctggggggtccctgagactctcctgtgcagcctctggattcaccttcagtagctatagcatgaactgggtccgccaggctccagggaaggggctggagtgggtctcatccattagtagtagtggtacttacatatactacgcagactcagtgaggggccattcaccatctccagagacaacgccaaagaactcactgtatctgacaaatgaacagcctgagagccgaggacacggctgtgtattactgtgcgagacgccctccacctcagcagcagcggtgacttcgtggggccagggaaccctgggtcaccgtctcctcacgcctccgaccgaaccgggcccacgtccggtcccttccccgtcggcccacccctccctccaacgacgacctacccgtcgtcggggctacgacggccggcccgtcgggctcgccgtcgtaccaaggtccgtaccttcccgtattaccctacgtacctacgtacggacggtccgggcgtcggtacgg

SEQ ID NO: 79222 - DNA, 722 bp, Homo sapiens
  misc_feature: GYAE6OF02IEFEA.37.26.C04.1.454.CMB.1.raw
  modified_base (227)..(227): a, c, t, g, unknown or other
  misc_feature (227)..(227): n is a, c, g, or t
  modified_base (293)..(293): a, c, t, g, unknown or other
  misc_feature (293)..(293): n is a, c, g, or t
  modified_base (714)..(714): a, c, t, g, unknown or other
  misc_feature (714)..(714): n is a, c, g, or t
  modified_base (716)..(716): a, c, t, g, unknown or other
  misc_feature (716)..(716): n is a, c, g, or t
  modified_base (719)..(721): a, c, t, g, unknown or other
  misc_feature (719)..(721): n is a, c, g, or t
tcagtagtgtagatcacgaccggtgctcgatttagtctagcgactttgggtttgggggaggcttggtacagcctgggggggtccctgagactctcctgtgcagcctctggtttcatctttagcaactacgccatgagctgggtccgccaggctccgaggggaaggggctggagtgggtctcaggttattactggtagtggtaataccgcatactacgcagactccgnggacgggccgttcaccgtctcagagaacaattccaaagaaccacgctctaatctgacaaatgaacngcctgaaggagccgaaagacacggcccgtaattaacttactgtgtaggaaacggcgtgggggagtggggggactacggtcgggggaccgagggtaacccgtggtccgaccggttcctcctacgacgccctacccgaccgaacgggccctaacgtccggtaccctttcccccggtcggaccctaccccttaccccgtaccgaaacggtaccgccgtaacccgtccggtcgggggaccctaacgaccgggcccggtaccccggtcgggccgttccggacccggttagggtacccgaaacggttaacccgtttacccgttacccgaactttacccgttaaaccgtaccttacgtcgggaacgggcccgggtacggttacgggaacggaaaccggggtaccgacggtaacgttaacggatcgcgngncgnnng

SEQ ID NO: 79223 - DNA, 711 bp, Homo sapiens
  misc_feature: GYAE6OF02JXLCV.37.26.C04.1.454.CMB.1.raw
  modified_base (705)..(705): a, c, t, g, unknown or other
  misc_feature (705)..(705): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctgggagtgggtctcaggtattactggtagtggtaataccgcatactacgcagactccggtgacgggccgttcaccgtctccagagacaattccaaggaatacggtctatctaggaaatgaaacagcctgagaggaccgaggaccaccgggccccttatagttactggtgacgagagatacgaggacggtataagtagcgaaggcacgcttactacgtaccgttaccggtcgggggtacccaacccggggtaaaccccttggggttaccctaaccccggttcccgttccccgtcccgaaccggtccccctaccccgaaacccggaaccgggtaccccgtaacgtcccggttcccgttcccccgtcggacccctacccccgtcccgtacccgaacggaccgcccaacccgttcgggtcgggaccgaccgacggcccggtcccggtcgggccgtcggtcccgtacggtacgaaacggtaccttaacctcctactaccgtaacctacctaccggtacgaccggcgggcgtcggacgaacggcgngactag

SEQ ID NO: 79224 - DNA, 690 bp, Homo sapiens
  misc_feature: GYAE6OF02FH691.37.26.C04.1.454.CMB.1.raw
  modified_base (669)..(669): a, c, t, g, unknown or other
  misc_feature (669)..(669): n is a, c, g, or t
  modified_base (682)..(682): a, c, t, g, unknown or other
  misc_feature (682)..(682): n is a, c, g, or t
  modified_base (687)..(687): a, c, t, g, unknown or other
  misc_feature (687)..(687): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtgggtctcaggtattactggtagtggtaataccgcatactacgcagactccgtgacgggccggttcaccgtctccagagacaattccaagaacacgctctatctgcaaatgaacagcctgagagccgaagacacggccgtatatactgtgtgaaaggctggggatggggggactacgtggggccagggaaccctggtcaccgtctccctcagccctccaaccgaaacggggccccagtcccggttacctttcccccccgtgggtaccctacccctcccttacccgaaacggacgtccaaccctccggtcggggggtaccaccgacggtcccgggccccgttagggggccctggccccgttagggttacccgaaacggggtacctttacccgtttacccgtaactttacccgttaaacccgtaacccttaaacgttcggaacgggtcccgggggtccgtacggggaccgaaacggggcccggtaccgtaaagttaacggnacgtcgaccgtgntacgnacg

SEQ ID NO: 79225 - DNA, 573 bp, Homo sapiens
  misc_feature: GYAE6OF02GTDXT.37.26.C04.1.454.CMB.1.raw
  modified_base (330)..(330): a, c, t, g, unknown or other
  misc_feature (330)..(330): n is a, c, g, or t
  modified_base (466)..(466): a, c, t, g, unknown or other
  misc_feature (466)..(466): n is a, c, g, or t
  modified_base (490)..(490): a, c, t, g, unknown or other
  misc_feature (490)..(490): n is a, c, g, or t
  modified_base (507)..(507): a, c, t, g, unknown or other
  misc_feature (507)..(507): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccgagggaaggggctggagtgggtggccaacatacaggggaggtggtggtaacgaaaaactatgtggactctgtgcggggccattcaccatctccagacgacaacgaccaaaaactcactgtatctgacaaagtggaccggcctgagactccgaggaccgacggctgtgtattattgngcgagagtattacgactaataaagtttcgagtgactggtatgatgactttatgacttaccgtggggaccaagggaccagtcggtaccaccgtctctacacgcctccaccgaagggcccactccggtccttccccgnggcccgcccgtgcctccgaggacnccaccgtcgagcgcacncggccgccgtgggctcgccgtgtacgaacgaccttactccactacctactactacgtcgagtccgg

SEQ ID NO: 79226 - DNA, 621 bp, Homo sapiens
  misc_feature: GYAE6OF02HWHTT.37.26.C04.1.454.CMB.1.raw
  modified_base (237)..(237): a, c, t, g, unknown or other
  misc_feature (237)..(237): n is a, c, g, or t
  modified_base (358)..(358): a, c, t, g, unknown or other
  misc_feature (358)..(358): n is a, c, g, or t
tcagtagtgtagatcacgaccggtgctcgatttagtctagcgactttgggtttgggggaggcttggtacagcctgggggggtccctgagactctcctgtgcagcctctggtttcatctttagcaactacgccatgagctgggtccgccaggctccagggaaggggctggagtgggtctcaggtattactggtagtggtaataccgcatactacgcagactccgtgacgggccggttnaccgtctccagagacaattccaagaatacggtctatctggaaatgaacagcctgagacgccgaggaccacggccctctattactggtgacggagagatcagacggatatagcagcagctcngactacgtggggccaccggacctcgcacccgtctccccacgccctaccaccgaaccggcccacgttccggtccctttcccccgtcggtaccctacccctccctaccaacgacgtacccacccgtcgggtcgggggcccaccgacggcccgggcccgtcgggcctggcccgtggtaccgaacggtacctaccttccacgttacctacctacctacgtacggaccggtcgggaccgtcggacgtaaccgggccgagtacgagtac

SEQ ID NO: 79227 - DNA, 567 bp, Homo sapiens
  misc_feature: GYAE6OF02G60ZC.37.26.C04.1.454.CMB.1.raw
  modified_base (354)..(354): a, c, t, g, unknown or other
  misc_feature (354)..(354): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtgggtctcaggtattactggtagtggtaataccgcatactacgcagactccgtgacgggccggttcaccgtctccagagacaattccaagaatacggtctatctggaaatgaacagcctgagagccgaggacacggccctctattacctgtgcgagagatcagacggagtatagcagcagctcngactacgtggggccaacggacctggtccaccgtctcctcacgcctcccaccgaacggcccaacgtccggtacccttccccgtcggccctacccgtccctaccaacgcgccacctcgtcgggaccacgacgccgcccgtggctcgccgtggtacaacggactacgtccactcctacactactcgacgccggcgtcggacgacggcgacagtacg

SEQ ID NO: 79228 - DNA, 682 bp, Homo sapiens
  misc_feature: GYAE6OF02HA23C.37.26.C04.1.454.CMB.1.raw
  modified_base (204)..(204): a, c, t, g, unknown or other
  misc_feature (204)..(204): n is a, c, g, or t
  modified_base (308)..(308): a, c, t, g, unknown or other
  misc_feature (308)..(308): n is a, c, g, or t
  modified_base (316)..(316): a, c, t, g, unknown or other
  misc_feature (316)..(316): n is a, c, g, or t
  modified_base (339)..(339): a, c, t, g, unknown or other
  misc_feature (339)..(339): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaagggctggagtgggtctcaggtattactggtagtggtaataccgnatactacgcagactcgtgacgggccgttcaccgtctccagagacaattccaagaatacggtctatctaggaaatgaacagcctgagagccgagacacggccctntattacgngtgcgagagatcgagacggatanagcagcagctctagacgtacgtcggggacccaaccgggaacctgggtcccaccggttcctaccgtcaccgtccctacccgaaccgaaccgggccctacgtccggttacccttccccgtcgaccctacccctccctaccgaacgacgaccgtaaccgtccggtacggggaccaccggaccggccccgggtaccgtcggggtacccgttcggtacccggttacgggtacccgaaacgggttaccttacccgttaccgtaaccgtaccgtaaccgtaaccgttaacggttacggacggtaccgggtaccgtacgggtaccggaacgggtccggtacgtaaggtacg

SEQ ID NO: 79229 - DNA, 618 bp, Homo sapiens
  misc_feature: GYAE6OF02JGAWD.37.26.C04.1.454.CMB.1.raw
  modified_base (297)..(297): a, c, t, g, unknown or other
  misc_feature (297)..(297): n is a, c, g, or t
  modified_base (329)..(329): a, c, t, g, unknown or other
  misc_feature (329)..(329): n is a, c, g, or t
  modified_base (343)..(343): a, c, t, g, unknown or other
  misc_feature (343)..(343): n is a, c, g, or t
  modified_base (361)..(361): a, c, t, g, unknown or other
  misc_feature (361)..(361): n is a, c, g, or t
  modified_base (415)..(415): a, c, t, g, unknown or other
  misc_feature (415)..(415): n is a, c, g, or t
  modified_base (468)..(468): a, c, t, g, unknown or other
  misc_feature (468)..(468): n is a, c, g, or t
  modified_base (520)..(520): a, c, t, g, unknown or other
  misc_feature (520)..(520): n is a, c, g, or t
  modified_base (614)..(614): a, c, t, g, unknown or other
  misc_feature (614)..(614): n is a, c, g, or t
tcagtagtgtagatcacgaccggtgctcgatttagtctagcgactttgggtttgggggaggcttggtacagccgtggggggtccctgagactctcctgtgcagcctctggtttcatctttagcaactacgccatgagctgggtccgccaggctccagggaaggggctggagtgggtctcaggtattacgtggtagtggtaataccgcatactacgcagactccgtgacgggccgttcaccgtctccagagacaatccaagaatacggtctatcgtaggaaatgaacagcctgaacgngacccgaggacacggccccttactaattacgngtaggcgtaagganatcgaggacggaagttanacgcaggcagctcagactacgcggggaccaacggaccgtgcctaccgtctaccnacgcctaccgaaccgtacggacccacgtccgtaccctcccgtcggcctacccncctaccgaacgacgtccaccgtcgtcgggacctacgcgtccggccgtccggngtccgtccgtaggtacgaacgtacgttaccgtcaacgttccgaacctacgtaacgtcggaccggtgggacccggtggaccgaacggccgtatanacgg

SEQ ID NO: 79230 - DNA, 868 bp, Homo sapiens
  misc_feature: GYAE6OF02I4BJ0.37.26.C04.1.454.CMB.1.raw
  modified_base (400)..(400): a, c, t, g, unknown or other
  misc_feature (400)..(400): n is a, c, g, or t
  modified_base (742)..(742): a, c, t, g, unknown or other
  misc_feature (742)..(742): n is a, c, g, or t
tcagtagtgtagatcacgaccggtgctcgatttagtctagcgactttgggtttgggggaggcttggtacagcctggggggtccctgagactctcctgtgcagcctctggtttcatcttttagcaaacttacgccatggagtcgtcggtccgaccgaggtccgtaccggaagggggaacggggtcgtagggtagggttcgggttcctacggtaaggttacttttacgtagggttaggttaggttaaacctacccgataacttaccgtacgacgaacgtaccgttccggtacgggacccggggttcccgttaccacccgtttcctaccgaaggaacgtaactaaccttaacccgaaaaggtaacgttacggtacttacttcggtaaggtaaactacgaaacncgtccgtagggaagaccggtacccgggaaggacccgtccggtccctttacgtttaacttcgttgcggacgaaggtacgtactacggaacgggtaacggtagtttaaacggcagacgtcacggttactcgtaccgtaaccgtaggggtccggaaccgtaaccggtcccgtagtaccctaccgtccgtaccgtcgaccgttcccctacccggaaccggtaccggaccttaccggttcccgtttccccgtttaccccgcgtaccccttaccccgtacccgtaaccgaacgtccgcccgttacccggttcgggggaccgacgaccggacccggtccggttcccggngttaccggccgtacggttacggaccgtaacgtttacctaccgtttcccgacgttacccttaccgtaacgtttccgggaacggtccgggacggtccggacgggtaccgaccgtacgaccgtaggtac

SEQ ID NO: 79231 - DNA, 621 bp, Homo sapiens
  misc_feature: GYAE6OF02FS60P.37.26.C04.1.454.CMB.1.raw
  modified_base (311)..(311): a, c, t, g, unknown or other
  misc_feature (311)..(311): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtgggtctcaggtattactggtagtggtaataccgcatactacgcagactccgtgacgggccggttcaccgtctccagagacaattccaagaatacggtctatctggaaatgaacagcctgagagccgaggacacggccctntattactgtgcgagagatcagacggagtataggcagcagctctgactacgtcggggccaaccggaaccctggtccaccggtcctcctcacgtccctccaccgaacggcccactccggtcccttcccccgtcggccctaccccgtccctacccaacgaccgcctaccgtccgtcgggggaccacgacggccggcccgtcggggcctcgccgttcggtaccgtaaacggtaccttaccgttaccactaccgtaacctaaccgttacgtacggtacgtccgggcgtacggaccgaacgggcgtacgagtacgg

SEQ ID NO: 79232 - DNA, 620 bp, Homo sapiens
  misc_feature: GYAE6OF02FYQQI.37.26.C04.1.454.CMB.1.raw
  modified_base (310)..(310): a, c, t, g, unknown or other
  misc_feature (310)..(310): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtgggtctcaggtattactggtagtggtaataccgcatactacgcagactccgtgacgggccgttcaccgtctccagagacaattccaagaatacggtctatctggaaatgaacagcctgagagccgaggacacggccctntattactgtgcgagagatcagacgagtatagcagcagctctagacctacgtcggggccaaccggtacccgtggtcccaccggtcctcctcacgccctaccaccgaacggcccagtcccggtccttccccgtgcccaccctcctaccgaacgacgccaccgtcggtcggggtccacgaccggcccgggtcccgtcgggccgtcggtcccgttgggtaccgaaacggtaccttacccttaccgacttacccgtaaccaccttacgtacggacggccgggtccgtcgggaccgaacgggccgacgtagtacgg

SEQ ID NO: 79233 - DNA, 612 bp, Homo sapiens
  misc_feature: GYAE6OF02I9625.37.26.C04.1.454.CMB.1.raw
  modified_base (312)..(312): a, c, t, g, unknown or other
  misc_feature (312)..(312): n is a, c, g, or t
  modified_base (321)..(321): a, c, t, g, unknown or other
  misc_feature (321)..(321): n is a, c, g, or t
  modified_base (337)..(337): a, c, t, g, unknown or other
  misc_feature (337)..(337): n is a, c, g, or t
  modified_base (609)..(609): a, c, t, g, unknown or other
  misc_feature (609)..(609): n is a, c, g, or t
tcagtagtgtagatcacgaccggtgctcgatttagtctagcgactttgggtttgggggaggcttggtacagcctgggggggtccctgagactctcctgtgcagcctctggtttcatctttagcaactacgccatgagctgggtccgccaggctccgaggggaaggggctggagtgggtctcgaggtattactggtagtggtaataccgcatactacgcagactccgtgaccgggtccgttcaccgtctccagagacaattccaaagtaatacggtctatctaggaaatgaacagcctagagagccgaggacnccggccctntattactgtgcgaganatcaggacggatatagcagcagtctcgtacgactacggcggggaccaaccggaccctggtaccaccgttcctcctccacgccctaccgaccgacggcccacgttccgtcccttcccgtcgacctacccctcctaccgaagcaccgtaccgtcggtcgggaccgacgaccggccggcccgtcgggcctcggccgtggtacgaacgtccttaccttcacgttacctactaaccgtacgtacggacggccggtacgtcggacgtacggcgtacgntcg

SEQ ID NO: 79234 - DNA, 676 bp, Homo sapiens
  misc_feature: GYAE6OF02IHCL3.37.26.C04.1.454.CMB.1.raw
  modified_base (206)..(206): a, c, t, g, unknown or other
  misc_feature (206)..(206): n is a, c, g, or t
  modified_base (271)..(271): a, c, t, g, unknown or other
  misc_feature (271)..(271): n is a, c, g, or t
  modified_base (286)..(286): a, c, t, g, unknown or other
  misc_feature (286)..(286): n is a, c, g, or t
  modified_base (321)..(321): a, c, t, g, unknown or other
  misc_feature (321)..(321): n is a, c, g, or t
  modified_base (328)..(328): a, c, t, g, unknown or other
  misc_feature (328)..(328): n is a, c, g, or t
  modified_base (331)..(331): a, c, t, g, unknown or other
  misc_feature (331)..(331): n is a, c, g, or t
  modified_base (349)..(349): a, c, t, g, unknown or other
  misc_feature (349)..(349): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtgggtctcaggtattacgtggtagtggtaataccgnatactacgcagactccgtgacgggccgttcaccgtctccagacgacacttccaaagaatacggtnatcaggaaatgaacncgcctgagagccgaggacacggtcccactaattcngtgcganagntcagacggatatagcaancagctcgtagacttcgcggggaccaaccggtaccctggtacccaccgttcctcccgtacaaccggtccacccgaccgaacgggcccctacgtccggttcccttccccgcggtccaccccgtcctaccaacgtacgtaccaccgtccggcgggcccacggacggcccggtacccggtcgggtaccgtcggtacccgtacgggtacccgtaaacgtaacccggtttacccttaccgtaccgttaccccgtaaacgttacccgtaacgttccgggaacggtacccggggtcctacggggaacccgtaacgggaccgtaccgtaggaacgg

SEQ ID NO: 79235 - DNA, 583 bp, Homo sapiens
  misc_feature: GYAE6OF02JBQQ7.37.26.C04.1.454.CMB.1.raw
  modified_base (205)..(205): a, c, t, g, unknown or other
  misc_feature (205)..(205): n is a, c, g, or t
  modified_base (312)..(312): a, c, t, g, unknown or other
  misc_feature (312)..(312): n is a, c, g, or t
  modified_base (319)..(319): a, c, t, g, unknown or other
  misc_feature (319)..(319): n is a, c, g, or t
  modified_base (347)..(347): a, c, t, g, unknown or other
  misc_feature (347)..(347): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtgggtctcaggtattactggtagtggtaataccgnatactacgcagactccgtgacgggccgttcaccgtctccagagacaattccaagaatacggtctaatctaggaaatgaacagcctgagagccgaggacacggccctntattacngtgcgtagagatcagacggagtatacgnagcagctcgtagacctacgtggggacccaacgggaccctggtccaccgtctccgtcacgcctccacacggccacgtcggtccttcccgtcgccaccctcctcctaacgacgaccacctccgtcggggcacgcgaccggccgcggcgtcgtccgtcggtcgaacggtactaccgttcgtactacctaactacctacgcgacgtcggacgttacggaccggacggccgacgtatacgg

SEQ ID NO: 79236 - DNA, 602 bp, Homo sapiens
  misc_feature: GYAE6OF02F4QT5.37.26.C04.1.454.CMB.1.raw
  modified_base (355)..(355): a, c, t, g, unknown or other
  misc_feature (355)..(355): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtgggtctcaggtattactggtagtggtaataccgcatactacgcagactccgtgacgggccggttcaccgtctccagagacaattccaagaatacggtctatctggaaatgaacagcctgagagccgaggacacggccctctattactgtcgcgagagatcagacggagtagtagcgagcagctntgactacgtcggggccaacgggaaccctgggtaccaccgttccacctccacgccctccaaccaacgggccccaagtccggttcccttcccccgttcggacctacccctcctaccaacgacgccaccctcggtcggggcacacggccggcccgtcgggtcctcgccgttggtcgaaacgtccgtacttcccataccgtaactaacctacgtcgacggcggtcctcgggacgtacgggcgacgagtacg

SEQ ID NO: 79237 - DNA, 618 bp, Homo sapiens
  misc_feature: GYAE6OF02IQJG6.37.26.C04.1.454.CMB.1.raw
  modified_base (206)..(206): a, c, t, g, unknown or other
  misc_feature (206)..(206): n is a, c, g, or t
  modified_base (248)..(248): a, c, t, g, unknown or other
  misc_feature (248)..(248): n is a, c, g, or t
  modified_base (316)..(316): a, c, t, g, unknown or other
  misc_feature (316)..(316): n is a, c, g, or t
  modified_base (396)..(396): a, c, t, g, unknown or other
  misc_feature (396)..(396): n is a, c, g, or t
tcagtagtgtagatcacgaccggtgctcgatttagtctagcgactttgggtttgggggaggcttggtacagcctgggggggtccctgagactctcctgtgcagcctctggtttcatctttagcaactacgccatgagctgggtccgccaggctccagggaaggggctggagtgggtctcaggtattactggtagtggtaataccgnatactacgcagactcgtgacgggccgttcaccgtctccaganacaattccaagatacgtctatctaggaaatgaacagcctgagagccgaggacacggccctctattacngtgcgagagatcagacggagtatagtagcagctctgactacgtcggggaccaacggaacccgtggacctaccgtctcctnaccgtccctccaccgaacgggcccacgtccggtcccttcccccgtggcccaccctcccctaccaacgacgaccacccgtcgtcgggggaccacgacggccgggcccgtcgggacgtcgccgtcgggtacgaacggtaccttaccttaccacttaccgtaaccgtaccgttaacgtaggtacggtccgggtacgtacggacggaacggccggacgtagtagtg

SEQ ID NO: 79238 - DNA, 589 bp, Homo sapiens
  misc_feature: GYAE6OF02IUA0D.37.26.C04.1.454.CMB.1.raw
  modified_base (311)..(311): a, c, t, g, unknown or other
  misc_feature (311)..(311): n is a, c, g, or t
tcagtagtgtagatcacgaccggtgctcgatttagtctagcgactttgggtttgggggaggcttggtacagcctgggggggtccctgagactctcctgtgcagcctctggtttcatctttagcaactacgccatgagctgggtccgccaggctccagggaaggggctggagtgggtctcaggtattactggtagtggtaataccgcatactacgcagactcgtgacgggccgttcaccgtctccagagacaacttccaagaatacggtctatctaggaaatgaacagcctgagagccgagacacggccctntattactgtgcgagagatcagacggagtatagcagcagctgtagaactacgtggggacccaacgggaacccttggacctacccgtctccctcacgccctaccaaccgaacggcccacgtccggtccttccccgtcggcctacccctccctaccaacgacgcctaccgtacgtgggcacgacggccggcccgtggcctcgccgtggtacaacgtaccttactacctactacctaactactacgtgacggtacggcgtggaccgaacggcacgtagtacg

SEQ ID NO: 79239 - DNA, 852 bp, Homo sapiens
  misc_feature: GYAE6OF02ID8HD.37.26.C04.1.454.CMB.1.raw
  modified_base (210)..(210): a, c, t, g, unknown or other
  misc_feature (210)..(210): n is a, c, g, or t
  modified_base (228)..(228): a, c, t, g, unknown or other
  misc_feature (228)..(228): n is a, c, g, or t
  modified_base (296)..(296): a, c, t, g, unknown or other
  misc_feature (296)..(296): n is a, c, g, or t
  modified_base (304)..(304): a, c, t, g, unknown or other
  misc_feature (304)..(304): n is a, c, g, or t
  modified_base (313)..(313): a, c, t, g, unknown or other
  misc_feature (313)..(313): n is a, c, g, or t
tcagtagtgtagatcacgaccggtgctcgatttagtctagcgacttttgggtttgggggaggcttggtacagcctggggggtccctgagactctcctgtgcagcctctggtttcattctttagcaactacgccatgagctgggtccgccaggctccgaggggaaggggctggagtgggtctcgaggtattactggtagtggtaataccgnatactacgcagactccgngacgggccgttcaccgtctccagagaactaattccaaagaattacggtctatcgtaggaaatgaaacngcctgagngccgagacncggccctatacttacgtggtagcgagagatcgaggaacggagtagtagacgagcagtcttccgtagaaccttccggtcggggaccctaaccgggtaaaccccgttgggtaacccctacccggtttccctacccctaccgtacccggtacccccgttaaccccgaaaccccggtaaacccggggtacccccgtaaaccggtttcccccgggtttacccccgtttttacccccccgggtaccgggggtccccccgtacccccgtttccgggtaccccgttacccggaaccggggtaccgtaccccgttaaccccgtaccggggaaccgtaacccggacccgaaacccggtacccgggtccccgggtaccccgggttcggggtacccgttcggtacccccgggtacgggttaacccgggaaaccgtacccggttttaacccttaccccgtaattaccccgttaaacccgtaacccgtttaaccggtacgggaccgggtcccggggtaccgttccgggggaaccggtaccgggcccgtaaccg

SEQ ID NO: 79240 - DNA, 717 bp, Homo sapiens
  misc_feature: GYAE6OF02HAFQ7.37.26.C04.1.454.CMB.1.raw
  modified_base (330)..(330): a, c, t, g, unknown or other
  misc_feature (330)..(330): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtgggtctcaggtattactggtagtggtaataccgcatactacgcagactcgtgacgggccgttcacgtctccagagacaattccaagaatacggtcttatctaggaaaatgaaacagcctgagacgccgaaggacacggccctatatactgtgcgaaganatcgagacggataatagacagcagtcctcgtagacgttaacgtcgggggacccaacgggtaaccctcgggtaccaacccggttcctcccgtacacgtcccctacccgaaccgaaacggggtccccaagttacccggttccctttaccccgtggaccctacccgttccctaaccgaaagcgaccaaccgtcggtacggggacctaacgcggcccggtacccggttggggaccttacggtcccgttacgggtaaaccgtaaacggtaacccgttaacctttacccgtaacgttacccgttaaaccggtaaccttaccggtacggtaaccggggtaccggtaccggttaacgggacccgtaacgggggtaccgtaccggaacgttaaggg

SEQ ID NO: 79241 - DNA, 777 bp, Homo sapiens
  misc_feature: GYAE6OF02IX9D7.37.26.C04.1.454.CMB.1.raw
  modified_base (293)..(293): a, c, t, g, unknown or other
  misc_feature (293)..(293): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccgagggaaggggctggagtgggtctcaggtattactggtagtaggtaataccgctatactacgcagactccgtagaccgggccggttcaccgtctccagagacaactccaagaactacggtctatctaggaaatgaaacngcctgagacggcccgaaggggaccaccgggtccccttacttaatttacgtggtaggtccggaaggtaagacttcgaagggaaccggtaagttataaggcaaggcccaagtccttaccgtaggtaccctacgggtccgggggaaccccaacggtacccgtcggtaccctacccggtcctcctccgtacgccctcccgaaccgaaccgggtcccgtacgttcccggttccttcccccggtcggtccctaccccttccctacccggaaacgtaccgacccgtacccgtccgggtccggggaccgaccgtaaccgggcccgggtccccggttcggggtacccgtccgggtccgtttacgggtaacccggtaaaccggtacccgtttaacccgtttaccctaaccgttacccgttaaccgtaacccgttacggtacggacgggtaccggtaccggtacgggacccggaacgggccggtacgtagtacgg

SEQ ID NO: 79242 - DNA, 582 bp, Homo sapiens
  misc_feature: GYAE6OF02I2UJI.37.26.C04.1.454.CMB.1.raw
  modified_base (312)..(312): a, c, t, g, unknown or other
  misc_feature (312)..(312): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtgggtctcaggtattactggtagtggtaataccgcatactacgcagacctccgtgacgggccgttcaccgtctccagagacaattccaagaatacggtctatctaggaaatgaacagcctgagagccgaggacacggccctntattactgtgcgagagatcagacgagtatagcagcagctctgacctacgtcggggaccaacggacctggtccaccgtctccctcacgcctccaccgacggccacgtcgtcccttccccgtcggcctacccctcctaccaagacgaccaccgtcgtcggggcacgacggccggtacccgtcgggcctcgccgtggtaccgaacggaccttacgtaccacttccgtaactactaccgtggacgcgggtcgtcggaccgaggcgacgatacgg

SEQ ID NO: 79243 - DNA, 901 bp, Homo sapiens
  misc_feature: GYAE6OF02IKV88.37.26.C04.1.454.CMB.1.raw
  modified_base (210)..(210): a, c, t, g, unknown or other
  misc_feature (210)..(210): n is a, c, g, or t
  modified_base (218)..(218): a, c, t, g, unknown or other
  misc_feature (218)..(218): n is a, c, g, or t
tcagtagtgtagatcacgaccggtgctcgatttagtctagcgactttgggtttgggggaggcttggtacagcctgggggggtccctgagactctcctgtgcagcctctggtttcatctttagcaactacgccatgagctgggtccgccaggctccgaggggaaggggctgggagtgggtctcaggttattacgtggtagtggtaatccgnatactacncagactcgtggacgggccgttcaccgtctaccagagaacaattaccaaagaactacgtctatcgtaggaaaatgaaacacgccgtaggaagacgccggaaggtaccaccggtccccttacttaagtttaccgtggtaggacggaaggacgagtacgaagggacggtaacttagtaacgccgagtaccgaggtcccttacgtaacgtaacccgttaaccggggtcggggaccccgtaaaccggtaaccccggttgggtaaccccgttacccgtttaccgttaccccgtacgtacccgtaacccccgttaaccccgaaacccgggtaaacccgggttaccccttaaacccggtttcccccgggtttaccccgttttaccccccggtccggtacccccgtaaaccccccgtttaccccgtaaacccgtaaaacccggtaccggtaaccccgttaccccggtacggggtacccgggggaacctaaaccgggtacccggtacccggggtaccccgggtcggtaccggtacccgggttacccgttaaccgggtaaaccggaaacccggtttaccccgttaacgttaccctaaccgtttaccctaaaccgtaaccctaacggtaccgggtaaccgggtaccgggtaccggttaccgggaaccggtaaccggggacttaccgtaaggtacg

SEQ ID NO: 79244 - DNA, 817 bp, Homo sapiens
  misc_feature: GYAE6OF02IJHIL.37.26.C04.1.454.CMB.1.raw
  modified_base (816)..(816): a, c, t, g, unknown or other
  misc_feature (816)..(816): n is a, c, g, or t
tcagtagtgtagatcacgaccggtgctcgatttagtctagcgactttgggtttgggggaggcttggtacagcctgggggggtccctgagactctcctgtgcagcctctggtttcatctttagcaactacgccatgagcgtgggtccgccaggctccgaggggaggggctggagtgggtctcgaggtattacgtggtagtggtaataccgcatactacgcagacctccggtggacggggccgttcaccgtcctccgagagacaacttaccaagtaactacggtcttatacgtaggaaatgaacgagccgtagagacggaccggaaggaaccgaccggtccccttacttaacgtttacgttggtcggacggaaggtacgtactacggaagggacgggaagttaagtaacgacgtagacgagtctaccgtagaccgttaacggccgggggaccctaacccggggtaacccgttacgggtacccctaaccggttccctaccgtccgtaccgtacccctacccgaacccggaacccgggtaccctaaccggtttccccgggttacccctttccccccgggtaccggtaacccccctacccccgtttaccccgtaacccgtaaacggtacccgacccggttaacccggttccggggtaccggggacctaaccgggacccggtccccgggtcccggtcggggtcccgtccggtaccgttacgggtaccgtaaccgtacccgttaccttaccctacgttcctaacgtaccgtacgtacgggtacggccgggttccggacggaccggaaccggacgtggtaacgng

SEQ ID NO: 79245 - DNA, 676 bp, Homo sapiens
  misc_feature: GYAE6OF02GCZ63.37.26.C04.1.454.CMB.1.raw
  modified_base (288)..(288): a, c, t, g, unknown or other
  misc_feature (288)..(288): n is a, c, g, or t
  modified_base (345)..(345): a, c, t, g, unknown or other
  misc_feature (345)..(345): n is a, c, g, or t
  modified_base (357)..(357): a, c, t, g, unknown or other
  misc_feature (357)..(357): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccgagggaaggggctggagtgggtctcaggtattactggtagtggtaataccgcatactacgcagactccgtgacgggccgttcaccgtctccagagacaattccaaagaatacggtctatctaggaaatgaaacngcctagagagccgaggacacggcccctatattactgtgcgagagatcagacggatanagcagcagctcngaactcgtggggacccaacggtaacccgtggtacccaaccgttctacccgtcacgtccctacccgacccgaaacgggccccacgttcccggtaccctttcccccgtacgacccacccccgttaccctaccaaacggacgaccaccgttacgtccgggggaccaaccgcggaccgggtcccgtcgggacgtccgcccgttagggtacaaacgggttaccttaaccgttaccacgttaccgtaaaccgtaaccttaaccggtaggaccggtaccggggacgttaccgggaaccgtaacgggacccgttacgaattaccggg

SEQ ID NO: 79246 - DNA, 618 bp, Homo sapiens
  misc_feature: GYAE6OF02JCQXO.37.26.C04.1.454.CMB.1.raw
  modified_base (406)..(406): a, c, t, g, unknown or other
  misc_feature (406)..(406): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtgggtctcaggtattactggtagtggtaataccgcatactacgcagactccgtgacgggccggttcaccgtctccagagacaattccaagaatacggtctatctggaaatgaacagcctgagagccgaggacacggccctatattactgtaacgaaaatggcctacggatatgactactagttgggactggtactcgatctcgtggggcgtggcacctggtcacttcgtctcctcncgccctccaaccgacgggccccagttccggttccttcccccgtcgggcccgtcccgtcgcctccgacggacgcctacccgtccggagacgccacgacggccggcccgtgggcctcggtccgtgggtaccgacgggtaccttaccgttaccacttacctaccgtaaccttacgtcgggtacgggcccgggtcgtacgggtaccgaagggtccg

SEQ ID NO: 79247 - DNA, 670 bp, Homo sapiens
  misc_feature: GYAE6OF02JWHJO.37.26.C04.1.454.CMB.1.raw
  modified_base (207)..(207): a, c, t, g, unknown or other
  misc_feature (207)..(207): n is a, c, g, or t
  modified_base (279)..(279): a, c, t, g, unknown or other
  misc_feature (279)..(279): n is a, c, g, or t
  modified_base (294)..(294): a, c, t, g, unknown or other
  misc_feature (294)..(294): n is a, c, g, or t
  modified_base (339)..(339): a, c, t, g, unknown or other
  misc_feature (339)..(339): n is a, c, g, or t
  modified_base (420)..(420): a, c, t, g, unknown or other
  misc_feature (420)..(420): n is a, c, g, or t
  modified_base (570)..(570): a, c, t, g, unknown or other
  misc_feature (570)..(570): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccgagggaagggtctggagtgggtctcgaggtattactggtagtggtaataccgnaatactacgcagactccgtgaccgggtccgttcaccgttctccgagagacaacttccaaagatacggtctancgtaggaaatgaacngcctgagacgcgaggacacggccctatatacgtgtgacgagagtntaccgaggacggagtatcgcaagctagactcgtagactacggtcgggacctaacgggacccttggtacccaccggttaccncccgtcaaccgtccccgtaccgaacccggtacgggaccctacggtaccgttccccttccccgtacggaccccttacccgtacccgtaccgaacgtacccgtccgtacccgtacgggtaccgggaacccacggccggtcccgtaccccggngggtcctaccggtcccgtcggtaccggaacgtaccgtccttacgcccttacgaaccgtaacgtcgtaggccgaccggtcgcggtagaccggctagatacg

SEQ ID NO: 79248 - DNA, 796 bp, Homo sapiens
  misc_feature: GYAE6OF02FTKU7.37.26.C04.1.454.CMB.1.raw
  modified_base (145)..(145): a, c, t, g, unknown or other
  misc_feature (145)..(145): n is a, c, g, or t
  modified_base (246)..(246): a, c, t, g, unknown or other
  misc_feature (246)..(246): n is a, c, g, or t
tcagtagtgtagatcacgaccggtgctcgatttagtctagcgactttgggtttgggggaggcgttggtacagcctggggggtccctgagactctcctgtgcagcctctggttcatctttagcaactacgccatgagctgggtccnccaggcctccgagggaaggggctgggagtgggtctcaggtattactggtagtggtaataccgcatactacgcagactccgtgacgggtccgttcaccgtcnccagacgacattccgaagaatacggtctagtcgtaggaaatgaacacgcctagagacgaccgaaggacgaccggtaccctcgttaattacgtggttacggacgtaagagtacttacgaacggtaacgggagttacaacggtcgaagtccgaagccttcgttacgacgttacggtcgggggaccctaaaccggtaacccggtaggtacccaacccgttcccgtccgtacccgaacgccccttacccgaacccgtaaccgggaccccgtaaccgtacccggtttccccgtttacccccggtacgggtaccctacccccgttaccctaacccgaaacggtaccgtacccgtaacccgttcggtaccgggggtaccgaaccgacgggtaccgggtccccggtacgggtccgttccgggcccgttacgggtacgtaaaccgggtactttaacccgtacgtaaccgttacccggttaaacctacccgttaacggtaccgggtacggtacccgggtaccggtaccgggtaaccgtaacgggccgttacgagtaccgg

SEQ ID NO: 79249 - DNA, 733 bp, Homo sapiens
  misc_feature: GYAE6OF02JLV6D.37.26.C04.1.454.CMB.1.raw
  modified_base (237)..(237): a, c, t, g, unknown or other
  misc_feature (237)..(237): n is a, c, g, or t
  modified_base (270)..(270): a, c, t, g, unknown or other
  misc_feature (270)..(270): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccgagggaaggggctgggagtgggtctcaggtattactggtagtggtaataccgcatactacgcagactcgtgacgggccggttnaccgtctccagagacaattccaagaatacggtntactctaggaaatgaacagctagagagccgaggaccacggcctactacgttactgtagccgtagaagtatcgaggaacggagtaagtacgacacggtacagtctactacggtaaccgtagggtccgggggacccaaaccgggaaacccgttgggtaaccccgaccgttccgtacccttacgacggtacccctacccggaaacccgaacgggtcccctaacgttcccgttaccccttcccgttacggacccctacccctacccgtaccgaaacgacgtcccgtaacccgtcgggtccggggacctaacgaccggtacccggcccgtaggggccctacggtcccgttacgggtacgaaccgggtaccttaacccttacgtaaccgtacgtaacccgttaaccgttacggtacggaccgggtacgggtcccgtaaggtcccggaacggtccgggtacctagtacgg

SEQ ID NO: 79250 - DNA, 204 bp, Homo sapiens
  misc_feature: GYAE6OF02H6AA8.37.26.C04.1.454.CMB.1.raw
  modified_base (138)..(138): a, c, t, g, unknown or other
  misc_feature (138)..(138): n is a, c, g, or t
  modified_base (146)..(146): a, c, t, g, unknown or other
  misc_feature (146)..(146): n is a, c, g, or t
  modified_base (170)..(204): a, c, t, g, unknown or other
  misc_feature (170)..(204): n is a, c, g, or t
tcagtagtgtagatcacgaccggtgctcgatttagtctagcgactttgggtttggggggaggcttggtacagccctggggggtccctgagactctcctgtgcagcctctggtttcatctttagcaactacgccatganctggtccncaggctcagggaagggctgagtgnnnnnnnnnnnnnnnnnnnnnnnnnnnnnnnnnnn

SEQ ID NO: 79251 - DNA, 630 bp, Homo sapiens
  misc_feature: GYAE6OF02I8EBN.37.26.C04.1.454.CMB.1.raw
  modified_base (227)..(227): a, c, t, g, unknown or other
  misc_feature (227)..(227): n is a, c, g, or t
  modified_base (353)..(353): a, c, t, g, unknown or other
  misc_feature (353)..(353): n is a, c, g, or t
  modified_base (407)..(407): a, c, t, g, unknown or other
  misc_feature (407)..(407): n is a, c, g, or t
  modified_base (623)..(623): a, c, t, g, unknown or other
  misc_feature (623)..(623): n is a, c, g, or t
tcagtagtgtagatcacgaccggtgctcgatttagtctagcgactttgggtttgggggaggcttggtacagcctgggggggtccctgagactctcctgtgcagcctctggtttcatctttagcaactacgccatgagctgggtccgccaggctccgaggggaaggggctgggagtgggtctcaggtattactggtagtggtaataccgcatactacgcagactccgngacgggccgttcaccgtctccagagacaatccaagaatacggtctatctaggaaatgaacagcctgaagagccggaggacaccggccctatattactggtcgacgagagatcgaaggacggagtanagcagcagctgtagactacgtggggccaacggtacctggtccacccgtctcctnaccgcctaccgaccgaacggccctagtccggtccctcccgtgacccacctccaccgaagccacctacgtcggacgggccacgtacgggcccgtcccggtgggtaccctggtccccgttgggacctaaaccgggttacctaccgtttaccgaaccttcgtaaacccgacttaccggtacggtacgggtccgggtctacgggaccgtaacggccgtanagtaacg

SEQ ID NO: 79252 - DNA, 654 bp, Homo sapiens
  misc_feature: GYAE6OF02GJS80.37.26.C04.1.454.CMB.1.raw
  modified_base (377)..(377): a, c, t, g, unknown or other
  misc_feature (377)..(377): n is a, c, g, or t
tcagtagtgtagatcacgaccggtgctcgatttagtctagcgactttgggtttgggggaggcttggtacagcctgggggggtccctgagactctcctgtgcagcctctggtttcatctttagcaactacgccatgagctgggtccgccaggctccaggggaaggggctggagtgggtctcaggtattacgtggtagtgggtaataccgcatactacgcagacctccgtgacgggccggttcaccgtctccagagacaattccaagaactacggtctagtctggaaatcgaacagtcctgagacgccggagacaccgggtccctactattactgtgcgtagagatcagacggagtatagcagcagctctagactacgngggaccacggaaccctggtcacccgtctcctcacgtccctccgaccgacgggcccacgtccgttcccgttccccgtcggccctaccccgtccctaccgtaaacgcgccacccgtcggtcgggggccaaccgcggtccgggacccgtcggggaccgtcggtacccgtcggtacggtaaccggtaccttacccttaccgacgttaccctaacctacccgttaccgtaggaccgggtacgggtaccggtcgggtacccggagggtcccgtacgagtacgg

SEQ ID NO: 79253 - DNA, 663 bp, Homo sapiens
  misc_feature: GYAE6OF02I4EGV.37.26.C04.1.454.CMB.1.raw
  modified_base (360)..(360): a, c, t, g, unknown or other
  misc_feature (360)..(360): n is a, c, g, or t
tcagtagtgtagatcacgaccggtgctcgatttagtctagcgactttgggtttgggggaggcttggtacagcctgggggggtccctgagactctcctgtgcagcctctggtttcatctttagcaactacgccatgagctgggtccgccaggctccgagggaaggggctggagtgggtctcaggtattactggtagtggtaataccgcatactacgcagactccgtgacgggccgttcaccgtctccagagacaattccaaagaatacggtctatctaggaaatgaacagcctagagagccgaggaccacggccctatacttacgtgtgcgaagagatcaggacgagtatagcagcagctntcgactacgtcggggacccaacggaacccgttggtaccaccgttcctccgtacacgccctaccaaccgacgggaccccacgttccggtaccctttcccccgtcggacccctaccccgtacccttaccgaaacggacgtaccctaacccgttcggtccggggaccacggaccgccgggtacccgtcggggcctcggtcccgttaggtaccggaacgtaccttaacccgttctaaccgttacctaaccgtacctaccggtcggacggccgggtacgtcgggaacgacgggacgacgtacgtaacg

SEQ ID NO: 79254 - DNA, 635 bp, Homo sapiens
  misc_feature: GYAE6OF02JEDNX.37.26.C04.1.454.CMB.1.raw
  modified_base (243)..(243): a, c, t, g, unknown or other
  misc_feature (243)..(243): n is a, c, g, or t
  modified_base (311)..(311): a, c, t, g, unknown or other
  misc_feature (311)..(311): n is a, c, g, or t
tcagtagtgtagatcacgaccggtgctcgatttagtctagcgactttgggtttgggggaggcgttggtacagcctggggggtccctgagactctcctgtgcagcctctggtttcatctttagcaactacgccatgagctgggtccgccaggctccagggaaggggctggagtgggtctcaggtattactggtagtggtaataccgcatactacgcagactccggtgacgggcgttcaccgtcnccagagacattccaagaatacggtctatctaggaaatgaacagcctagagagccgagacacggccctnatactgtgcgagagatcagacggagtatagcagcagactcgtagactcgtcgggacacggaacctggtacacccggtctcctcagtcccctaccaccgaaccggacccacgtcccggttaccttcccccgtacggtaccctaccccgttccctaccgaacgtaccgacctacccgtccgtacggggcctaccgacggacccggtcccgtcgggccgtcgtacccgtggtaccaacggtaccttacctccgtaaccttaccgtaacctaccgtacgtacgacggtcggaccggtacggtaccggacggaccggtacgtagtacgg

SEQ ID NO: 79255 - DNA, 911 bp, Homo sapiens
  misc_feature: GYAE6OF02FOLWK.37.26.C04.1.454.CMB.1.raw
  modified_base (905)..(905): a, c, t, g, unknown or other
  misc_feature (905)..(905): n is a, c, g, or t
  modified_base (910)..(910): a, c, t, g, unknown or other
  misc_feature (910)..(910): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccaggggaaggggctggagtgggtctcaggtattactggtagtggtaataccgcatactacgcagactccgtgacgggccggttcaccgtctccagacgacaattccaagaatacggtctaatctaggtaaatggaacagtcctaggaagacggcccggaaggaccgacccgggtcccctcttaacttacgtggttcgaccggaagacggcccccttaccgacccttacgacgtccaacggaccgacggtaccggggttacgtaacccggttttccgggacggggggggaccccctaaacgggggggtaaccccccgttggggtttaccccgaaaccccggttcccgtttacccccgttaccgtaacccggggtcccccctttaaccccccgaaaccccggtaaaccggggggtcccccccgttaaaccggtttcccccgggggttttaccccgttttaccccccccccgggtacggggtaccccccccgttaaaccccccctttaccccgtaaccccgttaaaaccgggacccgttaccccggttaaaccccggttccggggtaccggggggaacccgaccggttaaccgggccccgggttaccccggtcgggggttcccttccgggtaccccgggttacggtaccggaaaccggttaccgttaacccgttaccgtacccttacgttacccgtaactaccggtcgggaccgggtcgggaccgttcgggaacgtaacgggcctacgaagtcgngacgng

SEQ ID NO: 79256 - DNA, 755 bp, Homo sapiens
  misc_feature: GYAE6OF02G3GP1.37.26.C04.1.454.CMB.1.raw
  modified_base (350)..(350): a, c, t, g, unknown or other
  misc_feature (350)..(350): n is a, c, g, or t
tcagtagtgtagatcacgaccggtgctcgatttagtctagcgactttgggtttgggggaggcttggtacagcctggggggtccctgagactctcctgtgcagcctctggttcatcttagcaactacgccatgagctgggtccgccaggctccgaggggaagggctggaggtgggtctcgaggttattacgtggtagtaggtaactaccgcatactacgcagactccgtgaccgggtccgttcaccgtctccagacgactaattccaaagtaactacggtctaagtcgtaggaaatgaacagcctagagagccggaaggaccacggccctattattacgtgtgacgagganatacgaaggacggagtatacgacagacagctcagtaacctcggtcggggaccaaccggacctggtacctacccgtctccgtacacgtccctaccaaccgacggacccacgtccggttacccttccccgtcggtaccctaccccgtacccgtaccgaaacgtaccgccctaccgttccgggtacgggggaccacccggtaacggccccggggtacccgtcggggtacccgtaccggtcccggttacgggtaacccgtaaacgggttaacccgttaacccgtttacccgtaaccgtttacccgttaaacccgtaacccggtttaaccgtaacgggtaccgggtacccgggggtaccggtttacccgggggaaccgtaaaccggggcccgtaaccggtaagtaccggg

SEQ ID NO: 79257 - DNA, 841 bp, Homo sapiens
  misc_feature: GYAE6OF02HGVMS.37.26.C04.1.454.CMB.1.raw
  modified_base (311)..(311): a, c, t, g, unknown or other
  misc_feature (311)..(311): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccgagggaaggggctggagtgggtctcaggtattactggtagtggtaataccgcatactacgcagactcgtgacgggccggttcaccgtctccagagactattccaaagatacggtctatctaggaaatgaacagcctgagacgcgagacacggccctntatctgtgcgagagatcgagacggagtatagcaggctagctacgtcgtacgtacggtcggggacccgaaccgggtaacccttggggtcccaacccggtttcccttcccgtaccgaccgtaccccgtaccccgaacccggaaaccgggacccccgtaacggttacccccggttccccgtttaccccccggtttacccggaccccgttaaccccccgttaccccgtaacccggtaaaccggtaacccgtaccccgtacccggttcccgggtacccgggggggtaccctaaacccgggtacccgggtaccccggggtccccggtaccgggggttaccgttacccgggttcccggtttaaccggggttaaacccggtaaaccgggttaacccttaaccccgtttaccccgttaacgtttaaccccgttaaacccgtaacccgtttaaccggttacgggtaacccggggtaccgggttaacccggttaccggggaaccggtaaccggggtaaccggtacggtaaaccgttaacgg

SEQ ID NO: 79258 - DNA, 709 bp, Homo sapiens
  misc_feature: GYAE6OF02IV0BQ.37.26.C04.1.454.CMB.1.raw
  modified_base (206)..(206): a, c, t, g, unknown or other
  misc_feature (206)..(206): n is a, c, g, or t
  modified_base (241)..(241): a, c, t, g, unknown or other
  misc_feature (241)..(241): n is a, c, g, or t
  modified_base (248)..(248): a, c, t, g, unknown or other
  misc_feature (248)..(248): n is a, c, g, or t
  modified_base (283)..(283): a, c, t, g, unknown or other
  misc_feature (283)..(283): n is a, c, g, or t
  modified_base (326)..(326): a, c, t, g, unknown or other
  misc_feature (326)..(326): n is a, c, g, or t
  modified_base (366)..(366): a, c, t, g, unknown or other
  misc_feature (366)..(366): n is a, c, g, or t
  modified_base (684)..(684): a, c, t, g, unknown or other
  misc_feature (684)..(684): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccgagggaagggctggagtgggtactcaggtattactggtagtggtaataccgnatactcgcagactcgtggacgggtccgttcacgtntccaganacaatccaagaatacggtctaagtctaggaaatanaacacgcctgagaggaccgagacaccggcctacttaattaccnggtagcgaagagtactacaggtaacgacggttaatacggnaacgtcaacggtccttgacgttaactccggtacggggacccctaacgggaacccttggtcccgtaacgttcccttactaccggactaccccgacccgtaaccggaaaccgggtccctaaacggtccggtttaccccgttcccgtcgggtacccgtcccgtcgtacccgttaccggaacggtacgaccgtaacccgttccgaaggccgtaacgaccgtacggcccggtacccggttggacccgtacggtaccgttacggaccgtaaaccgggtcttaacccgttccgaacttacccgtaagtccttaaccgtgaccggngggtccgtaggaaccgtagtcaacg

SEQ ID NO: 79259 - DNA, 738 bp, Homo sapiens
  misc_feature: GYAE6OF02G1PIZ.37.26.C04.1.454.CMB.1.raw
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtgggtctcgaggtattactggtagtggtaataccgcatactacgcagactcgtgacgggccgttcaccgtctccagagacaacttccaagaatacggtctatctaggaaaatgaacagcctgagagccgaggacacggcctctatactgtgcgagagatcgagacggagtaatgacagcagctcagactacgcggggaccaacggtaacccgtggtccgaacccgttctccctacaccgccctaccgaaccgaaccgggcccctaacgttcccgggttccctttcccccggtcggacccacccccgttccctaacccgaacggtacccgtccgaaccccgtttcgggtaccggggggtaccaacccgaacggggtccccgggtccccggtacgggggccccgtttcgggtccccgttagggggtaacccgaaaggggttaacccctttaacccttacccgtaacgttaccccgttaaccaacccgtttaacccgtacgggaaccccgggttaccgggggccgtttacgggggaaccccggtaaggggaccccgaacgtacgtaacggg

SEQ ID NO: 79260 - DNA, 676 bp, Homo sapiens
  misc_feature: GYAE6OF02IEZ0N.37.26.C04.1.454.CMB.1.raw
  modified_base (209)..(209): a, c, t, g, unknown or other
  misc_feature (209)..(209): n is a, c, g, or t
  modified_base (302)..(303): a, c, t, g, unknown or other
  misc_feature (302)..(303): n is a, c, g, or t
  modified_base (337)..(337): a, c, t, g, unknown or other
  misc_feature (337)..(337): n is a, c, g, or t
  modified_base (376)..(376): a, c, t, g, unknown or other
  misc_feature (376)..(376): n is a, c, g, or t
  modified_base (457)..(457): a, c, t, g, unknown or other
  misc_feature (457)..(457): n is a, c, g, or t
  modified_base (543)..(543): a, c, t, g, unknown or other
  misc_feature (543)..(543): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccgagggaaggggctgggagtgggtctcaggttattacgtggtagtggtaataccgnaatactacgcaagactccggtgacgggtcccgttcacccgtctccgagacgactaattccaagaaacttcggtctatcgtaggaaatgaaacnnccgtggacgacgaccgaggaccaccggtcccctntatttaccgtgtgcgagagtatcgaggacggtaggttanacggacagcacgtaccttgtagaaccgtacggtacgggggaaccaccggtaacccgtcggtaccacccggttcctccgacnccgtacccctaccgaaccggaccgggccctaacgtcccggtccttccccgcggtccctaccctcctaccgacgcactacccgtcgngggacacgacgccggcccgtggcctcgtaccgtcggtaccgaaacggttacccttaccgttaccgtattcccgtaactaccgtacgtacggtaccgggtcgtacggtacggaccgtacggcgtaccgatacgg

SEQ ID NO: 79261 - DNA, 893 bp, Homo sapiens
  misc_feature: GYAE6OF02J1KGB.37.26.C04.1.454.CMB.1.raw
  modified_base (193)..(193): a, c, t, g, unknown or other
  misc_feature (193)..(193): n is a, c, g, or t
  modified_base (210)..(210): a, c, t, g, unknown or other
  misc_feature (210)..(210): n is a, c, g, or t
tcagtagtgtagatcacgaccggtgctcgatttagtctagcgactttgggtttgggggaggcttggtacagcctggggggtccctgagactctcctgtgcagcctctggttcatctttagcaactacgccatcgagctgggtccgccaggctcccgagggaagggcctgggagtgggtctcgaggtattacgnggtagtggtaatcccgntatactacgcacgactccggtgaccgggtccggttcaccggtctaccgaggtagaacctaatttcccgaaaggaacttacgggttacctaagttccgtaaggtaaaagttacgaaacccgtaacggccgttaacgggaacgaccgggtacccggtaaacgggacccgaaacccgggtcccctttaacgttaaacgtttaccggtcgggtttaaccgaccggtaacggaaagggtaaccttaccgggaaaccggggtaaccgggtaacgttaaagttaaccgggcttaaaccgggctaaacggggtcccctttaaggttccgtaaaaccgttaccgggggtacggggtaaccccgtaaccggggttaacccttacggggtaccacccgtttaccgtcccgtaccgacgttacccgtacccgaccgtaaccgggtccctaccggttccgtacccgttccccacggtaccctaccccgttccgtaaccgaaccgtacggtaccaacccggtgggttaccggggaacctaacccggcgggtaccccggtcggtaccggggtaccttaccggtccgggttacgtaaacgacgggttaaccccttacggtaacctctaccgttaaccgtacctaccggttcgggtaccgacgggttcgtaaccggtccgtaacggcgttacctagtacg

SEQ ID NO: 79262 - DNA, 679 bp, Homo sapiens
  misc_feature: GYAE6OF02GJN41.37.26.C04.1.454.CMB.1.raw
  modified_base (149)..(149): a, c, t, g, unknown or other
  misc_feature (149)..(149): n is a, c, g, or t
  modified_base (251)..(251): a, c, t, g, unknown or other
  misc_feature (251)..(251): n is a, c, g, or t
tcagtagtgtagatcacgaccggtgctcgatttagtctagcgactttgggtttgggggtagggcttggtacgagcctggggggtccctgagactctcctgtgcagcctctggtttcatctttagcaactacgccatcgagctgggtccnccaggctccagggaagggctggagtggtctcagccatttccggcaacgtggtggtaggcacgcactacgcagactccgtgaagggccggttcacgtctcganacgacaattccaaagaaccacgtctctatctgacaaatgaacacgcctagagacgccgaagacgaccggtacgtaataacttacgtagtagtagaaaggcgtagggagtgggggactggtcgggaccgaggaacccgtggtaccaccgtctaccgtcacgcctaccacgaacggcctcgtcgtcctcccgtcgtccgaccgtaccgtccgaagtacgcctaccgtcgtcggggaccacgacgtccggtaccgtcgggtacgtcggtccgtcgggtacgtaaacgggtaccgttaaccgttacccgtacgttaccgtaaccgtaaacgttaccgttacgggaacggtaccggggtaccgttacgggaaccggtaaaccggggcccgtaaccggtaacgtacgggtactacggtctacggcctacggacc

SEQ ID NO: 79263 - DNA, 712 bp, Homo sapiens
  misc_feature: GYAE6OF02HD8ZZ.37.26.C04.1.454.CMB.1.raw
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccgaggggaaggggctggagtgggtctcgaggtattactggtagtggtaataccgcatactacgcagactcgtgacgggccgttcaccgtctccagacgacaattccaaagaatacggtctatctaggaaatgaacacgcctgagacgccgaggaccacggccctatattctggtgcgagagatcgaggacggatatacgcagcagtcctctacggaacttaccgggaccgggacccgaaacccggtaacccgttcggtacccgtaacccgttcgttacccgtacgacccgtaccccgtacccgaaaccggaaccggccctacggttcccggttccccttcccggtccggtccctaccccgtcccgtaacgaacgaccgtaccgtaccgtccgggacgggaccaacggaccggtacccgggaccgtcgggtaccgtccggtccggtacggtaaccgtaacggttaccgttaccgtacctaacgttaacctaaccgtaaccgttacggtacggtaccgggacgggtaccggtacggacggtaaccggcgtacgtagtacgg

SEQ ID NO: 79264 - DNA, 742 bp, Homo sapiens
  misc_feature: GYAE6OF02JTQHU.37.26.C04.1.454.CMB.1.raw
  modified_base (320)..(320): a, c, t, g, unknown or other
  misc_feature (320)..(320): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccaggggaaggggctggagtgggtctcaggtattacgtggtagtggtaataccgcatacctacgcagactccgtggacgggccgttcaccgtctccagagacaattccaagaactacggtctatctaggaaatgaacagcctaggagacgccgaggacaccggccctntattactgtgcgagagatcgagacggatatagcagacagtctcgtacgtaactaccggtcgggggaaccctaccgggtacccgtggtccctaacccggttcctacccgtaccgaccggtacccctaccccgaacccggaaccgggaccccgtaaccgttcccggttcccccgttacccccgtccggtacccctacccccgttaccccgtaacccgtaaccgtaccgaccccgtacccggtccgggtaccgggggacccaccggtaccggccccgggtcccggtcgggtccgtccggtcccgttaccgggaccgtaaccggtaccttacccgttacccgtaacgttacccgtaaccgtaccttacggtaccggtacgggtccgggtacggtacggtaccggaaccgggccgtaccgtagtacg

SEQ ID NO: 79265 - DNA, 659 bp, Homo sapiens
  misc_feature: GYAE6OF02JG6LT.37.26.C04.1.454.CMB.1.raw
  modified_base (348)..(348): a, c, t, g, unknown or other
  misc_feature (348)..(348): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaagggctggagtgggtctcgaggtattacgtggtagtggtaataccgcatactacgcagactccgtggacgggccggttcaccgtctccagagacaattccaagaatacggtctatctaggaatgaacagcctagagacgcgaacggacacggccctatatactggtgacgagagatcgagacggagtanagctagacagctgtacgtactacggtcgggaccaccgggaaccgtcggtaccctacccgtctcccgcgacgtccctaccgaaccgaccgggaccctacggttaccccggtcccgttacccccgtcgggtacccctaccccctacccgttaccgaaacgtccgtaaccacccgtcgggtaccggggaccaacgcgggcccgacccggtcgggcctcgggcccgttacgggtacgaacggttaccgtacttacccgactaccgtactacgtacgtgaccggcgggtacgcggacgtacgggccgtagtagtcg

SEQ ID NO: 79266 - DNA, 653 bp, Homo sapiens
  misc_feature: GYAE6OF02ILVN1.37.26.C04.1.454.CMB.1.raw
tcagtagtgtagatcacgaccggtgctcgatttagtctagcgacttttgggtttggggggaggcttggtacagcctgggggggtccctgagactctcctgtgcagcctctggtttcatctttagcaactacgccatgagctgggtccgccaggctccagggaaggggctggagtgggtctcaggtattactggtagtggtaataccgcatactacgcagactccgtgacgggccggttcaccgtctccagagacaattccaagaacacactgtctctgacaaatgaacacgcctgagagtcgaggacacggccttatattactgtgtgaagggacctctacgaccccttatagcacgcggctcggtctggtactttgacgacgtcggggccgaacgggtaacccgtggtaccgtaccgtcctcctacacgccctaccaccgacgggcccacttccggtccttccccgtcggcctcccgtcgcctccgtacgggaccgccacccgtccgacggacgaccacgccggccggtacccgtggggtcctcgggtacccgttcgggtaccgaaacggtcccttaccgttaaccctcgttaccttaccctaaccttacggtcggtaccgggtccggggtaccttacggggacgaaccggg

SEQ ID NO: 79267 - DNA, 738 bp, Homo sapiens
  misc_feature: GYAE6OF02GDX41.37.26.C04.1.454.CMB.1.raw
  modified_base (276)..(276): a, c, t, g, unknown or other
  misc_feature (276)..(276): n is a, c, g, or t
tcagtagtgtagatcacgaccggtgctcgatttagtctagcgactttgggtttgggggaggcttggtacagcctgggggggtccctgagactctcctgtgcagcctctggtttcatctttagcaactacgccatgagctgggtccgccaggctccagggaaggggctgggagtgggtctcaggtattactggtagtggtaataccacatactacgcagactcgtgaacgggccggttcaccatctccagggacaattccaagaacacactgtctcnacaaatgaaacagcctgagagtcggaggacacggccttatattactgtgtagaacggactctacgtcccttatacgcagccggcgttcgtaccgtggttacttcggacgtacgtcgggaccgacgggtaacccgtcggtaccgaccggttcccttaccgtacgacggtaccctccccgaaaccgtaaccggggacccctacgttaccccgggtttacccttccccccggtagggtccccggtccccgttacgccccgttaacccggcggtaccgacccggtacccgtccgtaggaaccgtcccgaacgacccgggccccggtcccgggtcggtaccggttcgacccgttcgggttaacccgaaccggtacccgtttaaccgttcccgtaaaccgttccgttaacccgtaaccgtaccggttacggaaccgggtcccgggtaccgttacgggaccgtaacggg

SEQ ID NO: 79268 - DNA, 599 bp, Homo sapiens
  misc_feature: GYAE6OF02FX4JL.37.26.C04.1.454.CMB.1.raw
tcagtagtgtagatcacgaccggtgctcgatttagtctagcgactttgggtttgggggaggcttggtacagcctgggggggtccctgagactctcctgtgcagcctctggtttcatctttagcaactacgccatgagctgggtccgccaggctccagggaaggggctggagtgggtctcaggtattactggtagtggtaataccgcatactacgcagactccgtgacgggccgttcaccgtctccagagacaattccaaagaatacgggtctatctggaaatgaacagcctgagagccgaggacacggccctctattactgtgcgagagatcagacggagttatagcagcagctctgactacgtggggccacggaaccctggtcagtcgtctcctcacgccctccaccgaacgggcccagtccggtccttccccgtcggccacccctcctaccaacgacgccaccgtcgtcggggcacgacggccgggcccgtgggccgtcgtccgtcgggtacgaacggtaccttaccgttccaacgttccctaacaaccgttaccgtacggtacggcgggtcggtacggacgaacggtcgactaacg

SEQ ID NO: 79269 - DNA, 667 bp, Homo sapiens
  misc_feature: GYAE6OF02JBQFN.37.26.C04.1.454.CMB.1.raw
  modified_base (522)..(522): a, c, t, g, unknown or other
  misc_feature (522)..(522): n is a, c, g, or t
  modified_base (663)..(663): a, c, t, g, unknown or other
  misc_feature (663)..(663): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccgaggggaaggggctgggagtgggtggccaacataaagcaagatggaagtaaagaaggagtatggtggactcgtgtggaagggtcctttacaccattcctcgaagacgaaccaacgccaaagaacctccgtgacctatcctgacaaaatcgaaactgtctaggaagacgccggaagaccgacggtacttaatttacttacgtgccgacgaagaggaacggtacgtggggtccggttttacgaaccgttacggtcggggaccaaacggggaacccttgggtaccacccgtacgtcctacgacgtccctaccgaccgaacgggcccctagtccgtcccttcccgcggcccgtccctcgcctcgacggaccncctacccgtacgacgacgaccgacgacggcccggtaccgtccgggtcgtcggccgttacggtacgaacggtacctcctaactacgtactacctaccgtacgcggtacggcggtcgtacggtacgacggacgtacagtacgngcag

SEQ ID NO: 79270 - DNA, 631 bp, Homo sapiens
  misc_feature: GYAE6OF02GIAR0.37.26.C04.1.454.CMB.1.raw
  modified_base (246)..(246): a, c, t, g, unknown or other
  misc_feature (246)..(246): n is a, c, g, or t
  modified_base (327)..(327): a, c, t, g, unknown or other
  misc_feature (327)..(327): n is a, c, g, or t
  modified_base (337)..(337): a, c, t, g, unknown or other
  misc_feature (337)..(337): n is a, c, g, or t
  modified_base (361)..(361): a, c, t, g, unknown or other
  misc_feature (361)..(361): n is a, c, g, or t
  modified_base (415)..(415): a, c, t, g, unknown or other
  misc_feature (415)..(415): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaagggctggagtgggtctcaggtattacgtgggtagtggtaaataccgctatactacggcagactccgtgacgggccggttcaccgtnccagagacaattccaaagaatacggtctaatcgtagaaatgaacagcctgagacgccgaggacaccggccctactattacngtgccgaagngatcgaggacgatatgctagcagntcctgactacggtcgggacccacggtaaccctggtaccaccgttcctccgtacncgtccctaccaccgacggcccagtccggtaccttccccgtggccctaccctcctcgaacgacgcctaccgtcggtcgggaccacgacggccggtccgtcgggtccgtcgtcccgttaggtaccgaacggtaccttaccgttcctaacgtacccgttaactaccgttacgacggtacgggtccggtcgtcgggtacgacgggtccgacgtacgtcgg

SEQ ID NO: 79271 - DNA, 634 bp, Homo sapiens
  misc_feature: GYAE6OF02HVOGV.37.26.C04.1.454.CMB.1.raw
  modified_base (265)..(265): a, c, t, g, unknown or other
  misc_feature (265)..(265): n is a, c, g, or t
  modified_base (345)..(345): a, c, t, g, unknown or other
  misc_feature (345)..(345): n is a, c, g, or t
  modified_base (365)..(365): a, c, t, g, unknown or other
  misc_feature (365)..(365): n is a, c, g, or t
  modified_base (373)..(373): a, c, t, g, unknown or other
  misc_feature (373)..(373): n is a, c, g, or t
  modified_base (379)..(379): a, c, t, g, unknown or other
  misc_feature (379)..(379): n is a, c, g, or t
  modified_base (422)..(422): a, c, t, g, unknown or other
  misc_feature (422)..(422): n is a, c, g, or t
  modified_base (476)..(476): a, c, t, g, unknown or other
  misc_feature (476)..(476): n is a, c, g, or t
  modified_base (494)..(494): a, c, t, g, unknown or other
  misc_feature (494)..(494): n is a, c, g, or t
  modified_base (606)..(606): a, c, t, g, unknown or other
  misc_feature (606)..(606): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagctggggtcccgccaggcctccgaaggggaaggggctgggagtgggtctcgaggttattacgtggtagtggtaataccgcatactacggcagactccggtggaccgggtccgttcaccgtctaccgaganacaattccaagaatacggtctatctaggaaatgaacagcctagagacgcgaggacacggcccctatattactgtagcganagtatcgaaggacgtagtanagcagacngctcgngactcggtcggacccgtaacgaccggtcgtacccgcgtcaccncgaccgtcccaaccgaccgacggtcctacgtcccgttcccgtaccgccgacccncccgtaccacgaacgacnccgtacgcgggtacggaccgaaccgtccggcccgtcccggcggtccgtccgtcgtcggaacgaccgtaaccttccgtactaccgtcgtaaccttagacggcgtacgggccgngttaccgggaacgtcggactaggactag

SEQ ID NO: 79272 - DNA, 647 bp, Homo sapiens
  misc_feature: GYAE6OF02I73AZ.37.26.C04.1.454.CMB.1.raw
  modified_base (311)..(311): a, c, t, g, unknown or other
  misc_feature (311)..(311): n is a, c, g, or t
  modified_base (318)..(318): a, c, t, g, unknown or other
  misc_feature (318)..(318): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtgggtctcaggtattactggtagtggtaataccgcatactacgcagactccgtgacgggccgttcaccgtctccagagacaattccaagaatacggtctatctggaaatgaacagcctagagacgcgagacgaccgccctntattacngtgcgagagatcgaggacggagtagtagcagcacgtctcgtagactacggtcggggacccaacgggtaaccctgggtaccctacccggtcctccgtcaccgtccctacccgaacccgaacgggccccacgttcccggttccccgttcccccgtcggcccctacccctccctaccgaaacgccgtaccgaccctcgggtcggggaccacgcggcccggcccgtcgggccgtcggtccgtcggtaccgtaacggtaccttacccgtctacctaccctaacctaccgtacggtacgacggcgggtacgtcggaccgaacggccgcgtaatcg

SEQ ID NO: 79273 - DNA, 669 bp, Homo sapiens
  misc_feature: GYAE6OF02GHF4L.37.26.C04.1.454.CMB.1.raw
  modified_base (315)..(315): a, c, t, g, unknown or other
  misc_feature (315)..(315): n is a, c, g, or t
  modified_base (346)..(346): a, c, t, g, unknown or other
  misc_feature (346)..(346): n is a, c, g, or t
  modified_base (355)..(355): a, c, t, g, unknown or other
  misc_feature (355)..(355): n is a, c, g, or t
  modified_base (358)..(358): a, c, t, g, unknown or other
  misc_feature (358)..(358): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtgggtctcaggttattactggtagtggtaataccgcatactaacgcagactccgtgacgggccgttcaccgtctccagagacaattccaaagaataccggtctatctggaaatgaacagcctgagacgccgaggacacggccctntatactgtgcgagagatcaggacggagttanagcagcganctntcgactacgcggggaccaacggtacccgtgtccaccgtcctccctacacgccctcccaaccgtaaccgggaccccacgtaccgggttcccttcccccgttacgggcccaccccgtccctacccgtaaacgacgaccacccgttcgacgggggtcaccgaccggccgggcccgttggggaccgttcgccgttacgggtaccgtaaacgggtacccttaccttacccgtattacccgtaacctaacccgttaacgtcggtacgggtccggggtaaccgttcgggaaccggaacgggtccgtaccgaagtacgg

SEQ ID NO: 79274 - DNA, 692 bp, Homo sapiens
  misc_feature: GYAE6OF02GE010.37.26.C04.1.454.CMB.1.raw
  modified_base (270)..(270): a, c, t, g, unknown or other
  misc_feature (270)..(270): n is a, c, g, or t
  modified_base (283)..(283): a, c, t, g, unknown or other
  misc_feature (283)..(283): n is a, c, g, or t
  modified_base (306)..(306): a, c, t, g, unknown or other
  misc_feature (306)..(306): n is a, c, g, or t
  modified_base (314)..(314): a, c, t, g, unknown or other
  misc_feature (314)..(314): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccgagggaaggggctggagtgggtctcaggtattactggtagtggtaataccgcatactacgcagacctcgtggacgggccggtcaccgtctccagagacaattccaagaatacggtntatctaggaaatnaacagcctagagacgccgagacncggccctntatactgtgcgagagatacgagacggtagtatacgcagcacgtctacgtagacctaggtccgggacccgaaccggaacccgttggtaccctacccgtcctacccgtccgaacgtcccctaccgaacccgaaccggtaccccacgttcccggttcccttcccccgtcggtacccaccccgttaccctaccaacggacctacctacccgtcggtaccgggccaccgaccgggaccggtcccggtcgggtccgtcggaccgttacgggaccgtaaacgggtaccttaacccgttccaacttaccgtaaccgtaaccgttaacgggtacggtaaccgggtcccgggtacggtacgggaaccgaacgggacctacggataacg

SEQ ID NO: 79275 - DNA, 788 bp, Homo sapiens
  misc_feature: GYAE6OF02IPXRW.37.26.C04.1.454.CMB.1.raw
  modified_base (206)..(206): a, c, t, g, unknown or other
  misc_feature (206)..(206): n is a, c, g, or t
  modified_base (263)..(263): a, c, t, g, unknown or other
  misc_feature (263)..(263): n is a, c, g, or t
tcagtagtgtagatcacgaccggtgctcgatttagtctagcgactttgggtttgggggaggcttggtacagcctggggggtccctgagactctcctgtgcagcctctggttcatctttagcaactacgccatgagctgggtccgcaggctcagggagggctggagtgggtgccaacataaagcaagatggaagtaagaaggagtangtggactctgtgaagggtctttcaccatctaccagacgacaaccgaccaaagaaccncgtagcaactctagcaaaatgaaccacgtcgtagagaacggccgaacggacacgggtaccttagttttaaccgttaacgtcggacgacggaacggaacgaacgggtacgttcggggtacggtttaccgaacgttaaccggttggggaccggtaacggggaacccgttcggtaccgtaaccccggttcgtacccgttacgaaccggtacccttaacccgaacccggtaaaccgggggacccctaggttacccgggttaccctttccccccggtagggcccccgtaccctcggtaccctccgaacgggtaccggaaccctaacccgttaccccggaacggaacggacccgtaaacgacccggggaccggtcccccggtacggggtccgttaccggtccgttaccgggttacgaaaaccgggtaaccttaccgttaacccgtacttaaccaccgttaacgttaccggtaggtaacgggccggtccgtacgggaaccgaacggtacggtaacctaaggtagtacgcagg

SEQ ID NO: 79276 - DNA, 626 bp, Homo sapiens
  misc_feature: GYAE6OF02IO32X.37.26.C04.1.454.CMB.1.raw
  modified_base (211)..(211): a, c, t, g, unknown or other
  misc_feature (211)..(211): n is a, c, g, or t
  modified_base (317)..(317): a, c, t, g, unknown or other
  misc_feature (317)..(317): n is a, c, g, or t
  modified_base (350)..(350): a, c, t, g, unknown or other
  misc_feature (350)..(350): n is a, c, g, or t
tcagtagtgtagatcacgaccggtgctcgatttagtctagcgactttgggtttggggggaggcttggtacagcctgggggggtccctgagactctcctgtgcagcctctggtttcatctttagcaactacgccatgagctgggtccgccaggctccagggaagggggctgggagtgggtctcgaggtattacgtggtagtggtaataccgnatactacgcagactccgtggacgggccgttcaccgtctccagagactaattccaaagaatacggtctatctaggaaatgaacagcctgagagcgagacacgccctntatactgtgcgagagatcaggacggagtagagnagcacgctacgtcgtactacgtcggggaccaacggtaacccgtggtaccaccgtctcccgtcgacgtccctaccgaaccgaacgggtcccacgtcccggttcccttaccccgtcggaccctacccctaccctaccaaacggtacgccctaaccgttccggacggggaccacggacggcccggtcccgtggggcctccgcctcggacacggtacctaccttccaacttccaacctactacgcggtacggcggcgttacggacgacggctacgagtcg

SEQ ID NO: 79277 - DNA, 798 bp, Homo sapiens
  misc_feature: GYAE6OF02JNW18.37.26.C04.1.454.CMB.1.raw
  modified_base (172)..(172): a, c, t, g, unknown or other
  misc_feature (172)..(172): n is a, c, g, or t
  modified_base (301)..(301): a, c, t, g, unknown or other
  misc_feature (301)..(301): n is a, c, g, or t
tcagtagtgtagatcacgaccggtgctcgatttagtctagcgactttgggtttgggggaggcttggtacagcctggggggtccctgagactctcctgtgcagcctctggtttcattctttagcaactacgccatgagctgggtccgccaggctccgaggggaaggggctggngtgggtctcgaggtattacgtggtagtggtaactaccgcatactacgcagtacctccggtggacggggtccgttcaccgttctccagagacaacttccaagaactacggtactatctaggaaatcaacncgcctaggaacgacggcccggaggaccaccggtcccttagttaacttactggtggaccgagtagactacggaggaaccggtaagtaactacggacaacggctacggtcctactacgaccgttacgggtccggggaccctaacccgggtacccttggtaccctacccgttccgtacccgtacaccggtacccctacccgaaccggtaaccggtacccgtaacgttcccggttaccccgttacccccgtacgggtacccctaaccccgttacccttaaccgaaccggtacccgtccctaccggttaccggggtccggggaacccgtaaccggcccgggtacccggtcccgggtcgggttacccgtccgggtccggttacgaccggtaaaccggtaccctttacctaccctacgtacccgtaaccgttaccgtaccgggtacgaaccgggtccgggtaccggttaccgggaaccgtaacccgggacgtacctaggtaccg

SEQ ID NO: 79278 - DNA, 667 bp, Homo sapiens
  misc_feature: GYAE6OF02HDP8H.37.26.C04.1.454.CMB.1.raw
  modified_base (648)..(648): a, c, t, g, unknown or other
  misc_feature (648)..(648): n is a, c, g, or t
  modified_base (662)..(662): a, c, t, g, unknown or other
  misc_feature (662)..(662): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggcctccagggaaggggctggagtgggtctcaggtattactggtagtggtaataccgcatactacgcagactccgtgacgggccggttcaccgtctccagagacaattccaaagaataccggtctatctaggaaatggaaacagcctaggagagccgaggacaccggtccctctattacgtgtgcgagagactcgagacggagtatagacagcagtctctgacctacgtcggggacccaaccggaaccgttcggtccaacccgtcttaccgtaccaccggtccctacccaacccgaaccgggtcccctaacgttccccggtttccccttccccgtacggcccctacccccgttccctaacccgaaaggaccgtaccctacccgtcgggtcggggaccaccgacggtccccgggccgtccggggccttcggcccgttcggtacaaaccggttacctacccttacacgttctaacctacgtaccgagtacggccggttccgnggtaccgaggaccnaagtc

SEQ ID NO: 79279 - DNA, 726 bp, Homo sapiens
  misc_feature: GYAE6OF02I2AXA.37.26.C04.1.454.CMB.1.raw
  modified_base (317)..(317): a, c, t, g, unknown or other
  misc_feature (317)..(317): n is a, c, g, or t
  modified_base (353)..(353): a, c, t, g, unknown or other
  misc_feature (353)..(353): n is a, c, g, or t
  modified_base (357)..(357): a, c, t, g, unknown or other
  misc_feature (357)..(357): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtgggtctcaggtattactggtagtggtaataccgcatactacgcagactccgtgacgggccggttcaccgtctccagagacaattccaagaacacactctatctgacaaatgaacagcctgaagactggaggacacggctggtagtntcacgtggtcgacgaaccggtagggggtttggagtntggnaggcgtcgggagggtgtagttcggttttagtagtttacggaggggaccgaaagggtacgtaaggttcggtaccgtaccgttacgttcctacgtaccgtaccctacccgtaaccgggaaccgggtccctacgggttaccccggttccccgtttccccccgtacggtcccctacccccgttaccgtacccgaaacgtaccgacccgttaccggtaccggtcgggggaccacggaccgggcccggtacccggtcggtccgtacgtcccggttcgtacccggtaacggtacccgttaaccgttccgtaaccttaccgttaaccctacgttaccggtacggaccgggtcgggtaccgtcgggtaccgaaccggg

SEQ ID NO: 79280 - DNA, 600 bp, Homo sapiens
  misc_feature: GYAE6OF02GAH8D.37.26.C04.1.454.CMB.1.raw
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaagggctggagtgggtctcaggtattactggtagtggtaataccgcatactacgcagactccgtgacgggccgttcaccgtctccagagacaattccaagaatacggtctatctggaaatgaacagcctgagagccgaggacacggccctctattactgtgcgagagatcagacggagtatagcagcagctctgactacgtggggccacggaaccctggtccaccgtctcctcacgcctccaccaacgggcccagtccggtccttccccgtggcccaccctcctccgaagacgccacccgtcgtcgggggccacgacgccgggcccgtcgggcctcggtccgtggtaccgaacggtaccttaaccgttcccaactccgttaaccaaccttaccgtacggaccggtcgggccgttcgggaccgaacgggccgacgagtaacgg

SEQ ID NO: 79281 - DNA, 904 bp, Homo sapiens
  misc_feature: GYAE6OF02IUPUV.37.26.C04.1.454.CMB.1.raw
  modified_base (212)..(212): a, c, t, g, unknown or other
  misc_feature (212)..(212): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagcgtgggtccgccaggctccgaggggaagggctggaggtgggtctcgaggttattacgtggtagtggtaactaccgnatacctacgcaagacctccggtggaccggggcccggttcaccgtcctaccagacgactaacttccaaagaatacggtctatacgtaggaaatagaacgacgccgtaggaacggacggaccggaacggaaccgacccggtccccttacgttaactttaccggtggtcggtacggaaggtagacgtacgaagggaaccggtaagtaagtacggacgaaggccacggtcctaccgttaggaacccgttacggtccgggggaaccccgaaacccggggtaacccgttccggtaacccgttaccccgtcccttcccgtaccgaccgtacccctaaccccgaacccgggaaacccgggtaccccttaaccggttcccccgggtttacccccctttccccccggtcccggggtaacccccctacccccgtttaaccccgtaaccccgaaacggtacccgtcccccgttaacccgggttccgggggtacccgggacccgtaaacccggcccggggtccccggtacccccgggttcggggtaccccgttacgggtaccccggtttacggggtaaacccgtaaaccgggtttaccctttaacccgtacccgtaacttaccccgttaacccgtacccttaggtaacggacccgggtccggttaacggtacccggaccggaacggtcccgtaacgtacggtacg

SEQ ID NO: 79282 - DNA, 719 bp, Homo sapiens
  misc_feature: GYAE6OF02JHUOZ.37.26.C04.1.454.CMB.1.raw
  modified_base (206)..(206): a, c, t, g, unknown or other
  misc_feature (206)..(206): n is a, c, g, or t
  modified_base (326)..(326): a, c, t, g, unknown or other
  misc_feature (326)..(326): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtgggtctcaggtattacgtggtagtggtaataccgnatactacgcagactccggtgaccgggccggttcaccggtctccgagagacctaattccgaaagaattacggtctaatctaggaaatgaacagcctgagacgccggaggaccacggccctntaagttactgtgacgagagactcaaggacggagtatacgcaggcaaggtctcgacgtacctacggtcggggacccaaccgggtaaccctggttacccaaccggttcctcccgtacgaccgtcccctacccgaacccgtaaccgggaccctaacgtccggttacccttccccgtacggaccctaaccccgtccctaccgaacgacgacccgaccgtaccggtcggggaccaccggtaccggtacccggtacccgtcgggtaccgtcgtacccggttacgggttaccgtaaacggtacccgttaaccttccgtaaccgtaccgttaaccgtaacctacgtaccggacggtaccgggtacgtacgggtaccgacggggacccgtacgtaacgtacg

SEQ ID NO: 79283 - DNA, 595 bp, Homo sapiens
  misc_feature: GYAE6OF02IVHDL.37.26.C04.1.454.CMB.1.raw
  modified_base (269)..(269): a, c, t, g, unknown or other
  misc_feature (269)..(269): n is a, c, g, or t
  modified_base (312)..(312): a, c, t, g, unknown or other
  misc_feature (312)..(312): n is a, c, g, or t
  modified_base (344)..(344): a, c, t, g, unknown or other
  misc_feature (344)..(344): n is a, c, g, or t
  modified_base (356)..(356): a, c, t, g, unknown or other
  misc_feature (356)..(356): n is a, c, g, or t
  modified_base (489)..(489): a, c, t, g, unknown or other
  misc_feature (489)..(489): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtgggtctcaggtattactggtagtggtaataccgcatactacgcagactccgtgacgggccgttcaccgtctccagagacaattccaagaataccggtntatctggaaatcgaacagcctgagagccgaggacacggccctntatacgtgtgcgagagatcaggacggagttanagcagcagcctntagacgtcgtgggacccacggtaacctggtaccaccgtctcctcgacgtccctccgaccgacggcccacgtcggtcccttccccgtacgcccaccctcccgtaccaagaccgtccaccgtcgcggggccacgngcccggtccgtcggtcctcgtccgtacggtaccgaacggtacttaccgtcctacgtccgtaacctacgtactcggacgcggcgtacggcgacggcgtacgagtacg

SEQ ID NO: 79284 - DNA, 580 bp, Homo sapiens
  misc_feature: GYAE6OF02GQ1GL.37.26.C04.1.454.CMB.1.raw
  modified_base (211)..(211): a, c, t, g, unknown or other
  misc_feature (211)..(211): n is a, c, g, or t
  modified_base (319)..(319): a, c, t, g, unknown or other
  misc_feature (319)..(319): n is a, c, g, or t
  modified_base (334)..(334): a, c, t, g, unknown or other
  misc_feature (334)..(334): n is a, c, g, or t
  modified_base (366)..(366): a, c, t, g, unknown or other
  misc_feature (366)..(366): n is a, c, g, or t
  modified_base (393)..(393): a, c, t, g, unknown or other
  misc_feature (393)..(393): n is a, c, g, or t
tcagtagtgtagatcacgaccggtgctcgatttagtctagcgactttggggtttggggggaggcttggtacagcctgggggggtccctgagactctcctgtgcagcctctggtttcatctttagcaactacgccatgagctgggtccgccaggctccgaggggaaggggctggagtgggtctcaggtattacgtggtagtggtaataccgnatactacgcagactccgtggaccgggccgttcaccgtctccagagactaattccaaagaatacggtctatctaggaaatgaacagcctgagagcgagacacggccctntatctgtgcgagagntcagacggatacagcagcagctcagactacgngggaccaacggaacctggaccacgtcncctcacgcctaccaaccgacggcctagtccgtcccttcccgcgcctacccctcctacctaaacgcacacctgtcgggacacgtagccggccgtcggcgtcgcgtcggtacaaacggtaccttacgtcctaacgtcctaactacctacgtgacggccgggtcgtacggacgacgggtacgacagtacg

SEQ ID NO: 79285 - DNA, 799 bp, Homo sapiens
  misc_feature: GYAE6OF02H42VW.37.26.C04.1.454.CMB.1.raw
  modified_base (648)..(648): a, c, t, g, unknown or other
  misc_feature (648)..(648): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtaccgccaggctccgaggggaaggggctggagtgggtcggccgtagtaaaagcgaaggttcgtggtggacacagactacgctcgcccgtgaaaggcagtatcaccatctcgagagatagaactacaaaacctcctgtactctagacaactagtacgaacgacgtccgtacgaaccgaaccggaacgaaccaccgacggtaccgtttacttaacttacgtcgtttactacgtaacgttaaggtaagttacggttaacttttaacttttacggaacctttaaccgaaacgggttaccgggttaaacgttaacggtttacgggttaccgggggttaaccccttttaggaaccgttacggggtacggggtaacccggtaacggggtaacccgtgggtacccgtaccgtccgttccgtaccgacgtaccctacccgaaccgtacgggtcccctaacggttccgttccccttaccccggtgtaccccgtccttacggctaccggacggtaccncccgtacccgttccgggaacgacgacccgaacggtccggtaccggtcccggtacgggctcccgggtaccgtttcggaccgtaaccggttaccctacccgttttacaccgttaccgtacaccgtttacggacggttccggaccggttaccgg

SEQ ID NO: 79286 - DNA, 601 bp, Homo sapiens
  misc_feature: GYAE6OF02HEW0E.37.26.C04.1.454.CMB.1.raw
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccgagggaaggggctgggagtgggtctcaggtattactggtagtggtaataccgcatactacgcagactccgtgacgggccggttcaccgtctccagagacaattccaagaatacggtctatctggaaatgaacagcctgagagccgagacacggccctctattactgtgcgagagatcagacggagtatagcagcagctactgactacgtggggacccacggaaccctggtccaccgtctccctcacgcctcccaccgaacgggcccacgtccggttcccttccccgtcggacccacccctcctacccaacgacgccaccgtccgtcggggccacgacgccggcccgtggcctgccgtcggtaccgaaacggtaccttaccgtccgactccgtaacaccttaacgtcggtacgcgggtcgtcgggaccgaacgggtccgacgagtacg

SEQ ID NO: 79287 - DNA, 808 bp, Homo sapiens
  misc_feature: GYAE6OF02ILLF7.37.26.C04.1.454.CMB.1.raw
tcagtagtgtagatcacgaccggtgctcgatttagtctagcgactttgggtttgggggaggcttggtacagcctggggggtccctgagactctcctgtgcagcctctggtttcattctttagcaactacgccatgagcgtgggtccgccaggctccgagggaaggggctggagtgggtctcaggttattacgtggtagtggtaatccgcaatactacgcagactccggtggacgggccgttcaccgtctccgagagaacaacttccaaagactacggtctatcgtaggaaaatggaactagccgtagacggtagaccggaaggaccaccgggtacccttcgtaacgtttactcggtcggtacggagtaacgagtacggaagggacggtaacgttaagtaggacctaggactacggctaccgttagaaccgttaccgggtacggggtaccccgtaacccgggtaaccttccggggtaccctacccggtttacctccccttaacggacccgttccccgttaacccgaacccggaaaccgggaccccgtaaccggttcccggtacccgtttcccccgtacccgggtacccttaccccgttacccgttaccgtaaccggtaccggacccgttaccccgtacgggttacccggggacgtaaccggaccgggtaccgggtcccggtcgggtcccggtacgtaccggttcgggtaacctaacgggtacccttaccgttacctaacgttcctaaccgtaccgttacgtcggtacggacgggtacgttcgggaccgtaacggtacgacgtaggtacg

SEQ ID NO: 79288 - DNA, 583 bp, Homo sapiens
  misc_feature: GYAE6OF02FRRYP.37.26.C04.1.454.CMB.1.raw
  modified_base (556)..(556): a, c, t, g, unknown or other
  misc_feature (556)..(556): n is a, c, g, or t
  modified_base (566)..(566): a, c, t, g, unknown or other
  misc_feature (566)..(566): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggcctccgagggaaggggctgggagtgggtctcaggtattactggtagtggtaataccgcatactacgcagactccgtgacgggccgttcaccgtctccagagacaattccaagaatacggtctatctaggaaatgaacagcctgagacgcgagacaccggccctctattactgtgcgagagatcgagacggagtatagcagcacgctcgtgacctacgtcggggcccaacggtaacccgtggtcctaccgtcctccgtacgacgccctacccgaaccgacgggccctacgtccgttcccttccccgtcggccctacccctcctaccaacgacgaccacctcggtcgggcacgacggccggcccgtgggcctcggcctggacgacgacttacctcactctacactcgngacgcggcgnggacgacggcgcgatcg

SEQ ID NO: 79289 - DNA, 850 bp, Homo sapiens
  misc_feature: GYAE6OF02FXDIB.37.26.C04.1.454.CMB.1.raw
  modified_base (315)..(315): a, c, t, g, unknown or other
  misc_feature (315)..(315): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccgaggggaaggggctgggagtgggtctcaggtattactggtaggtggtaataccgctactactacgcgacgaccgtccggtggaccggggtccgttccaccgtcctaccgaggagactaacttccgaaagtaagttaccggtctactcgtaggaaatgaacncgtccgtagacgacggcccgtaagggacctaccgggtcccttcttaacgtttaccgttggtacggacggaagtaacggtactacggaacggtaacggggtaaacttacgtaacggacgtacgggtactaacggcccgttacgttacggaaccgtttaacgggtaccgggggaccctaaaacccggggtaccccgttcggggtaccctaccccggtttccgtaccccgttccggaaccgttacccccgttacccggaaacccggtaaacccgggtccccgttaaccggttccccgggtttacccccgttccccccggtacgggtaacccccctaccccgttacccgtaaccgaacggtacccggtcccgtaacccggtcggggtaccggggaccaacgggtccggacccgggtacccgtggggtaccctcggtaccgtcggtaacgtaacggttacctaccgtccgtacgaccttaactaccgtacggtacggaccggtcggaccgtacggaccggtaacgtcggtactaggtacg

SEQ ID NO: 79290 - DNA, 596 bp, Homo sapiens
  misc_feature: GYAE6OF02G630H.37.26.C04.1.454.CMB.1.raw
  modified_base (291)..(291): a, c, t, g, unknown or other
  misc_feature (291)..(291): n is a, c, g, or t
  modified_base (325)..(325): a, c, t, g, unknown or other
  misc_feature (325)..(325): n is a, c, g, or t
  modified_base (349)..(349): a, c, t, g, unknown or other
  misc_feature (349)..(349): n is a, c, g, or t
  modified_base (351)..(351): a, c, t, g, unknown or other
  misc_feature (351)..(351): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtgggtctcgaggtattacgtggtagtggtaataccgcatactacgcagactcgtggacgggccgttcaccgtctccgagagacaattccaaagaatacggtctatcgtaggaaatgaacancctgagagccgaggacaccggccctatattacgngtgcgagagatcgagacggtatangntagcagtctcgtagactacgtcggggaccaccggtaacctggtaccaccgttctacccgcacgccctaccaccgaacggcctctccggttcctccccgtcgccctaccccgtcctaccgaacgcgcccgaccgtcggtcggacgacgcggcccgcccgtggctcgaccgtggtacaccgggtcttccgtacctagtaccgaactacgtccgacggcggtacggcgtacggccgaggccgatagcg

SEQ ID NO: 79291 - DNA, 652 bp, Homo sapiens
  misc_feature: GYAE6OF02FYZMT.37.26.C04.1.454.CMB.1.raw
  modified_base (207)..(207): a, c, t, g, unknown or other
  misc_feature (207)..(207): n is a, c, g, or t
  modified_base (296)..(296): a, c, t, g, unknown or other
  misc_feature (296)..(296): n is a, c, g, or t
  modified_base (345)..(345): a, c, t, g, unknown or other
  misc_feature (345)..(345): n is a, c, g, or t
  modified_base (349)..(349): a, c, t, g, unknown or other
  misc_feature (349)..(349): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtgggtctcgaggttattactggtagtggtaataccgnatactacgcagactctgtgacgggccgttcacgtctccgagagacaattccaagaagtacggtctatctaggaaatgaacagcctgagngccgaggcacggccctctattactgtcgcgagagatcgagacggagtanacgnacgcagtctctagacgtacggtcggggacccaacgggtaacccgtcggtccctacccggtccttcctcgaccgacccgtaccgaacccggaccgggacccgtaccgtccggttccccttcccccgtaccgcccctaccccgtccctacccgaacgaccgtaccctacccggtccggtcgggaccgaccgaccgcccgggtcccgtcgggccgttcggtaccgtcggtaacgtacggtaccttaccgtacctacgtacctaccacgttacgtggacggcggtcgtacggacgacggcctagacg

SEQ ID NO: 79292 - DNA, 657 bp, Homo sapiens
  misc_feature: GYAE6OF02G3ATB.37.26.C04.1.454.CMB.1.raw
  modified_base (208)..(208): a, c, t, g, unknown or other
  misc_feature (208)..(208): n is a, c, g, or t
  modified_base (504)..(504): a, c, t, g, unknown or other
  misc_feature (504)..(504): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccgagggaaggggctgggagtgggtctcgaggtattactggtagtggtaataccgnatactacgcagacctccgtggaccgggccgttccaccgtctccagagacaattccaaagaatcggtctatctggaaatgaacagctgagagccgagacacggccctctattactgtgcgagagatcagacggagtatagcagcagctctacgtactacgtcggggaccaaccggaacccgttgggtccaccgttcctcctcacggtccctccgaaccgaacgggccccagtccggttccttccccgtcggccctccccgtccctaccgaaacgcgacccactcgggtcggggaccncgacggtccggacccgtcgggtcgtacgccgttacggtaccgaaacggtcccttaccgtttaccgaccttacccgtaaccgtaccgttaccgtacggtaacggtcccggggtacgtaccgggaacggtaaccgggaccggtactagtaacggg

SEQ ID NO: 79293 - DNA, 627 bp, Homo sapiens
  misc_feature: GYAE6OF02GZEH3.37.26.C04.1.454.CMB.1.raw
  modified_base (327)..(327): a, c, t, g, unknown or other
  misc_feature (327)..(327): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagcgtgggtccgccaggctccgaggggaaggggctgggagtgggtctcgaggtattacgtggtagtggtaataccgcatactacgcagactccggtggacgggccggttcaccgtctccagagactaattccaaagaatacggtctatcgtaggaaaatgaaacagcctgagacgccggaggacaccggcctntattactggtgacgaggagatcgaaggacggagtataggcacgcagctcgtgaactcggcggggacccaacgggacccttggcctaccgttctccctacgacgtccctaccgaaccgaccggacctacggtccggttcccttccccgtcggaccctaccccgtccctaaccgaacgaccgtacctccgtcgggcgggaccacggcggacccggccgtgggcctcgtcgtcgtacgaacgtacctacttaccgactccgtactactacgtcgacggcgtcgcggaggacgcgtacgagtcg

SEQ ID NO: 79294 - DNA, 780 bp, Homo sapiens
  misc_feature: GYAE6OF02H2EFO.37.26.C04.1.454.CMB.1.raw
  modified_base (292)..(292): a, c, t, g, unknown or other
  misc_feature (292)..(292): n is a, c, g, or t
  modified_base (316)..(316): a, c, t, g, unknown or other
  misc_feature (316)..(316): n is a, c, g, or t
  modified_base (335)..(335): a, c, t, g, unknown or other
  misc_feature (335)..(335): n is a, c, g, or t
tcagtagtgtagatcacgaccggtgctcgatttagtctagcgactttggggtttgggggaggcttggtacagcctgggggggtccctgagactctcctgtgcagcctctggtttcatctttagcaactacgccatgagctgggtccgccaggctccgagggaagggctggagtgggtctcaggtattacgtggtagtggtaataccgcatactacgcagactcgtgacgggtccgttcaccgtctccagagacaacttccaagaatacggtactatcgtagaaaatgaacanccgtgaagacgaccggaaggaccnccggtaccctctaattacnggttcgacgtagagtacacgaacggaacggtagtaagtacgcaacgcgaagtccgtcgtacgaacttaacggtcggggacccgaacccggtaaccctgggtacccacccgttccgtccctacgtaccgaccctccgaaacccggtaaccggccccgtaccgtcccggttcccctttccccggtaccggtcccctaaccccttacccgtacccgtaacggaccgtacccgaacccgtttcggggacggggtaacccacggtaacccggtcccgggtaccccggtcggggtccttccggtcccggttaacggttaacccggaaacggttaacccgtttacccgttacccttaaccgttacccgttaaccctaacccggtttaacgtacgggtaacccgggccggggtaaccgtacggggaacccgtaacgggcccgaacgtactagg

SEQ ID NO: 79295 - DNA, 872 bp, Homo sapiens
  misc_feature: GYAE6OF02G4JR0.37.26.C04.1.454.CMB.1.raw
  modified_base (225)..(225): a, c, t, g, unknown or other
  misc_feature (225)..(225): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccgagggaaggggctggagtgggtctcgaggtattacgtggtagtggtaataccgcatactacgcagactcgngacgggccgttcaccgtctccagagacattccaagagtacggtctatcgtaggaaatgaactagcctgagacgccgaggacaccggccctatacgttacgtgtgaccgtagagtactcgaagggaacggtacgtaagtacgaccgaagaccgtaacggtccttaccgtacggaaaccgttacggggtaccgggggaaccccgtaaaacccggggtaaaccccgttcggggtaaccccgtaacccggttccccgttaccccgttccgaaacgttccccccgtaaccccgaacccggaaacccggggtacccccgtacggttaaccccgggtttccccttacccccggtccggtaacccccgtaccccgtaccccgtaaccggaaaccggtaaccgtccccgtaaacccgggttcgggtaaccggggggtacccgaaacccggtaaccggggtccccggtaccccgggttacgggggtccccgttacgggttacccggttaccggggttaaacccgaaaccggggttaaccctttaacccgtttacccgtaaacttcccgttaaacccgttaaccgtaaccgggttcggaaccggggttacccggtcggtaccgggtaaccggtaacgggtcccggacgtaacgtacgg

SEQ ID NO: 79296 - DNA, 689 bp, Homo sapiens
  misc_feature: GYAE6OF02F6I47.37.26.C04.1.454.CMB.1.raw
  modified_base (250)..(250): a, c, t, g, unknown or other
  misc_feature (250)..(250): n is a, c, g, or t
  modified_base (262)..(262): a, c, t, g, unknown or other
  misc_feature (262)..(262): n is a, c, g, or t
  modified_base (271)..(271): a, c, t, g, unknown or other
  misc_feature (271)..(271): n is a, c, g, or t
  modified_base (303)..(303): a, c, t, g, unknown or other
  misc_feature (303)..(303): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccaggggaaggggctggagtgggtctcaggtattactggtagtggtaataccgcatactacgcagactccgtgacgggccggttcaccgtctccaganacaattccaaanaatacggtntatctgaatgaacagcctgagacgcgaggacncggccctctatactgtgcgagagatcagacggagtatagacagcagctctggaacctacggtcgggggacccaaccggtaacccgtcgggtacctacccgtcctccctcacgtccctccgaacccgaacggtccccaagtccggttaccccttcccccgtcggacccctccccctacccttaccgaacgtaccggcctaacccgttcgggtaccggggccgtaccgaccgggcccgtacccggttcgggggaccgttccggtcccgttcgggtacccggaaaccggtaaccgttaacccttccgtaactaacccgtaaccctaacccttccggtaacggaaccggcggggaccttacgggaccgtaaccgggcgacccgtagtacg

SEQ ID NO: 79297 - DNA, 238 bp, Homo sapiens
  misc_feature: GYAE6OF02GA2VK.37.26.C04.1.454.CMB.1.raw
  modified_base (232)..(238): a, c, t, g, unknown or other
  misc_feature (232)..(238): n is a, c, g, or t
tcagtagtgtagatcacgaccggtgctcgatttagtctagcgactttgggtttgggggactactggggccagggaaccctggtcaccgtctcctcagcctccaccaagggcccatcggtcttccccctggcaccctcctccaagagcacctctgggggcacagcggccctgggctgcctggtcaaggactacttccatctacactactgagcgggctggcaaggcgcatagnnnnnnn

SEQ ID NO: 79298 - DNA, 629 bp, Homo sapiens
  misc_feature: GYAE6OF02IJ7SR.37.26.C04.1.454.CMB.1.raw
  modified_base (365)..(365): a, c, t, g, unknown or other
  misc_feature (365)..(365): n is a, c, g, or t
  modified_base (488)..(488): a, c, t, g, unknown or other
  misc_feature (488)..(488): n is a, c, g, or t
  modified_base (623)..(623): a, c, t, g, unknown or other
  misc_feature (623)..(623): n is a, c, g, or t
tcagtagtgtagatcacgaccggtgctcgatttagtctagcgactttgggtttggggggaggcttggtacagcctgggggggtccctgagactctcctgtgcagcctctggtttcatctttagcaactacgccatgagctgggtccgccaggctccaggggaaggggctgggagtgggtctcaggttattactggtagtggtaataccgcatactacgcagactccgtggacgggccgttcaccgtctccagagacaattccaagaatacggtctatcgtaggaaatgaacagcctagagacgccggaggaccaccggcccttcgtaattacgtggtcgacgagagatcgaggacggagtatagnagcagctcgagtactacgcgggaccaccggaaccctggtaccacccgtctccctagaccgtcctacccgaccgaacggcctacgtccgtcccttcccgcgccctacccgtaccaccaacgacncccgtaccgtcgggtcggggacctacgacggtacccggtccgtcggtccgtccgtccgtacgggtactaacggtaccttaccttaccattaccacgtacctacggtacgacggtccggcgcggaccggacggacntagtcg

SEQ ID NO: 79299 - DNA, 829 bp, Homo sapiens
  misc_feature: GYAE6OF02F990H.37.26.C04.1.454.CMB.1.raw
  modified_base (200)..(200): a, c, t, g, unknown or other
  misc_feature (200)..(200): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccgagggaaggggctggagtgggtctcagctattaagtgggaatggtnataccacatactacgcagactccgtgaacggccgttcacatctccgagggactaattccgaaagaacactactgtactccgtagtacaaaagtggaaacacgtaccgtgaacgaggtacggaacggaaccgaaccggtcctttaagttaactttaaccgttggtacggtaagggtaaacgggaccttacgtaaccgtaccccgttaagtaacggtactaacggcggtcgttagggtcccgttaggttacccttttggacggtaacggtacgggggtacccgaacgggggtaaaccccttgggttacccaacccggttacctacccgttacgtaaccggtacccctacccgtaacccggaaaccgggtccccaacggttcccgggttaccccgttacccccgtcgggtaccccgttacccccgttcgtacccgttacccgaacgggtaaccgtacccgtaacccgttacccggaacggtaccgaacgtaaccgaacgggtcccggccccggttagggtccgttaccggtccggttaccgggtacggtaaacggtacccttaaaccggtcctaaccgttaccgttaaccgacctttaaccggtcgtaacggggtccgggtacgttaacggg

SEQ ID NO: 79300 - DNA, 668 bp, Homo sapiens
  misc_feature: GYAE6OF02HWAPI.37.26.C04.1.454.CMB.1.raw
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtgggtggccaacataaagcgagatggaagcgagaaatactatgtggactctgtggagggccgattcacatctccacagacaacgccaaagaatcaatctttttagacaaatgaacagtctgagagtacgagacacggccatgtattactgtacgagagaacagacgttggggcaacgggaacctggtcaccgtctcctacacgcctaccaccgaacgggccctaacgtccggtccttacccccgtcggccgtccccgtcgtccgtacccgacggacgcccgtaccgtaccggaagacgaccaaccgacggcccgggtcccgtcggggactccgggtaccgttcgggtaaccgtaaacgggtaaccctttaacccgttacctaacgttacctaaccgtaaaccgttaacgtcgggaaccgggtccggggtacccggtcgggtaaccggaaccgggaccggtaacccgtaaggttacggtaccgacgacgacgtcgcgag

SEQ ID NO: 79301 - DNA, 555 bp, Homo sapiens
  misc_feature: GYAE6OF02HLUMF.37.26.C04.1.454.CMB.1.raw
  modified_base (144)..(144): a, c, t, g, unknown or other
  misc_feature (144)..(144): n is a, c, g, or t
  modified_base (309)..(309): a, c, t, g, unknown or other
  misc_feature (309)..(309): n is a, c, g, or t
  modified_base (317)..(317): a, c, t, g, unknown or other
  misc_feature (317)..(317): n is a, c, g, or t
  modified_base (324)..(324): a, c, t, g, unknown or other
  misc_feature (324)..(324): n is a, c, g, or t
  modified_base (333)..(333): a, c, t, g, unknown or other
  misc_feature (333)..(333): n is a, c, g, or t
  modified_base (361)..(361): a, c, t, g, unknown or other
  misc_feature (361)..(361): n is a, c, g, or t
  modified_base (365)..(365): a, c, t, g, unknown or other
  misc_feature (365)..(365): n is a, c, g, or t
  modified_base (394)..(394): a, c, t, g, unknown or other
  misc_feature (394)..(394): n is a, c, g, or t
  modified_base (398)..(398): a, c, t, g, unknown or other
  misc_feature (398)..(398): n is a, c, g, or t
  modified_base (494)..(494): a, c, t, g, unknown or other
  misc_feature (494)..(494): n is a, c, g, or t
tcagtagtgtagatcacgaccggtgctcgatttagtctagcgactttgggttgggggaggcttggtacagcctggggggtccctgagactctcctgtgcagcctctggtttcatctttagcaactacgccatgagctgggtccnccaggctccaggggaaggggctggagtgggtctcgaggttattacgtggtagtggtaaataccgctattactacgcaggactccggtgacgggtccgttcaccgtctaccagagacaattccaaagaatacgtctatctggaaatgaacagctgagagcgagacncggccctntattacngtgcgaganatcagacggatatagacagcagctcgtnaacncgtgggccaacggaaccctgtccacgtcncctnacgtcctccaccgaacggccacgtccgtccttccctggccctaccctcctacgaacgacgacacctcggtacgggccacgacgcggtcccgtggcncgtcctggacaacgactactccatcacacactgacgtcgcgtcgacgtaggcgtcagtacg

SEQ ID NO: 79302 - DNA, 738 bp, Homo sapiens
  misc_feature: GYAE6OF02IKR9M.37.26.C04.1.454.CMB.1.raw
  modified_base (295)..(295): a, c, t, g, unknown or other
  misc_feature (295)..(295): n is a, c, g, or t
  modified_base (379)..(379): a, c, t, g, unknown or other
  misc_feature (379)..(379): n is a, c, g, or t
tcagtagtgtagatcacgaccggtgctcgatttagtctagcgactttgggtttgggggaggcttggtacgagccgtgggggtccctgagactctcctgtgcagcctctggtttcatctttagcaactacgccatgagcgtgggtccgccaggcctccgagggaaggggctggagtgggtctcaggtattacgtggtagtcggtaactaccgcatactacgcagactccggtgacgggccgttcaccgtctccagagacaattccaaagactacggtctatcgtaggaaatgaacngcctgagtcgcgagacacggccctagtactacgtagtcgacgtacgagatcgaagacggtagtatacggctaagctagctacgnaccgtacgtcgggacccacggtaaccttcggtaccacccgttcgaccctcgacgtccctaccgacccgtaaacgggcccctacgttcccggttcccttaccccggtcggtaccctacccccgttaccgtaccgtaaacgggacctacccggtaccgttccgggtacgggggtacctaaccggtacccgggcccggttccccggtcggggtacccgttccgggttaccgggttacccggtaccggttaaaacggtaccgtttaccctttacgtaacgtacccgttaacctacccgttacgtacgggtaccgggtacggtccggtacgggaacccgtacggaccggtaccgtagtaaccgg

SEQ ID NO: 79303 - DNA, 681 bp, Homo sapiens
  misc_feature: GYAE6OF02H6RKW.37.26.C04.1.454.CMB.1.raw
  modified_base (212)..(212): a, c, t, g, unknown or other
  misc_feature (212)..(212): n is a, c, g, or t
  modified_base (259)..(259): a, c, t, g, unknown or other
  misc_feature (259)..(259): n is a, c, g, or t
  modified_base (328)..(328): a, c, t, g, unknown or other
  misc_feature (328)..(328): n is a, c, g, or t
  modified_base (427)..(427): a, c, t, g, unknown or other
  misc_feature (427)..(427): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggcctccgaggggaaggggctgggagtgggtctcgaggtattacgtggtagtggtaactaccgnatactacgcagactccggtggacgggtccgttcaccgtctccagganactaattccaagtaagtacggtctatcgtaggaaaatgaacacgcctagagagccgaggacacggcctntacttactgtgcgagagatcgaggacggagtatgcagcagctactgactacggtcggggaccaccggaacccgttcgggtacctacccgtcctcctacnccgtccctacccgaccgaaccgggcccctacgtcccggttcccttccccgtcggccctacccgttccctacccgaacgtacgcctacccgttcgggtcggggaaccacggaccggcccggtcccggtcggggtccctacggtccgttcgggtaccggaacgtaccttaccgttaccctacttaccggtaacctaaccgttacgtacggtaccggcggggtacctacgggaccggtaacggcggtacctagtacg

SEQ ID NO: 79304 - DNA, 707 bp, Homo sapiens
  misc_feature: GYAE6OF02G04EZ.37.26.C04.1.454.CMB.1.raw
  modified_base (302)..(302): a, c, t, g, unknown or other
  misc_feature (302)..(302): n is a, c, g, or t
  modified_base (337)..(337): a, c, t, g, unknown or other
  misc_feature (337)..(337): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagcgtgggtccgccaggcctccgaggggaagggctgggagtgggtctcgaggtattacgtggtagtggtaataccgcatactacgcagtactccgtggacgggccggttcaccgtctaccagacgacaattccaaagaacgtacggtctagtcgtaggaaatcgaacngacctgagacgcggagacgaccgtcctatattcgngtcgacgaagagtatcacggtaacggagtactaggacagacgaccggcttagtacgaacttaccgggtcgggacccctaaaacggggtaacccttggtaacccctaccggttacctcccgtaccgaaccgtcccgtaacccgaaacccgggtacgggtaccctaccggtcccggtttaccccgttcccgtccgaccctaccccgttccgtacccggaaacgtaccgtccaccggttccgtacggggaccaccgtccggaccggtccggtcgggaccgtccggcgtacggtactaaccgtccttaacctcctactacgtacctacgttacgtcggtccggtacgggtcgtacggacgacggcagtagtacg

SEQ ID NO: 79305 - DNA, 611 bp, Homo sapiens
  misc_feature: GYAE6OF02HUABU.37.26.C04.1.454.CMB.1.raw
  modified_base (333)..(333): a, c, t, g, unknown or other
  misc_feature (333)..(333): n is a, c, g, or t
  modified_base (413)..(413): a, c, t, g, unknown or other
  misc_feature (413)..(413): n is a, c, g, or t
  modified_base (492)..(492): a, c, t, g, unknown or other
  misc_feature (492)..(492): n is a, c, g, or t
  modified_base (516)..(516): a, c, t, g, unknown or other
  misc_feature (516)..(516): n is a, c, g, or t
  modified_base (574)..(574): a, c, t, g, unknown or other
  misc_feature (574)..(574): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtgggtctcaggtattactggtagtggtaataccgcatactacgcagactccgtgacgggccggttcaccgtctccagagacaacttccaaagaatacggtctaatctggaaatgaaacagcctgagacgccgaggaccacggccctatattactgtgcgaagngactcaaggacggagtatagcagcagctctgactaggcggggcccaacgggtaaccctggtaccacccgtctcccgtacncgtccctaccgaccgaacgggtcccagtcccgttaccttccccgcgtcccacccctcctaccaacgacgccacctcggngggacccagaccggccgtcccggngggtcctcgccgtaggtaccaacggtacctacgttcccacttccctaacaccttacgnggtacggcggtacgtcggaccgacggcacgtagtacg

SEQ ID NO: 79306 - DNA, 562 bp, Homo sapiens
  misc_feature: GYAE6OF02FQGOF.37.26.C04.1.454.CMB.1.raw
  modified_base (350)..(350): a, c, t, g, unknown or other
  misc_feature (350)..(350): n is a, c, g, or t
  modified_base (398)..(398): a, c, t, g, unknown or other
  misc_feature (398)..(398): n is a, c, g, or t
  modified_base (539)..(539): a, c, t, g, unknown or other
  misc_feature (539)..(539): n is a, c, g, or t
  modified_base (546)..(546): a, c, t, g, unknown or other
  misc_feature (546)..(546): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtgggtctcaggtattacgtggtagtggtaactaccgcatactacgcagactccgtgacgggtccgttcaccgtctcagagacattccaagaatacggtctaatctaggaaatgaacagcctgagagccgaggaccacggccctctattactgtcgcgagagatcagacggagtatagcancagctctgactcgtggggaccacggaccctggtccaccgtcctcctcncgccctccaccacggcccacgtcgtcccttccccgtgcccaccctccctaccagaccgccaccgtcggtacgggccacgacggccggacccgtcggcgtcgccgtggaccagtactcctacgatccgtacaccttacgcgngcgggtncggacaggcgacagtg

SEQ ID NO: 79307 - DNA, 668 bp, Homo sapiens
  misc_feature: GYAE6OF02HO5JL.37.26.C04.1.454.CMB.1.raw
  modified_base (207)..(207): a, c, t, g, unknown or other
  misc_feature (207)..(207): n is a, c, g, or t
  modified_base (274)..(274): a, c, t, g, unknown or other
  misc_feature (274)..(274): n is a, c, g, or t
  modified_base (319)..(319): a, c, t, g, unknown or other
  misc_feature (319)..(319): n is a, c, g, or t
  modified_base (326)..(326): a, c, t, g, unknown or other
  misc_feature (326)..(326): n is a, c, g, or t
  modified_base (337)..(337): a, c, t, g, unknown or other
  misc_feature (337)..(337): n is a, c, g, or t
  modified_base (364)..(364): a, c, t, g, unknown or other
  misc_feature (364)..(364): n is a, c, g, or t
  modified_base (380)..(380): a, c, t, g, unknown or other
  misc_feature (380)..(380): n is a, c, g, or t
  modified_base (424)..(424): a, c, t, g, unknown or other
  misc_feature (424)..(424): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccgaggggaaggggctggagtgggtctcaggtattactggtagtggtaataccgnatactacgcagactccgtgaccgggtccgttcaccgtctccagagactaattccaaagaatacggtntaatctaggaaatgaacagcctgagacgccgagacacggcccctntattacngtcgacgaganatccagtacggagtaatagactagacngcctcgtgaactacgnggggaccctaacggaacccgttggtaccacccggtctacccgtnaccgtaccctccgaaccgacgggacccctaagtcccggttacccttccccgtacggtcccaccccttaccctaccgaaacgacgacctacccgtcgggtcggggtaccaccgaccggtccgggtacccgtcgggtcctcggtaccgttcggtaacgaacggtaccttacgttaccgacttaccgtaaccaacgttacgtacggacggtccgggataccgggaacgtacggaccgactagtacgg

SEQ ID NO: 79308 - DNA, 678 bp, Homo sapiens
  misc_feature: GYAE6OF02HDGOY.37.26.C04.1.454.CMB.1.raw
  modified_base (269)..(269): a, c, t, g, unknown or other
  misc_feature (269)..(269): n is a, c, g, or t
  modified_base (285)..(285): a, c, t, g, unknown or other
  misc_feature (285)..(285): n is a, c, g, or t
  modified_base (311)..(311): a, c, t, g, unknown or other
  misc_feature (311)..(311): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtgggtctcaggtattactggtagtggtaataccgcatactacgcagactccgtgacgggccggttcaccgtctccagagacaattccaagaatacggtntatctggaaatgaacngcctgagagccgaggacacggccctntacttactgtgcgagagatcaggacggagtaatacgcaggtcaggcttcgaggtaaccttacggtcgggggtacccgaaccggtaaacccgttggtaccctacccggttcctccctcgacgtccctacccaaccgaacgggccctaacgtccggttcccttccccgtcggccctacccctcccgtaccaacgtaccgccctacccgttccgggtccgggggacctaccggacggcccgggtcccgtggggccgtccggtccgttcggtaccggaaacggtaccttaccttaccgtacttacccgtaacctaccgttacgtacggacggtccgggtaccgtacgggaccgaacgggcgacgtagtacg

SEQ ID NO: 79309 - DNA, 583 bp, Homo sapiens
  misc_feature: GYAE6OF02I0B84.37.26.C04.1.454.CMB.1.raw
  modified_base (455)..(455): a, c, t, g, unknown or other
  misc_feature (455)..(455): n is a, c, g, or t
tcagtagtgtagatcacgaccggtgctcgatttagtctagcgactttgggtttgggggaggcttggtacagcctgggggggtccctgagactctcctgtgcagcctctggtttcatctttagcaactacgccatgagctgggtccgccaggctccaggggaaggggctggagtgggtctcaggtattactggtagtggtaataccgcatactacgcagactccgtgaccgggccggttcaccgtctccagagacaattccaaagaatacggtctatctaggaaatgaaacagcctgagagccgaggacacggccctctattactgtgcgagagatcaggacggagtatagcagcagctctgactacgtgggcccaacggaccctggtaccacccgtctcctcacgccctaccaccgaacggcccagtccggtccttccccgtcgcccaccctccnccaacgcaccacctcgcgggcacgcgccgccgtcggcgtcgccgtcggacgaacggtaccttacctccacttacctaacctacctacgtacggacggccgggtcgtcggaccgacggcgactagtacg

SEQ ID NO: 79310 - DNA, 711 bp, Homo sapiens
  misc_feature: GYAE6OF02GDFD5.37.26.C04.1.454.CMB.1.raw
  modified_base (207)..(207): a, c, t, g, unknown or other
  misc_feature (207)..(207): n is a, c, g, or t
  modified_base (322)..(322): a, c, t, g, unknown or other
  misc_feature (322)..(322): n is a, c, g, or t
  modified_base (332)..(332): a, c, t, g, unknown or other
  misc_feature (332)..(332): n is a, c, g, or t
tcagtagtgtagatcacgaccggtgctcgatttagtctagcgactttgggtttgggggaggcttggtacagcctggggggtcactgagactctcctgtgcagcctctggtttcatctttagcaactacgccatgagctgggtccgccaggctccagggaaggggctggagtgggtctcgaggtattacgtggtagtggtaataccgnatactacgcagactcgtgacgggccggttcaccgtctccagagacattccaaagaatacggtctatctaggaaatgaacagcctgagacgccgagacacggtccctatattacgngtgcgagagntcgagacggatagtagcagcagtctcgtagacttacggtcggggacccaacggaaccccgttgggtacccacccggtttcctcccgtacgaccgtccccgtacccgaacccgaaccgggcccctaacggttcccggttccccttacccccggtccggaccccgtacccccttacccgttacccgaaacgaccgtaccctaacccggtccgggtaccgggggacctaaccggaccggcccgggtacccggtcgggtaccgtccggtacccgtcgggtaaccgaacgggtacccttaccgttaccctaacgttacctaacctaccgttaaccgtggtaccgggccgggtacggtacgggaccgtacgggaccgacgtaacg

SEQ ID NO: 79311 - DNA, 653 bp, Homo sapiens
  misc_feature: GYAE6OF02FISXF.37.26.C04.1.454.CMB.1.raw
  modified_base (145)..(145): a, c, t, g, unknown or other
  misc_feature (145)..(145): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccnccaggctccagggaaggggctggagtgggtctcaggtattactggtagtggtaataccgcatactacgcagactccgtgacgggcgttcaccgtctccagacacaattccaagaaccaccctgtctctgcaaatcgaacaacctgacgagacgagacacggccctatattactgtaacgaaaatcggaccgtaacgatatgtaactactagttcggggactggtacttcgattctcggtgggccgtggactccctgtcctacttcggtccttaccgtcgacgtcctaccaaccgaagggtccccaagttccggttacccttcccccgtcgggccctacccgtgtacctccgaaggtccgacctacccgtaccggagaccgccgtaaccgacggcccggtcccgtagggtcctaccggtccgtacggtacctaacgggtacctaccgtttaccacgttacctaacgtaccgtacgtgtacgggccggtcgtacgggacgtacggtaccg

SEQ ID NO: 79312 - DNA, 778 bp, Homo sapiens
  misc_feature: GYAE6OF02GWW70.37.26.C04.1.454.CMB.1.raw
  modified_base (208)..(208): a, c, t, g, unknown or other
  misc_feature (208)..(208): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaaactacgccatgagcgtgggtccgccaggctccgagggagggctggagtgggtctcgaggtattacgtggtagtggtaataccgnatactacgcagactccgtggacgggtccgttcaccgtctaccgaagacgaactaacttccaaaagaacgttaccggtctaacgttcgtaaggaaaatcgaaacgacgaccgttaggaacgacggcccggaaggtaccaccggtccccttattaacgttaccgtggttcggaccgaaggtaacgactaccggaagggtaacggtaagttaatacggacgacggactaaggtccttagacgtaacgtaccgggtcggggacccaaaccgggtacccgttggacctacgttcgtacctccgtagacccgccctaacccgaaccggaaccggtccctacgttcccggttcccttcccgacggtacccctacccgttccgtaaccgaacggcctacccgtaccgtcgggtaccgggacctaaccggcccggtcccggtccgtcggggtacctccggtaccgtcggtaaccgaaccgttaccttacccgtacgtaaccgttaccgttaaccgtaccgtacggtaccggtccgggtacggtacccggtacggtaaccggacggtccgtacgtaacgg

SEQ ID NO: 79313 - DNA, 558 bp, Homo sapiens
  misc_feature: GYAE6OF02HZQG5.37.26.C04.1.454.CMB.1.raw
  modified_base (352)..(352): a, c, t, g, unknown or other
  misc_feature (352)..(352): n is a, c, g, or t
  modified_base (387)..(387): a, c, t, g, unknown or other
  misc_feature (387)..(387): n is a, c, g, or t
  modified_base (428)..(428): a, c, t, g, unknown or other
  misc_feature (428)..(428): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtgggtctcaggtattactggtagtggtaataccgcatactacgcagactccgtgacgggccgttcaccgtctccagagacaattccaagaatacggtctatctaggaaatgaacagcctgagagccgaggacacggccctctattactgtgcgagagatcagacggatatagcagcagctcngactagtgggccacggacctggtacaccgtctccnacgcctccaccgacggccctatccgtccttcccctcggccnccctcctaccaacgacgccacctcgtcggggccacgacggcccggcccgtcgggccgtcgccgttcggacgaacgtacctctacactctacacctactcgacggcggacgtcggacgacggcgcagtacg

SEQ ID NO: 79314 - DNA, 638 bp, Homo sapiens
  misc_feature: GYAE6OF02J1DB1.37.26.C04.1.454.CMB.1.raw
  modified_base (374)..(374): a, c, t, g, unknown or other
  misc_feature (374)..(374): n is a, c, g, or t
  modified_base (509)..(509): a, c, t, g, unknown or other
  misc_feature (509)..(509): n is a, c, g, or t
  modified_base (599)..(599): a, c, t, g, unknown or other
  misc_feature (599)..(599): n is a, c, g, or t
tcagtagtgtagatcacgaccggtgctcgatttagtctagcgactttgggtttggggggaggcttggtacagcctggggggtccctgagactctcctgtgcagcctctggtttcatctttagcaactacgccatgagctgggtccgccaggctccgagggaagggctggagtgggtctcaggtattactggtagtggtaataccgctatacgtacgcagactccgtgacgggtccgttcaccgtctccgagacgactaattccaagtaacgtacggtctaattctaggaaatagaactacggcctgagacgacggaggacaccggtccctagtattacgtgtggacgaagagatacgaggacggataagtacgnaagcaaggtctacgtagacgtacgtcggggacccaaccggtaaccctggaccctaccggtcctcctacacgtccctacgaccgaacgggccctaacgtccgtccctacccgtcggccaccctaccacgaacgacncctacgtccggtagggaccacgccgtccggccgttacggccgtacggccgtcgggaacacggtaactcctacacgttactaacacgtacnggtaacggcggttcgtacggaccgtaggaccgtgacgtg

SEQ ID NO: 79315 - DNA, 769 bp, Homo sapiens
  misc_feature: GYAE6OF02IO3FG.37.26.C04.1.454.CMB.1.raw
  modified_base (147)..(147): a, c, t, g, unknown or other
  misc_feature (147)..(147): n is a, c, g, or t
  modified_base (211)..(211): a, c, t, g, unknown or other
  misc_feature (211)..(211): n is a, c, g, or t
  modified_base (364)..(364): a, c, t, g, unknown or other
  misc_feature (364)..(364): n is a, c, g, or t
tcagtagtgtagatcacgaccggtgctcgatttagtctagcgactttgggtttgggggaggcttggtacagcctggggggtccctgagactctcctgtgcagcctctggtttcattctttagcaactacgccatgagcgtgggtccnccaggcctccgaggggaaggggctggagtgggtctcgaggtattactggtagtggtaataccgnatactacgcagactccgtaggaccgggtccgttacaccgtctaccgaggacgaactaacgttacccaaagtaacgtacggttacctaagtacgttaaggaaaatggaaaccagcctgaacgacgtcgaaggacctacgcccttatacgttacngtcgacgaagatacgtcgaaggaacggtataacgtagacgacgacacgtcgtactagtaaccgtcggagggaccccaacggtaacccgttgtaccgaccgttccacgtacgccgaccctaccgaaccgtaaccggacctacgtcccggtttacccctaccccggtacgtacccctacccgtccgtaaaccgaacggacctacccgtaccggtacggggtaccggggaacaccggtaaccgggtccccggtaccggtacggggtcgtaccggtaccggttcggtaaaccggaaaggttaccccttaaccgttaccctaaccgttcgttaaaaccgaaccgttttaggacccgggtaacggccgggttaccggtacgggaacccgaacgggtcctacgtaacgacgg

SEQ ID NO: 79316 - DNA, 641 bp, Homo sapiens
  misc_feature: GYAE6OF02IXN1F.37.26.C04.1.454.CMB.1.raw
  modified_base (284)..(284): a, c, t, g, unknown or other
  misc_feature (284)..(284): n is a, c, g, or t
  modified_base (313)..(313): a, c, t, g, unknown or other
  misc_feature (313)..(313): n is a, c, g, or t
  modified_base (613)..(613): a, c, t, g, unknown or other
  misc_feature (613)..(613): n is a, c, g, or t
tcagtagtgtagatcacgaccggtgctcgatttagtctagcgactttgggtttgggggaggcttggtacagcctggggggtccctgagactctctgtgcagcctctggttcatctttagcaactacgccatgagctgggtccgccaggctccgagggaaggggctggagtgggtctcaggtattactggtagtggtaataccgcatactacgcagctcgtgacgggccggttcaccgtctccagagacaacttcaagaatacggtctatcgtggaaatcgaacngcctgacgacgccgaggacacggcccctntaacttacgtgtgcggacgagatcgaagacggaacgtatagctagcagtcttcgtgaaacgtacgtagggggtcccaaccgggaaccctggtcccgtaaccgtcccgtaccgttccaacggtccctacccgaacccgacgggccccagtcccggttcccttaccccgcgtacccgtacccctaccctacccgaagtaccgccgtaccgtcggtcggggacctacgacggtcccgggcccgtcgggtctcggccgtacgtcgaaacggtcctaccgttaccaccgtctactactacgtcgnggtcggccggtgaccgaggcacgatacg

SEQ ID NO: 79317 - DNA, 963 bp, Homo sapiens
  misc_feature: GYAE6OF02FQFYJ.37.26.C04.1.454.CMB.1.raw
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccgagggagggctggagtgggtctcaggtattactggtagtggtaataccgcatactacgcagactccgtggacgggtccgttacaccggtctccagacgtacaagttccaagtaatacggtacttagtcgtacgggaaagtcgaaccgacgtaccgtaggaggacggacccggaagggaaccgtaaccgggtccccttacgttaacttttaaccgtcggtttacggaccggtaagtaccggattacggaacgggtaccgggtaagttacgtaacggacgaggaccgtaaggtaccttacggtacgtaaccgttacggtacgggggtcccgaaaacccgggtaaccctccgggggtttacccaaccccgggttcccgttacccgtacccggtaaccggtacccccgtttaaaccccgaacccgggtaaaccccggggtccccctaaaccgggttttccccgggtttaacccccttttaccccccggggtttaccgggtaaccccccggtttaaccccccctaaccccggttttacccccggaaaacggttaaccccgtacccggtttaaaccccggtccgggggttaaccgggggtacccaaacccgggtaccgggggtacccgtaccccggggttacggtacccggggtccttacccggggttacgggtaaccggttaaacggaaccccgttttaccccgttacgtaaccgttccccgttaaacttacccggtaaacgttcgggaacccgggtaccggggttaccgtccgggggtaacccgtaaaccgggtcggtaccgtaacgtacggg

SEQ ID NO: 79318 - DNA, 792 bp, Homo sapiens
  misc_feature: GYAE6OF02F3V8G.37.26.C04.1.454.CMB.1.raw
  modified_base (281)..(281): a, c, t, g, unknown or other
  misc_feature (281)..(281): n is a, c, g, or t
  modified_base (284)..(284): a, c, t, g, unknown or other
  misc_feature (284)..(284): n is a, c, g, or t
  modified_base (317)..(317): a, c, t, g, unknown or other
  misc_feature (317)..(317): n is a, c, g, or t
  modified_base (352)..(352): a, c, t, g, unknown or other
  misc_feature (352)..(352): n is a, c, g, or t
tcagtagtgtagatcacgaccggtgctcgatttagtctagcgactttgggtttggggaggcttggtacagcctggggggtccctgagactctcctgtgcagcctctggtttcatctttagcaactacgccatgagctgggtccgccaggctccgaggggaaggggctggagtgggtctcaggtattactggtagtggtaataccgcaatactacgcagactcgtggacgggccgttcaccgtctccagagaacattccaagaatacgtctatctggaaatnaanagctgagacgcgaggacaccgcctctatactgngcgagagactacgagtacggagttaatacgctagnacgctagtcgaacgttacggtcggggaaccctaccgggacccttggtccctaaccggtccttccgtccgaaccgccctacccgaaacccgaaccggacccgtacgttcccggttaccccgttcccccgtacggtaccccgtacccccttacccgttaacccgaaaccgaccggtacccacccggttccgggttaccgggggaccctaacccgggtaccgggtccccgggtaccccgggttccggggtacccggtaccggttccccgggttaccggggttaaaccccggtaaaacggggttaacccctttaaccgttaccccgtaaccggtttaaccccgtaacctttaaacccgtaacccggttacgggaaccggggttcccggggtccggttaccggggaaacccggtacggggtacccgggtacgtaacggtaacggg

SEQ ID NO: 79319 - DNA, 816 bp, Homo sapiens
  misc_feature: GYAE6OF02H4ZDV.37.26.C04.1.454.CMB.1.raw
  modified_base (147)..(147): a, c, t, g, unknown or other
  misc_feature (147)..(147): n is a, c, g, or t
  modified_base (306)..(306): a, c, t, g, unknown or other
  misc_feature (306)..(306): n is a, c, g, or t
tcagtagtgtagatcacgaccggtgctcgatttagtctagcgactttgggtttgggtgaggcttggtacagcctggggggtccctgagactctcctgtgcagcctctggttcatctttagcaactacgccatgagcgttgggtcccnccgaggcctccgaaggggaagggctgggagtgggtctcgaggtattacgtggtagtcggtaactccgacatactaccgctagtaccgtccgtggaccgggtccggttcaaccggttcctaccgaaggaagaacctaagttaccaaaggaattaccggtnttacgtctaggaaatggaacctagcctggaagacggccggagaaccgccggtcctagttattagtagtcgacgtagagctacgaggacggtatagtacgcgaacgtcgacgttcgtacgttacggtaacgtaccggggtccgggacccggtaaacccggttaccccgttagggtacccctaacccgtttccccgccgtaacccggccggtaccccgtaacccgtaacccgggaaacccgggttacccgtaacccggtttccccggttaccccgtttaccccccggtacggttaccccctaccccgttacccgtacccggtaaccgaccgtacccgtaacgtcccgggtacgggaccgtaccggtaccggccccggtacgggtcccggtacgttccgggtacccgttcggtaaccgacggttccctttacgtacccgtaccgtaacgttaaccacggttaccggtacgtccgggtaccggttcgacgtacccggaacgcccgtagtaccgg

SEQ ID NO: 79320 - DNA, 783 bp, Homo sapiens
  misc_feature: GYAE6OF02HDW2J.37.26.C04.1.454.CMB.1.raw
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaagggctggagtgggtctcaggtattactggtagtggtaataccacatactacgcagactccgtgaagggtccgtttacatctccagacgacaagtccaagaacacgctagtatctgacaaatagaacagcctagagagcgacggacacggccgtatattactgttacgaagtagtaggtactcgtaggttcggtcttaacttttttaatcgttacctattcgtttacgaccgtaccgttagggggacccgaacggggtaaccccgttcgggtcccgtaacccggttccctacccgtaccgacgaccccttacccgaacccgtaaccgggccccgtaaccgttacccggtttccccgttaccccccgtcgggccccgtaccccgtcggtaccctaccggtaacgggacccgtacccgtaaccccgtccgggaaaccggtacccgccgtaaacccggaacgggtccccggggtccccgtttacggggaccgttccgggtaccccggttaggggttacccgtaaacggggtaccctttaacccgttccgtaaaccgttccctaaccgtaaccttacggttaccggtacgggtcccgggtacgtccgggaacggtaagggcgtaaccg

SEQ ID NO: 79321 - DNA, 1030 bp, Homo sapiens
  misc_feature: GYAE6OF02HSIG7.37.26.C04.1.454.CMB.1.raw
tcagtagtgtagatcacgaccggtgctcgatttagtctagcgactttggggtttgggggaggcttggtacagccgtggggggtccctgagactctcctgtgcagcctcgtggattcaactttggtagcttagttggatgggacgttggggtccgccgaggtcctccgagggccgtaagggggctgggaggtggggtggctagtttactatcgagagtgatagggaagttggttaggaagggtagttatcggacaaggtaccgttccggtagggaaacggggcctatttccaacctatccgtccgaagaacgaacctaattacccgaaaagaaacccaactaccttactaacgttccgtacggtaacaaaagttacggaaaccaacggtcccggtaaaggaacgtaaaacggttgggaaaccgggaaccgcggttaccgttagggttacgttaacttccgaacgttcgggtaaccggaaccggggtaaaaaccgggggtttaaggggggggtttgaaaacgcggttacgggaccgacggggtttaacgggtgggggttaaaggggtggtttaacgggttttaggggttttttaagaccggtttttacggggggaccgggggtaaacccggttaaaggggtaaacgttaacgggtttaccgggttaacccggttaacccgggtttacccgttaccggttaaccgtaccggttaccccgttaacccgtaaacccgggtaaaccgggtccccgttaacggtttccccgggtttacccccgtttccccggtacccggtaccccgtttaacccccgtaccccggttaaacccggtaaccggtaaccccggtacccgtaaccccggggttcggggaacccggggtaccttaaaccggggcccggtcccgggtcccggggttacgggttacccggtcccgggttacccggtacgggttaaacccggtaaccgggttaaccctttacccggtaccgttaaaccgttaccttaacccgttaccggttacggtaaccgggg

SEQ ID NO: 79322 - DNA, 623 bp, Homo sapiens
  misc_feature: GYAE6OF02HMERU.37.26.C04.1.454.CMB.1.raw
  modified_base (310)..(310): a, c, t, g, unknown or other
  misc_feature (310)..(310): n is a, c, g, or t
  modified_base (328)..(328): a, c, t, g, unknown or other
  misc_feature (328)..(328): n is a, c, g, or t
  modified_base (335)..(335): a, c, t, g, unknown or other
  misc_feature (335)..(335): n is a, c, g, or t
  modified_base (352)..(352): a, c, t, g, unknown or other
  misc_feature (352)..(352): n is a, c, g, or t
  modified_base (424)..(424): a, c, t, g, unknown or other
  misc_feature (424)..(424): n is a, c, g, or t
  modified_base (510)..(510): a, c, t, g, unknown or other
  misc_feature (510)..(510): n is a, c, g, or t
tcagtagtgtagatcacgaccggtgctcgatttagtctagcgactttgggtttgggggaggcttggtacagcctggggggtccctgagactctcctgtgcagcctctggtttcattctttagccaactacgccatgagctgggtcccgccgaggcctccgaaggggaaggggctggagtgggtctcgaggttattacgtggtagtggtaactaccgctatacctacggcagactccggtggaccgggtccgttcaccgtctccagcgaacaattaccaaagaactacggtctagtcgtaggaaatgaacngcctgagacgcgaggacncggcctntactactgtgacgaganactcacggacgtagtataggcagctagcctcacgtacgtcgtcgggacaccgtacgtcggtcctacctctcncgtcctcctaccgaccggacggcctacgtccgttccctacccgtcgaccctcccgtcctaccagacctacctcgtcggcgggaccncgacgtcccggcgtcggccgttcgtcggtcggtaccgaacgttaccgtacctactacgttacctacgactacggtacgacgggtccgacgtcggagtaccgcgtacgagtacg

SEQ ID NO: 79323 - DNA, 687 bp, Homo sapiens
  misc_feature: GYAE6OF02J2I5F.37.26.C04.1.454.CMB.1.raw
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccaggggaaggggctggagtgggtctcaggtattacgtggtagtggtaataccgcatactacgcagactccgtgacgggccgttcaccgtctccagacgacaattccgaagtaactacggtctaactcgtaggaaatgaactagcctgagacgaccgtaggacctacggccccttcttaattactcggtgaccgagaacgactcgaagacggtagtactaggcagctagctcgtgaacctggtcgggacccaacggtaacccgtgggtacctacccggtctaccctcgacctccctaccaccgaaccggcccgtaccgtccgtcccgttccccgtccgtacccgtacccctcccgtacccgaaccgtcgaaaaaccgtcccgtcggtacgggacccgtacgacccggtcccggtcccggtcggtaccggtccgtcccgtacggtaccgtaacggtaacccttacccgttcctacgtaccctaaccgtaccttacgtacggcggtaccggcgtcggaccgacggacgtacgtagtg

SEQ ID NO: 79324 - DNA, 575 bp, Homo sapiens
  misc_feature: GYAE6OF02FUBOY.37.26.C04.1.454.CMB.1.raw
  modified_base (310)..(310): a, c, t, g, unknown or other
  misc_feature (310)..(310): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtgggtctcaggtattactggtagtggtaataccgcatactacgcagactccgtgacgggccgttcaccgtctccagagacaattccaagaatacggtctatctggaaatgaacagcctgagagccgaggacacggccctntattactgtgcgagagatcgagacgggagtatagcagcagctgtgactacgtggggcccaacgggaccctggtcaccgtctcctcgacgcctccaccgaacggcccagtccggtccttcccctcgaccaccctcctaccagacgctaccgcgtcggggcacgcgccggccgtgggctcgccgtcgtacgaacggaccttacctaccatacctaacgaccttaacgtcgacggccgggtacgtcggaccgacggccgacgagtacg

SEQ ID NO: 79325 - DNA, 832 bp, Homo sapiens
  misc_feature: GYAE6OF02IZGTW.37.26.C04.1.454.CMB.1.raw
tcagtagtgtagatcacgaccggtgctcgatttagtctagcgactttgggtttgggggaggcttggtacagcctgggggtccctgagactctcctgtgcagcctctggtttcatctttagcaactacgccatgagcgtgggtccgccaggcttccagggaaggggctggtagtgggtctcaggtattactggtagtggtaatacggcagtacgtacgcagactccggtgacgggccgttcaccgtctccagacgactaattccaaagtaatacggtctatcgtaggaaaatgaacagcctagaacgacgaccggacgggaccaccgggtcccctattaagttaccgtggttacggacgtaaggtaggtaacgttaccgaaaggaacggtaaggttaactacggacgaagtaccgtaggtccttacgtaggtaccgttacggtcgggggaccctaacggggaaacccgttgggtacccaacccggttcctaaccgtacctacggtaccccttaccgaaccgaaaccgggtaccctaacggttacccggttacccgttacccccgtagggtaccccttaaccccgttccccttaacccggaaaacgtaaccgtacccgtaacccgttcgggtaccgggggtaccaacccggtacgggaccccgggttacccggttaccggggtaccgtttaccgttacccggtttacgggttaaccggtaaacgggttaccttaacccggtttaccctaaaccgttcccgttaaaccggtaccggttaccggtaacggtaccgggccgggtaccgttacggaccgtaacggccgtactacgacg

SEQ ID NO: 79326 - DNA, 619 bp, Homo sapiens
  misc_feature: GYAE6OF02JUEYR.37.26.C04.1.454.CMB.1.raw
  modified_base (248)..(248): a, c, t, g, unknown or other
  misc_feature (248)..(248): n is a, c, g, or t
  modified_base (295)..(295): a, c, t, g, unknown or other
  misc_feature (295)..(295): n is a, c, g, or t
  modified_base (427)..(427): a, c, t, g, unknown or other
  misc_feature (427)..(427): n is a, c, g, or t
  modified_base (513)..(513): a, c, t, g, unknown or other
  misc_feature (513)..(513): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggcctccgaggggaacggggctgggagtggggtctcgaggtattactggtagtggtaataccgcatactacgcagactcggtgacgggccgttcaccgtntccagagactaatccaaaggactacggtctagtctaggaaatgaacngcctgagacgaccgagaccacggcctcgtattacgtgtagcgagacgactacgaaggacggtaatactaggcagctaggcctcgtacgacgtacgtcggggacccacggtacctggtccaccgtctccgtcncgccctccaccgacggccctatccggtcccttcccgtcggcccgtccgtcgtccgtccgaggccgccaaccgtcgacggacgtacncgcggcccggtccggtacgggctcgcgtacggtacaggtaccttccgtacaacgtacctaacgtccgtacgtaggtcggcgggtccggtacggcgacggcctacgg

SEQ ID NO: 79327 - DNA, 806 bp, Homo sapiens
  misc_feature: GYAE6OF02G2WB0.37.26.C04.1.454.CMB.1.raw
  modified_base (140)..(140): a, c, t, g, unknown or other
  misc_feature (140)..(140): n is a, c, g, or t
  modified_base (202)..(202): a, c, t, g, unknown or other
  misc_feature (202)..(202): n is a, c, g, or t
  modified_base (220)..(220): a, c, t, g, unknown or other
  misc_feature (220)..(220): n is a, c, g, or t
  modified_base (239)..(239): a, c, t, g, unknown or other
  misc_feature (239)..(239): n is a, c, g, or t
  modified_base (316)..(316): a, c, t, g, unknown or other
  misc_feature (316)..(316): n is a, c, g, or t
tcagtagtgtagatcacgaccggtgctcgatttagtctagcgactttgggtttgggggaggcttggtacagcctggggggtccctgagactctcctgtgcagctctggttcatcttagcaactacgccatgagctggtcncaggctccgagggagggctggagtgggtctcgaggttattacgtggtagtggtaactaccgnatacgtacgcaagctcgngaccggtcgttcaccgtcncagcaactattccaagatacggtctatcgtagtaaactgaactagcctagaggtacgccggaggacaccggaccttnttaacttactggtacgcgagagtactcgaaggaacgagttatacgacgtaggactacggtactaccgtaggaccgttacgggtacccggggaacctaaccggttaacccggttcgggtacccgtaaccgtttcccgacccgtacgtaccgttaccccgtacccggtaacccgacggggtaacccctaacgggttccccggtttaacccttcccggtacggtaccccgtaaacccttccccgggtaaacaaccggttaccgtccgtaacccgttacggggtccggtaaccgaaccggttcccggaccccgggtccgtaaccggggtaccgttcggtaccccgttcgggtaaacggtaaaacccgggttcccgttccgttaaaccgttaccgttaacccgttaaccttacccggttaacgtaccgggaacccgggttcccgggtaacggttaacggaacccgggttacccggcgttaccggtaacgtaacgg

SEQ ID NO: 79328 - DNA, 664 bp, Homo sapiens
  misc_feature: GYAE6OF02HH8U0.37.26.C04.1.454.CMB.1.raw
  modified_base (272)..(272): a, c, t, g, unknown or other
  misc_feature (272)..(272): n is a, c, g, or t
  modified_base (357)..(357): a, c, t, g, unknown or other
  misc_feature (357)..(357): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccgagggaagggctggagtgggtctcgaggtattacgtgggtagtggtaataccgcatactacgcagactccgtgaccgggccgttcaccgtctcagacgacaattccaagaatacggtntatctaggaaactgaacacgcgtgagacgccgaggaccacggccctatattactgtagcgaagtcacgtcgaaggacggtaatanacgcaggacagcttagtagaacttacggcggggacccaaccgggtaaccgttcggtaaccacccgttctacccgtcgaaccgtccctaccgaacccgaaccgggtacccgtacgttccggttcccttccccgtaggaccctaccccgtcctaccgaaacgcccgactaccgtcggtcgggacaccgtacggccggtacgtcgggtcctcgtccgtacggtacgaaccggttctaccgttctactccgtaactaccggtactcgggtaacgccggttcgacccgggagtaaccggactacgacgacgg

SEQ ID NO: 79329 - DNA, 660 bp, Homo sapiens
  misc_feature: GYAE6OF02FMNUI.37.26.C04.1.454.CMB.1.raw
  modified_base (296)..(296): a, c, t, g, unknown or other
  misc_feature (296)..(296): n is a, c, g, or t
  modified_base (347)..(347): a, c, t, g, unknown or other
  misc_feature (347)..(347): n is a, c, g, or t
tcagtagtgtagatcacgaccggtgctcgatttagtctagcgactttgggtttgggggaggcttggtacagcctggggggtccctgagactctcctgtgcagcctctggtttcattctttagcaactacgccatgagctgggtccgccaggctccgagggaaggggctggagtgggtctcgaggtattacgtggtagtggtaactaccgcatactacgcagactccggtgacgggtccgttccaccgtctccagagacaattccaagaactacggtctatcgtaggaaatcgaaancgcctggacgaggccgaggacaccggccctcttaattacgtgtgcgagagntacgagacggataagtgcagcacgtctacgtgaaccgttcggtcggggacccaaaccggaccccgttggtaccctacccggttcctccgttacgaccgtcccctacccgaaccggaaccggtccctacgtcccggttccccgttcccccgtcggtacccctaccccctcccttaccgaagccgtacccgtaccgtcgggtcgggaccaccgacggccgcccgtggctcgccgtggtaccgacggtacctccgttacactaccgtacgtacgtacgcgtacggccgggtcgtacggcgtaacggcgacgagtcg

SEQ ID NO: 79330 - DNA, 698 bp, Homo sapiens
  misc_feature: GYAE6OF02FJVZ9.37.26.C04.1.454.CMB.1.raw
  modified_base (296)..(296): a, c, t, g, unknown or other
  misc_feature (296)..(296): n is a, c, g, or t
  modified_base (368)..(368): a, c, t, g, unknown or other
  misc_feature (368)..(368): n is a, c, g, or t
tcagtagtgtagatcacgaccggtgctcgatttagtctagcgactttgggtttgggggaggctttggtacagcctggggggtccctgagactctcctgtgcagcctctggtttcatctttagcaactacgccatgagctgggtccgccaggctccgagggaaggggctggagtgggtctcaggtattactggtagtggtaataccgcatactacgcagactccgtgacgggccggttcaccgtctccagagacaattccaaagtatacggtctatttaggaaatgacagcctgagngccgaggaccacggcccctctacttactgtgcgagagatcagtacggagtatcgcagcagctctgactacgnggggacccacggaaccctggtaccaccggttctcccgtcaccgtccacccgtaccgaacgggcccctacgttccggtccctttcccccgtcggcctaacccctccctacccgaacggtaccgtccctaccgttccgcgggggtcccacgaccggtacccggcccggttacgggtcccgttacggcccggttacgggtaaccgtaaacccgggtaaccgttaacccgtttacccgttacctacccttaaccccaaccgttaaccgttaacgggaacggtcccgggtaccgtacgggtacccggtaaagggaccccgtacgtacgtaggtag

SEQ ID NO: 79331 - DNA, 691 bp, Homo sapiens
  misc_feature: GYAE6OF02IY973.37.26.C04.1.454.CMB.1.raw
tcagtagtgtagatcacgaccggtgctcgatttagtctagcgactttgggtttgggggaggcttggtacagcctgggggggtccctgagactctcctgtgcagcctctggtttcatctttagcaactacgccatgagctgggtccgccaggctccaggggaaggggctggagtggggtctcgaggttattacgtggtagtggtaataccgcatactacgcagacctccggtggaccggggccggttcaccgtctaccagagactaattccaaagaatacggtctaatctaggaaactgaacagcctgagagccgaggacacggccctctatactgtgacgagagatcgaaggaacggaagtatagcagcagctcagactacggtcggggaccaccggaacctcggtaccacccgtcctccctaccgacacccgtacccacccgaaccgggaccccacgtcccggttcccttccccgtcgaccctacccctccctaacccgaacgaccgtaccctacccgtcggtaccggggaccaccgaccgggacccggtcccggtacgggtcccgtaccggcccgttacgggtaaccgtaaacggtaccttacccgttacctaccttaaccttaacgaaccgttacgtacggaccggtccgggtacgtacgggaccgaagggaccgtaccgtagtacgg

SEQ ID NO: 79332 - DNA, 715 bp, Homo sapiens
  misc_feature: GYAE6OF02I0YW9.37.26.C04.1.454.CMB.1.raw
tcagtagtgtagatcacgaccggtgctcgatttagtctagcgactttgggtttgggggaggcttggtacagcctgggggggtccctgagactctcctgtgcagcctctggtttcatctttagcaactacgccatgagctgggtccgccaggctcgagggaaggggctgggagtgggtctcaggtattacgtggtagtggtaataccgcatactacgcagactccggtggacgggccggttcaccgtctccagagacaattccaagaacacactgtctctgacaaatgaacacgcctagagacgtgaaggacgacgtaccttaatattactggtagtcggaaaggcctactacgtcccttaatagacagcggtacgtggtaccgtgggttactttagacggtacgtcgggggaccgaacggggtaacccgtcggtaccacccggttcctaccctagaccgacccttacccgaaccgtaaaccggggcccttaacggtcccggttcccgtttacccccgtccgggtacccgtcccgttacgtacctacccggtaaggggaccgtaccgaacccgttacgacgaacggtaccaacgacggtaccgggcccgtcgggtctcccggtccgttaccgggacgtaaacggtaccttaacccgttccgtaactacgttaacctacgtacgtacggacggtacgggtcgtacggacgtaacggg

SEQ ID NO: 79333 - DNA, 614 bp, Homo sapiens
  misc_feature: GYAE6OF02ITC6R.37.26.C04.1.454.CMB.1.raw
  modified_base (317)..(317): a, c, t, g, unknown or other
  misc_feature (317)..(317): n is a, c, g, or t
  modified_base (339)..(339): a, c, t, g, unknown or other
  misc_feature (339)..(339): n is a, c, g, or t
  modified_base (354)..(354): a, c, t, g, unknown or other
  misc_feature (354)..(354): n is a, c, g, or t
  modified_base (357)..(357): a, c, t, g, unknown or other
  misc_feature (357)..(357): n is a, c, g, or t
  modified_base (369)..(369): a, c, t, g, unknown or other
  misc_feature (369)..(369): n is a, c, g, or t
  modified_base (378)..(378): a, c, t, g, unknown or other
  misc_feature (378)..(378): n is a, c, g, or t
  modified_base (397)..(397): a, c, t, g, unknown or other
  misc_feature (397)..(397): n is a, c, g, or t
  modified_base (409)..(409): a, c, t, g, unknown or other
  misc_feature (409)..(409): n is a, c, g, or t
  modified_base (424)..(424): a, c, t, g, unknown or other
  misc_feature (424)..(424): n is a, c, g, or t
  modified_base (459)..(459): a, c, t, g, unknown or other
  misc_feature (459)..(459): n is a, c, g, or t
tcagtagtgtagatcacgaccggtgctcgatttagtctagcgactttgggtttggggggaggcttggtacagcctgggggggtccctgagactctcctgtgcagcctctggtttcatctttagcaactacgccatgagctgggtccgccaggctccgaggggaaggggctgggagtgggtctcaggtattactggtagtggtaataccgcatactacgcagactccgtgacgggcgttcaccgtctccaagacgacaacttaccaaagtaatacggtctaatcgtaggaaatgaaacacgcctgagagccgaggacnccggcctctatctgtgcgaganatcacgacggagtanagnagacagtctcgngacttacgngggccacggacctggtccncgtcctcctcgncctcaccgacggccncgtcgtcccttcccgcgccacccctcccacaacgnccgtaccgtcggtacgggccaacgcggaccggtccggtcggtctcggccgtacggtcgtaaaccggcttaccttaccgtattacccgtaaccgtaacttaaccgtcgggtcggtacgggtacgtaccgggtacggaacggttccggataggtacg

SEQ ID NO: 79334 - DNA, 771 bp, Homo sapiens
  misc_feature: GYAE6OF02IXFR2.37.26.C04.1.454.CMB.1.raw
  modified_base (307)..(307): a, c, t, g, unknown or other
  misc_feature (307)..(307): n is a, c, g, or t
  modified_base (765)..(765): a, c, t, g, unknown or other
  misc_feature (765)..(765): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagcgtgggtccgccaggcctccgaaggggaaggggctgggagtgggtctcgaggtattacgtggtagtggtaactaccgcatacgtacgcagtacctccgtggaccgggtccggttcaccgtctaccagagacaattccaaagtaactacggtctactcgtaggaaatgaacngaccgtggaacggaccggaccggagggaaccacccgggtccccttaccgttaacgtttaccgtggtcgaaccggtgaacgtacgtacgacggaacggtaagtaacgtacggccgaagccgacgcttacgtagtaccgttacggccgggacccgaacggtacccgtcggtacccgtaccgtcccgtcctacgcccgtcctccccgaaccgtaccggccgtaccgtccggttccccttaccccggtcgtacccctaccccgtacccgtaacgaacggtcctacccgtccggttccgggaccgggtaaccgaccgtacgggtaccccggtccgtcggggtaccgtccggttaccggttagggaaccctaacgggtccctaacccggttcaaccggttaccttaccgaaccgttcgtaacgggcccggtccggacggttcggaacccgtaagggccgtacgnggttag

SEQ ID NO: 79335 - DNA, 743 bp, Homo sapiens
  misc_feature: GYAE6OF02GZED0.37.26.C04.1.454.CMB.1.raw
  modified_base (151)..(151): a, c, t, g, unknown or other
  misc_feature (151)..(151): n is a, c, g, or t
  modified_base (322)..(322): a, c, t, g, unknown or other
  misc_feature (322)..(322): n is a, c, g, or t
  modified_base (348)..(348): a, c, t, g, unknown or other
  misc_feature (348)..(348): n is a, c, g, or t
  modified_base (433)..(433): a, c, t, g, unknown or other
  misc_feature (433)..(433): n is a, c, g, or t
  modified_base (485)..(485): a, c, t, g, unknown or other
  misc_feature (485)..(485): n is a, c, g, or t
tcagtagtgtagatcacgaccggtgctcgatttagtctagcgactttgggtttgggggaggcttggtacagcctggggggtccctgagactctcctgtgcagcctcttggtttcatctttagccaaactacgccatggagcgtgggtcccnccagggcctccgaaggggaaggggctgggaggtgggtcctcgagggtatttacgtgggttaagtaggttaaactaccgatagtaaccgtacgcagtactccggtaggaccgggtccggttacacccgttcacccgagacgaactaacttaccgaaaagtaacgtaccggtnttaacgtcgtaaggaaaatcgaaacncgtacctaggaagacgccggacggaacctacccggtccctattaacgtacgtggagacgagtagacctacgaaggacggtaattnaacgcagtcgatcactagaccttcggcggaccgaaccggacctacggtaccnccgtctccgacgcctcccgaccgaaccgtacggcccttcgtacccggttacccttcccgaccggtaccctaccccgttaccaacgacgacctcccgtaccgttcgggaccgggaccaacggccggtcccggtaccgtcggaccgttcgccgttaacggtaacgaacccgttaacgttaccgttaccgtaacttacccgtaacctaggtacccgaggtaccggtcgttacgacggtaaccggtacgcggtagtagtacg

SEQ ID NO: 79336 - DNA, 712 bp, Homo sapiens
  misc_feature: GYAE6OF02IOVPL.37.26.C04.1.454.CMB.1.raw
tcagtagtgtagatcacgaccggtgctcgatttagtctagcgactttgggtttgggggaggcttggtacagcctggggggtccctgagactctcctgtgcagcctctggttcatctttagcaactacgccatgagctgggtccgccaggctccaggggaaggggctggagtgggtctcaggttattacgtggtagtggtaataccgcatactacgcagacctcgtgacgggccggttcaccgtctccagacgactaattccaaagaattacggtctatcgtaggaaatgaaacagcctaggagagccggaggacaccggccctactattaccgtggtcgacgagagatcaggacggagtatagacgagacagctcgtagtactaccggtcgggacccaacgggtaaccccttggtaccgtacccgtcctcccgtacgacgtccctcccgaaacccgaaccgggtaccccgtagttcccggttacccttcccccgtcgggcccctaacccccttcccgtaacccgaaaccggacctacccgtaccccgttccgggttccggggacccaacgccggtacccggccgtcggggcctccgtacccgtgggtaaccaaaacgggtacccttaaccttaccctaacgttacctaaccgtaccgtaccgtacggtacggacgggtccgtaacgggtccgaaggtccgtacgtagtaacg

SEQ ID NO: 79337 - DNA, 863 bp, Homo sapiens
  misc_feature: GYAE6OF02H5NJJ.37.26.C04.1.454.CMB.1.raw
tcagtagtgtagatcacgaccggtgctcgatttagtctagcgactttgggttgggggaggcttggtacagcctgggggtccctgagactctcctgtgcagcctctggtttcatctttagcaactacgccatgagcgtgggtcccgccaggctccgaggggaagggctggagtcgggtctcgtaggttactttacgtaggtacgtagggtaactacccggcaataccgtacgcaaggacctccggtggaccggggtccggtttcacccggttcctaccgagacgaactaaacgttccgaaagtaactaccgggttctaagtccgtagggaaattgaaaccgagtccgtaggacgacggtaccggaggaccgtaccgggtccccttacgtaacttttaccgtacggttacggaccggaaggtaacggtaacttaccggtaaacgggaaccgggtaaggttaacgtaaggaccgacggactaacggcttaccgtaggtaaaccgttcggacggggtacccgaaccgggtaacccgtgggtacctacccgttcgttaccctcgtacgcccctacccgaaccggaacccgggtcccctaccgttacccgggttaccccgttaccccgtccggttaccccaccccgttacccgtaacccgaaccggtaacgtaccctacccggttacggggtacggggtacccacgggtaaccggccccggggttcccgttacggggtccgtacggttacccggttacggtaaccgtaaacggtacccgtttacctacccgttacgttaccgtaaccttaaccctaggtaccgaccggtccgggtaccgtaggacccggtaggtccgaccgtaaggtcg

SEQ ID NO: 79338 - DNA, 902 bp, Homo sapiens
  misc_feature: GYAE6OF02GOOLT.37.26.C04.1.454.CMB.1.raw
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccaggggaaggggctgggagtgggtctcaggtattactggtagtggtaataccgcatactacgcagactccgtgacgggtccgttcaccgtctccgagagactaattccaaagaacgtacggttctatcgtaggtaaatcgaacacgccgtagaagacgaccggaggaccgaccggtccccttacgttaactttaccgtggtacgacggaaggacgtactacgaaggaccggtaagttaagtagaccaaggccacgtacgttccgttaggaaccgttaccggtaccgggggaacccccgtaaaccgggtaaaccccggttcgggttaccccgtaaccccggtttcccgttaccccgttaccgaacccgggtcccccttaaccccggaaacccgggaaacccggggtaccccccgttaacgggtttccccgggtttcccccctttccccccgggtttaccgggaccccctaaccccccgttttaccccgtaacccggtaaaccggacccggaccccttaaccccgggttaccgaacggtaacccgtaaccgacccggaacccgggtccccggtacccgggtccgggttaccgtcccggttcccgggtttacgggaacccggtaaccgggtaacccttttaccccgttaacccgtaaccgttaccgttaaacccggtacttaccgggtaccgggtaccgggtcccggggtaccttaaccgggggacggtaaccggggtacccacgggttaac

SEQ ID NO: 79339 - DNA, 772 bp, Homo sapiens
  misc_feature: GYAE6OF02I29O6.37.26.C04.1.454.CMB.1.raw
  modified_base (765)..(765): a, c, t, g, unknown or other
  misc_feature (765)..(765): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtgggtctcgaggtattacgtggtagtggtaataccgcatactacgcagactccgtgacgggccgttcacgtctccagagacaattccaagaactacggtctagtctaggaatagaacagcgtgagacgccgaggaccaaccggccctacttacttacgtgttacggcgtagagactccgaaggacggtaagtagtacggacgtacgacacggtctacgtacgtacgtaacgttccgggggacctaaccgggtaaacccgttcggtacccgtacccggtaccttccccgacgtacgtcccctacccgaaacccggtaccggtacccccgtaacgtttcccggttcccccgtttacccccggtcggtaaccccgtacccccgttaacccctaaccggaaaccgcccgtaacccgttccccgtacggggtaccgggtcccaaccgaccggggacccgggtaccccggttcggggccttccgggtcccgttacgggtaccgtaaacgggtacccttaccgttacccgtaccgttacccttaaccgtaaccgtaaccggtcggtaacggcccgggtagtcgggaccgtaaggggtaccgngtatacg

SEQ ID NO: 79340 - DNA, 802 bp, Homo sapiens
  misc_feature: GYAE6OF02H1ZZU.37.26.C04.1.454.CMB.1.raw
tcagtagtgtagatcacgaccggtgctcgatttagtctagcgactttgggtttgggggaggcttggtacagcctgggggggtccctgagactctcctgtgcagcctctggtttcatctttagcaactacgccatgagcgtgggtccgccgaggctaccgaggggaaggggctggaggtgggtctcgaggtattacgtggtagtggtaataccgcatactacgcagacctccggtaggacgggccgttccaccgttctaccgaaggacgaactaacttaccgaaaggtaacgttaccggttctaaagttccgtagggtaaaactgaaaccgagtcccgtaggagacggaccggaacggaccgacccggtcccttaacgttacgtacgttcggtcggacgtaacgaggtaactacgaagggaacgggtaggtaactacggacgagcgtaacgtccgttacgtacgtacgtaccggtccggggacccaaaccgggacccgttcggtacccgtacccgttccctacccggtacaccggtcccctacccgaaccggtacccggacccgtaaccgttcccggttccccggttccccgtaccgggccccgtcccgtccgtcccgaccggtacggaccgtccccgtaccaccgggtaacgaccgccgaaccgcccgggtaccccggccgggtcccggtcgtaccggtcccgttacgggtaccgaaccgtaccgttacccttacgtccttacccgtaccgtacccgttacgccgggtacggcgggtacccggcggaccgaccgggcgaacg

SEQ ID NO: 79341 - DNA, 655 bp, Homo sapiens
  misc_feature: GYAE6OF02FRQ6I.37.26.C04.1.454.CMB.1.raw
  modified_base (206)..(206): a, c, t, g, unknown or other
  misc_feature (206)..(206): n is a, c, g, or t
  modified_base (313)..(313): a, c, t, g, unknown or other
  misc_feature (313)..(313): n is a, c, g, or t
  modified_base (320)..(320): a, c, t, g, unknown or other
  misc_feature (320)..(320): n is a, c, g, or t
  modified_base (344)..(344): a, c, t, g, unknown or other
  misc_feature (344)..(344): n is a, c, g, or t
  modified_base (365)..(365): a, c, t, g, unknown or other
  misc_feature (365)..(365): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtgggtctcaggtattacgtggtagtggtaataccgnatactacgcagactccgtgacgggccggttcaccgtctccagagacaattccaagaatacggtctatctagaaaatgaacagcctgagagccgaggacacggccctntattacngtgcgagagatcgagacggagtanagcagcagtctctgactacgnggggacccaccggtaacctgggtccaccggtctcccgtcacgtccctccaaccgtaacgggccccacgtcccggtcccttccccgtcggaccctacccctaccctccgaaacgacgccacccgtcgtcggggaccacggcgccgggtcccgtcggggtccgtcggtccgttcgggtaccgtaaacggtaccttaccgttaccctacgtacccgttaacctaccgttaccgtacggtaccggtaccggggaccgttacgggtaccgaacgggtccgtaccgtaacgtacgg

SEQ ID NO: 79342 - DNA, 698 bp, Homo sapiens
  misc_feature: GYAE6OF02HREJB.37.26.C04.1.454.CMB.1.raw
  modified_base (209)..(209): a, c, t, g, unknown or other
  misc_feature (209)..(209): n is a, c, g, or t
  modified_base (300)..(300): a, c, t, g, unknown or other
  misc_feature (300)..(300): n is a, c, g, or t
  modified_base (340)..(340): a, c, t, g, unknown or other
  misc_feature (340)..(340): n is a, c, g, or t
  modified_base (382)..(382): a, c, t, g, unknown or other
  misc_feature (382)..(382): n is a, c, g, or t
  modified_base (465)..(465): a, c, t, g, unknown or other
  misc_feature (465)..(465): n is a, c, g, or t
tcagtagtgtagatcacgaccggtgctcgatttagtctagcgactttgggtttgggggaggcttggtacagcctggggggtccctgagactctcctgtgcagcctcgtggttacatctttagacaactacgccatgagcgtgggtccgcgaggctccgagggagggctgggagtgggtctcgaggtatacgtggtagtggtaataccgnatactacgcacgtctcggtcggacgggtccgttcaccgtcctcgagacgactaattaccaagtaacgtacgtctagtctaggaaatgaacncgcctagagacgaccgagacaccggtcccttatagttacnggtagacggaagtacgtacgtcggaaggaccggtaagttaanacggacgtaggactacggtctcgtacgtaacgtcgggacggggacccaacgggtaccgttcggacctccgttactccaacgcnccctacgaacccgaacggtcctacgtccggttccctcccgtcgaccctccctaccacaacgcgctccgtcggacgggaccacggcggacccgtccggcggtacgtcccggtacgttccggtaacgaacggttacccttcggtacctacggttaccctaaaggtcccgttaaggacggtaccgggtacgggtcggtaaccgggtacggtaacccgggtactaccggttaaggcg

SEQ ID NO: 79343 - DNA, 561 bp, Homo sapiens
  misc_feature: GYAE6OF02GCP9A.37.26.C04.1.454.CMB.1.raw
  modified_base (311)..(311): a, c, t, g, unknown or other
  misc_feature (311)..(311): n is a, c, g, or t
  modified_base (391)..(391): a, c, t, g, unknown or other
  misc_feature (391)..(391): n is a, c, g, or t
  modified_base (445)..(445): a, c, t, g, unknown or other
  misc_feature (445)..(445): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtgggtctcaggtattactggtagtggtaataccgcatactacgcagactccgtgacgggccggttcaccgtctccagagacaattccaaagaatacggtctatctggaaatgaacagcctgagagccgagacacggccctntattactgtgcgagagatcagacggagtatagcagcagctctgactacgtggggccacggaaccctggtcaccgtctccncacgcctccacgacggcccatcggtcctcccgtcgccacccctcctaccaagcncctaccgtcgtcggggcacgacggccggcccgtgggcctcgtcccgtggtaccaacggtcctacttccatcctaacacttacgcgacgtcggactcggaccgaaggccgagatacg

SEQ ID NO: 79344 - DNA, 791 bp, Homo sapiens
  misc_feature: GYAE6OF02G635S.37.26.C04.1.454.CMB.1.raw
  modified_base (213)..(213): a, c, t, g, unknown or other
  misc_feature (213)..(213): n is a, c, g, or t
  modified_base (300)..(300): a, c, t, g, unknown or other
  misc_feature (300)..(300): n is a, c, g, or t
  modified_base (488)..(488): a, c, t, g, unknown or other
  misc_feature (488)..(488): n is a, c, g, or t
tcagtagtgtagatcacgaccggtgctcgatttagtctagcgactttgggtttgggggaggccttaggtacagcctgggggggtccctgagactcctcctgtgcagcctctggtttcatctttagcaactacgccatgagcgtgggtccgccaggctccaggggaaggggctggagtgggtctcaggtattactggtagtaggtaactaccgnatactacgcagactcgtggacgggtccgttcaccgtctccagacgactaacttccaaagactacggtctatcgtaggaaatgaaacncgcctagagacgccgaggacaccggcccttacgtattcgtagtcggaccgtaaggacgtacgtactaacggaccgggtagttaacgtacgcgaaggcctaacggccttaacgtacgtaaccgtacggtaaccgggggaccctaacccggtaacccgttgggtaccctacccggttctaccctcgtacnccccgtaccgaaccgaccgggcccgtacgtcccggttacccttccccgcgtacccctacccgtcccgttaccgaacgtccgtacccaaccggtccggtaccggggacctaacccgccgggtacccggttcccgggtacggggtcccgttccgggtaccgttaccggggtacggtaaaccgttacccgtaaccccgttccgtaacccgttaccggttaacccctaaccggttaaccggttccgggtaacccgggtccgggtaccgttaccggggaccgtacggggacccgtacggtacgtacgg

SEQ ID NO: 79345 - DNA, 719 bp, Homo sapiens
  misc_feature: GYAE6OF02JN1Z8.37.26.C04.1.454.CMB.1.raw
  modified_base (205)..(205): a, c, t, g, unknown or other
  misc_feature (205)..(205): n is a, c, g, or t
  modified_base (228)..(228): a, c, t, g, unknown or other
  misc_feature (228)..(228): n is a, c, g, or t
  modified_base (233)..(233): a, c, t, g, unknown or other
  misc_feature (233)..(233): n is a, c, g, or t
  modified_base (261)..(261): a, c, t, g, unknown or other
  misc_feature (261)..(261): n is a, c, g, or t
  modified_base (266)..(266): a, c, t, g, unknown or other
  misc_feature (266)..(266): n is a, c, g, or t
  modified_base (281)..(281): a, c, t, g, unknown or other
  misc_feature (281)..(281): n is a, c, g, or t
tcagtagtgtagatcacgaccggtgctcgatttagtctagcgactttggggtttggggggtagggtcgttgggtacgaggccgtgggggggtcccgtggagactctcctgtatagcctctggattcaccttcagcaactatggcatgcactgggtccgccaggctccaggctaaggggggctagggaggtggggtggcaggttanatcagatgatggaatgttgaggntatgnagactcggagaagggcgattcgacatcncaganacaatccaagaccanaactctatcgtcgataaatgaacagcccgtagacgtaacctggaacgggaaccacgtacgtgttagtaactccgagttacggtacgaccgtaaaaccgggttagggggggtttagacgttaacgtggaacctgggtaacggttggggaacgggggttagtattttgggggttttaccaggtttttacgggacgggggacgtaaaggggtaactaaggttcgggttacgtacctcgttacgttcgaaccggtcccgtaacccgaccgttaaaccgggcccgttaacgttccggttaccccttcccggaccgggtccctacccctcccgtactaaccggccgtaccctacggtccgggtacgggactacgcgggtccggtccgtcgggactcggtccgtacggccggtaacggttcaccgttccgacttcgaaccgtacg

SEQ ID NO: 79346 - DNA, 770 bp, Homo sapiens
  misc_feature: GYAE6OF02FIF0Z.37.26.C04.1.454.CMB.1.raw
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccgaggggaaggggctgggagtgggtctcgaggttattacgtggtagtggtaataccgcatactacgcagacctccgtgaccgggtccgttcaccgtctccgagagacaattccaaagtaacgtacggtctattcgtaggaaatgaacagcctaggaggacgccggaaggaccaccggcccctacttaattaccgtggtcggacgagtaagatacgaaggaacggtaagtacgtacgacgagaccaagccttaccgtgaaccgttaacggtcggggacccaaccgggtaacccgtggtacccgtaccgttcctacccgtcgtaaccgtcccgtaccctaacccggaaccgggtccccgaaccgtttcccgggtttaccccgttacccccccgttccgggtacccctaaccccccgttccccttaacccgaaaccggtaccggaccccgtaccccgtccgggtaccgggggacccgtaccggaccggcccgggtcccggtcggggtcccgtccgtcccggtacgtaccggaaccggtaccttaccgttacccactaccgtaaccgtaaccttaccgtcggacggtccgggcgtacggaccgaacgggcgtacgagtacg

SEQ ID NO: 79347 - DNA, 835 bp, Homo sapiens
  misc_feature: GYAE6OF02I8X2Y.37.26.C04.1.454.CMB.1.raw
  modified_base (147)..(147): a, c, t, g, unknown or other
  misc_feature (147)..(147): n is a, c, g, or t
  modified_base (217)..(217): a, c, t, g, unknown or other
  misc_feature (217)..(217): n is a, c, g, or t
  modified_base (828)..(828): a, c, t, g, unknown or other
  misc_feature (828)..(828): n is a, c, g, or t
  modified_base (833)..(833): a, c, t, g, unknown or other
  misc_feature (833)..(833): n is a, c, g, or t
tcagtagtgtagatcacgaccggtgctcgatttagtctagcgactttgggtttgggggaggcttggtacagcctggggggtccctgagactcctcctgtgcagcctctggtttcatctttagcaactacgccatgagcgtgggtccnccgaggctccaggggaaggggctgggaggtgggtctcgtaggtattacgtggtaggtggtaaactaccgnaatacgtcgcacgactccggtggaccggggtcccgttcaacccgttctccgaaaggtacgaacctaaacttcccgaaaagaaccaccgtcttaccgttatctcggactaaacgtacgaaaccacggtcctacgggtagaacggaccggtaaacgaaccgaccggtacccggtaagttaacgtttacgttaggtaggtaacggaaacgggtcgggtacgggggtaggggtacgggggggtaccgtacgggtaccgggggtacccggaaccggggtaacccgtacggtacccgtacccggttccggtcctaccgtacgtacccgtaacccgaaccggaaccgggtacccctaacggttcccggttacccctttcccccggtccgtaacccctacccccgtacccgtaccgaaacgcccggtacctacccggtccgggttcgggacccgcggtaccgggtaccggttcccggcgggtccgtccgtaccggtcggtaaccggtaacggtaaccttacccgtacctacgttacctaaccgtcgttaccggtcggaacgggtccgggtacgtccggaaggacggtccgtaacgtaggtacgcgtacacggcctagcncgacncg

SEQ ID NO: 79348 - DNA, 760 bp, Homo sapiens
  misc_feature: GYAE6OF02HSV55.37.26.C04.1.454.CMB.1.raw
  modified_base (149)..(149): a, c, t, g, unknown or other
  misc_feature (149)..(149): n is a, c, g, or t
  modified_base (212)..(212): a, c, t, g, unknown or other
  misc_feature (212)..(212): n is a, c, g, or t
  modified_base (223)..(223): a, c, t, g, unknown or other
  misc_feature (223)..(223): n is a, c, g, or t
  modified_base (360)..(360): a, c, t, g, unknown or other
  misc_feature (360)..(360): n is a, c, g, or t
tcagtagtgtagatcacgaccggtgctcgatttagtctagcgactttggggtttggggggaggcttggtacagcctgggggggtccctgagactctcctgtgcagcctctggtttcattctttagcaactacgccatgagctgggtccnccaggctcgaggggagggctggagtgggtctgaggttattacgtgggtagtggtaaataccgntatactacggnacgactccgtggacgggtccgttcaccgtctaccagagaactattaccaagaatacggtactatctaggaaatgaaacgtgtcgtaggacggacgacccggaaggacccgtaccggtccccttattaagtttaccgngtacgggacgaagtagactacggaaggacggtagtatacggacgagtaccagtctctacgaaccggtacgtccggggacctaaacgggtaccctcgggttacccacgttccgttcctacggacctccctaaccgaaccgacggaccttaccgtcccggttcccgttccccgtacggcccttacccgtacccgtaaccgtaagaccgtaccgtacccggttacgggaccggggtacctaaccggcccggtcccggggttaccccgtcggggtaccttaccgggcccgtttaacggaccggtaaaaccggttccctttaccgtaccttacttaccgtaactaccttaccggaggtacccggtacggccggttacggtaccggtacgtacggtacttacgagg

SEQ ID NO: 79349 - DNA, 710 bp, Homo sapiens
  misc_feature: GYAE6OF02I50I6.37.26.C04.1.454.CMB.1.raw
  modified_base (212)..(212): a, c, t, g, unknown or other
  misc_feature (212)..(212): n is a, c, g, or t
  modified_base (236)..(236): a, c, t, g, unknown or other
  misc_feature (236)..(236): n is a, c, g, or t
  modified_base (322)..(322): a, c, t, g, unknown or other
  misc_feature (322)..(322): n is a, c, g, or t
  modified_base (341)..(341): a, c, t, g, unknown or other
  misc_feature (341)..(341): n is a, c, g, or t
  modified_base (348)..(348): a, c, t, g, unknown or other
  misc_feature (348)..(348): n is a, c, g, or t
  modified_base (354)..(354): a, c, t, g, unknown or other
  misc_feature (354)..(354): n is a, c, g, or t
  modified_base (360)..(360): a, c, t, g, unknown or other
  misc_feature (360)..(360): n is a, c, g, or t
  modified_base (363)..(363): a, c, t, g, unknown or other
  misc_feature (363)..(363): n is a, c, g, or t
  modified_base (368)..(368): a, c, t, g, unknown or other
  misc_feature (368)..(368): n is a, c, g, or t
  modified_base (388)..(388): a, c, t, g, unknown or other
  misc_feature (388)..(388): n is a, c, g, or t
  modified_base (392)..(392): a, c, t, g, unknown or other
  misc_feature (392)..(392): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccgaggggaagggctggagtgggtctcagggtattacgtgggtagtgggtaaactccggnactacgtacgcgacgacttccggnggacgggggtcccggtttacaccggttctccaaggacgaccaatttaccaagaacgtaccggtctatactacgggaaatcgaaacngtcctgagagccgaggacncggcctntatcgngtcganagngtacncgaagcgtagtataggcagngacnctgctaacgtcggtcggcccaacggaccctgcctaccggtctacctgacctccctcccgaaccgaccggtacccgtacgtacccgttccgttccccgtcgacccttacccgtaccctaccgaacgggtcctaccgacccgttcgggtccggggactaaccggaccgggtcccggtacccggcgggttcccgaccggttccggtaacggtacggttaaccgggtacctttaccgttaccctacttacccgtaacccggtaaccttacggtcggaacggtcggggtacgtcgggaccgtaccggacgacggtactaacgg

SEQ ID NO: 79350 - DNA, 695 bp, Homo sapiens
  misc_feature: GYAE6OF02JDKR6.37.26.C04.1.454.CMB.1.raw
tcagtagtgtagatcacgaccggtgctcgatttagtctagcgactttgggtttggggggaggcttggtacagcctggggggtccctgagactctcctgtgcagcctctggattcaactttggtagctattggatggactgggtccgccagtctccagggaagggctggagtgggtggccaacatacagggaggtggtggtacgaaaaactatgtggactcgtgtgcgggccgattcaccatctccagagacaacgaccaaaaactcactgtactctgacaaagtcggacgcctgagatccgaggacacggtctacgtaggtacttagttaggtcgacgaaggtacgtatttacggaacttaacgtaaagtttcgaggtagtaactggtaataggacttcgtacttagtagtacgtaccggtaggggtaaccgaaacgggtaaccacgttacggtccaccgttactaccttcgactacccgtacccgtaaccgaaccgggtccctacggttacccggttccccttccccggtcggtacccgtcccgtccgtaccgtacccggtaacggaccggtaccctacccgttacccggaacgaccggtaccaaccgtacggtcccgaccgtacggtacctcgtaccgtcggtaacaaccggtctacctacgactacctactaccgtactggacgtcggtacg

SEQ ID NO: 79351 - DNA, 648 bp, Homo sapiens
  misc_feature: GYAE6OF02GNNFN.37.26.C04.1.454.CMB.1.raw
  modified_base (348)..(348): a, c, t, g, unknown or other
  misc_feature (348)..(348): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtgggtctcaggtattacgtggtagtggtaataccgcatactacgcagactccgtgacgggccggttcaccgtctccagagacaattccaagaatacggtctatctggaaatgaacagcctgagacgccgaggacaccggccctctattactgtcgcgagagatcagacggatatagcngcagctctgactacgtcgggccaacggacctgggtaccaccgtcctccctcacgccctaccgacccgtaacgggccccagttcccggtcccttccccgtccgggtacccctaccccgtaccctacccgtaaacgggccgtaacctcccgttacggtccgggggaccaaccggaccggtcccgggcccgtcggggccgttccggccgttacggtaccgaaacgggtccttaccttccgtaccttaccgtaacctacgttacgtcggacggccgggtcgtacggcggaacggcgcgtatcgg

SEQ ID NO: 79352 - DNA, 702 bp, Homo sapiens
  misc_feature: GYAE6OF02GQY9J.37.26.C04.1.454.CMB.1.raw
  modified_base (299)..(299): a, c, t, g, unknown or other
  misc_feature (299)..(299): n is a, c, g, or t
  modified_base (309)..(309): a, c, t, g, unknown or other
  misc_feature (309)..(309): n is a, c, g, or t
  modified_base (331)..(331): a, c, t, g, unknown or other
  misc_feature (331)..(331): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccgagggaaggggctggagtgggtctcaggtattacgtggtagtggtaactaccgcatactacgcagacctccgtgaccgggccgtcaccgtctccagagaacaattccaaagaatacggtctatctaggaaatgaaacagctgagngccgaggacncggcctactatactgtgacganagatcgaagacggagtatagcaagcagtcctgtcgactaggtcgggacaaccggtaccctgggtacctccgtacctccgtacaccggtacccttacccgaacccgaaacgggtaccccgtacgttaccccgggttcccttcccccgtacggtaccccgtaacccccgttcccgtaaccctaaacggtacgacccgtaacccgtaccggttcgggggtaaccaccgtaccggcccgggaccccgtcggggtaccgtccgtcccgttggtaaccgaaaccggttaacctaccgttaccctaacttaccgtaacctaaccttaaccgtacgaccgggtacggtacgtacggaacgaccggactacgtacgtaag

SEQ ID NO: 79353 - DNA, 722 bp, Homo sapiens
  misc_feature: GYAE6OF02H31DY.37.26.C04.1.454.CMB.1.raw
  modified_base (146)..(146): a, c, t, g, unknown or other
  misc_feature (146)..(146): n is a, c, g, or t
  modified_base (204)..(204): a, c, t, g, unknown or other
  misc_feature (204)..(204): n is a, c, g, or t
tcagtagtgtagatcacgaccggtgctcgatttagtctagcgactttgggtttgggggaggcttggtacagcctggggggtcctgagactctcctgtgcagcctcgtggttcattctttagcaactacgccatgagtctgggtccnccaggctccgaagggaaggggctaggagtgggtctagtaggttattaacgtggtaagnggtaaatccgcaatacgtacgcagtactccgtaggaccgggccgttcaccgttcacgaggagactaacttacgaaagtaagttaccggtctaagtcgtaggaaaactggaaacagccgtagagacggacgaggtacgaaccggtcctagtaattaccgtgtacgtacgagagtacacgaaggacgtataacgtagacagtacacgtctagtagactacggtcgggaaccaacggtaccgtggacctacgtacctcgacacgtaccctacgacgacggaccctacggttacccgtccgttacccgtacggccctacctccgaacctaagtacccgtacgtacccgttacgggacggggtaccaacggccgtaccggtaccgtcggaacctcggtacccgtacggtaaaccgtaaaccggtaccttaaccgttacccgtaaccgttacctaacgtaacctaggtaccgacgggttaccgggagtaccgggaaaccgtaccgggacgtacgtaagtaacgg

SEQ ID NO: 79354 - DNA, 918 bp, Homo sapiens
  misc_feature: GYAE6OF02F0X9I.37.26.C04.1.454.CMB.1.raw
  modified_base (214)..(214): a, c, t, g, unknown or other
  misc_feature (214)..(214): n is a, c, g, or t
tcagtagtgtagatcacgaccggtgctcgatttagtctagcgactttggggtttggggggaggcttggtacagcctggggggtccctgagactctcctgtgcagcctctggtttcatctttagcaactacgccatggagtcgtcgggtccgccaggcctccgaagggggaaggggtcgtagggaggtcgggtctacgtaagggttatttaccgngggttaggtaggttaaacgtaccgctaagtacgtacgcagtactccggtggaccgggtccggttccaccgtctaccgagacgtaacgtaacttaccgaagtaacgtcggtactaactacggttaaggaaatcgaacagcctaggaacgcgacggaagaccgtacccggtacccttattaacgttccgtagggtacgacggtaaaggaccgttacgtaccggaaagggaaccgggttaagtttaacgacggaccgtaaacggtacctaacgggttccttacgggtaacggaaccggtttacggggaaccggggtaaccccaacccgggtttaaacccgtcgggtaccctaacccgggttccctccgtaacgtacccggtcccctaaccgggaaccgtaccggaccccgtacgttcccgggttacccctcccggtacggcccctaaccccgtccgtaaccggaaaggtccctacggggttacccgtacggggtccgggtaacccaccgggttacccgggtacccggttacccggggttaccgggtcccggttacggaaccccgggggtttacgaaacccggggtaacccggttacctttaaccccgttccgtaaaccggttaaccctccgttaaaccgttccggtaacgggaccgggtaccggtacccggttaggaacccgtacggaccggtttaccaagggtccc

SEQ ID NO: 79355 - DNA, 558 bp, Homo sapiens
  misc_feature: GYAE6OF02FVTZI.37.26.C04.1.454.CMB.1.raw
  modified_base (463)..(463): a, c, t, g, unknown or other
  misc_feature (463)..(463): n is a, c, g, or t
  modified_base (547)..(547): a, c, t, g, unknown or other
  misc_feature (547)..(547): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtgggtctcaggtattactggtagtggtaataccgcatactacgcagactccgtgacgggccggttcaccgtctccagagacaattccaaagaacaccctgtctctgcaaatgaacaacctgagagccgaggacacggccctatattactgtacgaaaatggcctacggatatgactactattgggactggtacttcgatctcgtggggccgtggcaccctggtcactgtctcctcagcctccaccaagggccccagtcggtccttccccctggccgccctgcctccgaggtcncacctccgagcgcacgacgccggcccgttgggctcgcctggtccaggactacgttccattcctaacactacgtgacgcgggtcnggcgaggtccg

SEQ ID NO: 79356 - DNA, 739 bp, Homo sapiens
  misc_feature: GYAE6OF02GHZF7.37.26.C04.1.454.CMB.1.raw
  modified_base (295)..(295): a, c, t, g, unknown or other
  misc_feature (295)..(295): n is a, c, g, or t
  modified_base (303)..(303): a, c, t, g, unknown or other
  misc_feature (303)..(303): n is a, c, g, or t
  modified_base (376)..(376): a, c, t, g, unknown or other
  misc_feature (376)..(376): n is a, c, g, or t
tcagtagtgtagatcacgaccggtgctcgatttagtctagcgactttgggtttgggggaggcttggtacagcctgggggtccctgagactctccgtgtgcagcctctggttcatctttagcaactacgccatgagcgtgggtccgccaggctccgagggaagggctggagtgggtctcaggtattacgtggtagtggtaactaccgacatacctacgcagactccgtggaccgggtccgttcaccggtctccagagtacaattccaaagaatacggtctatctaggaaatgaacngctagagngccgaggaccaccggtcccttagtattacgtggcgacgtaaggacgtactcgaaaggtaccggtaagtttaanaccggcaagtacgacgttacctcgtaacgaccttaccgggccggggtacccaacccggtacctgggtcccctaacccgtcctacccgtacaccgtccccgtacccgaacccgtaacgggtacccctacgttcccggttaccccttccccggtacggtacccctaccccgttccctaaccgtaacggaccgtacccgtaccggtcggtacgggaccaacggtccggcccggtacccggtacggccgtccgtccggttccgaaaccgtaacgtaccgttacccgtacctaccgtaccgtaaccctaccgtaccggtaggaccggtacggcgtaccggtaacggaccggtaccgtacgtacgtcgg

SEQ ID NO: 79357 - DNA, 699 bp, Homo sapiens
  misc_feature: GYAE6OF02JTBI3.37.26.C04.1.454.CMB.1.raw
tcagtagtgtagatcacgaccggtgctcgatttagtctagcgactttgggtttgggggaggcttggtacagcctggggggtccctgagactctcctgtgcagcctctggttcatcttagcaactacgccatgagctgggtccgccaggctccgaggggaagggctggagtgggtctcgaggtattacgtgggtacgtggtaactccgcgatacgtacgcagactccgtaggacgggccgttcaccgtctaccagacgactaacttccaagtaacgttcggtactaagtccgtaggtaaatcgtaacgacgccgtaggacgacggaccgaggacgtaccggaccctcttaagttaccgtggtcggacgtaacggagacgtcgaacgggaccggtaaggtacgtagactacggactacggtcgtacgtaccgtaacgttacggcgggtaaccgaccgtaaccggtcgtacgcccgttctccgtcacgaccctaccgaaccgtaccgggacctacgtaccggttcccgttcccgtaccggtcccgtaacccgttccctaccgaacgtacgcgtacccgtcgggtcgggctacgccggtacccgggtccgtacggtccgtcgtccggtcgacgtaacgtacctacggtactacgtctaacgcttacggacgaccggtcgcggtacgacggaacgcgcagtacg

SEQ ID NO: 79358 - DNA, 753 bp, Homo sapiens
  misc_feature: GYAE6OF02I65M5.37.26.C04.1.454.CMB.1.raw
  modified_base (250)..(250): a, c, t, g, unknown or other
  misc_feature (250)..(250): n is a, c, g, or t
  modified_base (741)..(741): a, c, t, g, unknown or other
  misc_feature (741)..(741): n is a, c, g, or t
  modified_base (746)..(746): a, c, t, g, unknown or other
  misc_feature (746)..(746): n is a, c, g, or t
  modified_base (751)..(752): a, c, t, g, unknown or other
  misc_feature (751)..(752): n is a, c, g, or t
tcagtagtgtagatcacgaccggtgctcgatttagtctagcgactttgggtttgggggaggcttggtacagcctggggggtccctgagactctcctgtgccaacctctggattcagttgtagtgattgttggatgggttgggtccgccaggctcgagggagggctggagtgggtgccaacataaagcgagatggaagcgaagaaactctagtgtcggactgtggtggacggggccattccacctactccnccaacgacgaaccaaccgacaaagaaactcgtaattcctttttaggacaaagtacgaaacgtacgttaccgtagaaccgtagtaccggtacggaaccgaaccggcctatagttacttaaccgtacggtaaccgtaaggaacgaacgacggtaaccgtttccggggacgtaacggggtaaccccgttgggtacccgtaccgttcctacccggtccgaccctaacccgaacccggtaacgggaacccctacgttacccggttaccccgttcccccgtcggtacccgtccccgtcgacccgttacccgaacggtaccgaccctaccccgtacggaacgaccgaccgtacgaccggtcccggacccggttccggacgttccggaccgttacccgggtaacaaccggttaacctaccgttaccctacgtccctacgtaacccttacgtacggccggtacggtccgtacgtacgaccgggtcgactagatcgacganccganctcannc

SEQ ID NO: 79359 - DNA, 818 bp, Homo sapiens
  misc_feature: GYAE6OF02IUTJ2.37.26.C04.1.454.CMB.1.raw
  modified_base (208)..(208): a, c, t, g, unknown or other
  misc_feature (208)..(208): n is a, c, g, or t
  modified_base (250)..(250): a, c, t, g, unknown or other
  misc_feature (250)..(250): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagcgtgggtccgccaggcctccagggaagggctggagtgggtctcgaggtattacgtggtagtggtaataccgnatactacgcagactccgtgacggtccgttcaccgtctaccgngaacgtactaattccgaaagtaacgtacggttctagtaccgtaggaaattgaaactacgtcctaggaaggtacgccggaacggaaccaccgggtccccttacgtttaacgtttaacctgggttacgaccggaaggtaacgtagtccgaacggggttaccgggtaaggttaatacgggacccaaggtctaacgggtcctttaccgtaccggtaaaccgttaccgggttaccggggggaccccctaaaaccggggtaccccgttgggtaccctaaacccggttcccttaccccgtcgtaccgacccgttaccccgaacccgtaaccgggacccgtaccgtacccggttacccgtttcccccggtaccgtcccgtaccccgtccccgttaaccgaaccgtacgaccccgtacccgttccggtacggggtacccgaacgaccggacccgggtacccgtccgggtccgtacgtccggtacggtacgtaaccgtaccgtaccttaccgtaacttcccgtaactacctaacgtcgaaccggtccgggtacgtcggacgtaacggcgtacgactag

SEQ ID NO: 79360 - DNA, 735 bp, Homo sapiens
  misc_feature: GYAE6OF02G2BC4.37.26.C04.1.454.CMB.1.raw
  modified_base (257)..(257): a, c, t, g, unknown or other
  misc_feature (257)..(257): n is a, c, g, or t
  modified_base (279)..(279): a, c, t, g, unknown or other
  misc_feature (279)..(279): n is a, c, g, or t
  modified_base (297)..(297): a, c, t, g, unknown or other
  misc_feature (297)..(297): n is a, c, g, or t
  modified_base (325)..(325): a, c, t, g, unknown or other
  misc_feature (325)..(325): n is a, c, g, or t
  modified_base (332)..(332): a, c, t, g, unknown or other
  misc_feature (332)..(332): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccgagggaaggggtctgggagtgggtctcgaggtattacgtggtagtggtaactaccgctatactacgcagactccgtggacgggtccgttcaccgtctccaganaactattccaagtaatacggtntatctaggaaatgaaacngcctgagacgccgaggacacggtccctntattacngtgacgagacgatacgaggtaccggtagtacttaaggcaacggacagtcctcgtacgactaacggtcggggaccctaaccgggtaacccgttggtaccctaccgttccgtccgtacgtaccgaccccttacccgaaacccgtaacccggggtaaccccctaacggttccccgggtttaccccgtttacccccggtaccggtaccccgtaacccccgttccccgtaacccgaaaccggttaccgacccgtacccgttacgggtccggggaccaccggtacggcccggtacccggtcggtacgtcgtccgtacggtacgtacgtaccgtaccttacctacgtccgtaaccgttactacggtaccgacggtccggtacgtccgggaacgacggccgtacgactacg

SEQ ID NO: 79361 - DNA, 726 bp, Homo sapiens
  misc_feature: GYAE6OF02JU0TB.37.26.C04.1.454.CMB.1.raw
  modified_base (244)..(244): a, c, t, g, unknown or other
  misc_feature (244)..(244): n is a, c, g, or t
  modified_base (382)..(382): a, c, t, g, unknown or other
  misc_feature (382)..(382): n is a, c, g, or t
tcagtagtgtagatcacgaccggtgctcgatttagtctagcgacttttgggtttgggggaggcttggtacagcctggggggtccctgagactctcctgtgcagcctcttggtttcattctttagcaactacgccatgagctcgggtcccgccaggctccgaaggggaaggggtctggagtcgggtctcgaggttattacgtgggttagttaggtaactaccgcattacctacgcagactccggnggtaccggggtccgttcaccgttctccgagaagacctaataccaagaacttacggtctatcgtagaaatcgaacagctagacgacgacccgaggaccaccggtccctacgttatttacctggtacggaccgaaggaanacctcggaaggtaccgggtaattaaggtaaccggaccaaggaccgtcgtaacttcgtaacgtaaccggtaacgtccggggaaccccggtaacggtaacccgtcggggtaaccccaccgttccgttcccgtaacgacccgtccctacccgaacgacccgggtccgtaccgtccgtacccgttcccgtcgacccgtcccctaacctctaaacgccgccgacccgtcgccgggtaccacggaccgtccggccggtacggtctcggtccgtcgacgtaaccgtacgtacctcgacctactaaccgtactacgtcggacggcggtcggtacggacgtacgctcgatacg

SEQ ID NO: 79362 - DNA, 815 bp, Homo sapiens
  misc_feature: GYAE6OF02GXC1Y.37.26.C04.1.454.CMB.1.raw
  modified_base (386)..(386): a, c, t, g, unknown or other
  misc_feature (386)..(386): n is a, c, g, or t
  modified_base (809)..(809): a, c, t, g, unknown or other
  misc_feature (809)..(809): n is a, c, g, or t
tcagtagtgtagatcacgaccggtgctcgatttagtctagcgactttgggtttgggggaggcttggtacagcctggggggtccctgagactctcctgtgcagcctctggtttcattctttagcaacgtcgccatgagcgtcgggtccgccaggcctccgaagggggaaggggctgggaggtcgggtcctcgtaaggttattacgtgggtagtaggtaaactaccggcaatacgtacgcacgacctcggtcggacggggtcccgtttacacccgttcctaccgagacgaacctaattccgaaagtaacgtcggtctatcgtaggaaatcgaaacagccgtaggagacggccggaacggacacccggtccctatttacgttacgtggngacgaaggtgatcgaaggtacggtaatggtacgcacgtacgacgtctccgtagaaccggtacggtcggggaccccgtaaacccggtaccgtttcggggacccttaccccgtccttaccgtaccgaccgtacccctacccgaaacccgggaaccggtccccgttacggtacccccggttccccgttcccccgaccggtccccttaccccgtacccgttaacccgaacggtacccgaccgttacccggttcgggacccggcgaaccggtcccgggtcccggtccggggtcggcccgttaaccggtcccgtaaccgggttacaaaccggttcctttaacccgtccttaaccggttaccctaacgtaccttaccgggtaggacccgggtacggtaccggtcggggtaacccgacgggtccctaacgnggttcc

SEQ ID NO: 79363 - DNA, 644 bp, Homo sapiens
  misc_feature: GYAE6OF02I4J8L.37.26.C04.1.454.CMB.1.raw
  modified_base (211)..(211): a, c, t, g, unknown or other
  misc_feature (211)..(211): n is a, c, g, or t
  modified_base (220)..(220): a, c, t, g, unknown or other
  misc_feature (220)..(220): n is a, c, g, or t
  modified_base (254)..(254): a, c, t, g, unknown or other
  misc_feature (254)..(254): n is a, c, g, or t
  modified_base (354)..(354): a, c, t, g, unknown or other
  misc_feature (354)..(354): n is a, c, g, or t
  modified_base (593)..(593): a, c, t, g, unknown or other
  misc_feature (593)..(593): n is a, c, g, or t
  modified_base (642)..(642): a, c, t, g, unknown or other
  misc_feature (642)..(642): n is a, c, g, or t
tcagtagtgtagatcacgaccggtgctcgatttagtctagcgactttgggtttgggggaggcttggtacagcctggggggtccctgagactctcctgtgcagcctctggtttcatctttagctaactacgccatgagcgtgggtccgccaggcctccgagggaagggctggagtgggtctcaggtatttacgtaggtagtagtaataccgnatactacgnagactcgtgacgggtccgttcaccgtctccaganacaatccaagaatacgtctatctaggaaatgaacagcctgagacgcgagacgccgccctatattactggtgacgacggatatcgaaggacggtagttaancgccaagcgaacgcgtttacgtacgaacgttacggtcgggacccaaaccggtaccgtgtaccctccggtaccttccgtaaccgcgtaccctacccgaaccgtaccggaccctacgtcccgttacccgttccccgacgccctaccccgtccgtaaccgaacgcgtacctcccgttacgggacgggaccaccgcggtacccggtccggtgccgtccgcgttcgcgaacgtaccttctaccnctacctaatccgtataggtaccggacgtcgtacggctacgggctacgancg

SEQ ID NO: 79364 - DNA, 736 bp, Homo sapiens
  misc_feature: GYAE6OF02H768J.37.26.C04.1.454.CMB.1.raw
  modified_base (214)..(214): a, c, t, g, unknown or other
  misc_feature (214)..(214): n is a, c, g, or t
  modified_base (233)..(233): a, c, t, g, unknown or other
  misc_feature (233)..(233): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagcgtgggtccgccaggctccgaggggaaggggcgtggaggtgggtctacgaggtatttacgtggtagtggtaactccgnatactacgcagacgtccgnggacgggtccgttacaccgtctaccgagacgaactaattccgaaagaagtaccggtctatcgtagaaatacgaacgagcctagagagaccgaggacacggccctatacttactggtacgacggagagatacgacgacggaagtatacgactgacgaggtcctaccgtagtaccgttacgccggggaacccgtaaccgggtaaacccgtcggttaccgaccccgggtttccctacccgtaccgaccgacccctaccgtaaacccggaacccgggtacccccgacggtttcccggtttacccccggtttcccctaccggaccccttacccccgtaccttaacccggacgtacgtacccgtaccgtcgggtacggggacccgtacgccggtaccggtccgtcgggtctaccggtcgttacggacgttaacgacttaccgtactaccgttacgactacccgtgtaaccggcggccggtacggttacggcggaacggcgtagtgtacg

SEQ ID NO: 79365 - DNA, 703 bp, Homo sapiens
  misc_feature: GYAE6OF02ITFLD.37.26.C04.1.454.CMB.1.raw
  modified_base (183)..(183): a, c, t, g, unknown or other
  misc_feature (183)..(183): n is a, c, g, or t
  modified_base (213)..(213): a, c, t, g, unknown or other
  misc_feature (213)..(213): n is a, c, g, or t
  modified_base (415)..(415): a, c, t, g, unknown or other
  misc_feature (415)..(415): n is a, c, g, or t
tcagtagtgtagatcacgaccggtgctcgatttagtctagcgactttgggtttgggggaggcttgggtacagcctggggggtccctgagactctcctgtgcagcctctggttcatctttagcaactacgccatgacgctgggtccgccaggctccgagggaagggctggagtgggtggccaanatacagggaggtggtggtaacgaaaaactntgtggactctggtgcgggggcctattccgaccatcctccgagacgaccaaccgtaccaaaaaactcactgtatcgtgacaagtcggaccgccgtagagacgtaccggaagtaccgcggtcttaggtagttagttagtggcggacggtagtagttagttaacgtaaccgttaagttaaggttcgaggtacgcgttaggtagtntagtcgtacgtttagtagtaacgtaccgggtacgggaaccggtaacggtcctacgttccggtacccgttaccggttccttaccgtaccgacccgtacccgtaacccgaaccggaccggtacccgtaccgttcccgttcccgttcccgtacgtcccgtccgtccgccgtaccgagtaccgcccgtacgtacgtacggacgaccgaccgcggccgtcggtcggtcgtcgtaccggtggaacgtacgtaccgtaccgtacgacgtacctactacgtacggtacggcgtcgg

SEQ ID NO: 79366 - DNA, 728 bp, Homo sapiens
  misc_feature: GYAE6OF02GFP6Q.37.26.C04.1.454.CMB.1.raw
  modified_base (286)..(286): a, c, t, g, unknown or other
  misc_feature (286)..(286): n is a, c, g, or t
  modified_base (340)..(340): a, c, t, g, unknown or other
  misc_feature (340)..(340): n is a, c, g, or t
  modified_base (348)..(348): a, c, t, g, unknown or other
  misc_feature (348)..(348): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccaatgacgcgtgggtccgcgaggcctccgaggggaaggggctggagtgggtctcgaggtattacgtggtagtggtaatccgcatactacgcagactccgtggacgggccgttcaccgtctccaggacgactaattccgaagtaattaccggtactntcgtaggaaaatcggaaacagcctaggacacggccgaaggacgaccggcccttntattacgnggtagcggaagtagactacgaaggacgtagttagacgacgagccgagtccgttcacggtaacgtccggtacggggacccacgggtaacccgtggtaccctaccggtccctacgtaccgaccgtccccgtaccgaacccgaacgggacccccgttacggttcccgggttccccttccccgtaaccgggtcccctacccccgtacccgtaacccggaaacgtcccgtaccctaccgtccggggtacgggactaccggacggcccggttaccggcggtcgtaccggtccgtacgtaaccggaacgttcctaccgttaccgcttaaccgtacgaccgttacgcggtacgggccggtacgtccggaacgtacggccgtagtgtcg

SEQ ID NO: 79367 - DNA, 844 bp, Homo sapiens
  misc_feature: GYAE6OF02JY1ZG.37.26.C04.1.454.CMB.1.raw
  modified_base (214)..(214): a, c, t, g, unknown or other
  misc_feature (214)..(214): n is a, c, g, or t
tcagtagtgtagatcacgaccggtgctcgatttagtctagcgacttttggggtttgggggaggcttggtacagcctgggggggtccctgagactctcctgtgcagcctctggtttcatctttagcaactacgccatgagctgggtccgaccaggctccgaggggaaggggctgggagtgggtctcaggttattacgtggtaggtgtaataccgnatactacgcagtactaccgtggaccgggccggttaccaccggtcctaccgaggaacgaacctaacgtttacccgaaagtaaacggtcggtttactaacgtcgtaagggaaaacttggaaacaggtccgtagggagacggaccgtacggaacgcccgggtcctacttaagtttacgtgggtaccgacggtaaggacggtactacggaacgggtaacgggtaaagtaccgaacgggaccacgggtacaggtcctaggttaccggaaacgggttaccggtacggggggaaccccacgggtttaaaccccgtcggggttaacccaacccgggttttcccgtcccgttaaccacccggtacccgtaccgtaacccggaaacccgggtacccgtacgttcccggttcccgttaccccggttaccggaccccttacccggttaccctaccggtaaacgaacggtccgtaacccgttccgggtcggggaccgtaaccggcgggtacccggtcccgggtacggttaccgtccggtccgttaccgggtccgtaaaacgttccttaccgtacgtactccgtaacgaaccgtttacggcgttacgggcggtaccgtacgggtaccgacggtcgagtaggacg

SEQ ID NO: 79368 - DNA, 757 bp, Homo sapiens
  misc_feature: GYAE6OF02JZW53.37.26.C04.1.454.CMB.1.raw
  modified_base (187)..(187): a, c, t, g, unknown or other
  misc_feature (187)..(187): n is a, c, g, or t
  modified_base (211)..(211): a, c, t, g, unknown or other
  misc_feature (211)..(211): n is a, c, g, or t
  modified_base (356)..(356): a, c, t, g, unknown or other
  misc_feature (356)..(356): n is a, c, g, or t
  modified_base (369)..(369): a, c, t, g, unknown or other
  misc_feature (369)..(369): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactccgccatgacgcgtgggtccgccaggcctccgagggaacgggctggagtgggtctgaggtnttaacgtggtagtggtaataccgntaactacgtacgcaaggccttccggaggaccgggtccggttacaccggttctccgagagacaacgttccaaagaatacggttctagtacgcggtaaacgtagaactagccgtgaacggacgccggaggaaccgacggtacccgtnttaaccgttacgnggttacgaccggtagaagacgttacgacgaacggtagacgtaggacaggacacgtcgttacgcgaacgttaccggtacgggaccctaaccggtaaccgtcgggtaccgacccgttccgtacctcgtaaccgcccgtaaccgaaccgaaccgggtaacccgtacgtacccgttacccgttacccgtccggacccctccctacccgtacctaaacccggacggttacctacccggtaccggtacgggaccctaacggacggcccgtacccgggacggttcccgtaccgtaccgtccggtaaccggaaacgtaccctaccgttccctaaccgtacgtaacccgttataccggtacgcggaccggtcgtccggagacgtccgacgtataccg

SEQ ID NO: 79369 - DNA, 892 bp, Homo sapiens
  misc_feature: GYAE6OF02JD8OR.37.26.C04.1.454.CMB.1.raw
  modified_base (324)..(324): a, c, t, g, unknown or other
  misc_feature (324)..(324): n is a, c, g, or t
tcagtagtgtagatcacgaccggtgctcgatttagtctagcgactttgggtttggggaggccttaggtacagcctggggggtccctgagactctcctgtgcagcctctggtttcatctttagcaactacgccatcgagctgggtaccgccaggctaccgagggaaggggctggagtgggtcctgaggttattacgtggtagtggtaactaccgcatactacgcagactccgtaggccgggtccggttcacccggttctccgaagacggaacctaactttccaaaaggtaacgtaccgggtctactcggttaggaaactgaaacncgtccgtaggaacgacggccggaaggtaccgaccggtcccttacgttaagttaccgtggtcggacgaggacacgttcggaaggtacggtaagttacgacgtaccgagccgtacgcctttaccgaacggttaaccttacggggtaccggggaccccaacccgggttacccgttacggtacccgtaaacccgtttccccgttaactaccccggaccgttccccgtaacccgaaccccggtaaacccgggtaccccgtaacccggtttcccggtttacccccgttccccgttaccgggtaccccttaccccgttcccttaaccggaaacgtacccgtacccggttaaccccggtccgggttacccgggggacccaaccgggtccgggtaccccgggttccgggtccgggttcccgttacccgggtacccgggttaccggtcccggtaaacccgggttaccggttttaccccgttaccttaccgtttccgtaaacccgttacgtacccggttcggacgggtacccgggtacgggttacccggaccggaccgggacccgtttacgaacgtcgg

SEQ ID NO: 79370 - DNA, 811 bp, Homo sapiens
  misc_feature: GYAE6OF02GJ9TV.37.26.C04.1.454.CMB.1.raw
  modified_base (346)..(346): a, c, t, g, unknown or other
  misc_feature (346)..(346): n is a, c, g, or t
tcagtagtgtagatcacgaccggtgctcgatttagtctagcgacttttgggtttgggggaggcttggtacagcctgggggggtccctgagactctcctgtgcagcctctggtttcatctttagcaactacgccatgagcgtgggtccgccaggctccgaggggaaggggctgggagtgggtctcaggtattactgggtagtaggtaaactaccgcatactacgcaagactccgtggacgggtccgttcaaccgtctccagagacaattccaaagtaatacggtctagtcgtaggaaatagaaacacggacctaggaagacggccgaagggaaccaccggtcccctnttaacgttaccgtggaggaccgaagaagtactcgaagggtaacggaagtatacggcgaagtacgacgtccttacgtacggtaacctaacgggtacgggggacccctaaaaccggggttaaccccttgggtaaccccgtaacccgttccgttacccctaccgaaccgtccccgtaacccgaaacccggtaaacccgggtaccccgtaacggtttacccgggttcccctttacccccggtaccggacccctacccccttacccgtaccgaaacggtacgaccgtaacccgtcgggtacggggaccaaccggacggacccgggtcccggtcgggtaccgtaccgtaccggttacggtaacgtaaacggtaaccttaccttaccgtaactaccgtaacctaacgttaccggtacggtaaccgggtaccggtacggtacgggaaccggaacggtccgtaacgagtaacgg

SEQ ID NO: 79371 - DNA, 713 bp, Homo sapiens
  misc_feature: GYAE6OF02IKTQF.37.26.C04.1.454.CMB.1.raw
  modified_base (370)..(370): a, c, t, g, unknown or other
  misc_feature (370)..(370): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccagggaaggggctggagtgggtctcagcctattagagtagtggtggaagcacgtactacgctgactccgtgaacgggccgttcgccctctccagagaccaactccaaacaacacgtctgtcctctgacaaacttacacgcctagagagacgaggacaccggtctaatacttacgtgtacggacgaagggacgggtcagcaggtcgcccttggtaccncccaagttactagttaactgggacctttcggtagggggaacctaaaaaggtacgtccggccggttcccgtaacccgggtcctacccgtcgaccgtacccgtaccccgaaccgaaaccgggcccgtaacgttcccggttacccgtttccccccgtaccggtacccgtaccccgttacccctacccgaaacgtaccgtacccgtacccgtccgtcgggggacctaccggaacgcccgggcccgtcgggtccgtcggtcccgttacggtaccggtaccggtaccttaccgttcctacctacctaaccgtacctacgtcggacggtccggacgtcggacgaggaccg

SEQ ID NO: 79372 - DNA, 826 bp, Homo sapiens
  misc_feature: GYAE6OF02JUNYS.37.26.C04.1.454.CMB.1.raw
tcagtagtgtagatcacgaccggtgctcgatttagtctagcgactttgggtttgggggaggcttggtacagcctggggggtccctgagactctctgtgcagcctctggtttcattctttagcaactacgccatgagctgggtccgccaggctaccgaggggaaggggctgggagtgggtctacaggttattacgtgggtagtcggtaatccgcatactacgcagacctccggtggaccgggtccgttacgacgtcctccgagacgactaacttccaaagaactacgactgtctctagacaaatacgaactacgccgtgacggtaggtacgacggacctaccgggtaccttaagtacttaacgtggttggtacggaacgggtacctcgtacgttccccgttaagtagtaccgaacggtccggtccgttacggtacccgttagggttaccttaggccggtaaccggtcggggtaccgaacggggtaacccgttcggtaccgtacccggtcctaccgtacgtaccgtcccgtacccgtaaccgaaccggggtaccctcggttaccggttaccccgttccccggtaccggtacccggtcccgttaccggtcccgttaacccggtaacgggtcccgtacctacccccggttaccggacggttaccgacccgtaccgggtacccggaccggtcccgggtacggtccgttacggtacccggttcggacggtaaccggttaccgttaccgttacctaccgttaacccttaacccgtaaccggttacggaccggttaccgggtacccgggtcggtaccggtaccgggtaaccggg

SEQ ID NO: 79373 - DNA, 771 bp, Homo sapiens
  misc_feature: GYAE6OF02IP4AI.37.26.C04.1.454.CMB.1.raw
  modified_base (736)..(736): a, c, t, g, unknown or other
  misc_feature (736)..(736): n is a, c, g, or t
  modified_base (768)..(768): a, c, t, g, unknown or other
  misc_feature (768)..(768): n is a, c, g, or t
tcagtagtgtagatcacgaccggtgctcgatttagtctagcgactttgggtttggggggagggcttggtacagcctgggggggtccctgagactctcctgtgcagccctctggtttcatctttagcaactacgccatgagcgtgggtccgccaggctccgaggggaaggggctggagtgggtcttcgaagggtattacgtggtagtggtaataccgcatacctagcgacggactccggtaggaccggggccggttacaccgtctccagagaactaattaccaaagtaatacggtactacgtcgtaggaaatagaaacaggtaccctggaaacgaccggaccggagggtaaaccaccgggtacccctttaccttaaaacgtttccggttaaggtcgggtaccggaaagtagtaagttaccgaacgggaacgggttaaggtaataagaccgtggaaccgtagcctacgtacggtaaccgttacggccggggtaacccgaaccggtaaaccccgtttagggacccgttacccggttactcccgtacaccggtaccctcccgaacccggaacgggccccgtaacgtacccggtcccctttaccccgtacccgggcctacccccgtacccgtacctaagaccgaccgtacccgtcgggtcgggacaaccgtgacccggtccggtcgggtctccggaccgttcggaaccgtaacgtaccttactccgaactctacactacgngtacgggcggtcgtagggaccacggcgtactntag

SEQ ID NO: 79374 - DNA, 757 bp, Homo sapiens
  misc_feature: GYAE6OF02F84IN.37.26.C04.1.454.CMB.1.raw
  modified_base (342)..(342): a, c, t, g, unknown or other
  misc_feature (342)..(342): n is a, c, g, or t
  modified_base (447)..(447): a, c, t, g, unknown or other
  misc_feature (447)..(447): n is a, c, g, or t
tcagtagtgtagatcacgaccggtgctcgatttagtctagcgactttgggtttgggggaggcttggtacagcctggggggtccctgagactctcctgtgcagcctctggtttcattctttagcaaactacgccatgagcgtcgggtccgccaggctccgaggggaagggctgggagtgggtctcgaggttattacgtggtagtaggtaaactaccgctaattacctacgcaacgtaccgttccggtcggaccggggtcccgtttccaacccgtctaccgaagacgaactaacgttacccaaaggaacttaccggtctaagttcgaaggtaaaatcgaaaccncgaccgtagacggacgtaccggaaggacctaccgggtcccttacttaattaccgttggcggacgtaggagataccgaaggacggtatacgtgccaagcagtcctnacggtacttacgggcgggtaacccgaacggtccgtcggtaacctacccgtccctcgaccgcctaccctacccgaaccgaacggtcccctacggttcccggttaccccttcccgcgtacccaccccttccaaccggacgaccgtaccgacccggtcgggaccgggtacacggtaccgggccgtcccggtacggtccggtcgtaccgggttaccgaacggttaaccgtaccttaccgtacctacgttaccgtaactacgtaccggtacggacgggtacggtcgaccggtaacggacggtccctagtacgtag

SEQ ID NO: 79375 - DNA, 900 bp, Homo sapiens
  misc_feature: GYAE6OF02GCE0V.37.26.C04.1.454.CMB.1.raw
  modified_base (248)..(248): a, c, t, g, unknown or other
  misc_feature (248)..(248): n is a, c, g, or t
  modified_base (292)..(292): a, c, t, g, unknown or other
  misc_feature (292)..(292): n is a, c, g, or t
  modified_base (296)..(296): a, c, t, g, unknown or other
  misc_feature (296)..(296): n is a, c, g, or t
tcagtagtgtagatcacgaccggtgctcgatttagtctagcgactttgggtttgggggaggcttggtacagcctggggggtccctgagactctcctgtgcagcctctggtttcatctttagcaactacgccatgagctgggtccgccaggctccaggggaaggggctgggagtgggtctcagctattaagtgggaatgggtgataccacatactacgcagactccgtgaacgggtccgttcaccatcnccgagggacaattccaaagacacactgtctctgacaaatgaacngccngagagtcgaggacacggtccttatattacgtgtaggttagaaacgggtccttacgtaccggtaccccttaagtacgacacgggtcggtcgttcgggtcccgttagggttaccttttacggggaacggtaccgggttacgggggggaaccccgtaaacggggggtaaacccccgttgggttaccccgtaaccccgtttaccggttcccccgttaaccgtaccggtacccccttaccccgaaacccgggtaaacccggggtccccgtacgggttaccccgggttcccccgtttacccccccggttacggtacccccgtaccccccgttaccccgttaaccccggtaaaccggtacccggtaaccccgtacccggttccggggtaccggggggtaccccaaccgggtacccggggaccccggggttccccgggttaccggggtccccggttaccgggttaccccggtttacggggttaacccggtaaccgggttaacccgttttaacccgtttacccgttaactttaaccccgttaaccgttaacccgttaacggttaccgggtaccgggtacccggggacggttaccgggaccggtaacccggggg

SEQ ID NO: 79376 - DNA, 546 bp, Homo sapiens
  misc_feature: GYAE6OF01EIIU9.14.11.A11.1.454.CMB.1.raw
  modified_base (415)..(415): a, c, t, g, unknown or other
  misc_feature (415)..(415): n is a, c, g, or t
tcagcgtctagtaccacgaccggtgctcgatttagctacgactgcagggggcaggagtcagacccactcaggacacagcatggacatgagggtccccgctcagctcctggggctcctgctgctctggctcccaggtgccagatgtgccatccaagtgacccagtctccatccctccctgtctgcatctgtaggagacagagtcaccatccacttggccgggcaagtcagttcattagaaatgagttaggctggtatcagcaagaaaccgagggaaacgcccctaagctcctgatctatgctgcgtcaatttacaaacgtcgggtaccatcaaggttcagcggcagtggatctggcacagtatttcactctcaccatcagcagcctgcacgcctagaagtattttgactaactttntacttgtactaacaagtaacttaactaacttacccctacgtaaccgttcggaccgtaagggaacctaagggtacgaaagtacaaaaccggtacgtacggtacggtacctacggacctacctatcgttaccg

SEQ ID NO: 79377 - DNA, 189 bp, Homo sapiens
  misc_feature: GYAE6OF01D0ZVL.14.11.A11.1.454.CMB.1.raw
  modified_base (183)..(189): a, c, t, g, unknown or other
  misc_feature (183)..(189): n is a, c, g, or t
tcagcgtctagtaccacgaccggtgctcgatttagctacgactgcagggtgtccgttgggttttgggggaagaggaagactgacggtcccccaggagttcaggtgctgggcacagcggccctgggctgcctggtcaaggctacttccgtactagacgctgagcgggctggcaaggcgcatagnnnnnnn

SEQ ID NO: 79378 - DNA, 499 bp, Homo sapiens
  misc_feature: GYAE6OF01AL659.14.11.A11.1.454.CMB.1.raw
  modified_base (272)..(272): a, c, t, g, unknown or other
  misc_feature (272)..(272): n is a, c, g, or t
  modified_base (386)..(386): a, c, t, g, unknown or other
  misc_feature (386)..(386): n is a, c, g, or t
  modified_base (494)..(494): a, c, t, g, unknown or other
  misc_feature (494)..(494): n is a, c, g, or t
tcagcgtctagtaccacgaccggtgctcgatttagctacgactgcagggggcaggagtcagacccactcaggacacagcatggacatgagggtccccgctcagctcctggggctcctgctgctctggctcccaggtgccagatgtgccatccaagtgacccagtctccatcctccctgtctgcatctgtaggagacagagtcaccatcacttgccgggcaagtcagttcattagaaatgagttaggctggtatcagcagaaaccagggaaancccctaagctcctgatctatgctgcgtccaatttacaaactgggtcccatcaagttcagcggcagtgatctggcacagatttcactctcacatcagcagctgcagcctgaagtnttttgactaacttattactcgtctactaagtattaacaacttaccctcgaaccgttcggaccaagggaccaagggtggaagtacgaaacgactgtcgactgacacctntctcg

SEQ ID NO: 79379 - DNA, 186 bp, Homo sapiens
  misc_feature: GYAE6OF01D2NLX.14.11.A11.1.454.CMB.1.raw
  modified_base (184)..(186): a, c, t, g, unknown or other
  misc_feature (184)..(186): n is a, c, g, or t
tcagcgtctagtaccacgaccggtgctcgatttagctacgactgcagggtgtccttgggttttgggggaagaggaagactgactgtccccccaggagttcaggtgctgggcacagcggccctgggctgcctggtcaaggactacttccgtactagacgctgagcgggctggcaaggcgcatagnnn

SEQ ID NO: 79380 - DNA, 549 bp, Homo sapiens
  misc_feature: GYAE6OF01B7A1B.14.11.A11.1.454.CMB.1.raw
tcagcgtctagtaccacgaccggtgctcgatttagctacgactgcagggggcaggagtcagacccactcaggacacagcatggacatgagggtccccgctcagctcctggggctcctgctgctctggctcccaggtgccagatgtgccatccaagtgacccagtctccatcctccctgtctgcatctgtaggagacagagtcaccatcacttgccgggcaagtcagttcattagaaatgagttaggctggtatcagcagaaaccagggaaagcccctaagctcctgatctatgctgcgtccaaatttacaaacgtcggggtacccatcaaggttcaggcgcagtggatctggcacagatttcactctcaccatcagcagcctgcagcctagaagtatttgactaacttattactgtactacaagtacttaactaactttaccctacgtaaccgtttcggaccgtaaagggaacccgtaaagggtacggaaagttaccgaaaacggtaccgtaggttacggtaccttacggacctacccagttcgttacg

SEQ ID NO: 79381 - DNA, 834 bp, Homo sapiens
  misc_feature: GYAE6OF01BY40X.14.11.A11.1.454.CMB.1.raw
  modified_base (183)..(183): a, c, t, g, unknown or other
  misc_feature (183)..(183): n is a, c, g, or t
tcagcgtctagtaccacgaccggtgctcgatttagctacgactgcgagggggcaggagtcagacccactcaggacacagcatggacatgagggtccccgctcagctccgtggggctcctgctgctcgtggctcccaggtgccagatgtgccatccaagtgacccagtctccatccctcccttntcgcactctcgtaggaggacacgagtactaccaactactaccgttacgtccgggaccggaacgtacgtacgtacgttattaaagttaaagtaagttaggttaacggttacggtcgttaggtacacgacgaacgaaaaccggaaacggaacgggaacccctacccgtacgtccctacgtatatactagtcgtcgtaccgtacctaacttaaacgttaaccgtaacgggtccggtactacgtaacggttacgtacgacgggacgtacgtaggtacgtacgtcggacgtacctaagttactttacctacctaccgttaccaccctaagtacgaccgacgtaacgtcccgtaccgaggaaccgtaccgttacgttaaagggttacctttttacggttacaaacctttttaagttttaccgtacgttaaccgttaaacaaacggttaacttttaaaacccttaacccgttttaacccgttaccccggtaaacggggtttaaccccgggttaacccccgggaaaagggttaaacccccggggttaaaagagggggttaaaaccggttaaaacccgaaaacccggtaaaccgggtttgtaccggggcggttaaacccaccggtaaccccccttaagttcggttttcccttaaccccgg

SEQ ID NO: 79382 - DNA, 512 bp, Homo sapiens
  misc_feature: GYAE6OF01ECUU2.14.11.A11.1.454.CMB.1.raw
  modified_base (505)..(505): a, c, t, g, unknown or other
  misc_feature (505)..(505): n is a, c, g, or t
tcagcgtctagtaccacgaccggtgctcgatttagctacgactgcagggggcaggagtcagacccactcaggacacagcatggacatgagggtccccgctcagctcctggggctcctgctgctctggctcccaggtgccagatgtgccatccaagtgacccagtctccatcctccctgtctgcatctgtaggagacagagtcaccatcacttgccgggcaagtcagttcattagaaatgagttaggctggtatcagcagaaaccagggaaagccctaagctcctgatctatgctgcgtccaatttacaaactgggtcccatcaaggttcagcgcagtgatcgtgcacagtattcactctcaccatcagcagcctgcagcctagaacgtatttgactaacttattactgtactacaagtattacaacttaccctacgtaacgttcggaccgaagggaccaagggtcggaagtacgaaacggaactgtacggtctacgaccaccgtntcgttcg

SEQ ID NO: 79383 - DNA, 523 bp, Homo sapiens
  misc_feature: GYAE6OF01ENAFP.14.11.A11.1.454.CMB.1.raw
  modified_base (220)..(220): a, c, t, g, unknown or other
  misc_feature (220)..(220): n is a, c, g, or t
  modified_base (338)..(338): a, c, t, g, unknown or other
  misc_feature (338)..(338): n is a, c, g, or t
  modified_base (352)..(352): a, c, t, g, unknown or other
  misc_feature (352)..(352): n is a, c, g, or t
tcagcgtctagtaccacgaccggtgctcgatttagctacgactgcaggggggcaggagtcagacccactcaggacacagcatggacatgagggtccccgctcagctcctggggctcctgctgctctggctcccaggtgccagatgtgccatccaagtgacccagtctccatcctccctgtctgcatctgtaggagacagagtcaccatcacttgccgggnaagtcagttcattagaaatgagttaggctggtatcagcagaaaccagggaaacgcccctaagctcctgatctatgctgcgtacaatttacaaacgtgggtcccatcaaggttcagcgnagtggatctggcanagtattcactctcaccatcagcagcctgcacgcctagaagtattttgactaacttattactgtactacaagtattacctaacttacccgtacgtaacggttcgaccgaaagggaccgtaagggtacggtaagtacaaaccgtaacgtgtcggctagaccactatcgttacg

SEQ ID NO: 79384 - DNA, 587 bp, Homo sapiens
  misc_feature: GYAE6OF01B4ODZ.14.11.A11.1.454.CMB.1.raw
  modified_base (194)..(194): a, c, t, g, unknown or other
  misc_feature (194)..(194): n is a, c, g, or t
  modified_base (219)..(219): a, c, t, g, unknown or other
  misc_feature (219)..(219): n is a, c, g, or t
tcagcgtctagtaccacgaccggtgctcgatttagctacgactgcagggggcaggagtcagacccactcaggacacagcatggacatgagggtccccgctcagctcctggggctcctgctgctctggctcccaggtgccagatgtgccatccaagtgacccagtctccatcctccctgtctgcatctgtagganacagagtcaccatcacttgccgggnaagtcagttcattagaaatgagttaggctggtatcagcaagaaaccgagggaaacgcccctaagctcctgatctatgctgcgtaccaatttaaccaaacgtcgggtaccagtactaaggttcaggcggacgtagtggtatcgtcggactaagacgtattacacttctcactactcagcacgcctagcacgtccgtagaacgttattttacgacttaactttactttactacgttacctaacgaagttaacttaacctaactttacccgtaccgtaaccggtttaccggaaccgtaaacgggtaaccgtaagggtaaggtaaacgtaacgaaaccgtacgtagtcggactacgaccacctattcgtacg

SEQ ID NO: 79385 - DNA, 515 bp, Homo sapiens
  misc_feature: GYAE6OF01BC5SY.14.11.A11.1.454.CMB.1.raw
  modified_base (350)..(350): a, c, t, g, unknown or other
  misc_feature (350)..(350): n is a, c, g, or t
tcagcgtctagtaccacgaccggtgctcgatttagctacgactgcagggggcaggagtcagacccactcaggacacagcatggacatgagggtccccgctcagctcctgggactcctgctgctctggctcccaggtgccagatgtgccatccaagtgacccagtctccatcctccctgtctgcatctgtaggagacagagtcaccatcacttgccgggcaagtcagttcattagaaatgagttaggctggtatcagcagaaaccagggaaagcccctaagctcctgatctatgctgcgtccaatttacaaactgggtcccatcaaggttcagcggcagtggatctggcanagtatttcactctcaccatcagcagcctgccagcctgaagtatttgactacttattactgtactacaagtattactaacttaccctacgtaacgttcggaccgtaagggaaccgtaaagggtggaacgtacaaacggaactaggtggtctagcacctatcgttcg

SEQ ID NO: 79386 - DNA, 534 bp, Homo sapiens
  misc_feature: GYAE6OF01BJA1T.14.11.A11.1.454.CMB.1.raw
  modified_base (335)..(335): a, c, t, g, unknown or other
  misc_feature (335)..(335): n is a, c, g, or t
tcagcgtctagtaccacgaccggtgctcgatttagctacgactgcagggggcaggagtcagacccactcaggacacagcatggacatgagggtccccgctcagctcctggggctcctgctgctctggctcccaggtgccagatgtgccatccaagtgacccagtctccatcctccctgtctgcatctgtaggagacagagtcaccatcacttgccgggcaagtcagttcattagaaatgagttaggctggtatcagcagaaaccaggaaacgccctaagctcctgatctatgctgcgtccaatttacaaactgggtcccatcaaggttcagcggnagtggatcgtgcacagatttcactctcaccatcagcacgcctgcagcctagagtatttgactaacttattactgtactaacaagtattaactaacttaccctacgtaaccgttaccggaccgtaaagggaccctaaagggtacgggtaaacgtacgaaaacgaacgtggtaacggctacggacctacctacttcgtacg

SEQ ID NO: 79387 - DNA, 563 bp, Homo sapiens
  misc_feature: GYAE6OF01A20F4.14.11.A11.1.454.CMB.1.raw
tcagcgtctagtaccacgaccggtgctcgatttagctacgactgcagggggcaggagtcagacccactcaggacacagcatggacatgagggtccccgctcagctcctggggctcctgctgctctggctcccaggtgccagatgtgccatccaagtgacccagtctccatcctccctgtctgcatctgtaggagacagagtcaccatcacttgccgggcaagtcagttcattagaaatgagttaggctggtatcagcagaaaccagggaaagcccctaagctcctgatctatgctgcgtccaatttacaaactgggtccatcaaggttcaggcgcagtggatcgtggcacagtatttcactctacaccatcagcagcctgaccagtccgtagtaagttattttacgacttaactttattacttacgtacttaacgaagtactttaactaactttaccctacgtaaccggttccggaccgaaacgggtaccgtaaagggtacgggaagttaccgaaaacggtaactagggttacggaccgtacgacccactagttccgttaccg

SEQ ID NO: 79388 - DNA, 528 bp, Homo sapiens
  misc_feature: GYAE6OF01CYTFJ.14.11.A11.1.454.CMB.1.raw
  modified_base (273)..(273): a, c, t, g, unknown or other
  misc_feature (273)..(273): n is a, c, g, or t
  modified_base (394)..(394): a, c, t, g, unknown or other
  misc_feature (394)..(394): n is a, c, g, or t
tcagcgtctagtaccacgaccggtgctcgatttagctacgactgcagggggcaggagtcagacccactcaggacacagcatggacatgagggtccccgctcagctcctggggctcctgctgctctggctcccaggtgccagatgtgccatccaagtgacccagtctccatcctccctgtctgcatctgtaggagacagagtcaccatcacttgccgggcaagtcagttcattagaaatgagttaggctggtatcagcaagaaaccagggaacnccctaagctctgatctatgctgcgtccaatttacaaactcggggtccatcaaggttcagcggcagtggatctggcacgagtatttcactctacaccatcagcagcctgcagcctagaagtnttttagactaactttattactagtactacgtaagtacttaactaacttaccctcgtaaccggttccggaccgaagggtaccaagggtacggtaacgtacgaaacgacgttgcggtactagacaactgtcttacg

SEQ ID NO: 79389 - DNA, 654 bp, Homo sapiens
  misc_feature: GYAE6OF01CKQEG.14.11.A11.1.454.CMB.1.raw
tcagcgtctagtaccacgaccggtgctcgatttagctacgactgcagggggcaggagtcagacccactcaggacacagcatggacatgagggtccccgctcagctccgtggggctcctgctgctctggctcccaggtgccagatgtgccatccaagtcgacccagtctccatccctccctgtctgcatctgtaggagacagagtccaccatcacgttcggccgggacaagtcagttcattaagaatgagttaggctggtatcagacaagaaaccgagggaaacgacccctaagcctcctagacttacctagtcgctcgtaccgttacctaaactttaacgaacgttcgggtaccctacgtacgtaaggttcgacggcggacgtaggtcgactcgtacggacacgtacgtacttcacttcctacacctatacacgcgtacgcctgaccacggtacctaggtaacgtttactttacgaaccttaactttacgttaccttaacgttacctaagtaaacgttaacttaaccttaaacctttacccgtaacggtaaccggttaccggtaacccggaaacgggtaaccgtaaacgggtacggaaacgttaccggtaaacgtacgttggtacgtactacgacctaacttacgtcgttaacg

SEQ ID NO: 79390 - DNA, 578 bp, Homo sapiens
  misc_feature: GYAE6OF01AYUPX.14.11.A11.1.454.CMB.1.raw
  modified_base (219)..(219): a, c, t, g, unknown or other
  misc_feature (219)..(219): n is a, c, g, or t
  modified_base (274)..(274): a, c, t, g, unknown or other
  misc_feature (274)..(274): n is a, c, g, or t
  modified_base (357)..(357): a, c, t, g, unknown or other
  misc_feature (357)..(357): n is a, c, g, or t
tcagcgtctagtaccacgaccggtgctcgatttagctacgactgcagggggcaggagtcagacccactcaggacacagcatggacatgagggtccccgctcagctcctggggctcctgctgctctggctcccaggtgccagatgtgccatccaagtgacccagtctccatcctccctgtctgcatctgtaggagacagagtcaccatcacttgccgggnaagtcagttcattagaaatgagttaggctggtatcagcagaaaccgagggaaacncccctaagctcctgatctatgctgcgtacctaatttacaaacgtcgggtacccagtacagttcagcggcagtgatcgtggcanagtattcacttcacacctatcgagcagcctgcagccgtagaagttattttcgacttaactttactttactcgttacgtaacaagttaacttaacctaactttaccccgtacgtaaccgtttccggacccggtaaacgggtaacccgtaaagggttaccgggaaagttaccgaaaccgtaacgttggtacggtacgtacggaccctaacctgttcgttaccg

SEQ ID NO: 79391 - DNA, 639 bp, Homo sapiens
  misc_feature: GYAE6OF01AMRT6.14.11.A11.1.454.CMB.1.raw
  modified_base (195)..(195): a, c, t, g, unknown or other
  misc_feature (195)..(195): n is a, c, g, or t
  modified_base (272)..(272): a, c, t, g, unknown or other
  misc_feature (272)..(272): n is a, c, g, or t
  modified_base (285)..(285): a, c, t, g, unknown or other
  misc_feature (285)..(285): n is a, c, g, or t
  modified_base (629)..(629): a, c, t, g, unknown or other
  misc_feature (629)..(629): n is a, c, g, or t
tcagcgtctagtaccacgaccggtgctcgatttagctacgactgcagggggcaggagtcagacccactcaggacacagcatggacatgagggtccccgctcagctcctggggctcctgctgctctggctcccaggtgccagatgtgccatccaagtgacccagtctccatcctccctgtcctgcatctgtagganacagatccaccatcacttggccggcaagtcagtcaattagaatgagtagctggtatcagacagaaccgagggaaacncccctaagctccngaactctatgctgcgttaccaaattacaaacgttcgggtacccatacgtaaacggttcgaacgccggtacgaaggttcggaacttcgtacggacaacgtagttaactttccaacttcctacaccgatcgagcctaacgtcctagcctacggtcctaggtaacttacttttacgacctttaactttacgttacttacggttaccttaacgtaattaaccttaacttaaccttacccgtaacggtaaccgtttaccgggaacccgtaaacgggtaaccgaaacgggttacggtaaacgtaccggtaaaaccgtaacgttcggttaaggtccttacgataacccgtntcgttacccg

SEQ ID NO: 79392 - DNA, 565 bp, Homo sapiens
  misc_feature: GYAE6OF01EXY49.14.11.A11.1.454.CMB.1.raw
  modified_base (224)..(224): a, c, t, g, unknown or other
  misc_feature (224)..(224): n is a, c, g, or t
  modified_base (349)..(349): a, c, t, g, unknown or other
  misc_feature (349)..(349): n is a, c, g, or t
tcagcgtctagtaccacgaccggtgctcgatttagctacgactgcagggggcaggagtcagacccactcaggacacagcatggacatgagggtccccgctcagctcctggggctcctgctgctctggctcccaggtgccagatgtgccatccaagtgacccagtcctccatccctcctgtctgctatctggtaggagacagagtcaccatcacgttggccgggnaagtcagtttcattaagaaatgagttaggctggtatcagcaagaaaccgagggaaacgccctaagctcctgactctatgctgctacctaattacaaacgtgggtaccctatcaaggttcagtcgngagtggatcgtggcaagagtactttcgacctctaccacatcagcacgctcgcagcctagagtatttgacttaacttattacgtcgtacctaactaagttaacttaaccgtaaacttaccccgtaacgtaaccggttcgaacccgtaaacgggaacgtaacgggtaggtaaactacggaaaacgtacgttgacggtactacgacacctagtcttacg

SEQ ID NO: 79393 - DNA, 537 bp, Homo sapiens
  misc_feature: GYAE6OF01D0QNE.14.11.A11.1.454.CMB.1.raw
  modified_base (529)..(529): a, c, t, g, unknown or other
  misc_feature (529)..(529): n is a, c, g, or t
tcagcgtctagtaccacgaccggtgctcgatttagctacgactgcagggggcaggagtcagacccactcaggacacagcatggacatgagggtccccgctcagctcctggggctcctgctgctctggctcccaggtgccagatgtgccatccaagtgacccagtctccatcctccctgtctgcatctgtaggagacagagtcaccatcacttgccgggcaagtcagttcattagaaatgagttaggctggtatcagcagaaaccagggaacgccctaagctcctgatctatgtctgcgtacctaatttacaaacgtcgggtaccatcaaggttcagcggcagtggatcgtggacacagtattcactctacaccatcagacagcctgcacgtctgaatagttttagcctaatttacttattcgttactaacgtaagtattaacctaacttacccgtaccgtaacgtcggaccgaaacgggacctaagggtagtaacgtacaacgaaacgtggtacggctacggacacctntcgttacg

SEQ ID NO: 79394 - DNA, 621 bp, Homo sapiens
  misc_feature: GYAE6OF01CNOWS.14.11.A11.1.454.CMB.1.raw
  modified_base (194)..(194): a, c, t, g, unknown or other
  misc_feature (194)..(194): n is a, c, g, or t
  modified_base (219)..(219): a, c, t, g, unknown or other
  misc_feature (219)..(219): n is a, c, g, or t
  modified_base (369)..(369): a, c, t, g, unknown or other
  misc_feature (369)..(369): n is a, c, g, or t
tcagcgtctagtaccacgaccggtgctcgatttagctacgactgcagggggcaggagtcagacccactcaggacacagcatggacatgagggtccccgctcagctcctggggctcctgctgctctggctcccaggtgccagatgtgccatccaagtgacccagtctccatcctccctgtctgcatctgtagganacagagtcaccatcacttgccgggnaagtcagttcattagaatgagttaggctggtatcagcaagaaaccgagggaaacgccctaagcctacctgactctatgctcgcgttacctaaactttaacgaaaccgtcggggtacccagtacaaggttcaggcggactaggtgactcgnggacaactaggtactttacacttcctaccaacctactaccagacctacgcccttaggaccagtccctaagtaacgttattttacgacttaactttacttacttcgttactaactaaagtaactttaacctaaacctttaacccgtacgtaaaccgttccggaacgtaaccgggaaccgtaagggtacggtaaggtaaccgtaaaccggtaacgtacggtacggtacgtacgaccaacctacgttcgttaccg

SEQ ID NO: 79395 - DNA, 669 bp, Homo sapiens
  misc_feature: GYAE6OF01EK899.14.11.A11.1.454.CMB.1.raw
  modified_base (199)..(199): a, c, t, g, unknown or other
  misc_feature (199)..(199): n is a, c, g, or t
tcagcgtctagtaccacgaccggtgctcgatttagctacgactgcagggggcaggagtcagacccactcaggacacagcatggacatgagggtccccgctcagctcctggggctcctgctgctctggctcccaggtgccagatgtgccatccaagtcgacccagtcctccatccctccctgtctgctatctggtagganacagacgtccaccatccacttcggccgggacaagtcagttcaagttagaaatgtagttaggctggtatcagacaacgaaaccgagggaaaccgcccctaaggcctacctgactctatgctgtcgtactaaatttacgaaaccgtcgggtacccaagtcgtaaggttcaggcggctaggtggactcgtacgactacgagtacttcacttcacaccatacgacgcacgcctagcctacgtctagtaagtttactttacgaactttaactttattacgttacgtaaccttaacgtaacgttactttaaacccttaacttaccccggttacggtaacccgggttcccgggaaaccgtaaaacgggggtaacccgttaaaggggttaaccggtaaaccgggttaaaccgtaaaacccgggtacgttagggaccggttacctaccgtacccgtaaaccgttgttccgtttaacccg

SEQ ID NO: 79396 - DNA, 554 bp, Homo sapiens
  misc_feature: GYAE6OF01DYZU0.14.11.A11.1.454.CMB.1.raw
  modified_base (276)..(276): a, c, t, g, unknown or other
  misc_feature (276)..(276): n is a, c, g, or t
  modified_base (447)..(447): a, c, t, g, unknown or other
  misc_feature (447)..(447): n is a, c, g, or t
  modified_base (544)..(544): a, c, t, g, unknown or other
  misc_feature (544)..(544): n is a, c, g, or t
tcagcgtctagtaccacgaccggtgctcgatttagctacgactgcagggggcaggagtcagacccactcaggacacagcatggacatgagggtccccgctcagctcctggggctcctgctgctctggctcccaggtgccagatgtgccatccaagtgacccagtctccatccctccctgtctgcatctgtaggagacagagtcaccatcacttgccgggcaagtcagttcattaagaaatgagttaggctggtatcagcaagaaaccagggaaacnccctaagcctcctagatctatcgctgcgttacctaaatttacgaaacgtcgggtacccatacgtaaggttcaggcggataggtggatcgtggacacgtagtactttacactctacacctatcagcagcctgcagcctagagttatttgacttaacttattactgtactaanaagtatttaacaacttaccctcggtaacgttccggaacaacgggactaagggtaacgaagtacgaaaacgacttggacggtcctacgactaaccgtnttcgttaccg

SEQ ID NO: 79397 - DNA, 517 bp, Homo sapiens
  misc_feature: GYAE6OF01AGNOA.14.11.A11.1.454.CMB.1.raw
  modified_base (219)..(219): a, c, t, g, unknown or other
  misc_feature (219)..(219): n is a, c, g, or t
  modified_base (511)..(511): a, c, t, g, unknown or other
  misc_feature (511)..(511): n is a, c, g, or t
tcagcgtctagtaccacgaccggtgctcgatttagctacgactgcagggggcaggagtcagacccactcaggacacagcatggacatgagggtccccgctcagctcctggggctcctgctgctctggctcccaggtgccagatgtgccatccaagtgacccagtctccatcctccctgtctgcatctgtaggagacagagtcaccatcacttgccgggnaagtcagttcattagaaatgagttaggctggtatcagcagaaaccagggaaacgcccctaagctcctgatctatgctgcgtcaatttacaactgggtccatcaagttcagcggcagtggatcgtggcacagatttcactctcaccatcagcacgcctgcagcctagaagtagtttacgctaacttattactgtactacaacgtattaacaactttaccctacgtaacgttcggaccgaaacgggtacctaaagggtcggaagtaccaaacgactagtacgtctagaccaccntcgtcg

SEQ ID NO: 79398 - DNA, 661 bp, Homo sapiens
  misc_feature: GYAE6OF01DAXT8.14.11.A11.1.454.CMB.1.raw
  modified_base (194)..(194): a, c, t, g, unknown or other
  misc_feature (194)..(194): n is a, c, g, or t
  modified_base (426)..(426): a, c, t, g, unknown or other
  misc_feature (426)..(426): n is a, c, g, or t
tcagcgtctagtaccacgaccggtgctcgatttagctacgactgcagggggcaggagtcagacccactcaggacacagcatggacatgagggtccccgctcagctcctggggctcctgctgctctggctcccaggtgccagatgtgccatccaagtgacccagtctccatcctccctgtctgcatctgtagganacagagtccaccatccacttgccgggcaagtcagttcattagaaatgagttaggctggtatcagcaagaaaccagggaacgaccctaagctctgatctatgctgacgtctaattaccaaacgtcgggtaccatacgtaagtcacggcgacaggtggatcgtggcaacgtagtacttcactactacacctatcaagccacgcctagcacgtacccgtagtaaagtagttttanaaccttaactttaacttacgttacggttaaccttaaacgtaaacggttaactttaacccttaaacgtttaacccccgttacgggttaaacccggtttaccggggtaaacccgaaaacgggggttaacccgtaaaacggggttaacgggtaaaccggttaaacccaaaaaccggggttaaaaccgttgggtaacggtacgttaacccgaccgaaacccttagttcccgtttaccgg

SEQ ID NO: 79399 - DNA, 580 bp, Homo sapiens
  misc_feature: GYAE6OF01E2HQH.14.11.A11.1.454.CMB.1.raw
  modified_base (275)..(275): a, c, t, g, unknown or other
  misc_feature (275)..(275): n is a, c, g, or t
  modified_base (381)..(381): a, c, t, g, unknown or other
  misc_feature (381)..(381): n is a, c, g, or t
tcagcgtctagtaccacgaccggtgctcgatttagctacgactgcagggggcaggagtcagacccactcaggacacagcatggacatgagggtccccgctcagctcctggggctcctgctgctctggctcccaggtgccagatgtgccatccaagtgacccagtctccatcctccctgtctgcatctgtaggagacagagtcaccatcacttgccgggcaagtcagttcattagaaatgagttaggctggtatcagcaagaaaccgagggaaacncccctaagcctcctgatctatgctgcgtacctaatttaacaaacgtcgggtacccatacgaaggttcagcggcaggtggtatcgtggcacgagtatttccacttcnccacctatacacgcacgcctgccagccgtagaagttattttcgacttaactttattactgttacctaacgtaagtaactttaacctaactttacccgtacggtaaccgttcggaacccgtaaagggaacccgtaagggtcggtaaagtaccgaaaacgtaacgttggtacggtcgtacgacctacctagttccgttacg

SEQ ID NO: 79400 - DNA, 606 bp, Homo sapiens
  misc_feature: GYAE6OF01ED268.14.11.A11.1.454.CMB.1.raw
  modified_base (363)..(363): a, c, t, g, unknown or other
  misc_feature (363)..(363): n is a, c, g, or t
tcagcgtctagtaccacgaccggtgctcgatttagctacgactgcagggggcaggagtcagacccactcaggacacagcatggacatgagggtccccgctcagctcctggggctcctgctgctctggctcccaggtgccagatgtgccatccaagtcgacccagtctccatccctccctgtctgcatctgtaggagacagagtccaccatccacttcggcccgggacaagtcagttcaattaagaaatgagttaggctggtatcagacaagaaaccgagggaaacgacccctaagcctcctgactctatgctcgcgtactaaatttacgtaaacgtcgggtacccatacgtaagttcagcggnaggtggatcgtggacacagtacttccactctcaccatcacgcacgcctgaccacgtcctagtaacgttatttcgacttaactttacttacgtcgttaactaactaaagttactttaactaacctttacccgtaacggtaacgttaccggacccgtaaacggggaaccgtaagggtacggtaaacgtaaccgtaaaacgtacggtagttcgggtactacggacctaaccttcgttcgttaaccg

SEQ ID NO: 79401 - DNA, 631 bp, Homo sapiens
  misc_feature: GYAE6OF01CR9YW.14.11.A11.1.454.CMB.1.raw
  modified_base (196)..(196): a, c, t, g, unknown or other
  misc_feature (196)..(196): n is a, c, g, or t
  modified_base (215)..(215): a, c, t, g, unknown or other
  misc_feature (215)..(215): n is a, c, g, or t
  modified_base (220)..(220): a, c, t, g, unknown or other
  misc_feature (220)..(220): n is a, c, g, or t
  modified_base (243)..(243): a, c, t, g, unknown or other
  misc_feature (243)..(243): n is a, c, g, or t
  modified_base (287)..(287): a, c, t, g, unknown or other
  misc_feature (287)..(287): n is a, c, g, or t
  modified_base (412)..(412): a, c, t, g, unknown or other
  misc_feature (412)..(412): n is a, c, g, or t
tcagcgtctagtaccacgaccggtgctcgatttagctacgactgcagggggcaggagtcagacccactcaggacacagcatggacatgagggtccccgctcagctcctggggctcctgctgctctggctcccaggtgccagatgtgccatccaagtgacccagtctccatccctcctgtctgcatctgaggagacngatcacatcagtgccgganaagtnagttcagttaagaatgagttagngtagtatcagacgaagaaaccgtagggaaccaccctaagctcgnatctatgctgacgtactaattacgaacggtcggaccagtacgtaaggtcacggcggtacgaggtcgaacgtcgtacgggacctaagtagtttaccttactaactcctaacaaccttgacaccggnaaccgtctgacacgtcctagggtaaacttagtttcgaaccctttaatttaacgttactccgttaaaccgtaactaaacggtttaccttaaaccgttaccgttacccgtaacggttacccgggttacggacccggtaaaacgggaccggttaaaggacgggtaaacttaacggaaaccgagtacggtacggacgtacgtaacccacggtcttgttacccg

SEQ ID NO: 79402 - DNA, 728 bp, Homo sapiens
  misc_feature: GYAE6OF01DWF38.14.11.A11.1.454.CMB.1.raw
tcagcgtctagtaccacgaccggtgctcgatttagctacgactgcagggggcaggagtcagacccactcaggacacagcatggacatgagggtccccgctcagctcctggggctcctgctgctctggctcccaggtgccagatgtgccatccaagtgacccagtctccatcctccctgtctgcatctgtaggagacagagtcaccatcacttgccgggcaagtcagttcattagaaatgagttaggctggtatcagcaagaaaccgaggaaacgccctaaggctcctgactctatgctgccgtacctaatttaccaaacgttcggggtaccctaagtccgtaaaggttcgaacggccggacgtaaggttcgggacttcgtcgggaccaacgtaacgtacttttccgtaccttccttaccaaccctattaccgaaggtcccaacggtcccgtacgacccgtaacggtccccgttaaggtaaagtttacttttttaccgggaacctttaaacttttaaccgtttaacgttacggtttaacccttaaacgtaaacggttaacttttaaacccgtaaaccgtttaacccccgttacggttaaaccggtttcccggggtaaacccgtaaacggggtaacccggtaaacgggtaacgggtaaaccgttaaccggtaaaaccgtaacgttacggacgggttacctaacgtcctaaacccggtattccggttaccg

SEQ ID NO: 79403 - DNA, 586 bp, Homo sapiens
  misc_feature: GYAE6OF01B4J29.14.11.A11.1.454.CMB.1.raw
  modified_base (218)..(218): a, c, t, g, unknown or other
  misc_feature (218)..(218): n is a, c, g, or t
  modified_base (272)..(272): a, c, t, g, unknown or other
  misc_feature (272)..(272): n is a, c, g, or t
tcagcgtctagtaccacgaccggtgctcgatttagctacgactgcagggggcaggagtcagacccactcaggacacagcatggacatgagggtccccgctcagctcctggggctcctgctgctctggctcccaggtgccagatgtgccatccaagtgacccagtctccatccctcctgtctgcatctgtaggagacagagtcaccatcacttgccggnaagtcagttcattagaaatgagttaggctggtatcagcagaaaccagggaaacnccctaagctctgatctatgctgcgtacctaatttacaacgtgggtcccatcgaaggttcaggcggcaggtggtatcgtggacacgtagtactttcacgttctaccaccactcagctagcctgctacgcctagaacgttgtttacacttaactttattactgttaacctagtaaacgttacttacctaaactttaccccgtaggttaaccggttaccggaccgtaaacggggtaaccgtaacggggtacggtaaagtaaccgtaaaaccggtacgttacggtacggtccttacgaccaaccgtcgttcttaccgg

SEQ ID NO: 79404 - DNA, 629 bp, Homo sapiens
  misc_feature: GYAE6OF01A44GB.14.11.A11.1.454.CMB.1.raw
tcagcgtctagtaccacgaccggtgctcgatttagctacgactgcaggggggcaggagtcagacccactcaggacacagcatggacatgagggtccccgctcagctcctggggctcctgctgctctggctcccaggtgccagatgtgccatccaagtgacccagtctccatccctccctgtctgcatctgtaggagacagagtcacatcacttgccgggcaagtcagttcattagaatgagttaggctggtatcagacaagaaccgaggaacgaccctaagcctacctagactctatcgctcgacgtactaacttaccgaacgtcgggtaccagtacgtaaggttcaggcggcgtaggtggactcgtacggacacgtagtacttcacgtactaccacctacgtacgagacctacgtacctaggaccacgtacctagtaacttactttacgacttaactttacttacgttagtacctaacgtaacgttaacttaaccgttaaccgttacccgtacgttaaccggtaccggtaacccggtaaacgggtaacccggtaagggtacggtaacggtaaccgaaaccggtaacgttacggtaccgtacgtaccgaacgtacctacgttcgttacg

SEQ ID NO: 79405 - DNA, 563 bp, Homo sapiens
  misc_feature: GYAE6OF01E0HGI.14.11.A11.1.454.CMB.1.raw
tcagcgtctagtaccacgaccggtgctcgatttagctacgactgcaggggggcaggagtcagacccactcaggacacagcatggacatgagggtccccgctcagctcctggggctcctgctgctctggctcccaggtgccagatgtgccatccaagtgacccagtctccatccctccctgtctgcatctgtaggagacagagtcaccatcacttgccggcaagtcagttcattagaatgagttaggctggtatcagcaagaaaccgagggaaacgcccctaagcctcctagactctatgctcgcgtacctaatttaacaacgtcgggtacccagtacgtaaggttcgagcggcagtcggatcgtcggacacagtacttcaccttctaccacctataccagcacgcctgacgacgacctagtaagttagtttacgacttaacttattactgtactactaagtacttaactaacttaccgtacgtacgtacggaccgtaaacggaccgtaaggtacggaacgtacgaaacgacgtaggtacgtcgtacgaccacctgtcgttacg

SEQ ID NO: 79406 - DNA, 549 bp, Homo sapiens
  misc_feature: GYAE6OF01CBK1P.14.11.A11.1.454.CMB.1.raw
  modified_base (420)..(420): a, c, t, g, unknown or other
  misc_feature (420)..(420): n is a, c, g, or t
tcagcgtctagtaccacgaccggtgctcgatttagctacgactgcaggggggcaggagtcagacccactcaggacacagcatggacatgagggtccccgctcagctcctggggctcctgctgctctggctcccaggtgccagatgtgccatccaagtgacccagtctccatcctccctgtctgcatctgtaggagacagagtcaccatcacttgccggcaagtcagttcattagaaatgagttaggctggtatcagcagaaaccagggaaacgcccctaagctcctgactctatgctgcgtaccaatttacaaacgtcgggtccatcaaggttcagcggcagtggatcgtgcacagtactttcactctcacatcagcacgtcctgccacgcctagaagttatttgactaacttattactnttactaactaagtacttaactaacttacccgtacgtaaccggttccggaccgaaacgggtaaccgtaaagggtcggtaaagtacgaaaacgtaacgtggtacggtactacggaccaacctgtcgttacg

SEQ ID NO: 79407 - DNA, 725 bp, Homo sapiens
  misc_feature: GYAE6OF01BBLXJ.14.11.A11.1.454.CMB.1.raw
  modified_base (220)..(220): a, c, t, g, unknown or other
  misc_feature (220)..(220): n is a, c, g, or t
  modified_base (276)..(276): a, c, t, g, unknown or other
  misc_feature (276)..(276): n is a, c, g, or t
tcagcgtctagtaccacgaccggtgctcgatttagctacgactgcagggggcaggagtcagacccactcaggacacagcatggacatgagggtccccgctcagctcctggggctcctgctgctctggctcccaggtgccagatgtgccatccaagtgacccagtctccatcctccctgtctgcatctgtaggagacagagtcaccatcacttgccggganaagtcagttcaattagaaatgagttaggctggtatcagcaagaaaccgagggaacnccctaagctcctgatctatgctagcgtacctaaatttaacgaaacgttcggggtacccagtacgtaacggttcgaaggcggtacgtaggtcggtaacttacgtacgggacctaacgtaaggttacttttacccgtaacgttacctacccgtaaccctacttaccgaacggtaccctaaaccggtcccgttaacggaccgtaacggtacccgttaaggtaaacgtttacgtttttaacgacctttaaacttttacgtttaacgttacgtttaaccttaacgtaaacgttaacctttaaccttaaacgtttaaccccgttacggtaacccggttaccggtaaccggtaaacggggtaaaccgttaaaggggtaacggtaaacggttaaccgtaaaaccggtaaccgttaggtacggtactacggtaacctaccgttacgttcgtttaaccg

SEQ ID NO: 79408 - DNA, 667 bp, Homo sapiens
  misc_feature: GYAE6OF01EYFWV.14.11.A11.1.454.CMB.1.raw
  modified_base (300)..(300): a, c, t, g, unknown or other
  misc_feature (300)..(300): n is a, c, g, or t
tcagcgtctagtaccacgaccggtgctcgatttagctacgactgcagggggcaggagtcagacccactcaggacacagcatggacatgagggtccccgctcagctcctggggcctcctgctgctctggcctcccaggtgccagatgtgccatccaagtcgacccagtcctccatccctcctgtctgcatctgtaggagacagagtccaccatcacgttggccggacagtcagttcattagaatgagttaggctggtatcagacaagaaaccgaggaaacgccctaagcctctgactctancgctgtcgtacctaattacaacgtcggtaccagtacgaaggttcagcgacaggtcggatcgtggacagtacgtacgtttaccacttactaccctaacctacgtcgaacgtcgacgtacctgacctacgtaccgttagtaacgtttactttcgaacgtttaaactttacgttaaccttacggttaaccgttaaacgtaaacgttactttaaacccgtaaaccgtttaccccgtaacggttaaaccccggttcgggaaacccggtaacggggtaaaacccgttaaggggttaccggtaaaaggtaacccgtaaaacggtaaccgttcgggtacgtaccgtacgaccgtaacccttagttcccgttaccg

SEQ ID NO: 79409 - DNA, 626 bp, Homo sapiens
  misc_feature: GYAE6OF01DAEBS.14.11.A11.1.454.CMB.1.raw
  modified_base (99)..(99): a, c, t, g, unknown or other
  misc_feature (99)..(99): n is a, c, g, or t
  modified_base (194)..(194): a, c, t, g, unknown or other
  misc_feature (194)..(194): n is a, c, g, or t
  modified_base (281)..(281): a, c, t, g, unknown or other
  misc_feature (281)..(281): n is a, c, g, or t
  modified_base (616)..(616): a, c, t, g, unknown or other
  misc_feature (616)..(616): n is a, c, g, or t
tcagcgtctagtaccacgaccggtgctcgatttagctacgactgcagggggcaggagtcagacccactcaggacacagcatggacatgagggtccccgntcagctcctgggctcctgctgctctggctcccaggtgccagatgtgccatccaagtcgacccagtctccatcctcctgtctgctatctgtagganacagactccacctatcacgtcggccggcaaggtcagttcagttaagaatgagttaggctagtatcgagacaagaaaccgaggaaccnccctaagcctacctagtactctagtcgctcgaccttactaattaaccgaacgtcggtaccaacgtcgtaaggtcagggcggactaggtacgtcgtcgtggaacctacgtagttactttccgaccttacctacccaacctacgttaccgaacgtcgtaaccgccgtagtaccgacggttaacctagttaagttacgttttacgactttaaacttttacgttaacttcgttaactaacgtaacgttaacttaacctaacccgtttaccgtaccgtacggttacggaccgaaacggtacgtaacggtacgaataacgaacggtactgacgtctacganactagtgtcg

SEQ ID NO: 79410 - DNA, 614 bp, Homo sapiens
  misc_feature: GYAE6OF01EGHMD.14.11.A11.1.454.CMB.1.raw
  modified_base (125)..(125): a, c, t, g, unknown or other
  misc_feature (125)..(125): n is a, c, g, or t
  modified_base (427)..(427): a, c, t, g, unknown or other
  misc_feature (427)..(427): n is a, c, g, or t
  modified_base (606)..(606): a, c, t, g, unknown or other
  misc_feature (606)..(606): n is a, c, g, or t
tcagcgtctagtaccacgaccggtgctcgatttagctacgactgcagggggcaggagtcagacccactcaggacacagcatggacatgagggtccccgctcagctcctggggctcctgctgctcnggctcccaggtgccagatgtgccatccaagtgacccagtctccatcctccctgtctgcatctgtaggagacagagtcaccatcacgttcgccgggactaagtctagttcaattagaaatgagttaggctggtatcgacgacaacggaaaccgaagggaaaacgtaccccctaagcctccgtagactactatcgctcgtactaccttaactaaacgccggtacgggtccatacgtaaggtcagcggactaagggtcgtagtcgacgacgaactacgtacttctactctaccacctatacgacncgacgtcctgaccgcgtaccgtaagtaacgttacttcgtaactttaactttacgttactacgttactaacgtattaacttaaccttaaccttaccgtaacgtaaccggttcgtaaccgaaacgggtaacgaagggtacgtaagtaacgaaacgtagtacgtcggacttacggactacgntcgttacg

SEQ ID NO: 79411 - DNA, 669 bp, Homo sapiens
  misc_feature: GYAE6OF01A60OV.14.11.A11.1.454.CMB.1.raw
  modified_base (219)..(219): a, c, t, g, unknown or other
  misc_feature (219)..(219): n is a, c, g, or t
  modified_base (277)..(277): a, c, t, g, unknown or other
  misc_feature (277)..(277): n is a, c, g, or t
tcagcgtctagtaccacgaccggtgctcgatttagctacgactgcagggggcaggagtcagacccactcaggacacagcatggacatgagggtccccgctcagctcctggggctcctgctgctctggctcccaggtgccagatgtgccatccaagtgacccagtctccatcctccctgtctgcatctgtaggagacagagtcacatcacttcggccggnaagtcagttcaattagaatgagttagctggtatcagacaacgaaaccgacgggaaacnccccgtaagcctaccgtgactctaatgctcgtaccgttacctaaatttaaccgaacggttcgggtaccctaagtaccgtaacggttcaggcggactaaggtcggtactcgtacgggacaacgtaagttactttaccacgttacctaccaaccgtactccgacgtacgacgtccgtcgaccgtaacgccgttaaggaatttacgttttcgaacttaactttactttaacgtgttaacctacgtaaagttaaccttaaccgttaaaccttaccccgtacggtaaccgttaccggaaccgtaaacgggtaacccggtaaagggtacggtaaacggtaacgaaaaccggttacgtacggttacggaccttacggaacctaccgtgtttccctacgg

SEQ ID NO: 79412 - DNA, 762 bp, Homo sapiens
  misc_feature: GYAE6OF01DMTSP.14.11.A11.1.454.CMB.1.raw
  modified_base (103)..(103): a, c, t, g, unknown or other
  misc_feature (103)..(103): n is a, c, g, or t
  modified_base (164)..(164): a, c, t, g, unknown or other
  misc_feature (164)..(164): n is a, c, g, or t
  modified_base (259)..(259): a, c, t, g, unknown or other
  misc_feature (259)..(259): n is a, c, g, or t
  modified_base (291)..(291): a, c, t, g, unknown or other
  misc_feature (291)..(291): n is a, c, g, or t
  modified_base (296)..(296): a, c, t, g, unknown or other
  misc_feature (296)..(296): n is a, c, g, or t
  modified_base (468)..(468): a, c, t, g, unknown or other
  misc_feature (468)..(468): n is a, c, g, or t
tcagcgtctagtaccacgaccggtgctcgatttagctacgactgcaggggggcaggagtcagacccactcaggacacagcatggacatggacgggtcccccgntccagcctccgtggggtccttcctgctgctcgtcggcctcccgaggtcgccagtatggtcnccataccaagtcgaccctatcctaccacttccctccgtgtctgctattcgaggtaggacacgagtacgtacaacctatcgtacgtcggccggtanagtctagtactaattaagaatggagttacggntagtnacgagaccaaggaaccgtaggaaccaccctagcctacgtagacttcgactcgactcgtaaccttactaaacgtttaaccgaacgggttccggaacctattaaccggaggtacgacggcgtacgtaggtacgaacgttgacggaccttatagttacctacacctcacacgtanacacgtcaccgtactcgacggtactacgtagttacgtttagtacctaactttaatttactacccgtattaacccgtaacgtaaacgttacccttaaaacgtacccgttttaaccccggaagggttttaccccgaaacggggaaaccccgggttaaaccggtaaaacgggtaaacgggggttaaacccgtttaaagaaaacccccgggtttaaacggttaacgggttacccgggtaacggttacccgggtaaccaaacccggtttacccgttagttttacccggttttaaacccg

SEQ ID NO: 79413 - DNA, 735 bp, Homo sapiens
  misc_feature: GYAE6OF01CHMXI.14.11.A11.1.454.CMB.1.raw
  modified_base (99)..(99): a, c, t, g, unknown or other
  misc_feature (99)..(99): n is a, c, g, or t
  modified_base (193)..(193): a, c, t, g, unknown or other
  misc_feature (193)..(193): n is a, c, g, or t
tcagcgtctagtaccacgaccggtgctcgatttagctacgactgcagggggcaggagtcagacccactcaggacacagcatggacatgagggtccccgntcagctcctgggctcctgctgctctggctcccaggtgccagatgtgccatccaagtgacccagtctccatccctcctgtctgcatctgtagganacagagtcaccatcacgttgccgggacaagtcagttcattagaatgagttaggctggtatcagacaagaaaccgagggaaacgcccgtaagcctccgtgtatctatgtctgtacgtacctaaatttaccgaaacgtcgggtaccctagtacgtaacggttcgaacggtcggacgtaggtacggacttacgtgggaccaacgtaacgttactttacccgacttcctactaaccctagttaccgtaacgccgacgtaccctacggaccaaccggtcttaaggtaacgtttacgttttacgtaacctaaacttttacttaaccgttacgtttaaccgtaacgttaaacgttaacgtttaaacccttaaacccgtttacccgtaacccggttaaaccgggtttccggtaaacccggtaaacgggggttaaccccggaaagggggttaaccgtaaaacgggttaacccgtaaaaaccgggttaccgttacgggttaccggttaaccgttaacgtaccccgtaacccgttaagtttcccgtttaccgg

SEQ ID NO: 79414 - DNA, 805 bp, Homo sapiens
  misc_feature: GYAE6OF01C6B3I.14.11.A11.1.454.CMB.1.raw
tcagcgtctagtaccacgaccggtgctcgatttagctacgactgcagggggcaggagtcagacccactcaggacacagcatggacatggacgggtcccccgctcagctccgtggggctcctgctgctctggctcccgaggtgccagatgtgccatccaagtcgacccagtcctccatccctccctgtctgcctatcgtaggtaggagacaggactccaaccatcgacgttcggccgggactaagtcagttactaagttaagaaagttggtaaggttaggcttaggtactcaaggaccgaaggaaaccggaagggaaacgtaccccctaaagccttaccgtgtaactctagtcgcttacggtacgtaaccttaaacttaaccgaaacggttccgggtaaccctagtaccgtaaacggttacgacggaccggtacgtaacgggttcggtaacttccggttaggaccccgtaaagtaacgtttaccttttaccgaaccttaccctaacctaacccgtaacgttacgaaaccgtacccggtacgtaccgttaccggaacgaccgtaccggttaagtaacgttaacgttttacgaaccgtttaaactttaacttaccgttaaggtaaccttaaacgtaaagtttaaccttaaaccttaaacccgtttaaccccggtaacggttaacccggggtttacccggaaaccgggtaaaccgggttaaacccggaaagggttaaacggtaaccgtttaaacggaaacgttacggttaacggtcgtaacggtacgacctaccttagtcgtttacccg

SEQ ID NO: 79415 - DNA, 518 bp, Homo sapiens
  misc_feature: GYAE6OF01BXC4N.14.11.A11.1.454.CMB.1.raw
  modified_base (99)..(99): a, c, t, g, unknown or other
  misc_feature (99)..(99): n is a, c, g, or t
  modified_base (220)..(220): a, c, t, g, unknown or other
  misc_feature (220)..(220): n is a, c, g, or t
  modified_base (272)..(272): a, c, t, g, unknown or other
  misc_feature (272)..(272): n is a, c, g, or t
  modified_base (511)..(511): a, c, t, g, unknown or other
  misc_feature (511)..(511): n is a, c, g, or t
tcagcgtctagtaccacgaccggtgctcgatttagctacgactgcagggggcaggagtcagacccactcaggacacagcatggacatgagggtccccgntcagctcctggggctcctgctgctctggctcccaggtgccagatgtgccatccaagtgacccagtctccatcctccctgtcctgcatctgtaggagacagagtcaccatcacttggccggnaagtcagttcattagaatgagttagctggtatcagcagaaaccagggaaacnccctaagctcctgatctatgctgcgtactaatttacaaacgtcgggtcccatacaagttcagcggcaggtgatctggcacagtattcactctcaccatcagcagcctgacagcctagaagtatttcgcttaattattactgtactaacaagtacttaacaacttacctacgtacgttccgacgaacgggaccaagggtcggtaagtacaaacggaactggtaggtactacgaccgtacntcggtac

SEQ ID NO: 79416 - DNA, 591 bp, Homo sapiens
  misc_feature: GYAE6OF01CO2JM.14.11.A11.1.454.CMB.1.raw
  modified_base (196)..(196): a, c, t, g, unknown or other
  misc_feature (196)..(196): n is a, c, g, or t
  modified_base (283)..(283): a, c, t, g, unknown or other
  misc_feature (283)..(283): n is a, c, g, or t
  modified_base (358)..(358): a, c, t, g, unknown or other
  misc_feature (358)..(358): n is a, c, g, or t
  modified_base (409)..(409): a, c, t, g, unknown or other
  misc_feature (409)..(409): n is a, c, g, or t
  modified_base (582)..(582): a, c, t, g, unknown or other
  misc_feature (582)..(582): n is a, c, g, or t
tcagcgtctagtaccacgaccggtgctcgatttagctacgactgcagggggcaggagtcagacccactcaggacacagcatggacatgagggtccccgctcagctcctggggctcctgctgctctggctcccaggtgccagatgtgccatccaagtgacccagtctccatccctccctgtctgctatctgtagganacagacgtcaccatcacttcggccgggcaagtcagttcaagttaagaaatgagttaggctggtatcagcaacgaaacgagggaaacncccctaagcctacctgactctatcgctgccgtactaaatttacaaacgtcgggtaccatacgaaggttcaggcgngtaggtggactcgtggactaacgtagttacttacgactcctaccacctacncgtacgctacgtcctagccgacgtccctaaggtaacgttattttacgaccttaactttatacttacgtactaactaagtacttactaacgttaccctcggtaaccgtcggaaccgtaggaccgtaaggtaacgtataaccggaacgtaacgtcgtacgtcgtacgaccacgtnttcgttacg

SEQ ID NO: 79417 - DNA, 627 bp, Homo sapiens
  misc_feature: GYAE6OF01AWN05.14.11.A11.1.454.CMB.1.raw
  modified_base (283)..(283): a, c, t, g, unknown or other
  misc_feature (283)..(283): n is a, c, g, or t
  modified_base (477)..(477): a, c, t, g, unknown or other
  misc_feature (477)..(477): n is a, c, g, or t
tcagcgtctagtaccacgaccggtgctcgatttagctacgactgcagggggcaggagtcagacccactcaggacacagcatggacatgagggtccccgctcagctcctggggctcctgctgctctggctcccaggtgccagatgtcgccatccaagtcgacccagtctccatccctcctgtctgcatctagtaggagacaggatacaccatccacttcggccgggctaagtcagttcattaagaatgagttaggctggtatcagcaacgaaccgagggaaacncccgtaagctcctagattctagtgctgtacctactaatttaacaacggtcgggtacccagttacgtaacggttccaggcggcgtaggtacggtagtcgtacggactaacgtacgttactttccgtaacttccacctaacctacgtaccgacgtaccgacgtcccgagtaccgacgtaccgtaggtaaacgtttntttacgaccttaactttacgttacttacgtaactaacgtaagttactaacgttaaccttacccgtacggtaaccggttacggaccgtaaagggaccgtaagggtacgaacgtacgaaacgacgttgacgtactgacctactcttcgtacg

SEQ ID NO: 79418 - DNA, 765 bp, Homo sapiens
  misc_feature: GYAE6OF01AJ2VI.14.11.A11.1.454.CMB.1.raw
  modified_base (384)..(384): a, c, t, g, unknown or other
  misc_feature (384)..(384): n is a, c, g, or t
tcagcgtctagtaccacgaccggtgctcgatttagctacgactgcagggggcaggagtcagacccactcaggacacagcatggacatgagggtccccgctcagctcctggggctcctgctgctctggctcccaggtgccagatgtgccatccaagtgacccagtctccatcctcctgtctgcatctgtaggagacagagtcaccatcacgttcggccgggacaagttcagttcaattagaaatgagttaggcgtggtatcagacaagaaaccgagggaaacgacccctaagcctcctgattcgtatcgcctgaccgtacctaagttaaccaacgtcgggtacccagtacgtaaggttcgacggcggacgtaggtggacttacgnggtacaacgtacgtactttacctaacctctaccaacctataccgacgtaccgaacgtcccgtacggacctacgtacccgttaagtaacgttttacgtttaccgtaacccgtttaaactttaaccgtttacgtttaacggtaaccttaaaccggtaaaacgtttaaccgtttaaaccgttaaacccgttttaaccccggttacccgggttaaaacccgggtttaccccgggggaacccgttaaaaaccgggggttaacccggtaaacgggggttaaccgggtaaacggttaaacccggtaaaaccggttaaccgggtttacggttaaccgggtaccgttacccgggaaccctaaacccgtttccgttaccgttttaaccccg

SEQ ID NO: 79419 - DNA, 587 bp, Homo sapiens
  misc_feature: GYAE6OF01A5PGN.14.11.A11.1.454.CMB.1.raw
  modified_base (273)..(273): a, c, t, g, unknown or other
  misc_feature (273)..(273): n is a, c, g, or t
  modified_base (579)..(579): a, c, t, g, unknown or other
  misc_feature (579)..(579): n is a, c, g, or t
tcagcgtctagtaccacgaccggtgctcgatttagctacgactgcagggggcaggagtcagacccactcaggacacagcatggacatgagggtccccgctcagctcctggggctcctgctgctctggctcccaggtgccagatgtgccatccaagtgaccccagtctccatcctccctgtctgcatctgtaggagacagagtcaccatcactgccgggcaagtcagttcattagaaatgagttaggctggtatcagcaagaaccagggaaacnccccgtaagcctcctagactcgtatcgcgtgcgttaccaaattttaccaaacgttcggggtaccctagtacctaacgggttccaggccggtacaggttacggtaatccgtggacacgtagtacttttcgaccttctaccaacctacgtcacgcaacgcctggcctagcctagtaacgttatttacgactaacctttatacttgtactaacgtaagtacttactaacttaccctacgtaaccggttcgaccgtaaggaaccgaaggtggaacgtacgaaacgcttaggtacggtctacgacccactntccgtacg

SEQ ID NO: 79420 - DNA, 676 bp, Homo sapiens
  misc_feature: GYAE6OF01AT4DL.14.11.A11.1.454.CMB.1.raw
tcagcgtctagtaccacgaccggtgctcgatttagctacgactgcaggggggcaggagtcagacccactcaggacacagcatggacatgagggtccccgctcagctcctggggctcctgctgctctggctcccaggtgccagatgtgccatccaagtcgacccagtctccatccctccctgtctgcatctagtaggagacagagtcacctatctacgttcggccgggactaagtctagttacaattaagaataggtagttaggtcgtaggtatcgaagacaacggaaaccggaacgggaaaccgtacccccgtaagtcctaccgtagtacttcgtatcggtcgttcgaccgttaccctaaacttttaaccgaaccggttccgggtaccctaagtacgtaacggttacgacggtcggacgtacggtggtactcgtacgactaacgtatactttccacctactaccacctactaccgacgcacgtcccgtacgacacggtccgttaagtagtttactttaccgtaactttaactttacgttacttacgtaactaaccgtaaattaaccttaacttaacccgtaccgtacgtacccggttacggacccgtaaaggaccgtaaggggtacgtaaactaacgaaccgtagtggtacgtcgtacacctaccttgtcttaccg

SEQ ID NO: 79421 - DNA, 680 bp, Homo sapiens
  misc_feature: GYAE6OF01CMI0M.14.11.A11.1.454.CMB.1.raw
  modified_base (194)..(194): a, c, t, g, unknown or other
  misc_feature (194)..(194): n is a, c, g, or t
  modified_base (199)..(199): a, c, t, g, unknown or other
  misc_feature (199)..(199): n is a, c, g, or t
  modified_base (218)..(218): a, c, t, g, unknown or other
  misc_feature (218)..(218): n is a, c, g, or t
  modified_base (272)..(272): a, c, t, g, unknown or other
  misc_feature (272)..(272): n is a, c, g, or t
  modified_base (288)..(288): a, c, t, g, unknown or other
  misc_feature (288)..(288): n is a, c, g, or t
  modified_base (426)..(426): a, c, t, g, unknown or other
  misc_feature (426)..(426): n is a, c, g, or t
tcagcgtctagtaccacgaccggtgctcgatttagctacgactgcagggggcaggagtcagacccactcaggacacagcatggacatgagggtccccgctcagctcctgggctcctgctgctctggctcccaggtgccagatgtgccatccaaggtgacccagtctccatccgtccctgtctgcatctgtaggnacagntcactatcacgttgccggnaagtcagttcatagaagtgagttggctggtatcaagcgaagaaacgagggaacnccccgtaagcctacgngtatctagtcgtcgtcgccgtacctaatttaacaacggtcgggtaccagttacgtaacggttcaacgggtcccggtagtaggtacggtaagtcgtacggactaacgtagttacttaccgtaccttcctaccaaccgtntacgagtaccgcggtacctacgaccagggttacctagtaacgttcgtttacgaacttaacgttttacgttacgtttacgtaacctaacgtaaacggtttaccttaacgttaaaccctttacccgtaacgttaacccggttaccggaacccggtaaagggtaaccgtaaagggttacggtaaaccgtaaaccggtaaaacccgggtaacgttcggaacggttccgtaacgtacccgtaacttccgttcgttaccg

SEQ ID NO: 79422 - DNA, 781 bp, Homo sapiens
  misc_feature: GYAE6OF01DFIPG.14.11.A11.1.454.CMB.1.raw
  modified_base (100)..(100): a, c, t, g, unknown or other
  misc_feature (100)..(100): n is a, c, g, or t
  modified_base (202)..(202): a, c, t, g, unknown or other
  misc_feature (202)..(202): n is a, c, g, or t
  modified_base (275)..(275): a, c, t, g, unknown or other
  misc_feature (275)..(275): n is a, c, g, or t
  modified_base (476)..(476): a, c, t, g, unknown or other
  misc_feature (476)..(476): n is a, c, g, or t
tcagcgtctagtaccacgaccggtgctcgatttagctacgactgcagggggcaggagtcagacccactcaggacacagcatggacatgacgggtccccgntcagctccgtgggctcctgctgctctgcctcccgaggtcgccagatcgtgccatccaaagtcgacccagtcctccatcctccctgtctgctatctgaagganacagactcactatactacgtgccgggactaagtctagttcataagaacttgagttagacttgtaatcgaaganaaacgaaaaccgaagggaaccacccttaagcctaccgttaagattacctaatcgcgttcgaccgttacctaaaatttaccgaaaaccgtcggggtaccctaactacgtaaggttcgaacggtcggacgtaacggtaggtaactcgttacggactaaccagttaacctttaccactaccgtaacctacccaacttaggaacnccgtacggtacctacggaccgtaacgtccgttaaggtaacgtttaccgttttaagtaacccttaaagtttaccgtttaacgttaacgttaccgtaaaccgttaaacgttaactttaaaccccgtaagtttaacccccgtacggttaaaaccggttaccccggtaaaccggtaaaccgggtaaccgttaaagggggtaaaggttaaaacccgggtaaaccgttaaaaaccgggttaaacccgtttaggggtaccccggttactaaaccggggtacccttaaccgaacgttttccggttaaaccccg

SEQ ID NO: 79423 - DNA, 901 bp, Homo sapiens
  misc_feature: GYAE6OF01DBSDE.14.11.A11.1.454.CMB.1.raw
tcagcgtctagtaccacgaccggtgctcgatttagctacgactgcagggggcaggagtcagacccactcaggacacagcatggacatgacgggtccccgctcagctccgtggggctcctgctgctcgtggcctcccgagggtcgccagatgtcgcccatccgaaggtcgacccagtcctccacttccctccctgtctgcatcgtaggtaggacgacacgacgtccacctactcctacgttcgggaccgggtactaacgtcgtagttacgtaatttaaggaaaagttggtaaggttacggtcgttaggttactcgaagtaccgaaacggaaaaccggaagggaaaccgtcccgtaaaggtcctaccgtagtacttacgtagttcgccgttaggaccgtttaaccctaaacgttttaaccgaaacggttccgggtaaccctagttaaccggtaacgggttaccgacgggtccgtagtacggtcggtacttcggttacggacctaacgttacgttacctttacccgtaccgttaccgtacccaaccgtgttacccgaacgttccccgaaggtcccgtacggtaccctaaccgttccggtaaaggtttaacggtttaccctttttaaggtaaacccctttttaaacgttttaaccgtttaaccgtcgttttaaaaccccgttaaagttaaacggttttaaaccctttaaccccgtttaaaccccggttttaaaccccggttaacccgggggttaaacccggttaacccggggtaaacccgggaaaacggggtttaaccgggaaacggggttaaaccggttaacccgtaaaacggttaccggtaaaccgggttggttacccgaaaccggtttcccgaaccctaacgtttcggttccgttaacccgg

SEQ ID NO: 79424 - DNA, 745 bp, Homo sapiens
  misc_feature: GYAE6OF01DOELX.14.11.A11.1.454.CMB.1.raw
  modified_base (128)..(128): a, c, t, g, unknown or other
  misc_feature (128)..(128): n is a, c, g, or t
  modified_base (213)..(213): a, c, t, g, unknown or other
  misc_feature (213)..(213): n is a, c, g, or t
  modified_base (236)..(236): a, c, t, g, unknown or other
  misc_feature (236)..(236): n is a, c, g, or t
  modified_base (737)..(737): a, c, t, g, unknown or other
  misc_feature (737)..(737): n is a, c, g, or t
tcagcgtctagtaccacgaccggtgctcgatttagctacgactgcagggggcaggagtcagacccactcaggacacagcatggacatggacgggtccccgctcagctccgtggggctcctgctgctcnggctcccgaggtcgccagatgtcgccatccaagtcgacccagtcctccactcccgtccctgtctgctatctgtaggagacagganaccaccatccagtcggccggganaagtcgagttcaagttaagaaagtggtacgttaggtacgtaggtactacggagaccaaaggaaaccgaacgggaaaccctaccccgtaaggcccttaccgtagtacgttacctaagtcggtaccgtaccgtaacccgtttaacttaaacgtttaacccggaaaccgggtttccgggtacccttaggtaaccgtaaagttccgaacgccgggtatacgggtacggtaactcggtacgaaccgtagtacgtttaccttacacccctttacgaacctaacctacgtacccgtacggacgaaccgttccgcgtaaccggaacgtcccgttaataacgggtttacttacgtaaacccttaattacgtttacgtaccgttaacaaaccgtacgtaaaccttaccttaaaccgttaccctaacgggtaccggttacgaccgggaaacggtaaacgtaacgggtacgtaacgaaccgtaaacggtgacgtacgtaccgactacgtaccngttcttac

SEQ ID NO: 79425 - DNA, 815 bp, Homo sapiens
  misc_feature: GYAE6OF01A2LL2.14.11.A11.1.454.CMB.1.raw
tcagcgtctagtaccacgaccggtgctcgatttagctacgactgcagggggcaggagtcagacccactcaggacacagcatggacatgagggtccccgctcagctcctggggctcctgctgctctggctcccaggtgccagatgtgccatccaagtgacccagtctccatccctccctgtctgcatcgtgtaggagacagacgtcaccatctacgttcggcccgggataacgtcagttactaagttaagtaaatgtagttaggtcgtaggtatcgagacgaaagaaaccgaagggaaaccgaccccgtaagcgtacctgtactctagtcgcgttacgtccgttacctaaattaaccgtaacgtcggggtacctagtaacgtacggttacagggtcggacgtaggtacggtacgtcgtccggaactacgtaacgttacctttcgtaaccttacccgtactaacccgtacgtaccgtacgaccgaacgtaccccggtgtaaccccgtaccgtaccgtttaaggtaaaccgttttacgttttaaccgtaacccttttaacgttttaaccgtttacgtttaacccgttaaccgttaaacttaaaacggtttaaaccgttttaaaccctttaaaccgtttaaccccggtttaacccgggttaaaccccggtttacccggggtaaaacccgggaaaaccggggttaacccggtaaaaggggtaaccgggttaaacggttaaaccggtaaaaccggttaaacggttcgggttaccgggtaacccgttacggtaacccgtacccgttaacgttccgtttccgg

SEQ ID NO: 79426 - DNA, 726 bp, Homo sapiens
  misc_feature: GYAE6OF01EQZ3Q.14.11.A11.1.454.CMB.1.raw
  modified_base (230)..(230): a, c, t, g, unknown or other
  misc_feature (230)..(230): n is a, c, g, or t
tcagcgtctagtaccacgaccggtgctcgatttagctacgactgcagggggcaggagtcagacccactcaggacacagcatggacatgagggtccccgctcagctcctggggctcctgctgctctggctcccaggtgccagatgtgccatccaagtcgaccccagtcctccatccctccctgtctgcatcgtggtaggagacagacgtccaccatcacgttcggccgggnaagtcagttcattaagaatgagttaggctggtatcagacaagaaccgaggaacgcccgtaagcctctgatctagtcgtcgtcgtaccgtaccctaaatttaaccgaaaccggttccggggtacccagttaccgaaagggtttccgaagggccgggacgtagggtacggtacgtaccgttaggggaccctaacgtaaggttaaccttttaccgtaacccttccttaccgaaccctacttaccgaacgtccgaacggtccccttacgggacctaccgggtaccttaacggtaagtttacgttttactaacgttaacttttacgttacgttaacgttactaaccgtaaagttaaccttaacttaaacccgttacccttaaccgggtaacccggttaccgggaacccggtaaacgggtaaccggttaaagggtaacggtaaacgaaccgtaaaacgtacggtacggtacggtaccgtcaacccgtactcgttcttcccgg

SEQ ID NO: 79427 - DNA, 778 bp, Homo sapiens
  misc_feature: GYAE6OF01BXADV.14.11.A11.1.454.CMB.1.raw
  modified_base (153)..(153): a, c, t, g, unknown or other
  misc_feature (153)..(153): n is a, c, g, or t
  modified_base (736)..(736): a, c, t, g, unknown or other
  misc_feature (736)..(736): n is a, c, g, or t
tcagcgtctagtaccacgaccggtgctcgatttagctacgactgcgaggggggcaggagtcagacccactcaggacacagcatggacatggacgggtcccccgctcagcctccgtggggcctcctgctgctcgtggcctcccaggtcgccagntcgtcgacctacgtaccaacgtcgacccacgttcctccacttccctcccgtgtctgctatcgtaggtaggacgacgaggtactaccacctactctacgttcggccggactaagtctagttacaagttaagtaactaggtaagttggtgttagtactacgacgaacgaaacggaaaccggaacgggaacctacccgtaagtcctacgtagtactactacgtcggtctaccggtacttaaccgttaacgttaaccggtaccggtcgtacctacgtacgtaacggtcgacggtacgtacggtacggtacgtacgtaccggtacgactaacgttaacttaccttacgacccttactacccgaaagttcgaccgtaacgcccgtacgtaccgaccggtacacggttacgtaaggttacttttactacgtaaccgttttaaacttcgttaacgttaccgtaactaaacggttaaactttaaccgttaaacccgttaaccgtttacccgaaccgggttaacccggaaccggtaaacggaaacccgggtaaggttaaaccgggtaacgttaaacgaaccgggttaaaccgnggttaccggtacgaccgtcttaaccgactttcgtaacttccg

SEQ ID NO: 79428 - DNA, 649 bp, Homo sapiens
  misc_feature: GYAE6OF01AR6FL.14.11.A11.1.454.CMB.1.raw
  modified_base (277)..(277): a, c, t, g, unknown or other
  misc_feature (277)..(277): n is a, c, g, or t
tcagcgtctagtaccacgaccggtgctcgatttagctacgactgcagggggcaggagtcagacccactcaggacacagcatggacatgagggtccccgctcagctcctggggctcctgctgctctggctcccaggtgccagatgtgccatcccaagtgacccagtctccatcctccctgtcctgcatctgtaggagacagagtcaccatccacttgccgggcaagtcagttcattagaatgagttaggctggtatcagcaagaaaccgagggaaacncccctaagcctctgatctatgctgcgtacctaatttaccgaaacgtcgggtcccagtacgtaacggttcaggcggacgtaggtcggtaatcgtagaccacgtagtactttaccacgttcctacctactataccgacgacctaacgcccttaggacccgtacgtccccgttaagtaaacggttacttttacggacctttaaactttacttaacgttcgtaaccttaccgaagttaaccttaaccgtaaactttaccccgtacggtaaccggttacccggaacgtaaaccggggtaacgtaaacgggttacgggaaacgttaacaaaccggtaacgtggtaacgtccgtaagaccctaacacgttcgttaaccg

SEQ ID NO: 79429 - DNA, 899 bp, Homo sapiens
  misc_feature: GYAE6OF01D3GDH.14.11.A11.1.454.CMB.1.raw
tcagcgtctagtaccacgaccggtgctcgatttagctacgactgcgaggggggcaggagtcagacccactcaggacacagcatggacatggacgggtccccgctcagcctccgtggggcctcctgctgctcgtcggcctcccgaggtcgccagtagtgtcgaccacgggggggtaccaaggtaccgaccctagttcctcctacttccccttcccgttcgtcgtcgactacgttcgtaggtaagggaacgaacgagtacgtaccaacctacgttaccgtacggttcggaccgggtactaacggtacgttagttactaagttaaggtaaacgtaggtaacgggttaggtacgttagggtaactacggaacgtaaccggtaaaccggtaaaaccggaaacggggtaaacccgtaccccgtaaacggacccttaccgttaacgtaaccttacgttacgtccggtcctaacggtacccgttaactaaaacgtttaaccgtaaacggtcccggtaacctaagttaccgtaaaggttccgacggaccggtagtacggtacggtacgttacgggacgaaccgtaagtaacgttactttaccctaccgttacctacccaacgttactacgaccgtaacgaccggtaccgtacgtaacccgagttaacctttaagggtaaacttttacgtttaaccgaaacttttaaccgttttaacgtactttaacggtaacctaaactaaccgtttaaacttacccgttaaaacccgtttaacccgggttacgggttaaccggtaaaccggaacccggttaaaccggggaaccggtttaaaggggaataaacccgggtaaccgttaaaacgggacgttcggacggtacaccggaacttaccgtcgttcgttaacccg

SEQ ID NO: 79430 - DNA, 751 bp, Homo sapiens
  misc_feature: GYAE6OF01D2FQV.14.11.A11.1.454.CMB.1.raw
  modified_base (100)..(100): a, c, t, g, unknown or other
  misc_feature (100)..(100): n is a, c, g, or t
  modified_base (141)..(141): a, c, t, g, unknown or other
  misc_feature (141)..(141): n is a, c, g, or t
  modified_base (555)..(555): a, c, t, g, unknown or other
  misc_feature (555)..(555): n is a, c, g, or t
  modified_base (741)..(741): a, c, t, g, unknown or other
  misc_feature (741)..(741): n is a, c, g, or t
tcagcgtctagtaccacgaccggtgctcgatttagctacgactgcagggggcaggagtcagacccactcaggacacagcatggacatgacgggtccccgntcagctccgtgggctcctgctgctctggcctcccgaggtcnccagatcgtcgccatccgaagtcgacccctagttcctcctactcccctccttgtcctgcctattccgtagggtaacggacgaccgaaggtacgtaccaaccgtacttacctacgtttcgggaccccgggtactaaacggttctacgtttactaagttaaaggtaaagttggtaacggttacggtcgttaggtactacgaacgtacgaaacggtaaaaccggaacggggaaccctaccccgtaagtccgttacctaagtaccttcgtagtcggtacctacgtaccgtttaaacttaacgttaacgtaaccgggtccggtacctaagttacggtaagtcggaacgtccgtaggtagtacgtcgtacgcggactagttacttactactccgtacaccgactacgcacgacgcgtacngtacctacggtacgtaacgttgttaacttacgtaactttaacgtttacttctaacgttaacaaacttaccttaacttaacctacgttaccggtaaccggttacgtaccgggtaaacgaccggtaaacggtaggtaacgtaaagtaacccgtaaggttacgtgtaccggctaaccgtcaacccgttntacgttcccg

SEQ ID NO: 79431 - DNA, 695 bp, Homo sapiens
  misc_feature: GYAE6OF01CFGA6.14.11.A11.1.454.CMB.1.raw
tcagcgtctagtaccacgaccggtgctcgatttagctacgactgcagggggcaggagtcagacccactcaggacacagcatggacatgagggtcccccgctcagctcctggggctcctgctgctctggctcccaggtgccagatgtgccatccaagtgacccagtctccatccctccctgtctgctatctgtaggagacagagtcaccatcacttcgccgggcaagtctagttcagttagaatgagttaggctggtatcgagacgaacgaaaccgaagggaaaccgccccgtaagccttacctgacttcgtagtcgcgtcgtcgtaccttaagttacgaacgtcgggtaccctagtacgtaagttcgacggtcggacgtaggtcggtacttccgagggacacgtacgtactttaccaccttcctacctaacctactacgacgcccacggtccgtcgacgtaccgtaccttaggtaacgttacttttacgaacctttaacgttttacttacgttccgttaacgttaacgtaaacgttaacttaacctttaacccgttaaccccgttaccggttaaacccggttcccgggaaccgtaaaccggggtaacccgtaaaggggttacggtaaacgtaaccggtaaaacggtacgttacgggtacgtaccggttacgacctaactacgtttccgttaaccg

SEQ ID NO: 79432 - DNA, 843 bp, Homo sapiens
  misc_feature: GYAE6OF01CZB7B.14.11.A11.1.454.CMB.1.raw
  modified_base (100)..(100): a, c, t, g, unknown or other
  misc_feature (100)..(100): n is a, c, g, or t
  modified_base (522)..(522): a, c, t, g, unknown or other
  misc_feature (522)..(522): n is a, c, g, or t
tcagcgtctagtaccacgaccggtgctcgatttagctacgactgcagggggcaggagtcacgacccactcaggacacagcatggacatgacgggtccccntcagctccgtggggcttcctgctcgctcgtcgcctcccgaggtgccaggatgtcgcctactaccgtaagtccacccacgttcctaccacttcccctaccgtgtccacgactagtcgtaggtacggacgactagaccgtcctaaccgtactacgtacgttcgggaccggtataacggtctacgtttactaagtaaggtaaagttgtaaacgggtttcgagttacgtattacgaacggaacctaacgggaaaccggtacgggaacctacccgttaacgccttccggatacgttactaggtcgacgttaccggttaccttaaaccgttaaggtaacccgacggtttacccgggtacctaggtacgtaacggtacggacggtcggtacgtacggcgtagtaccggagaccgtagttaacgttaccncttaacctcctaaccgacgtacgtaccgtaacggtaccgaccgttcgtaaccgtacgtaccgttacggttaacgttaccgtttactttacggttaaaccctttacgttaaccgttaaccgttaaccgttacgttaaacgtttaaccgttactttaaaccttacccggttaacccgggttacgggttaaaccgttaaacccgggaccgggttaaaaccgaccggggttaaaccgtaacggggtaaaccgttaacggtaaaccgtaccgggtaacggttacgtacccgttaccgtaaacctacggttgtttacccccgtacgg

SEQ ID NO: 79433 - DNA, 711 bp, Homo sapiens
  misc_feature: GYAE6OF01EUBZ2.14.11.A11.1.454.CMB.1.raw
  modified_base (354)..(354): a, c, t, g, unknown or other
  misc_feature (354)..(354): n is a, c, g, or t
  modified_base (665)..(665): a, c, t, g, unknown or other
  misc_feature (665)..(665): n is a, c, g, or t
tcagcgtctagtaccacgaccggtgctcgatttagctacgactgcagggggcaggagtcagacccactcaggacacagcatggacatgagggtcccccgctcagctccgtggggcctcctgctgctctggctcccgaggtgccagatgtgccatccaagtcgacccagtctccactccctcctgtctgctagtctaggtaggagacagagtccaccatcctacttcggacccgggactaacgtcctagttactaattaaggaaagtggtaagttaggtctaggtatcgacgacgaaacgaaaaccggaacgggaaacctaccccgtaagtccttaccgtaggtacttacgttancggtcgtcgtacgtaaccttaaatttaaccgaaaccggtcgggtacccagttacgaacggttacacggcgtagtacggtacgtacttcgtacggactaactacgtttaccttacaaccttcctaacccaacccgtacgtaaccgtacggtccaacccggtccttagacccgtacggtaccgttaagtaactttagtttaacctaactttaactttacgttactacgttaacctaagtaacttaacttaaccgttaacttacccgtacgtaaccggtaccggaacggtaaaccgaacggtaggtaacgtaanaaccggtaaagacgtcggtacggtactacaccacgttctgttaccg

SEQ ID NO: 79434 - DNA, 742 bp, Homo sapiens
  misc_feature: GYAE6OF01EZBLI.14.11.A11.1.454.CMB.1.raw
  modified_base (100)..(100): a, c, t, g, unknown or other
  misc_feature (100)..(100): n is a, c, g, or t
  modified_base (698)..(698): a, c, t, g, unknown or other
  misc_feature (698)..(698): n is a, c, g, or t
tcagcgtctagtaccacgaccggtgctcgatttagctacgactgcagggggcaggagtcagacccactcaggacacagcatggacatgagggtcccccgntcagctccgtggggctcctgctgctcgtggcctcccgaggtcgccagatgtcgccatccgaagtcgaccctagtcctaccacttccctcctgtctgctatcgtaggaggactacgagtacgtcaacctatccgtacgttcggaccgggtactaagtctagttacaattaacgtaagtgtagttacggcgttgtactcgagacgaacgaaaccggaggaaccgcccgtaagcctaccgtagtactacgttacgcgtactacgaccgtaaccttaaacttacggtaaaccggtccggtaccctaaggttaaccgtacggttaccgacggtaggactagggttacgacgttacgtacgactaacgtacttacgttaccaccttccaacctacgactaccgtacggacgtaaccgccgtagaccgtaccgtaggttaacggttaacttttacgttaccgttaatttaacccttagtaacccgttcttaaaccgtaacttaacgtaaccttaaccgttaaccgttacccgtaaacgtccggtaccggaacccgtaaagggtaaccgtagggtaaccgtaaaggaacccgttaacggttccggnggttaaccgcccgtaacgtaaaccccgttcttgttcccgttacg

SEQ ID NO: 79435 - DNA, 226 bp, Homo sapiens
  misc_feature: GYAE6OF01EXAYT.14.11.A11.1.454.CMB.1.raw
  modified_base (74)..(74): a, c, t, g, unknown or other
  misc_feature (74)..(74): n is a, c, g, or t
  modified_base (166)..(166): a, c, t, g, unknown or other
  misc_feature (166)..(166): n is a, c, g, or t
  modified_base (187)..(226): a, c, t, g, unknown or other
  misc_feature (187)..(226): n is a, c, g, or t
tcagcgtctagtaccacgaccggtgctcgatttagctacgactgcagggtgtccttggggttttgggggggaanaggaagactgaccggtcccccccaggagttcaggtgctgggcacagccggccctgggctgcctggtcaaggctacttccgtatagacgctgngcggctggacaggcgcatagnnnnnnnnnnnnnnnnnnnnnnnnnnnnnnnnnnnnnnnn

SEQ ID NO: 79436 - DNA, 531 bp, Homo sapiens
  misc_feature: GYAE6OF02IHJV8.14.11.A11.1.454.CMB.1.raw
tcagcgtctagtaccacgaccggtgctcgatttagctacgactgcagggggcaggagtcagacccactcaggacacagcatggacatgagggtccccgctcagctcctggggctcctgctgctctggctcccaggtgccagatgtgccatccaagtgacccagtctccatcctccctgtctgcatctgtaggagacagagtcaccatcacttgccgggcaagtcagttcattagaaatgagttaggctggtatcagcagaaaccagggaaagcccctaagctcctgatctatgctgcgtccaatttacaaactggggtcccatcaaggttcagcggcagtggatctggcacagatttcactctcaccatcagcagcctgcagcctgaagattttgctaacttattactgttactacaagtacttaactaacttaccctacgtaaccgtttacggacctaagggacccgtaaggtacgggaacgttacgaaaaccgtaacgtaggtacggactaggaccacctatcttacgg

SEQ ID NO: 79437 - DNA, 516 bp, Homo sapiens
  misc_feature: GYAE6OF02IQ1YO.14.11.A11.1.454.CMB.1.raw
tcagcgtctagtaccacgaccggtgctcgatttagctacgactgcagggggcaggagtcagacccactcaggacacagcatggacatgagggtccccgctcagctcctggggctcctgctgctctggctcccaggtgccagatgtgccatccaagtgacccagtctccatcctccctgtctgcatctgtaggagacagagtcaccatcacttgccgggcaagtcagttcattagaaatgagttaggctggtatcagcagaaaccagggaaagcccctaagctcctgatctatgctgcgtccaatttacaaactgggtccatcaaggttcagcggcagtggatctggcacagatttcactctcacatcagcagctgcagcctcgaagtattttgactaactttattactgtactacaagtattaacaatttaccctacgtaaacgttcggacctaacgggaccaagggtaggaaacgtacgaaaacgaacgtggtacgacgtgacgaccagtctacg

SEQ ID NO: 79438 - DNA, 494 bp, Homo sapiens
  misc_feature: GYAE6OF02IZBRL.14.11.A11.1.454.CMB.1.raw
tcagcgtctagtaccacgaccggtgctcgatttagctacgactgcagggggcaggagtcagacccactcaggacacagcatggacatgagggtccccgctcagctcctggggctcctgctgctctggctcccaggtgccagatgtgccatccaagtgacccagtctccatcctccctgtctgcatctgtaggagacagagtcaccatcacttgccgggcaagtcagttcattagaaatgagttaggctggtatcagcagaaaccagggaaagcccctaagctcctgatctatgctgcgtccaatttacaaactggggtcccatcaaggttcagcggcagtggatctggcacagatttcactctcaccatcagcagcctgccagcctgaagtattttgctaacttattactgtactacaagtattacaattacctcgaacgttcgaccagggacaaggtggaagtacgaaacgactgtagctgcacctatctacg

SEQ ID NO: 79439 - DNA, 491 bp, Homo sapiens
  misc_feature: GYAE6OF02JAAEC.14.11.A11.1.454.CMB.1.raw
tcagcgtctagtaccacgaccggtgctcgatttagctacgactgcagggggcaggagtcagacccactcaggacacagcatggacatgagggtccccgctcagctcctggggctcctgctgctctggctcccaggtgccagatgtgccatccaagtgacccagtctccatcctccctgtctgcatctgtaggagacagagtcaccatcacttgccgggcaagtcagttcattagaaatgagttaggctggtatcagcagaaaccagggaaagcccctaagctcctgatctatgctgcgtccaatttacaaactgggtcccatcaaggttcagcgcagtgatctgcacagatttcactctcaccatcagcagcctgcagcctagaagtatttgactaacttattactgtactacaagtattacaacttaccctacgtaacgttcgacacgggacaaggtggaagtcaaacgactgtgactgacacatctacg

SEQ ID NO: 79440 - DNA, 185 bp, Homo sapiens
  misc_feature: GYAE6OF02GOEIV.14.11.A11.1.454.CMB.1.raw
  modified_base (182)..(185): a, c, t, g, unknown or other
  misc_feature (182)..(185): n is a, c, g, or t
tcagcgtctagtaccacgaccggtgctcgatttagctacgactgcagggtgtccttgggtttgggggaagaggaagactgacggtcccccaggagttaaggtgctgggcacagcggccctgggctgcctggtcaaggactacttccgtactagacgctgagcgggctggcaaggcgcatagnnnn

SEQ ID NO: 79441 - DNA, 519 bp, Homo sapiens
  misc_feature: GYAE6OF02H6USW.14.11.A11.1.454.CMB.1.raw
  modified_base (414)..(414): a, c, t, g, unknown or other
  misc_feature (414)..(414): n is a, c, g, or t
tcagcgtctagtaccacgaccggtgctcgatttagctacgactgcagggggcaggagtcagacccactcaggaaacagcatggacatgagggtccccgctcagctcctggggctcctgctgctctggctcccaggtgccagatgtgccatccaagtgacccagtctccatcctccctgtctgcatctgtaggagacagagtcaccatcacttgccgggcaagtcagttcattagaaatgagttaggctggtatcagcagaaaccagggaaagcccctaaagcctcctgatcatgctgcgtccaatttacaaactggggtccatcaaggttcagcggcagtggatctggcacagatttcactctcacatcagcagcctgcagcctagaagtatttgctaacttatactgtctaanaagtattaacaatttaccctacgaacgttcgaccaagggacctaagggtcggaaagtaccgaaacgaacgttgtaggcttcggacctaaccgattcctgttaccc

SEQ ID NO: 79442 - DNA, 505 bp, Homo sapiens
  misc_feature: GYAE6OF02IR0PT.14.11.A11.1.454.CMB.1.raw
  modified_base (501)..(501): a, c, t, g, unknown or other
  misc_feature (501)..(501): n is a, c, g, or t
tcagcgtctagtaccacgaccggtgctcgatttagctacgactgcagggggcaggagtcagacccactcaggacacagcatggacatgagggtccccgctcagctcctggggctcctgctgctctggctcccaggtgccagatgtgccatccaagtgacccagtctccatcctccctgtctgcatctgtaggagacagagtcaccatcacttgccgggcaagtcagttcattagaaatgagttaggctggtatcagcagaaaccagggaaagcccctaagctcctgatctatgctgcgtccaatttacaactggggtccatcaaggtcagcgcagtggatctggcacagatttcactctcaccatcagcagcctgcagcctgaagtattttgactaacttattacttgtactacaagtattaacaacttaaccctacgaaccgttcgaccgacgggaccaagggtaggtaagtacgaaacgactagtggctgacaccactntacg

SEQ ID NO: 79443 - DNA, 488 bp, Homo sapiens
  misc_feature: GYAE6OF02I489P.14.11.A11.1.454.CMB.1.raw
  modified_base (412)..(412): a, c, t, g, unknown or other
  misc_feature (412)..(412): n is a, c, g, or t
tcagcgtctagtaccacgaccggtgctcgatttagctacgactgcagggggcaggagtcagacccactcaggacacagcatggacatgagggtccccgctcagctcctggggctcctgctgctctggctcccaggtgccagatgtgccatccaagtgacccagtctccatcctccctgtctgcatctgtaggagacagagtcaccatcacttgccgggcaagtcagttcattagaaatgagttaggctggtatcagcagaaaccagggaaagcccctaagctcctgatctatgctgcgtccaatttacaaactgggtccatcaaggttcagcggcagtggatctggcacagatttcactctcaccatcagcagcctgcagctgaagtatttgactaacttattactgtctanaagtattaacaacttaccctcgaacgttcgaccagggacaaggtggaagtcaaacgtactagtgctgcacatctcg

SEQ ID NO: 79444 - DNA, 489 bp, Homo sapiens
  misc_feature: GYAE6OF02GX2P9.14.11.A11.1.454.CMB.1.raw
  modified_base (388)..(388): a, c, t, g, unknown or other
  misc_feature (388)..(388): n is a, c, g, or t
  modified_base (430)..(430): a, c, t, g, unknown or other
  misc_feature (430)..(430): n is a, c, g, or t
tcagcgtctagtaccacgaccggtgctcgatttagctacgactgcagggggcaggagtcagacccactcaggacacagcatggacatgagggtccccgctcagctcctggggctcctgctgctctggctcccaggtgccagatgtgccatccaagtgacccagtctccatcctccctgtctgcatctgtaggagacagagtcaccatcacttgccgggcaagtcagttcattagaaatgagttaggctggtatcagcagaaaccagggaaagcccctaagctcctgatctatgctgcgtcaattacaaactggggtccatcaaggttcagcggcagtggatctggcacagatttcactctcaccatcagcagcctgcagcctgaagtntttgctaacttattacttgtactacagattacaattaccctnaacgttcgaccaggacaagggtgaacgtacaaacgtaactggtacgctgctacatctcg

SEQ ID NO: 79445 - DNA, 568 bp, Homo sapiens
  misc_feature: GYAE6OF02HB2JW.14.11.A11.1.454.CMB.1.raw
tcagcgtctagtaccacgaccggtgctcgatttagctacgactgcagggggcaggagtcagacccactcaggacacagcatggacatgagggtccccgctcagctcctggggctcctgctgctctggctcccaggtgccagatgtgccatccaagtgacccagtctccatcctccctgtctgcatctgtaggagacagagtcaccatcacttgccgggcaagtcagttcattagaaatgagttaggctggtatcagcagaaaccagggaaagcccctaagctcctgatctatgctgcgtccaatttacaaactggggtcccatcaaggttcagcggcagtggatctggcacagatttcactctcaccatcagcagcctgcagcctgaagtattttgactaactttacttacttgtacctaactaagtactttaactaaactttaaccctaccggtaaaccgtttccggacccgtaaacggggaccctaaaggggtcggaaaggttaccgaaaaccggtaaccgttacggtagggtacctacggacccgtaaccctacgttccttacgg

SEQ ID NO: 79446 - DNA, 512 bp, Homo sapiens
  misc_feature: GYAE6OF02G47CF.14.11.A11.1.454.CMB.1.raw
tcagcgtctagtaccacgaccggtgctcgatttagctacgactgcagggggcaggagtcagacccactcaggacacagcatggacatgagggtccccgctcagctcctggggctcctgctgctctggctcccaggtgccagatgtgccatccaagtgacccagtctccatcctccctgtctgcatctgtaggagacagagtcaccatcacttgccgggcaagtcagttcattagaaatgagttaggctggtatcagcagaaaccagggaaagcccctaagctcctgatctatgctgcgtccaatttacaaactggggtccatcaaggttcagcggcagtggatctggcacagatttcactctcaccatcagcagcctgcagcctagaagtattttgctaactttattactagtctacaagtattacaatttaccctacgtaaccgttccggaccaacgggaccgtaaagggtggaacgtacaaacgaacgtgtaggctgacacctatcttcg

SEQ ID NO: 79447 - DNA, 547 bp, Homo sapiens
  misc_feature: GYAE6OF02H9QU7.14.11.A11.1.454.CMB.1.raw
tcagcgtctagtaccacgaccggtgctcgatttagctacgactgcaggggggcaggagtcagacccactcaggacacagcatggacatgagggtccccgctcagctcctggggctcctgctgctctggctcccaggtgccagatgtgccatccaagtgacccagtctccatcctccctgtctgcatctgtaggagacagagtcaccatcacttgccgggcaagtcagttcattagaatgagttaggctggtatcagcagaaaccagggaaacgccctaagctcctgatctatgctgcgtacaatttacaactggggtccatcgaaggttcagcggcagtggatcgtgcacagtatttcactctcaccatcagcagccctgcacgcctagtaagtattttcgactaacttattacttgttactacaagtacttaactaactttacccgtacgtaaccgttacgaccgaacgggtaccgtaagggtcggtaaacgtacgaaaccggtaacgtaggtacggtacgtcggtaccaccgttactcttaccgg

SEQ ID NO: 79448 - DNA, 506 bp, Homo sapiens
  misc_feature: GYAE6OF02FZQMF.14.11.A11.1.454.CMB.1.raw
tcagcgtctagtaccacgaccggtgctcgatttagctacgactgcagggggcaggagtcagacccactcaggacacagcatggacatgagggtccccgctcagctcctggggctcctgctgctctggctcccaggtgccagatgtgccatccaagtgacccagtctccatcctccctgtctgcatctgtaggagacagagtcaccatcacttgccgggcaagtcagttcattagaatgagttaggctggtatcagcagaaaccagggaagccctaagctcctgatctatgctgcgtccaatttacaacgtgggtcccatcaaggttcagcggcagtggatcgtggcacgagtatttcactctacaccatcagcagcctgccagcctagaagtattttgactaactttattactgtactacaagtattactaattaccctgtaacgttcggaccaagggaccaagggtgaacgtacaaacgtagtgtcggctacgacaccatctacg

SEQ ID NO: 79449 - DNA, 505 bp, Homo sapiens
  misc_feature: GYAE6OF02I99OK.14.11.A11.1.454.CMB.1.raw
tcagcgtctagtaccacgaccggtgctcgatttagctacgactgcagggggcaggagtcagacccactcaggacacagcatggacatgagggtccccgctcagctcctggggctcctgctgctctggctcccaggtgccagatgtgccatccaagtgacccagtctccatcctccctgtctgcatctgtaggagacagagtcaccatcacttgccgggcaagtcagttcattagaaatgagttaggctggtatcagcagaaaccagggaaagcccctaagctcctgatctatgctgcgtccaatttacaaactgggtccatcaaggttcagcgcagtggatctgcacagatttcactctcacatcagcagcctgcagcctagaagtattttgactaacttattactgtactacaagtattacaacttaccctacgaacgttcggaccacgggaccaagggtcggaacgtacgaaacgacgtgtacggctacgcactactcttacg

SEQ ID NO: 79450 - DNA, 608 bp, Homo sapiens
  misc_feature: GYAE6OF02GRKJP.14.11.A11.1.454.CMB.1.raw
  modified_base (220)..(220): a, c, t, g, unknown or other
  misc_feature (220)..(220): n is a, c, g, or t
  modified_base (339)..(339): a, c, t, g, unknown or other
  misc_feature (339)..(339): n is a, c, g, or t
  modified_base (347)..(347): a, c, t, g, unknown or other
  misc_feature (347)..(347): n is a, c, g, or t
tcagcgtctagtaccacgaccggtgctcgatttagctacgactgcaggggggcaggagtcagacccactcaggacacagcatggacatgagggtccccgctcagctcctggggctcctgctgctctggctcccaggtgccagatgtgccatccaagtgacccagtctccatcctccctgtctgcatctgtaggagacagagtcaccatcacttgccgggnaagtcagttcattagaaatgagttaggctggtatcagcaagaaaccagggaaacgcccctaagctacctgactctatgctgcgtacctaattacaaacgtgggtccatcaagtcagcgnagtgatgngcacagtattcactctacacatcagcacgctcgcacgcctagaagtattttacgacttaactttacttacttagttaccttaacgtaaagttaacttaacctaaactttaaccccgtaacggtaaaccggtttaccggaacccggtaacgggtaacccgtaaacggggtaacggtaaaaccggttaaccgtaaaaacccggtaaacgttacggttacgggtaccgttaccggaccctaacccgttacgtaccgtttaccgg

SEQ ID NO: 79451 - DNA, 567 bp, Homo sapiens
  misc_feature: GYAE6OF02IUZY2.14.11.A11.1.454.CMB.1.raw
tcagcgtctagtaccacgaccggtgctcgatttagctacgactgcagggggcaggagtcagacccactcaggacacagcatggacatgagggtccccgctcagctcctggggctcctgctgctctggctcccaggtgccagatgtgccatccaagtgacccagtctccatcctccctgtctgcatctgtaggagacagagtcaccatcacttgccgggcaagtcagttcattagaaatgagttaggctggtatcagcagaaaccagggaaagccctaagctcctgatctatgctgcgtcaatttacaactgggtaccatcaaggtcagcggcagtggatctgcacagtatttcactctacaccatcagcagcctgcacgcctaggaatattttgaccttaacttattactgttacctaactaagtatttaacctaaactttaccccgtaacgttaaccggttaccgggacccgtaaacggggtacccgtaaaggggttagggtaaacgtaaccgtaaaaccgtaaccgttaggttacgggtacgtacgaccacccgtatccgttacg

SEQ ID NO: 79452 - DNA, 581 bp, Homo sapiens
  misc_feature: GYAE6OF02HUEX0.14.11.A11.1.454.CMB.1.raw
  modified_base (338)..(338): a, c, t, g, unknown or other
  misc_feature (338)..(338): n is a, c, g, or t
  modified_base (351)..(351): a, c, t, g, unknown or other
  misc_feature (351)..(351): n is a, c, g, or t
tcagcgtctagtaccacgaccggtgctcgatttagctacgactgcagggggcaggagtcagacccactcaggacacagcatggacatgagggtccccgctcagctcctggggctcctgctgctctggctcccaggtgccagatgtgccatccaagtgacccagtctccatcctccctgtctgcatctgtaggagacagagtcaccatcacttgccgggcaagtcagttcattagaaatgagttaaggctggtatcagcagaaaccagggaaaagcccctaaagctcctggatctatgctgcgtccaatttacaaactgggtccatcaaggttcagcgnagtgatctggcanagatttcactctcaccatcagcagcctgcagcctagaagattttgactaactttacttactgttacctaactaagtaacttactaaatttaaccccgtacgtaaaccggtttaccggacccgtaaggggtacccgtaaacggggtaacgggtaaacggtaaccggtaaaaccgtaaaccgttaggtaggggtaccgttacggacctaaccccgtacttcgtttaacccgg

SEQ ID NO: 79453 - DNA, 494 bp, Homo sapiens
  misc_feature: GYAE6OF02HIKI5.14.11.A11.1.454.CMB.1.raw
  modified_base (341)..(341): a, c, t, g, unknown or other
  misc_feature (341)..(341): n is a, c, g, or t
  modified_base (345)..(345): a, c, t, g, unknown or other
  misc_feature (345)..(345): n is a, c, g, or t
  modified_base (490)..(490): a, c, t, g, unknown or other
  misc_feature (490)..(490): n is a, c, g, or t
tcagcgtctagtaccacgaccggtgctcgatttagctacgactgcagggggcaggagtcagacccactcaggacacagcatggacatgagggtccccgctcagctcctggggctcctgctgctctggctcccaggtgccagatgtgccatccaagtgacccagtctccatcctccctgtctgcatctgtaggagacagagtcaccatcacttgccgggcaagtcagttcattagaaatgagttaggctggtatcagcagaaaccagggaaagcccctaaaggctcctgatctatgctgcgtcaatttacaaactgggtccatcagttcagcgcagtgatcngcanagatttcactctacaccatcagcagcctgcagcctagtaagtatttcgactaacttattactagtctaataagattaacaattaccctacgaacgttcgacaagggacaaggtggaacgtacaaacgaactgagctgacactatntacg

SEQ ID NO: 79454 - DNA, 587 bp, Homo sapiens
  misc_feature: GYAE6OF02FF6YY.14.11.A11.1.454.CMB.1.raw
  modified_base (194)..(194): a, c, t, g, unknown or other
  misc_feature (194)..(194): n is a, c, g, or t
  modified_base (220)..(220): a, c, t, g, unknown or other
  misc_feature (220)..(220): n is a, c, g, or t
  modified_base (275)..(275): a, c, t, g, unknown or other
  misc_feature (275)..(275): n is a, c, g, or t
tcagcgtctagtaccacgaccggtgctcgatttagctacgactgcagggggcaggagtcagacccactcaggacacagcatggacatgagggtccccgctcagctcctggggctcctgctgctctggctcccaggtgccagatgtgccatccaagtgacccagtctccatcctccctgtctgcatctgtagganacagacgtcaccatcacttgccgggnaagtcagttcattagaaatgagttaggctggtatcagcaagaaaccagggaaacncccctaagctacctagatctatgctcgcgtactaatttaccaaacgtcgggtccaatcaagttcagcggcaggtgatcgtgcacagtacttacactctcaccatacacgtcacgcctgaccagtccctagtaacgttatttcgaacttaactttacttaacgtcgtactaacaacgttaacttaacttaaccgttaccctaacggtaaccggttaccggaacccgtaacgggaacctaagggtaacggaaacgtaaccgtaaaaccgtacgtacggtacggacttacggaccaacccttaggttctttaccg

SEQ ID NO: 79455 - DNA, 518 bp, Homo sapiens
  misc_feature: GYAE6OF02G46VT.14.11.A11.1.454.CMB.1.raw
  modified_base (340)..(340): a, c, t, g, unknown or other
  misc_feature (340)..(340): n is a, c, g, or t
tcagcgtctagtaccacgaccggtgctcgatttagctacgactgcaggggggcaggagtcagacccactcaggacacagcatggacatgagggtccccgctcagctcctggggctcctgctgctctggctcccaggtgccagatgtgccatccaagtgacccagtctccatcctccctgtctgcatctgtaggagacagagtcaccatcacttgccgggcaagtcagttcattagaaatgagttaggctggtatcagcagaaaccagggaaagcccctaagctcctgatctatgctgcgtaccaatttacaaacgtcgggtaccatcaaggttcagcggnagtggatcgtggcacagtactttcactctcaccatcagcagcctgcagcctagaatatttgactaacttattactgtactacaagtaacttaacaacttaccctacgtaacgttcggaccaagggtacaagggtagaacgttacaaacgtacgtagtacggctagctactatcttacg

SEQ ID NO: 79456 - DNA, 520 bp, Homo sapiens
  misc_feature: GYAE6OF02IWFTV.14.11.A11.1.454.CMB.1.raw
  modified_base (220)..(220): a, c, t, g, unknown or other
  misc_feature (220)..(220): n is a, c, g, or t
  modified_base (339)..(339): a, c, t, g, unknown or other
  misc_feature (339)..(339): n is a, c, g, or t
  modified_base (397)..(397): a, c, t, g, unknown or other
  misc_feature (397)..(397): n is a, c, g, or t
  modified_base (442)..(442): a, c, t, g, unknown or other
  misc_feature (442)..(442): n is a, c, g, or t
tcagcgtctagtaccacgaccggtgctcgatttagctacgactgcagggggcaggagtcagacccactcaggacacagcatggacatgagggtccccgctcagctcctggggctcctgctgctctggctcccaggtgccagatgtgccatccaagtgacccagtctccatccctccctgtctgcatctgtaggagacagagtcaccatcacttgccgggnaagtcagttcattagaaatgagttaggctggtatcagcagaaaccagggaaagcccctaaagctcctgatctatgctgcgtccaatttacaaacgtcgggtaccatcaaggttcagcgnagtgatctggcacagtactttcactctaccaccatccagcagcctgcagcctagaatntttcgactaacttatactgtactacaagtattacaactttacccncgtaacgttcgaccgtaagggacctaagggtcggaacgtacgaaacgactggtacgctagaccgaacctatcgttacg

SEQ ID NO: 79457 - DNA, 578 bp, Homo sapiens
  misc_feature: GYAE6OF02GP5DF.14.11.A11.1.454.CMB.1.raw
tcagcgtctagtaccacgaccggtgctcgatttagctacgactgcagggggcaggagtcagacccactcaggacacagcatggacatgagggtccccgctcagctcctggggctcctgctgctctggctcccaggtgccagatgtgccatccaagtgacccagtctccatcctccctgtctgcatctgtaggagacagatcaccatcacttgccgggcaagtcagttcattagaaatgagttaggctggtatcagcagaaacgaggaaacgccctaagctcctgatctatgctgcgtactaatttaccaaacgtgggtaccatacgaagttcagtcggactaggtggatcgtggacactagtactttcacttcgacaccatcagtcaacgcccgtgcacgtccgtagaagttactttcgactaacgtttattactgtactaacgtaagtacttaactaacttacccgtacgtaacgttccgaccgaacgggaaccgtaaacgggttacggtaaacggttaactaaaaccgtaaccgtttaggtacggccgttacgaccaaccgttacgtcctttacgg

SEQ ID NO: 79458 - DNA, 579 bp, Homo sapiens
  misc_feature: GYAE6OF02I3S8H.14.11.A11.1.454.CMB.1.raw
  modified_base (366)..(366): a, c, t, g, unknown or other
  misc_feature (366)..(366): n is a, c, g, or t
tcagcgtctagtaccacgaccggtgctcgatttagctacgactgcagggggcaggagtcagacccactcaggacacagcatggacatgagggtccccgctcagctcctggggctcctgctgctctggctcccaggtgccagatgtgccatccaagtgacccagtctccatcctccctgtctgcatctgtaggagacagagtcaccatcacttggccgggcaagtcagttcatagaatgagttaggctggtatcagcagaaaccgagggaaacgccctaagctcctgatctatgctgcgtacctaattacaacgtcgggtaccatacgtaaggtcaacggcggacaggtcggatcgtggcacgagtntttaccactctaccacctatcgagcacgccctaggccacgtccgtagtaagttcttttagaccttaactttattactgttacctaataagtacttaacctaactttacccgtacgtaacgttccggacctaacgggaccgtaaagggtcggtaaacgtaaccgaaaacggtaccgttaggtacggtcgttacgacctaactacttccgttacg

SEQ ID NO: 79459 - DNA, 612 bp, Homo sapiens
  misc_feature: GYAE6OF02JL955.14.11.A11.1.454.CMB.1.raw
  modified_base (222)..(222): a, c, t, g, unknown or other
  misc_feature (222)..(222): n is a, c, g, or t
tcagcgtctagtaccacgaccggtgctcgatttagctacgactgcagggggcgaggagtcagacccactcaggacacagcatggacatgagggtccccgctcagctcctggggctcctgctgctctggctcccaggtgccagatgtgccatccaagtgacccagtctccatcctccctgtctgcatctgtaggagacagagtccaccagtcacttgccgggnaagtcagttcagttagaaatgagttaggctggtatcagcagaaacgagggaacgaccctaaggctcctaggactctaatcgctcgtcgtaccctaatttaccaaaacgttcggggtacccattacgaaaggttccagccggtactaggtacggattcgtggcaacgagtattttaccattaccgtacctacacgttacgaacgctacgacccttacgctaccgacgtacgtaacgttatttcggtactaacgtttacttacgtacttactaacgtacgttaattaacaactttaccctacgtaaccgttacgaacccgtacggaaccgtaagggtacggtaagttaccgaaacgtacgtagtcggatccgacctacgtactagttaccgg

SEQ ID NO: 79460 - DNA, 528 bp, Homo sapiens
  misc_feature: GYAE6OF02IWTAU.14.11.A11.1.454.CMB.1.raw
  modified_base (218)..(218): a, c, t, g, unknown or other
  misc_feature (218)..(218): n is a, c, g, or t
  modified_base (269)..(269): a, c, t, g, unknown or other
  misc_feature (269)..(269): n is a, c, g, or t
  modified_base (325)..(325): a, c, t, g, unknown or other
  misc_feature (325)..(325): n is a, c, g, or t
tcagcgtctagtaccacgaccggtgctcgatttagctacgactgcagggggcgaggagtcagacccactcaggacacagcatggacatgagggtccccgctcagctcctgggctcctgctgctctggctcccaggtgccagatgtgccatccaagtgacccagtctccatcctccctgtctgcatctgtaggagacagagtcaccatcacttgccggnaagtcagttcattagaatgagtagctgtatcagcagaacaggaagccctanctctgatcatgctgcgtcaatttacgaaactcgggtccaatctaacgttcagcganacgtggaatcgtaggcactagtatttcactctacacatcagcagcctgacagcctagtaagtattttcgactaacttaacgttactgttactactaacgtaattacgtaacttaccctaacgtacgttaccgacgtaacggaccgtaacggtaggtaagtaccaaagtaccgtagtacggctacgactaccgtactcgttacg

SEQ ID NO: 79461 - DNA, 527 bp, Homo sapiens
  misc_feature: GYAE6OF02GOHW8.14.11.A11.1.454.CMB.1.raw
  modified_base (278)..(278): a, c, t, g, unknown or other
  misc_feature (278)..(278): n is a, c, g, or t
  modified_base (353)..(353): a, c, t, g, unknown or other
  misc_feature (353)..(353): n is a, c, g, or t
  modified_base (419)..(419): a, c, t, g, unknown or other
  misc_feature (419)..(419): n is a, c, g, or t
  modified_base (500)..(500): a, c, t, g, unknown or other
  misc_feature (500)..(500): n is a, c, g, or t
  modified_base (524)..(524): a, c, t, g, unknown or other
  misc_feature (524)..(524): n is a, c, g, or t
tcagcgtctagtaccacgaccggtgctcgatttagctacgactgcaggggggcaggagtcagacccactcaggacacagcatggacatgagggtccccgctcagctcctggggctcctgctgctctggctcccaggtgccagatgtgccatccaagtgacccagtctccatccctccctgtctgcatctggtaggagacagagtcaccatcacttgccgggcaagtcagttcattagaaatgagttaggctggtatcagcaagaaaccgagggaaacnccctaagcctacctgactctatgctgcgtacctaatttaccgaacgtcgggtaccatacgaaggttcaggcgganaggtggatcgtggcaacgagtactttcactctaccactatcagcacgctgcacgtctagtaagttntttacgactaactttattactcgtactaactaatacttaactaacttacctacgtaacgtcgaccgaggacgaggtagaanacgaacgtagtgcgctgacacatntcg

SEQ ID NO: 79462 - DNA, 573 bp, Homo sapiens
  misc_feature: GYAE6OF02GL160.14.11.A11.1.454.CMB.1.raw
  modified_base (219)..(219): a, c, t, g, unknown or other
  misc_feature (219)..(219): n is a, c, g, or t
tcagcgtctagtaccacgaccggtgctcgatttagctacgactgcagggggcaggagtcagacccactcaggacacagcatggacatgagggtccccgctcagctcctggggctcctgctgctctggctcccaggtgccagatgtgccatccaagtgacccagtctccatcctccctgtctgcatctgtaggagacagagtcaccatcacttgccgggnaagtcagttcattagaaatgagttaggctggtatcagcaagaaaccagggaaacgccctaagctcctgatctatgctgcgtaccaatttacaaacgtcgggtaccatcaaggttcacggcgacgtagtggatcgtaggacaacgtagtactttcacgtctaccacctatacaacgcctacgcctagaccgacgtcccttaggtaacgttactttacgacttaaactttattacgtacgttacttaacgaagttaacttaactaacttaccctacgtaacgttaccgacgtacggacgtaaggtacgtaacgtaccgaaacgtagtcgtacggtctacgactactagtcgttacg

SEQ ID NO: 79463 - DNA, 515 bp, Homo sapiens
  misc_feature: GYAE6OF02GQZHX.14.11.A11.1.454.CMB.1.raw
  modified_base (274)..(274): a, c, t, g, unknown or other
  misc_feature (274)..(274): n is a, c, g, or t
  modified_base (402)..(402): a, c, t, g, unknown or other
  misc_feature (402)..(402): n is a, c, g, or t
tcagcgtctagtaccacgaccggtgctcgatttagctacgactgcagggggcaggagtcagacccactcaggacacagcatggacatgagggtccccgctcagctcctggggctcctgctgctctggctcccaggtgccagatgtgccatccaagtgacccagtctccatcctccctgtctgcatctgtaggagacagagtcaccatcacttgccgggcaagtcagttcattagaaatgagttaggctggtatcagcaagaaaccagggaaacncccctaagctcctgatctatgctgcgtaccaatttacaaacgtcgggtccatacaaggttcagcggcaggtggatcgtggctacgagtatttcactctcaccatcagcagcctgccagcctagaagtntttgactactttattctagtactacaagtattactaacttacctacgtaacgttcggaccgaggacctaagggtcgaagtacgaacgtactggtagacgtgaccactatctcg

SEQ ID NO: 79464 - DNA, 821 bp, Homo sapiens
  misc_feature: GYAE6OF02ILWYE.14.11.A11.1.454.CMB.1.raw
  modified_base (207)..(207): a, c, t, g, unknown or other
  misc_feature (207)..(207): n is a, c, g, or t
  modified_base (219)..(219): a, c, t, g, unknown or other
  misc_feature (219)..(219): n is a, c, g, or t
tcagcgtctagtaccacgaccggtgctcgatttagctacgactgcaggggcaggagtcagacccactcaggacacagcatggacatgagggtcccgctcagctcctgggctcctgctgctctggctcccaggtcgccagatgtgaccatccaagtcgacccagtcctccacttccctcccgtgtctcgactatcgtggtaggagacngacgtccaactntcctatcggcccggtactaacgtctacgttactagttaaagtaagtagtaggttacgtcgttaggtactacgtacggacgaaacgaaccgaaacggggtaaccgtaaccccggttaacggtaaccttccgtaacggtacttacgttaacgtcggtacgttaacggttaccgtaaccgttaaacttttaaacccgaaaccggggtttcccgggtaacccttacgaaccgttaacgggtttaaccgaacgggttccgggaacgtacgggttaacgggtaacgttaccggtacggtaccgtaacgtaacggtttaacctttcgtaaccttaccgtacctaaccggactaccggtacgtacgaccgtacctacggttaccgacgtaccgttaagttaaccgtttaagtttaccgtaacttaacctttaccgttaaccgttacgttaaccggtaacctaaaggttaaactttaaccgtaaaccgtttacccgttaaccgtaaccggtaccggtaccggtaaccgaacggttaacggtaacgtaaagggtaacctaaacgggtacgttaacgtcggtaaccgtcggtaccacgttaccgtacttacgg

SEQ ID NO: 79465 - DNA, 624 bp, Homo sapiens
  misc_feature: GYAE6OF02I5HMX.14.11.A11.1.454.CMB.1.raw
  modified_base (202)..(202): a, c, t, g, unknown or other
  misc_feature (202)..(202): n is a, c, g, or t
  modified_base (205)..(205): a, c, t, g, unknown or other
  misc_feature (205)..(205): n is a, c, g, or t
  modified_base (231)..(231): a, c, t, g, unknown or other
  misc_feature (231)..(231): n is a, c, g, or t
  modified_base (375)..(375): a, c, t, g, unknown or other
  misc_feature (375)..(375): n is a, c, g, or t
  modified_base (380)..(380): a, c, t, g, unknown or other
  misc_feature (380)..(380): n is a, c, g, or t
  modified_base (388)..(388): a, c, t, g, unknown or other
  misc_feature (388)..(388): n is a, c, g, or t
  modified_base (417)..(417): a, c, t, g, unknown or other
  misc_feature (417)..(417): n is a, c, g, or t
  modified_base (439)..(439): a, c, t, g, unknown or other
  misc_feature (439)..(439): n is a, c, g, or t
tcagcgtctagtaccacgaccggtgctcgatttagctacgactgcagggggcaggagtcagacccactcaggacacagcatggacatgagggtcccccgctcagctcctggggctcctgctgctctggctcccaggtcgccagatgtgcccatcccaagtcgacccagtcctccatccctccctgtctgcatctggtagganacngagtccaccatcacgttgcccggganaaacgtcctagttcctaattaacgaaatggtaagtaggtcgttggtatacagacaacgaaaccgagggaaacaccccgtaagcctacctagatacgtatggctgtcgactaattaaccaacgttcgggaccatacgtagtcgancgganacgtgtancgtgcaactgtattctaacgtctacaccnctacacgcgaactcctgcaccngttacgtagtatttcggacttaaccgttatttacctagttacctaacgtaacgtattaaccgtttaacctaacccgttacggtaacccgttacgaccgtacgggaaacctagggtaaaccgggtaactacgaaaaccgttacgtaacggttacggactaccggactaacccgtagttccttaccg

SEQ ID NO: 79466 - DNA, 603 bp, Homo sapiens
  misc_feature: GYAE6OF02H5CI5.14.11.A11.1.454.CMB.1.raw
  modified_base (419)..(419): a, c, t, g, unknown or other
  misc_feature (419)..(419): n is a, c, g, or t
  modified_base (440)..(440): a, c, t, g, unknown or other
  misc_feature (440)..(440): n is a, c, g, or t
tcagcgtctagtaccacgaccggtgctcgatttagctacgactgcagggggcaggagtcagacccactcaggacacagcatggacatgagggtccccgctcagctcctggggctcctgctgctctggctcccaggtgccagatgtgccatccaagtgacccagtctccatcctccctgtctgctatcgtgtaggagacagagtcaccatcacgttggccggacaagtcagttcaattaagaatagtagttaggctggtatcagcaagaaccagggaaacaccctaacgctcctagatctatgctgctacaattaacgaaacgttcggggtaccctagtacgtaacggttacgaggcggacgaggtaggatcgtgacacagtactttacactactctacctatcacgctacgtcctacgnacgacgttgtaattactttanaacttaactacttactacgttactaactaatacttaacctaacgtttacccgtacgtaaccgtttaccgaccggtaacggaaccggtaagggtacggtaaaccgtacgtaaaaccggttaacctgggttacgtaccgtcgaacctcgtaccttagttaacccg

SEQ ID NO: 79467 - DNA, 578 bp, Homo sapiens
  misc_feature: GYAE6OF02F7ASO.14.11.A11.1.454.CMB.1.raw
  modified_base (194)..(194): a, c, t, g, unknown or other
  misc_feature (194)..(194): n is a, c, g, or t
  modified_base (310)..(310): a, c, t, g, unknown or other
  misc_feature (310)..(310): n is a, c, g, or t
tcagcgtctagtaccacgaccggtgctcgatttagctacgactgcagggggcaggagtcagacccactcaggacacagcatggacatgagggtccccgctcagctcctggggctcctgctgctctggctcccaggtgccagatgtgccatccaagtgacccagtctccatcctccctgtctgcatctgtagganacagacgtcaccatccacttcggcccgggcaagtctagttcaattaagaaatgaaggttaggctggtatcagcaagaaaccgagggaaacacccgtaagcctccgtagtactctancgctcgtcgtacctaattaaccgaacgtcgggtacccatacgaacggttcacgcggctaggtggtatcgtggcacgtagtactttcaccgtctaccacatcagcacgtcctcgcacgtctagaagttactttcgacttaactttacttactacgtactaagtaatacttaacctaacttacccgtacgttaaccgtacggaccgtaacggaccgtaaggtaacggaacgtacgaacggtactggtcgacgactaccactacgtcttcg

SEQ ID NO: 79468 - DNA, 533 bp, Homo sapiens
  misc_feature: GYAE6OF02GOGW3.14.11.A11.1.454.CMB.1.raw
  modified_base (406)..(406): a, c, t, g, unknown or other
  misc_feature (406)..(406): n is a, c, g, or t
tcagcgtctagtaccacgaccggtgctcgatttagctacgactgcagggggcaggagtcagacccactcaggacacagcatggacatgagggtccccgctcagctcctggggctcctgctgctctggctcccaggtgccagatgtgccatccaagtgacccagtctccatcctccctgtctgcatctgtaggagacagagtcaccatcacttgccgggcaagtcagttcattagaaatgagttaggctggtatcagcaagaaaccgagggaaacgcccctaagcctcctgatctatgctgcgtacctaatttaccaaacgtcgggtacccatcaaggttcagcggcagtggatctggcacagtactttcactctcaccatcagcagcctgcagtccttagaagttntttgacctaactttattacttgtactactaagtattaactaacttacccgtacgtaaccgttacggaccagggaccaagggtggaacgtacgaaacgtacttgtacggctacgacacctattctacg

SEQ ID NO: 79469 - DNA, 632 bp, Homo sapiens
  misc_feature: GYAE6OF02GIKHX.14.11.A11.1.454.CMB.1.raw
tcagcgtctagtaccacgaccggtgctcgatttagctacgactgcagggggcaggagtcagacccactcaggacacagcatggacatgagggtccccgctcagctcctggggctcctgctgctctggctcccaggtgccagatgtgccatccaagtgacccagtctccatcctcctgtctgcatcgtgtaggagacagagtccaccatcacgttgccgggcaagtcagttcattagaatgagttaggctgtatcagacaaggaaaccaaggggaacacccgtaagcctaccgtgactctagtcgctcgtccgtacctaaatttaccgaaacgttcgggtaccctaagtacgtaacgttcgaggcggcacgggtgactcgcgcacgtagtactttcacttcacctacatcacgcacgcctcgacgacgtcctaggtaattacgtttgaaccttaactttacgttacgtttagtaccttaacgtaaacgttaactttaacctaaacctttaacccggttaccgttaaaccggttcccggtaaaccgtaacgggtaaccggtaagggttaacggtaaccggtaacctaaacgtaacggtgtaggtcctaacggtaacccacgtacgttcgttacg

SEQ ID NO: 79470 - DNA, 642 bp, Homo sapiens
  misc_feature: GYAE6OF02G0G58.14.11.A11.1.454.CMB.1.raw
  modified_base (262)..(262): a, c, t, g, unknown or other
  misc_feature (262)..(262): n is a, c, g, or t
  modified_base (619)..(619): a, c, t, g, unknown or other
  misc_feature (619)..(619): n is a, c, g, or t
tcagcgtctagtaccacgaccggtgctcgatttagctacgactgcaggggggcaggagtcagacccactcaggactacagcatggacatgagggtccccgctcagctcctggggctcctgctgctctggctcccaggtgccagatgtgccatccaagtgacccagtctccactcctccctgtctgcatctgtaggagacagagtccaccatcacgttgccgggacaagtcagttcattagaatgagttaggctggtatcagnaacgaaaccgagggaaacgacccctaagctcctagtactctatcgctcgccgttacctaaatttaaccgaaacgttcggggtacctacgtacgtaacggttcaggtcggtacgagtcggtatacgtggactactagttactttaccacttacctacacctagtacagtaccaggaccttgcccgagtacccgtagtaaccggttatttacggacttaacctttagttactacggttaaccttaaacgagttaaacttaacttaacctttacccgtacggtaacgttaccggaaccgtaggggtaaccctaagggttaacggtaaacgtaaccgtaaacggtacgtacggtaggtacncgtaccgacttacgtcgtttacc

SEQ ID NO: 79471 - DNA, 824 bp, Homo sapiens
  misc_feature: GYAE6OF02IB600.14.11.A11.1.454.CMB.1.raw
  modified_base (138)..(138): a, c, t, g, unknown or other
  misc_feature (138)..(138): n is a, c, g, or t
tcagcgtctagtaccacgaccggtgctcgatttagctacgactgcagggggcaggagtcagacccactcaggacacagcatggacatgacgggtccccgctcagctcctgggctcctgctgctctggctcccgaggtnccagatcgtcgcctatccaagtcgaccctagtcctccactcccgtcctggtctcgctacttcgtggtaacggacgtactaggacggtcaacctacgttacgtaccgttacggccggtactaaagtccgtagtttaccagttaaacggaagtggttacggttaggacgttaggtactacgacggtaaccgaaacggtaaccggaacgggaacctccccgtaaagtcccttaccgtacggtacttacctcgtacgccttaccgggtaccgttaactaaacgttttaaccggaacggttccgggtaaacctaggtacgttaacgggttccgaacggtacgggactagggttacggtaacctcgggtaacgactaaccggttatttaaccgtttccaaccgtactacccgtaacgttacgtaccgacgttacgaaccgttcgaacgtaccgtacggttaaccgtaaagttttacgtttaacggttaccttaaaccgttattaaccgttaccgtacgtttaaccaacgtttaaacgtaaccgtttaacgttaccccgttaacgttacccgggtaaacgtcccgggttaaagtaccgggtaacggttaacggttaacggaaacggttaccgttaaacccgtaggtaccggttacggtcccaaccggtactacccgttaggtactttacccgg

SEQ ID NO: 79472 - DNA, 578 bp, Homo sapiens
  misc_feature: GYAE6OF02GB73U.14.11.A11.1.454.CMB.1.raw
  modified_base (295)..(295): a, c, t, g, unknown or other
  misc_feature (295)..(295): n is a, c, g, or t
  modified_base (378)..(378): a, c, t, g, unknown or other
  misc_feature (378)..(378): n is a, c, g, or t
tcagcgtctagtaccacgaccggtgctcgatttagctacgactgcaggggggcaggagtcagacccactcaggacacagcatggacatgagggtccccgctcagctcctggggctcctgctgctctggctcccaggtgccagatgtgccatccaagtgacccagtcctccatccctccctgtctgcatctgtaggagacagacgtcaaccatccacgttcggcccgggacaagtcagttacaattaagaaatggaggttaggcgttggtatcgagcaagaaaccgaagggaaacnccccgtaagcctacctgactctatcgctggctactaattacaacgtcggtaccagtcgtaagttcaggcgataggtgactcgnggcagtagtactttcactcctacacctatcgacgacgacgccgtagacacgtcctagaagttactttcgaacttactttatactcgtactagaagttacttaacgtaacttacccgacgtaacgtccgaaccggtaacggacgtaagggtaacggaacgtacgaaacgtagtaggtcgactcgactacctagttcttacg

SEQ ID NO: 79473 - DNA, 698 bp, Homo sapiens
  misc_feature: GYAE6OF02IJO0K.14.11.A11.1.454.CMB.1.raw
  modified_base (197)..(197): a, c, t, g, unknown or other
  misc_feature (197)..(197): n is a, c, g, or t
tcagcgtctagtaccacgaccggtgctcgatttagctacgactgcagggggcaggagtcagacccactcaggacacagcaatggacatgagggtccccgctcagctcctggggctcctgctgctctggctcccaggtgccagatgtgccatccaagtgacccagtcctccatcctccctgtctgcatctggtagganacagagtcaccatcacttggccggcaagtcagttcattagaatgagttagctggtatcgagacaagaaaccgagggaaacgaccctaagtcctccgtagtatctatcgctgtaccgtacctaagtttaaccgaaacggttcgggtacctagtacgtaacggttacaacggcggacgtaggtggacgttcgtacggaccaacgtacgttacttttccaccgtttacctaccgaaccctactacgacgccgtaacgtccctacggtaccacgtaccgttaagtaaacggtttacttttacgaacctttaaactttacgttacgttacgtacctaactaaacgttaacttaaccgtaaccgtttaaccccgtacggttaaaccgggttaccgtaaacgggtaaccgggtaacggtaaacgggttaacggtaaacggtaaccgtaaacgggtaaccgttgggttaacgtaccgtccggtaacctaacccgttacttccgttacgg

SEQ ID NO: 79474 - DNA, 546 bp, Homo sapiens
  misc_feature: GYAE6OF02FTX33.14.11.A11.1.454.CMB.1.raw
  modified_base (221)..(221): a, c, t, g, unknown or other
  misc_feature (221)..(221): n is a, c, g, or t
tcagcgtctagtaccacgaccggtgctcgatttagctacgactgcagggggcaggagtcagacccactcaggacacagcagtggacatgagggtcccgctcagctcctggggctcctgctgctctggctcccaggtgccagatgtgccatccaagtgacccagtctccatcctccctgtctgcatctgtaggacacagagttcaccatccacttgccgggnaagtcagttcattagaatgagttaggctggtatcagcagaaacagggaatcccctaagctcctgatctatgctgcgttccaatttacaaacttgggtccatcaaggttcagcgcagtcgatctggcacgagactttcactcacaccatcagcagtcctagcacgtcctagaagttacttttagactaactttattactgtactacgtaagtattaaccaacttaccctacgtaacgttccggtaccgaacgggaccgaagggtcggaacgtaccgaaaccgtaactacggttacggccttacgacctaacctactacgttaccgg

SEQ ID NO: 79475 - DNA, 921 bp, Homo sapiens
  misc_feature: GYAE6OF02JQTBA.14.11.A11.1.454.CMB.1.raw
  modified_base (229)..(229): a, c, t, g, unknown or other
  misc_feature (229)..(229): n is a, c, g, or t
tcagcgtctagtaccacgaccggtgctcgatttagctacgactgcagggggcgaggagtcagacccactcaggacacagcatggacatgagggtccccgctcagctctgggctcctgctgctctggctcccaggtgccagatgtcgccagtccaagtcgacccagtcctccatcctcccgtgtctagctatctgtaggagacagagtccaccatcacgttggcccgggntaaacgtcaggtttcaagtttaagaaatgtaaggttaaggtcttaggtatccaagtccaaacggtaaaccgaaggggtaaacgaccccgtaaagtccctacctaggactccttaatcggccgtcggaccgttaccttaaatttaaccgtaaacggttaccggggttacccaacgttaccgtaaacggtttaccgagaccggggacgttaacggttacgggtaacttccggtaacgggtaacctaaccggtaacggttaaaccttttcccggtaaaccctttacccggttaaccccgtaaaccccttaaacgtttacccggaaacccggtaccgttaaacccggttcccggtaccggtaaccccgtaaccggtaacccgttaaggggttaaaaccgtttaagggttttaaccgtaaccctttaaaacccgttttaccgtttaaaccgtttaccgttaaccgtttaaaacccgtaaagtttaaaccttttaaaaccccgtttaaagttaaacccccccggttttaaagggtaccccgggttttaaaccgaacccccggggaaacgggtttaaacccgggtaaaccgggttacggggttaaaaaccgtaaccggtaaaaacccgggttaacccggtttaggttaaccgggtaccggtcgtaaaccccggaaccttaccggtttaccgtttacccg

SEQ ID NO: 79476 - DNA, 637 bp, Homo sapiens
  misc_feature: GYAE6OF02GB35V.14.11.A11.1.454.CMB.1.raw
  modified_base (377)..(377): a, c, t, g, unknown or other
  misc_feature (377)..(377): n is a, c, g, or t
tcagcgtctagtaccacgaccggtgctcgatttagctacgactgcaggggggcaggagtcagacccactcaggacacagcatggacatgagggtccccgctcagctcctggggctcctgctgctctggctcccaggtgccagatgtgccatccaagtgacccagtctccatcctccctgtctgcatctgtaggagacagatcaccatcacgttcgccgggacaagtcagttacattaagaaatgagttaggctggtatcagacaagaaaccgagggaaaacgtacccctaagcctacctagtactctaagtcgtactgaccgtacctaaatttaaccgaaacgtcggggtaccaagtacgtaaggttcaggcggtanaggtaggagtcgcgacaactagtacttcactctacacatcagctacggctacgcacgtctagtaagttatttcgaacttaacttaacgttactagttactaagtaaacgttaacttaaccgttaaaccttaaccccgtacggtaaacccgggttaccgggaacccgtaaacggggaaccgtaaaggggttacgtaaaacggtacctaaaacggtaacgtagggtacgactaccggtacctaacccggtattccgttaccg

SEQ ID NO: 79477 - DNA, 728 bp, Homo sapiens
  misc_feature: GYAE6OF02G9I1E.14.11.A11.1.454.CMB.1.raw
  modified_base (197)..(197): a, c, t, g, unknown or other
  misc_feature (197)..(197): n is a, c, g, or t
tcagcgtctagtaccacgaccggtgctcgatttagctacgactgcagggggcaggagtcagacccactcaggacacagcatggacatgagggtccccgctcagctcctggggctcctgctgctctggctcccaggtgccagatgtgccatccaagtcgacccagtcctccatcctccctgtctgctatctgtagganacagagtccacctatccacgttcggcccgggactaacgttcacgtttcaattagaaatggtagttaggtcttaggtatacgagacaaggaaaccgaaggggaaaaccgaccccgtaagtccctacctagtactctagtcgtctcgtaccgttacctaaactttaaccgaaacggttccggggtaccctacgtacgtaaggttccgaggcggacgtaggtcggtactcgtaggacactacgtactttacactcctaccacctacgtacgacgtccgacgtcccgtacgaccgtaccgtaccgttaaggtaacgtttacgttttacggaacctttaatttaacctttaacgttaccgttaaccgtaacgtaaggttaacccgttaacccgtaccccgttaacccccgttacgttaacccggtttaccggggaaccgggtacgggtaacccggaacggggtaccggtaacgttaccgtaacggacgtaacccggtaggttaccggtacggtccgtaccgtacgtacccttacgg

SEQ ID NO: 79478 - DNA, 630 bp, Homo sapiens
  misc_feature: GYAE6OF02HBT1M.14.11.A11.1.454.CMB.1.raw
  modified_base (195)..(195): a, c, t, g, unknown or other
  misc_feature (195)..(195): n is a, c, g, or t
  modified_base (377)..(377): a, c, t, g, unknown or other
  misc_feature (377)..(377): n is a, c, g, or t
  modified_base (414)..(414): a, c, t, g, unknown or other
  misc_feature (414)..(414): n is a, c, g, or t
  modified_base (427)..(427): a, c, t, g, unknown or other
  misc_feature (427)..(427): n is a, c, g, or t
tcagcgtctagtaccacgaccggtgctcgatttagctacgactgcagggggcaggagtcagacccactcaggacacagcatggacatgagggtccccgctcagctcctggggctcctgctgctctggctcccaggtgccagatgtgccatccaagtcgacccagtctccatcctccctgtctgcatctgtaggancagagtccaccatcgacttgccgggacaagtcagttcattagaatgtattaggctaggtatacgacgacgaaggaaaccgaaggggaaacgtaccccgtaatccgtaccttacggtactctaatcggcttcgaccgtacttaacttaacgaacgtcgggtaccagttacaaggttcaggcgnagtggatcgtggacatacgtatttcactcctcgaacncgttacagtaccngaccgtgcgtacacgttacgtaagttcgtttaccgtactaacttttaatccgtttataacccgtaataacttaaacttataaccctttaaaccccgtaggttaacccttaccgggtacctaaacggggacccggtaaggttccggtaaacggactaaaaccggacgttagttcggacgttacccaggtaccacgttattccgg

SEQ ID NO: 79479 - DNA, 625 bp, Homo sapiens
  misc_feature: GYAE6OF02GTISF.14.11.A11.1.454.CMB.1.raw
  modified_base (221)..(221): a, c, t, g, unknown or other
  misc_feature (221)..(221): n is a, c, g, or t
tcagcgtctagtaccacgaccggtgctcgatttagctacgactgcagggggcaggagtcagacccactcaggacacagcatggacatgagggtccccgctcagctcctggggctcctgctgctctggctcccgaggtgccagatgtgccatccaagtgacccagtctccatcctccctgtctgcatctgtaggagacagagtcaccatcacgttgccgggnaagtcagttcattagaaatgagttaggctggtatcagacaagaaaaccagggaaagacccctaagctacctagatctatagctgtcgtactaattaacaaacgtcgggtccatacgaaggttcaggcgactagtagatcgtggacacgagtactttcactctacaccatcaagcacgtcctgccgacgtcttagaaagttattttacgaacttaaccgtttaattacgtacgttaacttaacgtaaagtatttaacctaaactttaaccccgttaacggtaaaccgtttaccgggtaacccgtaacggggtaacccgtaaaggggtaacggtaaaacggttacccgaaaacggttaacgttacggttacggacggttacgacccgtaacctactccgtttaccg

SEQ ID NO: 79480 - DNA, 647 bp, Homo sapiens
  misc_feature: GYAE6OF02HQ2MO.14.11.A11.1.454.CMB.1.raw
tcagcgtctagtaccacgaccggtgctcgatttagctacgactgcagggggcaggagtcagacccactcaggacacagcatggacatgagggtccccgctcagctcctggggctcctgctgctctggctcccaggtgccagatgtgccatccaagtgacccagtcctccatccctccctgtctgcatctgtaggagacagacgtcaccatcacgttcggccgggacaagtcagttacattaagaaatgagttaggctggtatcagcaacgaaaccgaagggaacgcccctaagcctcctgactctatgctgtcgtactaattaccaaacgttcgggtacccagtacgtaagttcgaggcggacgacgtggatcgtaggtacaacgtacgtatttaccacctctaccactataccagccaacgtccgtcgaccacggtaccgtaagtaagtacgtttttacgaccttaacttttaaccttagttaccgttacctaaacgtaagttaaccttaacgtaaacctttacccgtaacgttaaaccggttaccggaaccggtaacgggaaccgtaaacggggtaacggtaaacggtaaccgtaaaccggtaacgtggtaccggtacgtacgtaccgaaccgtacttcttaccg

SEQ ID NO: 79481 - DNA, 547 bp, Homo sapiens
  misc_feature: GYAE6OF02FY4Z8.14.11.A11.1.454.CMB.1.raw
  modified_base (346)..(346): a, c, t, g, unknown or other
  misc_feature (346)..(346): n is a, c, g, or t
  modified_base (360)..(360): a, c, t, g, unknown or other
  misc_feature (360)..(360): n is a, c, g, or t
  modified_base (383)..(383): a, c, t, g, unknown or other
  misc_feature (383)..(383): n is a, c, g, or t
  modified_base (386)..(386): a, c, t, g, unknown or other
  misc_feature (386)..(386): n is a, c, g, or t
  modified_base (390)..(390): a, c, t, g, unknown or other
  misc_feature (390)..(390): n is a, c, g, or t
tcagcgtctagtaccacgaccggtgctcgatttagctacgactgcagggggcaggagtcagacccactcaggacacagcatggacatgagggtccccgctcagctcctggggctcctgctgctctggctcccaggtgccagatgtgccatccaagtcgacccagtctccatcctccctgtctgcatctgtaggagacagagtcaccatcacttgccggcaagtcagttcattagaaatgagttaggctaggtatcagcaagaaaccgagggaaacgccctaagctctagatctatgctgcctactaattacgaaacgtgggtcccatacgaacggttcaagcgganagtgatctggacanagtactttcactctacacatcancancctncgacgcctagaatgtttacgactaatttactactgtactacgaatacttacaacttacccgacgtaacgttacgtacccgaaggtacccgtaagggtaacggaaagtaaccgtaaacgacttacggtaggtcctaacgactacccgtaagtcttacg

SEQ ID NO: 79482 - DNA, 1057 bp, Homo sapiens
  misc_feature: GYAE6OF02HPZMV.14.11.A11.1.454.CMB.1.raw
tcagcgtctagtaccacgaccggtgctcgattttagctacgactgcaggggggcaggagtcagacccactcaggacacagcatggacatgagggtccccgctcagctcctggggctcctgctgctctggcctcccgaggtcgccagatgtcgccactccaaggtcgacccagtccgtccacttccctccctgtctgcctatccgtaggtacggagacgtaggacgtaccacctagttacctacggttccgggacccgggacgtaaccgttaccgtaaggtttacctaaaggttttaaacggaaaacgtttcgggtaacggtttaacgggtcgtttaaacgggttaaacggttacgtaaaccggtaacccgtaaaaacggggttaaaaacccccggaaaacggggggtaaaaaaccccggttaaaccccccgttaaaccggtttacccccggttaacccggtttacccgtaaacggttttaccccttaagtccgggttacccgtttaccgggttaccccggttaaaacccgttttaaaacggtttttaaaaccccggtaaaacggggtttccccggggggtaaacccctttaaagggtttaaaccccgtaacgggggttttcccgaaaccggggttccgggtacgggtttaaacggtacggggtacctttccggtaaccggtacccgtaaacgggttactttaaccgttttccccggaaccctttcctaaccccgtaacccgttacgtaaccgggtacccgtaccgaaccgttaccgtcgtacccggaaccgttaacccgttaacggttacgttttaaacgttttaccgtaaacccgttttaacttttaaccgtttaacgttaaccgttaactttaaaccgttaacggttaaacctttaaaccggtttaacccgttttaaccccggtaaaccggtttaacccggtacccgggttaaaccggggtacggtaacccgggtaaggttaacggtaaccggttaacgtaaccggttacgtaggggttcgaccgtaccgtaccctacgtacgttccgttaaccg

SEQ ID NO: 79483 - DNA, 707 bp, Homo sapiens
  misc_feature: GYAE6OF02IHLBM.14.11.A11.1.454.CMB.1.raw
  modified_base (195)..(195): a, c, t, g, unknown or other
  misc_feature (195)..(195): n is a, c, g, or t
  modified_base (670)..(670): a, c, t, g, unknown or other
  misc_feature (670)..(670): n is a, c, g, or t
  modified_base (687)..(687): a, c, t, g, unknown or other
  misc_feature (687)..(687): n is a, c, g, or t
tcagcgtctagtaccacgaccggtgctcgatttagctacgactgcaggggggcaggagtcagacccactcaggacacagcatggacatgagggtccccgctcagctcctggggctcctgctgctctggctcccaggtgccagatgtgccatccaagtgacccagtctccatcctccctgtctgcatctgtagganacagatccaccatctacttggccggactaagtctagttcaattaagaatggtagttaggtctaggtatcgagacaagaaaccgaaggggaaaccgtaccctaacgtccttccgtagtactaccttatcgtacgttcgaccgttaacctaaagtttaaccgtaaacggttccgggtacccctaagttaccgtaaacggttcgtaacgggccggtacggtaaggttacggacgttaccgtaggaccgtaaacgtacgttaccttttaccgtaacccgttaccgtacctaaacccttacgtacgtaaacgccgtaaccgtaccgtacgtaccggtaacgtcccggttaaggtaaacgtttacgtttacttaaactttaacttacgtttaccttacggttaactaacgtaagttaacttaaccgtaacctttaccgtacgtaaccgtcgggaaccgtaacggacgtaacgtggtaaacncgtaacgaactggtacncgtcacgtactacgtcttcg

SEQ ID NO: 79484 - DNA, 741 bp, Homo sapiens
  misc_feature: GYAE6OF02IKQX3.14.11.A11.1.454.CMB.1.raw
  modified_base (170)..(170): a, c, t, g, unknown or other
  misc_feature (170)..(170): n is a, c, g, or t
tcagcgtctagtaccacgaccggtgctcgatttagctacgactgcagggggcaggagtcagaccccactcaggacacagcatggacatggagggtcccccgctcagctcctgggctcctgctgctcgtggcctcccgaggtgccagatgtcgccatccgaagtcgacccngtctccatccctcctgtctgctatcgtaggtaggacgacagacgtaccacctacgtcctacgttcgggacccgggacgtacgtctagttacaagttaagaagttggtaaggttaggcttaggtatacgagacgaacgaaaccgaacggaacccgtacccgtaagcctaccgttgacttaccgtagtcgtcctcggtacctaaccgttaactttaaccgaaccggtcgggttaccacgttaacgagggttacgacgggtccggtagtacggtaggtacgtcggtaacgaccgtaaagtcgttaacttcccgtaactccgtaacctacctacgtacgacgacgtacgtccgtacgaccgtaacgtaccgttaacgttacgtttaacgttacgtaactttaaacctttactttaccgtacgttaacgttaactaagttaacctttaactaccgttaacccgtaaccggttaaccggtaaccggtaccggaaccgggtaacggtacgggtaacggtaaccgtacggtaaacgtacggtaacggtcgaccgtcgtaaccgaccgttactcgttacg

SEQ ID NO: 79485 - DNA, 711 bp, Homo sapiens
  misc_feature: GYAE6OF02GE45F.14.11.A11.1.454.CMB.1.raw
  modified_base (183)..(183): a, c, t, g, unknown or other
  misc_feature (183)..(183): n is a, c, g, or t
  modified_base (253)..(253): a, c, t, g, unknown or other
  misc_feature (253)..(253): n is a, c, g, or t
  modified_base (263)..(263): a, c, t, g, unknown or other
  misc_feature (263)..(263): n is a, c, g, or t
  modified_base (278)..(278): a, c, t, g, unknown or other
  misc_feature (278)..(278): n is a, c, g, or t
  modified_base (307)..(307): a, c, t, g, unknown or other
  misc_feature (307)..(307): n is a, c, g, or t
tcagcgtctagtaccacgaccggtgctcgatttagctacgactgcaggggggcaggagtcagacccactcaggacacagcatggacatgagggtccccgctcagctcctggggctcctgctgctctggctcccaggtgccagatgtgccatccaagtgacccagtctccatccctccctgtcngcatctgaggagacagagtccaccatcacgttcgccgggacaagtcagttcaattagaaatgtagtaggntggtatcagnacgaacagggaaacncccgtaagcctccgtagactacttatcgntacgcctacctaatttaacaacgtcggggtacccagtaccgaaggttcgacggcggcgtacggtggaacttgtacggcaacgtcgtactttactacctactacccactaactaccgacggacacgtcccgtacgaccgacgtacccgttaaagaaacggtttcttttaacgaaccgtttaaaccttttaacgttaccttacggttaacctaacgtaaattaaaccgtttaacctaaacccgtttaaccccgtaacggttaaacccggttcccggtaacccgggtaaccgggtaaccggtaacggggttaaccggtaaaacggttaacccggaaaaccggttaacccgttacgggtacggttacggtacccgtaccgtaaacccttgttacccgtttaacccggg

SEQ ID NO: 79486 - DNA, 783 bp, Homo sapiens
  misc_feature: GYAE6OF02IZT3N.14.11.A11.1.454.CMB.1.raw
  modified_base (579)..(579): a, c, t, g, unknown or other
  misc_feature (579)..(579): n is a, c, g, or t
  modified_base (585)..(585): a, c, t, g, unknown or other
  misc_feature (585)..(585): n is a, c, g, or t
  modified_base (774)..(774): a, c, t, g, unknown or other
  misc_feature (774)..(774): n is a, c, g, or t
tcagcgtctagtaccacgaccggtgctcgatttagctacgactgcagggggcaggagtcagacccactcaggacacagcatggacatgaggtccccgctcagctcctggggctcctgctgctctggctcccaggtcgccagatgtcgacctatcccaaggtcacccagtctccactcccgtccctgtctggactatccgttgtacggataccgagtacgtccaaccattaccacgttcgggacccgggactaaggtcctacggtttaccaagtttacgaaaagttcggtacggttaacggtcgttagggtactacgtacggacctaaacggaaacccggaacggggtaaacccgtacccccgtaaggtaccccttcgttacgttacgttaccgtaacgtttcggccgttacggttacccttaaccgtttaaacgttttacccgaaacgggtttccgggtaacccctaggtaccggttaaacggttcgacggggttaccgacgtagggttacggtacgttacggtacggaccgtaagtacggttactttacgacctttccactaccgtactcgtacgacncgtacncgtaccgacgtctaagtctacttttacgacttattccgttagtcgttaaccctataaactttacgttaaaacccttcccgttaacccgtacggttaaaccgtcccgtaacggtaacggtacgtaacggggtaacgtaacgtaaccgaaaggtacgtttcgggacggtacttaccgaccgtaaccgtttntaccttcgg

SEQ ID NO: 79487 - DNA, 745 bp, Homo sapiens
  misc_feature: GYAE6OF02HMMN3.14.11.A11.1.454.CMB.1.raw
  modified_base (150)..(150): a, c, t, g, unknown or other
  misc_feature (150)..(150): n is a, c, g, or t
  modified_base (237)..(237): a, c, t, g, unknown or other
  misc_feature (237)..(237): n is a, c, g, or t
tcagcgtctagtaccacgaccggtgctcgatttagctacgactgcagggggcgaggagtcagacccactcaggacacagcatggacatgagggtccccgctcagctctggggctcctgctgctctggctcccgaggtgccaggacttggngccagtccaaggtcgaccccagtcctccacttccctccgtgtcctgacctattctaggtaacgggacgacgagacgtcacctaactntacgttcgggccgggtataaacgtccgtagttactaagttaaggaaataggtacggttaacggtcgttagggtacttacgaggacgaacgaaaacgggaacggaaaccacccggtaacgtaccttaccgacgtaatctaacgtcgcgttaggacctactaaactttaaccgaaacggtccgggtacctaagtaccgtaaggttacgaggcgacgtaggtaggtacgtcgtacggaactcggtaacgttcttaccgtactcctacgtactaacgtacaacggtccgtaacgccgttacgacgtacgtccgttaagaaccgtttagttaaccgtacgttaactttacgttacgacgtttaaacggactaaacgttaacttaaacccttacgtttaaccccgtacggtaaacccggtccgttaaccggggaaccgtaacgtaaggggaacgtaaacggtactaaacgtaacgacggtacggtcgtcggacccgttaactcgtacgttaccg

SEQ ID NO: 79488 - DNA, 735 bp, Homo sapiens
  misc_feature: GYAE6OF02H4UXJ.14.11.A11.1.454.CMB.1.raw
  modified_base (99)..(99): a, c, t, g, unknown or other
  misc_feature (99)..(99): n is a, c, g, or t
  modified_base (123)..(123): a, c, t, g, unknown or other
  misc_feature (123)..(123): n is a, c, g, or t
  modified_base (195)..(195): a, c, t, g, unknown or other
  misc_feature (195)..(195): n is a, c, g, or t
  modified_base (197)..(197): a, c, t, g, unknown or other
  misc_feature (197)..(197): n is a, c, g, or t
  modified_base (286)..(286): a, c, t, g, unknown or other
  misc_feature (286)..(286): n is a, c, g, or t
tcagcgtctagtaccacgaccggtgctcgatttagctacgactgcagggggcaggagtcagacccactcaggacacagcatggacatgagggtccccgntcagctcctggggctctgctgctntggctcccaggtgccagatgtgccatccaagtgacccagtctccatccctcctgtctgctatcgtgtaggananaggatcaccatctacgtggacccggacaagttcagttcaagttagaaatgtagttaggctaggtatcagacgaacgaacgagggaaacnccctaagctacgtgtatacctatgtcctcggccgtttaactaaacgttttaaccgaaaaccggttcggggtaccctaacgttacggtaaacggttcgtaacgggtaccggaccggttaggttacggtaaccttaccgggttacggaaccctaaggttaaccgtttacggttttaaccgtaacccttaccgtaacccctaaacctacgttaccgaacgtaccgttacgccgttagccctaacgtacgttaaccggttaatttacgtttacgaacttagttaacttaccgttagtaaccgtaactaaagtttacctaaaccgttaacctttaacccgaacggttaaccgttccgggaaacgtaccgggtaacgtaagggtaacgttaaccgtaaccggtaaacgtacgtacgggttcgattcccgggaatacccttaggtacctttaaccg

SEQ ID NO: 79489 - DNA, 876 bp, Homo sapiens
  misc_feature: GYAE6OF02HHL7X.14.11.A11.1.454.CMB.1.raw
  modified_base (100)..(100): a, c, t, g, unknown or other
  misc_feature (100)..(100): n is a, c, g, or t
  modified_base (220)..(220): a, c, t, g, unknown or other
  misc_feature (220)..(220): n is a, c, g, or t
tcagcgtctagtaccacgaccggtgctcgatttagctacgactgcagggggcaggagtcagacccactcaggacacagcatgggacatgagggtccccgntcagctcctgggctccgtgctggctctggcctccaggtgccagatgtgccatccaagtgacccagtctccatcctccctgtctgcatctgtaggagacagagtcaccatcacttgccggnaagtcagttcattagaatgtagttaggctaggtagtacgagcaacgaaaccgagggaaacgcccctaagcctcctagactctatgcgtacgtccgtacctaatttaccaaaccgttcgggtacccaacgtaccgtaacggttccgaacggtaccggaccgtaacggttcgggaacttccggtacgggaccgtaacgtaacggttaactttttaccgaaccgtttaccgttaaccgaaccgtaaacttacccggaaacggtccgtaaacgggtcccctacgggtacccgtaacgggtacccgttaacgggtaaaacggttacgtttttaccgggtaacccgttaaaacccgtttttacgtttaacccgtttacggttacccttaaaccgtaaaacgggtttaaacccttttaaaccgttaaaacccgttttaacccccggttaaacccgggttaaacccggttttacccggggtaaacccccgttaaacggggggtaacccccgttaaaacggggggtttaaccggggtaaaaccgggtttaaacccggtaaaaaccccgggttaaacgggtttaccgggttaacccgggggttaaccgttacccggggtaaccccggttaaaccccggttaacggtttaccccgtttaaacccggg

SEQ ID NO: 79490 - DNA, 789 bp, Homo sapiens
  misc_feature: GYAE6OF02I4Q56.14.11.A11.1.454.CMB.1.raw
tcagcgtctagtaccacgaccggtgctcgatttagctacgactgcagggggcaggagtcagaccccactcaggacacagcatggacatgagggtccccgctcagctcctgggctcctgctgctctggctcccagtgccagatgtgccatccaagtcgacccagtcctaccactcccctcccgttgtctgcatccgttgtaggagaccagactcaccatcctacgttggcccggactaacgtcacgttcaattaacggtaaatggtaaggttacgtcgtaggttaagtcctagaccgaacggtaaaacggaacggggaaaccctaccccgtaagtccctaccgtacggtaacttaccgttaagtcggtcgttcgtaccgtacccttaaagtttaaccgaaaccggttccgggtaccctaacggttacgtaacggttacgacgggaccggacgtacgttacggtactcggttacgaccgtacgtaacgtttaccgtttcctaaccgttcccttacgtaacccctaagtaccgtgaccgtaaccgtctaccgggaccctccggaaccggttataacggtttacttaaccgtctttaaccctttatttaccgttacttaaccgtaacgtaaagttaccttaaaccgttaacctttaaccgttaccggttaaaggtaacccggtaccggaaagggttaacccgaagggtttaacggtaccggtaaaccgttaaaccggttcggtaacggttcgaaccggttcctaacccgtaccgttacgttaccgttacccgg

SEQ ID NO: 79491 - DNA, 894 bp, Homo sapiens
  misc_feature: GYAE6OF02G3ZWE.14.11.A11.1.454.CMB.1.raw
tcagcgtctagtaccacgaccggtgctcgatttagctacgactgcaggggggcaggagtcagacccactcaggacacagcatggacatgagggtccccgctcagctcctggggctcctgctgctctggctcccaggtgccagatgtgccatccaagtgacccagtctccactccctccctgtctgcatctggtaggacacgagagtaccaccataccacgttcgggcccgggactaacgtctaggttctaagttaagaaacgttggtaaggttacgggcgttaggtactacacgtacgaaacggaaaaccggacgggaaacgtcccctaaaggcccttacccgagtactaccgttagtaccggtcgttaccggaccgttaaccttaaacgttttaaacccggaaaccggggtttccggggtaaccccttaaggttaacccggtaaagggtttaccgaacggggtccgggtaacgtaacgggttacgggtaaccgttccggtaacggggtacccttaaacggtaacgtttaccttttaaccctacccgttacccttaccaacccgtacgttaacccggacgtaacccgtaccgtccggtaaccggtcctaaccgggtaccgttaaggtaaccgttttaacgtttccgtaaaccggtttaaccttttaagtttccgttaacgttaaccggttaaacctaaagtttaaaccgttttaaacccttaacccgttttaacccggtaaacccgggttaaaccgggttacccgggtaaaccggttaacccggggtaacgtaaacggggtacgggtaaaacgttaacccgggtaaacggttaaccggttcgggtaaccggtaccgttacggtaacccgtacccgttagttaaccggtttcccg

SEQ ID NO: 79492 - DNA, 774 bp, Homo sapiens
  misc_feature: GYAE6OF02GHBP7.14.11.A11.1.454.CMB.1.raw
  modified_base (99)..(99): a, c, t, g, unknown or other
  misc_feature (99)..(99): n is a, c, g, or t
  modified_base (123)..(123): a, c, t, g, unknown or other
  misc_feature (123)..(123): n is a, c, g, or t
  modified_base (261)..(261): a, c, t, g, unknown or other
  misc_feature (261)..(261): n is a, c, g, or t
tcagcgtctagtaccacgaccggtgctcgatttagctacgactgcagggggcaggagtcagacccactcaggacacagcatggacatgagggtccccgntcagctcctgggctcctgctgctntggctcccaggtgccagatgtgccatccaagtgacccagtcctccatccctccctgtctgctatctggtaggagacagataccaccatccacgttcggccgggactaagtctagttacagttaagaatgtagttaggntaggtatcgacgacgaaacgaaaccgagggaaaccgtacccgtaagtcctaccgtagtattacgtagtacgcgttacgtaccgttaaccttaaacgttaaacgtaaccggtaccggggtaccctaacgttaaccgtaacgggttacgacggtaccggtacgtacgggtaggtactaccgggtacggtaccaacgttacggttacctttacctacccttacctacccgtacctaacgtacccgtacgtaccgtaccggacgtaccggaccgtaaccggtacgttaacggtacgtttacgtttaccgtaaaccttactttaaccgttacgttaccgtaaccttaacgtaaaccgttaacctttaaccttaacccgttaaaccccgtttaccgggtaaacccgttaccggtaaccgggtaacgggttaacggtaacgggtaacggtaaaccgtaaccggtaaacggtaacgtagggttaccgacggtaccggtaccaccttacgtacgtttacccg

SEQ ID NO: 79493 - DNA, 621 bp, Homo sapiens
  misc_feature: GYAE6OF02H06AG.14.11.A11.1.454.CMB.1.raw
  modified_base (196)..(196): a, c, t, g, unknown or other
  misc_feature (196)..(196): n is a, c, g, or t
  modified_base (610)..(610): a, c, t, g, unknown or other
  misc_feature (610)..(610): n is a, c, g, or t
tcagcgtctagtaccacgaccggtgctcgatttagctacgactgcaggggggcaggagtcagacccactcaggacacagcatggacatgagggtccccgctcagctcctggggctcctgctgctctggctcccaggtgccagatgtgccatccaagtgacccagtctccatccctccctgtctgcatctgtagganacagagtcaccatcacgttcggccggactaagtcagttactaattaagaaatgagttaggcgtaggtatcgaagcgaagaaaccgaagggaaacgccctaagctacctagatctatgctcgcgtacctaattaacaacgtcgggtaccagtacgaaggttcagcgcaggtagatctgcagtagtatttcacttcacgactatacagcacgtacctgacctacgtaccgttaggtaacttacgtttcgaacttaactttaatttacgttagtacctaacgtaaaggtaactttaacgttaaacctttaaccccggtacgttaaaccggttccggaacccgaacgggtaccgtaaaggggacggttaaaccaacggtaaaacgtaacgtggtaaccgcgttacgacccaaccgttntaccgttaacg

SEQ ID NO: 79494 - DNA, 646 bp, Homo sapiens
  misc_feature: GYAE6OF02FWX1H.14.11.A11.1.454.CMB.1.raw
  modified_base (638)..(638): a, c, t, g, unknown or other
  misc_feature (638)..(638): n is a, c, g, or t
tcagcgtctagtaccacgaccggtgctcgatttagctacgactgcagggggcaggagtcagacccactcaggacacagcatggacatgagggtccccgctcagctcctggggctcctgctgctctggctcccaggtgccagatgtgccatccaagtcgacccagtctccatccctcctgtctgcatcgtagtaggagacgagacgtccaccatctacgtcggccggacaagtctagttcagttaataacgtgaagtaggctagtactcgacgacaacgtaacgaggaacgacccgtaagtcctacgtagtacttctagtcgcgtacgtaccgttactaacgttacgaacggtccgggtacctagtacgtaagtcgacggtcggagtaggtagacgtcgtacgactaacgtactactttaccacttcctacctacactcgaacgtcgtaccgtaccgtaccggactacggtaccgttaaggttaacgtttaacgtttaccgtaacttaacgtttaccgttacgtaacgtactaacgtaacgtacgttaacctacccgtaccctcgtacgtaccgggacggacgtacggtacggacgtagtacgtacgaacgttacggtacgtcggtcgtactcggtacnccgttacg

SEQ ID NO: 79495 - DNA, 668 bp, Homo sapiens
  misc_feature: GYAE6OF02II8KT.14.11.A11.1.454.CMB.1.raw
  modified_base (425)..(425): a, c, t, g, unknown or other
  misc_feature (425)..(425): n is a, c, g, or t
  modified_base (646)..(646): a, c, t, g, unknown or other
  misc_feature (646)..(646): n is a, c, g, or t
tcagcgtctagtaccacgaccggtgctcgatttagctacgactgcagggggcaggagtcagacccactcaggacacagcatggacatgagggtccccgctcagcgtcctgggctcctgctgctctggctcccaggtcgccagatgtcgaccataccaagtcgacccagtcctaccacttccgtccctgtcctgctactcgtagtaggagacagactcacatcacgtggcccggacaagtccagttcaattagaaatggtaagttaggcttggatcgagacaacgaaaacgacgggaacctacccgtagccttacgtatacgcttagcttcgactacgtacctaatttaaaccgacgttccggtacagtacagttcaggccgagtagagtatcgacgtacaacgtcgtttactaccgtacttaccncgtaacgtcaaccgacgtacgtacgttcagaacccgtcgttaacgaagtttaacccttgtttaaccgtaaactttcgtttaacgttacgttacgaaataaacccgttagtaaccttaacgttaaccccgttaagaaccggttaaccggtaccgaaccggaaggttacggtaacggaacgttaaacggaaccgtaacgttacggtcgacgttacggtaaccnccgttaaccgtgttaacttccg

SEQ ID NO: 79496 - DNA, 531 bp, Homo sapiens
  misc_feature: GYAE6OF02HXACA.14.11.A11.1.454.CMB.1.raw
  modified_base (185)..(185): a, c, t, g, unknown or other
  misc_feature (185)..(185): n is a, c, g, or t
  modified_base (229)..(229): a, c, t, g, unknown or other
  misc_feature (229)..(229): n is a, c, g, or t
  modified_base (268)..(268): a, c, t, g, unknown or other
  misc_feature (268)..(268): n is a, c, g, or t
  modified_base (307)..(307): a, c, t, g, unknown or other
  misc_feature (307)..(307): n is a, c, g, or t
  modified_base (387)..(387): a, c, t, g, unknown or other
  misc_feature (387)..(387): n is a, c, g, or t
  modified_base (500)..(507): a, c, t, g, unknown or other
  misc_feature (500)..(507): n is a, c, g, or t
  modified_base (509)..(516): a, c, t, g, unknown or other
  misc_feature (509)..(516): n is a, c, g, or t
  modified_base (518)..(531): a, c, t, g, unknown or other
  misc_feature (518)..(531): n is a, c, g, or t
tcagcgtctagtaccacgaccggtgctcgattttagctacgactgcagggaaggggctagagtgggtctcatctattagtagtagaagtagttacatatactacgcagactcagtgaaggggccggttcaccatctccagagacaacgccaagaactcactgtatctgcaaatgaacagctgagngccgaggacacggctatatattactgtgcgagaggaagggaaanaaagattattttgacttggttatatcaataatgtatttnatatcgtgggaccaagggacgaacggtaccgacccgttntcttacacgtccctacccgacgaaccggcccgtacttccggtacccttcccccgtaggcccctacccctcctaccagacnccaccgtcgtggggccagacggccgccgtcgggctcggcctgggcgaaggtaccttcgttaccgtactcgtaccgctggacggcggcgtaggacgacgggccacgacgtgctnnnnnnnngnnnnnnnngnnnnnnnnnnnnnn

SEQ ID NO: 79497 - DNA, 878 bp, Homo sapiens
  misc_feature: GYAE6OF01B42K9.1.51.E07.1.454.CMB.1.raw
tcagacgagtgcgtcacgaccggtgctcgatttagcatactctacaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagccgtggggccctcgagtgtagtcggtcctccgtgcgtagtcgtccgtttcgttacggttactacgttttcccttttaccccgtaaccggtttaacggttaagttaggtttaaggtttttcgggttaaggaacggtaaccggacccccggggtacccccggggaggggtacggggttcgttaggggagggttacgggtagggtagggtaggtacggtcgtaccgtaaccggttaaccccggttaaaacggtaaaaacctaaaaacggaagtaaggttacggtaagggaaacggtaaggttaaccggttacggaacgggacgtaacggtacgtacgtacgtacgtaccgtaacccggaccggaccggtaaccaaggtaaccccgtaccgaacggtaaccgaaccgtaaccgttacctaaagtaccggtaacgggtaacggtacgggaccggtaacgtccctaacggaaggttccgttacgaccggaaccgtaccgtacccggaccttttaacgttttacgtacccggcggtaaccgggagtaaacggtagtttaaacgtttcggtaccggtaaccgttcccgggtttacggggtcccttaacggggtacccgttaaaacccggtttaaccccggaggttttccggggtttaagggggcccggtaacccggg

SEQ ID NO: 79498 - DNA, 706 bp, Homo sapiens
  misc_feature: GYAE6OF01BEEC8.1.51.E07.1.454.CMB.1.raw
tcagacgagtgcgtcacgaccggtgctcgatttagcatactctacaacacacaaaggggacccaaaaaccacacccctccttgggagaatcccctagatcacagctcctcaccatggacgggacctggagcatccttttcttggtggcagcagcaacgaggtgcccactcccaggttcacctggtgcagtctggagctgagctgcagacgccgtggggcctcgagtcgatggtctccgtgctagtgtcttgtcggttactattccttttcccaccgttacggtatagtaagtttggttgacgtacgaccgggcccccggagggacgggggtcgttaggaggtggacggtggggtagtgggtacgtcgacggttaccccgtttaaccgggaaaacctaaaaccgaggtaacggttaacgtagggtaacgggtaaaggtaacggttaccggacggggtacaacggtagtactacgtaccgacgtaccggaacccggtacgggaaccaccgaactcccggaacggtacgtacgaccgaccctaagactagggtactacgggacgtacgccgtacgagactcgtacggaaccgaccgaccggtacctactttacgtacgtacgccggtagagtacgtagtttacgtcgtacgtaccgtcggttccgtacgtacgtaccgtacccgtacgttacgtgggtcggtacccggg

SEQ ID NO: 79499 - DNA, 559 bp, Homo sapiens
  misc_feature: GYAE6OF01BSRXI.36.29.C07.1.454.CMB.1.raw
  modified_base (439)..(439): a, c, t, g, unknown or other
  misc_feature (439)..(439): n is a, c, g, or t
  modified_base (510)..(510): a, c, t, g, unknown or other
  misc_feature (510)..(510): n is a, c, g, or t
tcagtacgctgtctcacgaccggtgctcgatttagagtgctacgaagggaaagggtctgcgaaggcttcaccagtcctggacctcctgtgcaagaacatgaaacatctgtggttcttccttctcctggtggcagctcccagatgggtcctgtcccaggtgcagctgcaggagtcgggcccaggactggtgaagccttcgcagaccctgtccctcacctgcactgtctctggtggctccatcagtacttactactggagttggatccggcagcccccagggaagggactggagtgggattgggtatatgtatcacagtgggagaaccaactacagtccctccctcaagagtcgagtcacatatcagtagacacgtccaaacgaaccagttctccctagaagctgatctctgtgaccgctgccgacgaccggcgtgtattnttgtgcgagtagttacttttttactagttggttacgggtagtttagttaagtaacggtagggttcggggtnttttaggattagtcgtaggggtaccgaagggataagtggtcgtaacccg

SEQ ID NO: 79500 - DNA, 535 bp, Homo sapiens
  misc_feature: GYAE6OF01BLQHZ.36.29.C07.1.454.CMB.1.raw
tcagtacgctgtctcacgaccggtgctcgatttagagtgctacgaagggaaagggtctgcgaaggcttcaccagtcctggacctcctgtgcaagaacatgaaacatctgtggttcttccttctcctggtggcagctcccagatgggtcctgtcccaggtgcagctgcaggagtcgggcccaggactggtgaagccttcgcagaccctgtccctcacctgcactgtctctggtggctccatcagtacttactactggagttggatccggcagcccccagggaagggactggagtggattggggtatatgtatcacagtgggagaaccaactacagtccctccctcaagagtcgagtcaccatatcagtagacacgtccaagaaccagttctccctgaagctgagctctgtgaccgctgcgacacggccgtgtattattgtgcgagagtacttttttactattggttcgggtagttattagtaacgaggtggggtcttttggattatcgtgggtccaagggacaagtggtctacccg

SEQ ID NO: 79501 - DNA, 556 bp, Homo sapiens
  misc_feature: GYAE6OF01EL2DT.36.29.C07.1.454.CMB.1.raw
  modified_base (214)..(214): a, c, t, g, unknown or other
  misc_feature (214)..(214): n is a, c, g, or t
  modified_base (404)..(404): a, c, t, g, unknown or other
  misc_feature (404)..(404): n is a, c, g, or t
  modified_base (425)..(425): a, c, t, g, unknown or other
  misc_feature (425)..(425): n is a, c, g, or t
tcagtacgctgtctcacgaccggtgctcgatttagagtgctacgaagggaaagggtctgcgaaggcttcaccagtcctggacctcctgtgcaagaacatgaaacatctgtggttcttccttctcctggtggcagctcccagatgggtcctgtcccaggtgcagctgcaggagtcgggcccaggactggtgaagccttcgcagaccctgtccctnacctgcactgtctctggtgctccatcagtacttactactggagttggatccggcagccccagggaagggactggagtggattgggtatatgtatcacaggtggagaaccaactacacgtccctccctcaagagtcgagtcaccatatcagtagacacgtccaagaaccagttactaccctgaacgctganctctgtcgaccgctcgcgacncggcgttgtattattgtgcgagtagttacttttttactagttacggttcggggtagtttagttagtaacggtagggttggggtcgttttggattagtgtcggggtacgaagggacaagttggtctacccgg

SEQ ID NO: 79502 - DNA, 711 bp, Homo sapiens
  misc_feature: GYAE6OF01EFRX3.36.29.C07.1.454.CMB.1.raw
  modified_base (184)..(184): a, c, t, g, unknown or other
  misc_feature (184)..(184): n is a, c, g, or t
  modified_base (333)..(333): a, c, t, g, unknown or other
  misc_feature (333)..(333): n is a, c, g, or t
tcagtacgctgtctcacgaccggtgctcgatttagagtgctacgaagggaaagggtctgcgaagccttcgcagaccctgtccctcacctgcactgtctctggtggctccatcagtacttactactggagttggatccggcagcccccagggaagggactggagtggattgggtatatgtatcanagtgggagaaccaactacagtcccctcctcaagagtcgagtcaccatatcagtagacacgtccaagaaccagttcctcctagaagctgagctctgtcgaccgctgcggacacggccgtgtattagttgtgcgagtagttacttttttanagttgggttcgggtatttattagtaacggtagggttggggtctttgattagtcggtagggaccaagggactaagtcggtaccaccgttcttcttacgacgtccctaccgaccgaacgggtccctacgttccggttccctttaccccccgtcggtaccctacccctcccgtaccgaacgacgtccctaacccgttcggtacgggggtaccaaccggacgggtcccgggtacccggttcggggtccgttccgggtcccgttacgggttacccgtaaaccgggtaacccgtttaacccgttacccgaacggtaaccgtacggtaccggttaaccgtacgggtacgggtccggggtaccggttacgggaccgaacgggtccg

SEQ ID NO: 79503 - DNA, 788 bp, Homo sapiens
  misc_feature: GYAE6OF01BDDRV.36.29.C07.1.454.CMB.1.raw
tcagtacgctgtctcacgaccggtgctcgatttagagtgctacgaagggaaagggtctgcgaagccttcgcagaccctgtcccctcacctgcactgtctctggtgctccatcagtacttactactggagttggatccggcacgccccgagggaaggactggagtggagttgggtatatgtatcacgtaggtgggaacgaaacctaactacacgtcccctccctacgaagagtcgagtccaccatatcagtagacaccgtaccaaacgaacctagttcctaccctaggaacgctagactctcgttgtcgaccgtctcggaccggtaccgaccgggtccgttagttaatttagttggtggtacggtaggtttaggtttttcgacggtaaggtacgtttcggttcgggggtacggttacgtccggtacggttcgggtagggggtaacgtaaacggggtactaccggtaccggtacgtaccgttccgtcccgttccctaccgaccgtccccgttacccgaacccggaaccgggtacccctaaccggttccccgggtttaccccgtttcccccccggtcgggtacccccgtcccgttcccggtcccttaccgggaaccgggtacccgccctaccccggtccggaacgaccgaccggaaccgaccggccccggaccccggtcgggcccgttccggtaccggtacggtaaccggtaacggtacccttaccgtacccgaacgtccgtacgtaccggtacgtcggacgggccgtcggtacggacgacggcgacgtag

SEQ ID NO: 79504 - DNA, 655 bp, Homo sapiens
  misc_feature: GYAE6OF01BFTCT.36.29.C07.1.454.CMB.1.raw
  modified_base (289)..(289): a, c, t, g, unknown or other
  misc_feature (289)..(289): n is a, c, g, or t
  modified_base (619)..(619): a, c, t, g, unknown or other
  misc_feature (619)..(619): n is a, c, g, or t
  modified_base (640)..(640): a, c, t, g, unknown or other
  misc_feature (640)..(640): n is a, c, g, or t
tcagtacgctgtctcacgaccggtgctcgatttagagtgctacgaagggaaagggtctgcgaagccttcgcagaccctgtccctcacctgcactgtctctggtggctccatcagtacttactactggagttggatccggcagcccccgagggaagggactggagtggattgggtatatgtatcacagtgggagaaccaactacacgtccctcctcaagagtcgagtcaccatatcagtagacacgtaccaagaaccagttcctccctgaagctgacgctctgtgaccgntcgcggacgacggccgtgtattagtgtcgcggagtacgttacttttttacgtagttcgggttacggggtaagtttaagttaagtaacggtagggttgggggttcttttggattagtcggtcggggtacgaagggtactaagtcggtaccgtaccgttcttcgttcacgtccctaccgaaccgaacgggcccctacgttccgggttacccttcccccggttggccctaaccccttcccgtaccgaaggccgctaacccgtcggtacggggaccacgacggccggcccgtcgggcctcgccgtggtacaacggtacttacccgtcacggacncggtctacgtcggacggcggngtcggcgacggtacg

SEQ ID NO: 79505 - DNA, 631 bp, Homo sapiens
  misc_feature: GYAE6OF01ED21H.36.29.C07.1.454.CMB.1.raw
tcagtacgctgtctcacgaccggtgctcgatttagagtgctacgaagggaaagggtctgcgaagccttcgcagaccctgtccctcacctgcactgtctctggtggctccatcagtacttactactggagttggatccggcagcccccagggaagggactggagtggattgggtatatgtatcacagtgggagaaccaactacagtccctccctcaagagtcgagtcaccatatcagtagacacgtccaagaaccagttctccctgaacgctgagctctgtgaccgctgcggacacggccgtgtattagttgtgcgagtagttacttttttactagttgggttcggggtagttagttagtaacggtaggtggggtctttgattagtcgtaggggcgaagggacaagtggtacctaccgtctctcacgccctaccgacgacggtcccagtccggttccttccccgtgccctaccctcctaccaacgcgccgtaccgtcggcggggaccacgacggcccggtcccgtgggcctcggcccgttaggtaccgtaacgggtacccttaccgttccgacggactacggaccgtaacgtcggtacgggtcccgggtacggtcgggacgtacgggtcccg

SEQ ID NO: 79506 - DNA, 735 bp, Homo sapiens
  misc_feature: GYAE6OF01BRX9N.36.29.C07.1.454.CMB.1.raw
tcagtacgctgtctcacgaccggtgctcgatttagagtgctacgaagggaaagggtctgcgaaggcttcaccagtcctggacctcctgtgcaagaacatgaaacatctgtggttcttccttctcctggtggcagctcccagatgggtcctgtcccaggtgcagctgcaggagtcgggcccaggactggtgaagccttcgcacgaccctgtccctcgacctcgcactgtctctggtcgctcatctagtacttactactggagttggatccggcacgcccagggacggacgtggaggtggagttcgggtatacgtgtatcgacgtaggtacgggacgaaccaactaccgacgttccccgtaccctacgaacgtacgtacgtacgtaccaacctactaactcgaagttaacgaaccgtaccgtaaccgaaaacgtaacctacgttacctacccgtacgaacgtcgtacggacgtacctacgttacggtaccgacccggtacgtcggaccggaccggtaaccgggtaccgtttacgttaagtttacgttcggtacggtacggtaacgttaacggttttaacgttttttttaacgtacggtttacgggtttacggggttaagtttaacgttaacggttaaacgggttaggggttacggggtttgttttaggtacgttacgttacgggtaccggggtaccggtaaacgggtaacgtaacggttcggtaccgttaacccggg

SEQ ID NO: 79507 - DNA, 885 bp, Homo sapiens
  misc_feature: GYAE6OF01EXPNO.36.29.C07.1.454.CMB.1.raw
  modified_base (162)..(162): a, c, t, g, unknown or other
  misc_feature (162)..(162): n is a, c, g, or t
tcagtacgctgtctcacgaccggtgctcgatttagagtgctacgaagggaaagggtctgcgaaggcttcaccagtcctggacctcctgtgcaagaacatgaaacatctgtggtttcttccttctcctggtggcagcctcccagatgggtcctgtcccaggtncagctgcgagggagtccgggcccagggtacgtgggtagaacgtcccgttcggacctaccggtacccccttcggttccccctaccaacccgttcggaccttacttcggttcccttccgtggggttcgtccttaccattcgtaacgttaccttttacgtacggtaggttaggttcggtaccgtcccggaccacccggaccccggaaggggtaaacgggtcgtacgggtagggtaggtaaggtttcggggtattaaggttcgtactaccgtaacggtaggtaacgggaacgtaaacccgtaacttaaccgtaccgttaccccctaccgtacgtaaacggtacgttaccggacgtaccgaactaacttaacgtacgtaaggtaacgtaaccgtaaccgtaaacccgaaacgtaacccgttaccgtttacccgtaacccgttaacggaaacgttcgtaaccgggtaacttccgttaccgtacggtacccggtacccgcgggttacggaccgacccgttacgggtcccgtttagtttacgtagtttcggtacgtacggttaacgttacgtttttaacgtttttacgttaagggtttacggggttacggttaaaggtttacgtttaagggtaaccgggtttagggttcgggttttagtttaagttacgttacggttacgggtacgggttaaacgacgggtaaagttaacggttccggtaccgttacccgg

SEQ ID NO: 79508 - DNA, 736 bp, Homo sapiens
  misc_feature: GYAE6OF01C61TE.36.29.C07.1.454.CMB.1.raw
  modified_base (429)..(429): a, c, t, g, unknown or other
  misc_feature (429)..(429): n is a, c, g, or t
tcagtacgctgtctcacgaccggtgctcgatttagagtgctacgaagggaaagggtctgcgaagccttcgcagaccctgtccctcacctgcactgtctctggtggctccatcagtacttactactggagttggatccggcacgcccccgagggaggactggagtggagttgggtatatgtatcacgaggtgggaagaaccaatacacgttcccctcctacgaagagtcgagtccaccatatcagtagacacgtacaacgacctagttcctacctagacgctagacgtctcgtcggtacgaccgcgtcggaccggaccgtccggtccggtattagtttagttgtggtacggtaggttagttttaacgttttttacgtaggttcgggttcggggttaagtttaagttaggtaacggtaggggtcgggtttnttttagtagttacgtggtacgggaccgtaagggactaaggttcggtaccgtaccgttcttcgtctaccgtcccgtaaccgaccgtaaccgggccccgtacgttccggttacccgttccccggtcgtaccccgtacccttcccgtaaccgaacgccgtacctcccggtcggcggggtaccacggaccggtccggtacccgtgggtcccgtccggtaccgtcggtacccgaacgttaccgttaccgttaccgaaggaccgtcgtaccgtacggtcgggtcggggaccgtagggcggaccggaggtaccg

SEQ ID NO: 79509 - DNA, 619 bp, Homo sapiens
  misc_feature: GYAE6OF01BHNDO.36.29.C07.1.454.CMB.1.raw
  modified_base (604)..(604): a, c, t, g, unknown or other
  misc_feature (604)..(604): n is a, c, g, or t
  modified_base (610)..(610): a, c, t, g, unknown or other
  misc_feature (610)..(610): n is a, c, g, or t
tcagtacgctgtctcacgaccggtgctcgatttagagtgctacgaagggaaagggtctgcgaagccttcgcagaccctgtccctcacctgcactgtctctggtggctccatcagtacttactactggagttggatccggcagcccccagggaagggactggagtggattgggtatatgtatcacagtgggagaaccaactacagtccctccctcaagagtcgagtcaccatatcagtagacacgtccaagaaccagttcctcctgaagctgagctctgtgaccgcgtgcggacacggccgtgtattattgtgcgagacgttactttttttacagttgggttcggggtagtttagttaagtaacggtagggtggggtcttttggatagtcgtcggggaccgaagggactaagttggtactaccggttctcttcacgtccctaccaccgacgggcccagttcccggtccttcccccgtcggccctacccctcctccaacgcgtcctaccgtcgtcggggcacgacgtccggcccgtggcctcgccgtggtaccgaacggtaccttaccgtccgagacgtacggaccgtacgtcggacggacgggtntcgggngacgggtcg

SEQ ID NO: 79510 - DNA, 693 bp, Homo sapiens
  misc_feature: GYAE6OF01B6BOX.36.29.C07.1.454.CMB.1.raw
  modified_base (621)..(621): a, c, t, g, unknown or other
  misc_feature (621)..(621): n is a, c, g, or t
tcagtacgctgtctcacgaccggtgctcgatttagagtgctacgaagggaaagggtctgcgaaggcttcaccagtcctggacctcctgtgcaagaacatgaaacatctgtggttcttccttctcctggtggcagctcccagatgggtcctgtcccaggtgcagctgcaggagtcgggcccaggactggtgaagccttcggcagaccctgtccctcacctgcactgtctctggtgctccatcagttacttactactggagttggactccggcacgcccgagggaaggctggagtggagttgggtatatgtatcacgaggtgggaagaaccaactacacgtccctcctacaagtagtcgacgtcaacctatatactaagtagacctacgtaccaaacgaaccctagttccctaccgtagaacgtccgtagtagtccttcgtcgtacggacccgtcgtacggaccgggtaccgacccgggtccggttacgttaagtttacgtttcgggtacgaccggtaggttaaccggtttttaacttttttttaacggttacggtttaggggtttaaccgggggttaattttaacgttaacggttaaacgggttaggggtttacgggggttntttttagggaacgtttcgtacggttacgggggacgtaaaggggtactaagggttcggttaccgttacccggg

SEQ ID NO: 79511 - DNA, 783 bp, Homo sapiens
  misc_feature: GYAE6OF01A528J.36.29.C07.1.454.CMB.1.raw
tcagtacgctgtctcacgaccggtgctcgatttagagtgctacgaagggaaagggtctgcgaaggcttcaccagtcctggacctcctgtgcaagaacatgaaacatctgtggttcttccttctcctggtggcagctccagatgggtcctgtcccaggtgcagctgcaggaggtccgggcccaggactgggtcgaacgtccttccgcacgtacccctcggtcccctactaccctgcctacgttgttctcgtggtcgcctccattcagttacttactacgtggtagttgacgtccgacaccggaccccgaaggggacggtacgtacgggaggtcggtaggtttagggtattacgtagtacgtacgagtagggtaggaacgtaaacccgaacgtaccgtacgtcccctacctacgaacgtcgtacgtacgtaccacgtaacttacgacgtaacggtacaacgaccgtaaccaaccgtaaccgtccgttaccgtaccgtaacgaacgtacgtacgtacgtacctcggtacgtaccggtacccgtcgttaccggaccggtaccgaccgggttacgttacgttaacgtttacggttaggtcggtaacgtacggttttaacgtttttaccgtttttaaggttaccgggtttacgggggtttaacggttaacgttttaaggtaacggtttaaacgggggttggggtttacgggttttacgtttggtaacgttacgggttacggtacgggtaaccggtaacggttaaggtcgtttccgggtacccttaccgg

SEQ ID NO: 79512 - DNA, 838 bp, Homo sapiens
  misc_feature: GYAE6OF01CNNP8.36.29.C07.1.454.CMB.1.raw
tcagtacgctgtctcacgaccggtgctcgatttagagtgctacgaagggaaagggtctgcgaagccttcgcagaccctgtccctcacctgcactgtctctggtgctccatcagtacttactactggagttggatccggcacgccccgagggaagggactggagtggattgggtatatgtatcacagtggaacgaaccaactacacgtccctcctacaacgacgtcgagtccaccatatcagtacgacaccgtaccaagaacctagttcctaccctagaacgtcgtcgagtctcgttgtacgaccgcgtcggcggaccgaccggtccgtagttacttagttgtcgacgtagtagtttactttttttacgtagtttacgggttacgggtaagtttagtttaacggtaacggtagggttcggggttacgtttttagagtttaacggttacgggttacggggaaccggtaaaggggtaaccgtaaggtttaccggtaccgttaaccggtttaccttaccgtttaccaccgggtaccccttacccccgtaaccggaaccggggtacccccttaacggttccccgggtttacccgtttccccccgtagggacccctacccccgttaccgtaaccgaacgtacggtaccctacccggttcgggtaccggggacctaacggcccggtcccgggtaccgttcgggtcctccggtacccgggttcgggtaaacccgtaaaccgggttacccttaaccgttacccgaacgggtaacccgtcggacccgggttaccgtacgggtacccggggtaccgggtccgtaaccggggaccgtaaaccggggccgg

SEQ ID NO: 79513 - DNA, 601 bp, Homo sapiens
  misc_feature: GYAE6OF01BDUIW.36.29.C07.1.454.CMB.1.raw
  modified_base (398)..(398): a, c, t, g, unknown or other
  misc_feature (398)..(398): n is a, c, g, or t
  modified_base (468)..(468): a, c, t, g, unknown or other
  misc_feature (468)..(468): n is a, c, g, or t
  modified_base (497)..(497): a, c, t, g, unknown or other
  misc_feature (497)..(497): n is a, c, g, or t
  modified_base (559)..(559): a, c, t, g, unknown or other
  misc_feature (559)..(559): n is a, c, g, or t
  modified_base (563)..(563): a, c, t, g, unknown or other
  misc_feature (563)..(563): n is a, c, g, or t
  modified_base (567)..(567): a, c, t, g, unknown or other
  misc_feature (567)..(567): n is a, c, g, or t
  modified_base (592)..(592): a, c, t, g, unknown or other
  misc_feature (592)..(592): n is a, c, g, or t
tcagtacgctgtctcacgaccggtgctcgatttagagtgctacgaagggaaagggtctgcgaagccttcgcagaccctgtccctcacctgcactgtctctggtggctccatcagtacttactactggagttggatccggcacgcccccagggaagggactggagtggattgggtatatgtatcacaggtgggagaaccaactacacgtcccctccctcaagacgtcgagtcaaccatatcagtagaccacgtccaaacgaacctagttcctcctgaagtctgagctctgtgaccgctcggcggacacggccgtgtattacgttgtcgcgtagagtttactttttttatagtttgggttacggggtagtttattagtacgtagggtggggtctttgatntcgtgggcaagggacagtggtctaccgtctctcacgcctccaccgacggcccacgtcgtcccttcccccnggccctacccctcctacccacgtctcccnccgttcggtcggggaccacgtaccggcccgccgtcggcgtcgccgtgaccgacgtccttacncganaccncggactagcggacggcggcgacggngtaacggcg

SEQ ID NO: 79514 - DNA, 856 bp, Homo sapiens
  misc_feature: GYAE6OF01BF0J0.36.29.C07.1.454.CMB.1.raw
  modified_base (109)..(109): a, c, t, g, unknown or other
  misc_feature (109)..(109): n is a, c, g, or t
  modified_base (149)..(149): a, c, t, g, unknown or other
  misc_feature (149)..(149): n is a, c, g, or t
  modified_base (213)..(213): a, c, t, g, unknown or other
  misc_feature (213)..(213): n is a, c, g, or t
tcagtacgctgtctcacgaccggtgctcgatttagagtgctacgaagggaaagggtctgcgaaggcttcaccagtcctggacctcctgtgacaaagaacatagaaactntctgtggttccttccttctccgtggtggacagcctccagngtcgggtcctgtcccgaggtgctacgctcgcgaagggtcggtccggacccgaggtactgggtanaccgtcccttcgaccgtacggtacccccttcgtcccctactaccgttcgacctacgttcgtccgttcggtacgggtcctacctctagttacgacgtttaccgttacgttacggtacggttacgttacggaccgtaccggaccgtacccggtaccggtagggaccggtacggtacggtacggtacgggttacggttacggttagtacgtacgtacgtacgtacggtacggtaacggtaaccgtaaccgtaccgtaacccgtaccgttaccctaaccgtaaccgttaacggtaccgtaccgtaaccgtacctaacgtaacgtaccgtaacggtaacgtaaccgtacccggtaaccgtaaccgtaaaccggtaccttaccggtacccgttaacgtaccgtaaccgtcgtaacgtacgtacggttaccgtacggtaccgtaccggtccggtaaccggaccgtacccggtacgttacgttacgttacgttgttacggtaacgtacgggtttactttacggtttacgtttacgggtggtttacggttaaggtttacgtaaggttaccgggtagggttcggtacggtttacgttacggtacggttacggtacggtacggtacggtagtaccggttcgtaccgtaccgtcg

SEQ ID NO: 79515 - DNA, 727 bp, Homo sapiens
  misc_feature: GYAE6OF01EJI1G.36.29.C07.1.454.CMB.1.raw
  modified_base (193)..(193): a, c, t, g, unknown or other
  misc_feature (193)..(193): n is a, c, g, or t
tcagtacgctgtctcacgaccggtgctcgatttagagtgctacgaagggaaagggtctgcgaaggattcaccagtcctggacctcctgtgcaagaacatgaaacatctgtggttcttccttctcctggtggcagctcccagatgggtcctgtcccaggtgcagctgcaggacgtcgggcccaggacgtggtanaacgtcccttcgcacgaccccttgtcccctcaccgtgcctactgtcctacgtgggtcgcctccgatcgtaacgttacttactacgtggtagttggacgtccggacaccggacccgaaggggaaggtcgtgggacggttggagttgggtaattgtgtatcgagaggtaggaacgaacctactacgtaccgtcccctaccgacgaacgtcgtacgtacgtaccaacctaatacgtacaacgtacgaaccgtaccgtaaccgaaacgtaaccctagtttccctaccgtaaggtaactcgtagtactccgtactcggtaccgaccgtcgacggacgtaccgcggtacgtagttattagttcgtacgtacggtagttacgttttaacctttttacggaaggtttccgggttagggttaacgttaacgttaacgggtaacgggtttaggggtttaccgggtttatttaggtacgtttacggttacgggtacggggtaacgtaaacgggttaacgtaacggtttccgggtaccgtacccgg

SEQ ID NO: 79516 - DNA, 597 bp, Homo sapiens
  misc_feature: GYAE6OF02H7ZIE.36.29.C07.1.454.CMB.1.raw
  modified_base (366)..(366): a, c, t, g, unknown or other
  misc_feature (366)..(366): n is a, c, g, or t
tcagtacgctgtctcacgaccggtgctcgatttagagtgctacgaagggaaagggtctgcgaaggcttcaccagtcctggacctcctgtgcaagaacatgaaacatctgtggttcttccttctcctggtggcagctcccagatgggtcctgtcccaggtgcagctgcaggagtcgggcccaggactggtgaagccttcgcagaccctgtccctcacctgcactgtctctggtgctccatcagtacttactactggagttggatccggcagcccccagggaaggactggagtggattgggtatagtgtatcacagtgggagaacaactacagtccctcctcaagacgtcgagtcaccatatcagtanacacgtccaaagaaccagttctcctgaacgtctagagtctctgtgaccgctgcgacacggtcgtgtattacttgtgcgagtagttactttttttaagagttgggttacggggtagtttaagttaagttaaccggtagggttcgggggttactttttagggagtttaacgttcggttacgggggtacccggtaaaggggtaaccgtaaggtttccgggtacttaaccccggg

SEQ ID NO: 79517 - DNA, 561 bp, Homo sapiens
  misc_feature: GYAE6OF02GPM7M.36.29.C07.1.454.CMB.1.raw
  modified_base (446)..(446): a, c, t, g, unknown or other
  misc_feature (446)..(446): n is a, c, g, or t
tcagtacgctgtctcacgaccggtgctcgatttagagtgctacgaagggaaagggtctgcgaaggcttcaccagtcctggacctcctgtgcaagaacatgaaacatctgtggttcttccttctcctggtggcagctcccagaatgggtcctgtcccaggtgcagctgcaggagtcgggcccaggactggtgaagccttcgcagaccctgtccctcacctgcactgtctctggtgctccatcagtacttactactggagttggatccggcagcccccagggaaggactggagtggattgggtatatgtatcacagtgggagaaccaactacagtccctcctacaagagtcgagtcaaccatatcagtagacacgtacaaagaaccagttctccctagaacgctgagctctgtcgaccgctgccggacacggccgtagtattagttgngtcgtagtagttacttttttacagttggttacgggtatttacgttagtaacggtagggtggggttacttttggattagttcggtagggaccgtaagggactagtcggtctaccgg

SEQ ID NO: 79518 - DNA, 679 bp, Homo sapiens
  misc_feature: GYAE6OF02IEPCV.36.29.C07.1.454.CMB.1.raw
tcagtacgctgtctcacgaccggtgctcgatttagagtgctacgaagggaaagggtctgcgaagccttcgcagaccctgtccctcacctgcactgtctctggtggctccatcagtacttactactggagttggatccggcagcccccagggaagggactggagtggattgggtatatgtatcacagtgggagaaccaactacagtcccctccctcaagagtcgagtcaccatatcagtagacacgtccaagaaccagttctccctgaagctgagctctgtgaccgctgcggacacggccgtgtattagttgtgcgagagttactttttttactagttgggtttacggggtagtttaattagtaacggtagggttgggggtctttttaggattagttcgtggggaccaaaggggacaaagtgggtaccaccggttctcttcacgtccctacaccgaacgggcccagtccggtccctttcccccgtcggccctaccccgttccctacccgaaaggccgaccacccgttcggtaccggggggtaccaccgtacgggcccggtcccggtcggggccctcggtcccgtcgggtacctaacgggtaccttaccgttccgaacggtaccgaacggtaccgttaacgtcggacggtcccggggtacgtcggggaccgtaagggaccg

SEQ ID NO: 79519 - DNA, 739 bp, Homo sapiens
  misc_feature: GYAE6OF02INENU.36.29.C07.1.454.CMB.1.raw
tcagtacgctgtctcacgaccggtgctcgatttagagtgctacgaagggaaagggtctgcgaatgcttcaccagtcctggacctcctgtgcaagaacatgaaacatctgtggttcttccttctcctggtggcagctcccagatgggtcctgtcccaggtgcagctgcaggagtcgggcccaggactggtgaagccttcgcagaccctgtccctcacctgcactgtctcgtggtgcctccatcagtacttactactggagttggatcggcacgcccccgagggacgggactggaggtggtacgttagggtactagttgtactcgaacgacggttagggaacaaaccgtaactaaccgaccgttccccgtcccgtaacgtaagacggtacgaacgttaccaacgtaactacgtacgtaagtacgaacgaaccgttaccgaaacgtaaaccctacgttcccttaacccgtagtaaaccggtacgtacgaacggttcttaccgttcggtaccgtaacccggtcgttacggacccgggtaccgtaaccgggttcccgttagtttaacgttagtttacggtcggtaccgtaagttacggtttttaactttttttaacgttacggtacgggtttacgggttagtttacgttaacggttaacgggtacggggtttggggtttacgtttaaggagtttaacgttcgggtacggggtaccgtaaacgggtactaaggttccggttaccg

SEQ ID NO: 79520 - DNA, 582 bp, Homo sapiens
  misc_feature: GYAE6OF02HKPKV.36.29.C07.1.454.CMB.1.raw
  modified_base (427)..(427): a, c, t, g, unknown or other
  misc_feature (427)..(427): n is a, c, g, or t
tcagtacgctgtctcacgaccggtgctcgatttagagtgctacgaagggaaagggtctgcgaaggcttcaccagtcctggacctcctgtgcaagaacatgaaacatctgtggttcttccttctcctggtggcagctcccagatgggtcctgtcccaggtgcagctgcaggagtcgggcccaggactggtgaagccttcgcagaccctgtccctcacctgcactgtctctggtcggctccatcagtacttactactggagttggatccggcagccccccagggaagggactgtagtggattgggtatatgtatcacagtgggagaaccaactacacgtccctcctacaagagtcgagtcaccatactcagtagacacgtaccaaagaaccagttcctccctagaagtctgagtcctcgtgtcgaccgntcggcgacgaccggcgtagtacttattgtgcgagtaagttacttttttagtagttcgggttacgggttagttatttagtaaggtagggttggggttcttttggtattacgttggtcggggacgtaaggggtactaacggtggttccgtaacccgg

SEQ ID NO: 79521 - DNA, 631 bp, Homo sapiens
  misc_feature: GYAE6OF02G4946.36.29.C07.1.454.CMB.1.raw
tcagtacgctgtctcacgaccggtgctcgatttagagtgctacgaagggaaagggtcgtgcgaaggcttcaccagtcctggacctcctgtgcaagaacatgaaacatctgtggttcttccttctcctggtggcagctcccagatgggtcctgtcccaggtgcagctgcaggagtcgggcccaggactggtgaagccttcgcagaccctgtccctcacctgcactgtctctggtgctccatcagtacttactactggagttggatccggcagcccccagggaacgggactggagtggattgggtatagtgtatcacagtgggagaaccaactacgacgtccctcctcgaagagtcgagtcaccatatcagtagacacgtccaacgaaccagttcctccgtagaagtctcgagtctctgtcgaccgtcgtcggcggacgcgggtccgtagttattacgttcggtagtacgtaagtagtttacgtttttttactaggttggtttaccggggtagttttaagttagttaaccgggtagggttggggggttacctttttagggtaacgtttacggttacggttacgggggtaccctaaagggggtacccaaaggtttacgggtccttaaccccggg

SEQ ID NO: 79522 - DNA, 606 bp, Homo sapiens
  misc_feature: GYAE6OF02H794Z.36.29.C07.1.454.CMB.1.raw
  modified_base (374)..(374): a, c, t, g, unknown or other
  misc_feature (374)..(374): n is a, c, g, or t
tcagtacgctgtctcacgaccggtgctcgatttagagtgctacgaagggaaagggtctgcgaaggcttcaccagtcctggacctcctgtgcaagaacatgaaacatctgtggttcttccttctcctggtggcagctcccagatgggtcctgtcccaggtgcagctgcaggagtcggcccaggactggtgaagccttcgcagaccctgtccctcacctgcactgtctctggtgctcatcagtacttactactggagttggatccggcacgccccccgagggaacgggactggagtggagtttgggtatagtgtatcacagtgggagaacaactacacgtccctacctcaagagtcgagtcaccatactacagtanacacgtaccaagaaccctagttcctcctagaacgtctgacgtctactgtcgaccgcgtcggcgacgaccggtccgtgtacgttattggttacgcgtagtagttactttttttaacgtagttcggtttacggggtagtttagttagttaacggtaggggtggggttacgttttaggtaagttacgttacggttggggaccgtaagggtactaacggttcggtaccttacccgg

SEQ ID NO: 79523 - DNA, 679 bp, Homo sapiens
  misc_feature: GYAE6OF02ICAS3.36.29.C07.1.454.CMB.1.raw
tcagtacgctgtctcacgaccggtgctcgatttagagtgctacgaagggaaagggtctgcgaagccttcgcagaccctgtccctcacctgcactgtctctggtggctccatcagtacttactactggagttggatccggcagcccccagggaagggactggagtggattgggtatatgtatcacagtgggagaaccaactacacgtcccctccctcaagagtcgagtcaccatatcagtagacacgtcaagaaccagttctccctgaagctgagctctgtgaccgctggcggacacggccgtgttattagttgtgcgagagttactttttttactagttggttcgggtagtttattagtaacggtaggttgggggtctttttaggattagtcgttcggggaccgtaaggggaacaagttcgggtactaccggttctcgtttcacgtcccctaccgaaccgaacgggccctagttcccggttcccttcccccgtggccctaccccgttcctacccaagaccgccacccgtcggtcgggggaccaccgacggcccgggcccgttggggcccttcggcccgttacgggtacgaaccgggtaccttaaccgttcccgaacggaacctacggtacccgttacgtcgggtacggcccggggtacgtcgggaccggaagggcccgg

SEQ ID NO: 79524 - DNA, 671 bp, Homo sapiens
  misc_feature: GYAE6OF02I313J.36.29.C07.1.454.CMB.1.raw
tcagtacgctgtctcacgaccggtgctcgatttagagtgctacgaagggaaagggtctgcgaaggcttcaccagtcctggacctcctgtgcaagaacatgaaacatctgtggttcttccttctcctggtggcagctcccagatgggtcctgtcccaggtgcagctgcaggagtcgggcccaggactggtgaagccttcgcagaccctgtccctcacctgcactgtctctggtggctccatcagttacttactactggagttggactccggcacgcccccgagggaggactggagtggagttgggtatagtgtatcacgaggtagggaacgaaaccaactacacgttcccctaccctacaagtacgtacgacgtccaccatactactaagtacacacgtaccaacgaacctacgtttcctaccgtagaacgtctagacgtctcgtgtacggacccgtcgtacggccggaaccgccgggtaccgttagttaagtttacgttggtacggtacgtaaggttacgttttacgttttttaacgttaggtttcggggtttacgggtacgttttagttacgttaacgggttaggggttcggggtttacgttttaggtagttacggttaccggttggggaaccggtaagggaacctaacggttcgggtaccttaacccgg

SEQ ID NO: 79525 - DNA, 794 bp, Homo sapiens
  misc_feature: GYAE6OF02GO0JX.36.29.C07.1.454.CMB.1.raw
tcagtacgctgtctcacgaccggtgctcgatttagagtgctacgaagggaaagggtctgcgaagccttcgcagaccctgtccctcacctgcactgtctctggtggctccatcagtacttactactggagttggatccggcagcccccagggaagggactggagtggattgggtatatgtatcacagtgggagaaccaactacagtccctcctcaagagtcgagtcaccatatcagtagacacgtccaagaaccagttctccctgaagctagagctctgtcgaccgcgtgcggacaccggccgtgtacttattggtgcgagagtactttttttacagttgggttcgggtagttattaagtaacggtaggtgggggtctttttagattagtcgtggggtaccaaaggggactaaagttcgggtacctaccggttcttccgtttacacgtcccctacccgaacccgtaaacggggcccctaacgttcccgggttacccctttcccccccgtacgggtaccctaacccccgttcccgttaccccgaaacggtaccgtaccccgtaacccgttccggttaccgggggggaccctaaccgggtaaccggcccggggtacccccggttcgggggtacccttaccgggtccccggttacggggttaacccgaaacggggttaaccccgtttaacccgttttaccccggaaacggttaacccggtaacggtaccccggtttaaccgttacgggtaaccgggtcccgggggtacctacgggggtacccgaaaccggggtcccgg

SEQ ID NO: 79526 - DNA, 645 bp, Homo sapiens
  misc_feature: GYAE6OF02FFQUN.36.29.C07.1.454.CMB.1.raw
tcagtacgctgtctcacgaccggtgctcgatttagagtgctacgaagggaaagggtctgcgaaggcttcaccagtcctggacctcctgtgcaagaacatgaaacatctgtggttcttccttctcctggtggcagctcccagatgggtcctgtcccaggtgcagctgcaggagtcgggcccaggactggtgaagccttcgcagaccctgtccctcacctgcactgtctcgtggtgctccatcagttacttactactggagttggactccggcacgcccccgaggggaacggactggagtggtattgggtatatgtatcacgaggtgggaacgaaccaactacgacgtccctccgtacaacgtacgtcgagtcaaccatactcagtacgacctacgtaccaaagaaccagttcctcctagagctagacgctcgtgtacgaccgtcgtcggacgtacgaccggtcgttagttagttagttgtgtacgtagttacgtttacgtttttttaacgagtttacggggtttacgggtaagtttacgtttacgtaacggtaggggtttacggggttacttttacggtaactttacggttacggtacggggtaaccgtaaacgggtactaacggttccggttaccgttaccccgg

SEQ ID NO: 79527 - DNA, 817 bp, Homo sapiens
  misc_feature: GYAE6OF02F2GLW.36.29.C07.1.454.CMB.1.raw
  modified_base (811)..(811): a, c, t, g, unknown or other
  misc_feature (811)..(811): n is a, c, g, or t
tcagtacgctgtctcacgaccggtgctcgatttagagtgctacgaagggaaagggtctgcgaagccttcgcagaccctgtccctcacctgcactgtctctggtggctaccatcagtacttactactggagttggatccggcagcccccagggaagggactggagtggattgggtatatgtatcagaggtggagaaccaactacacgtccctcctacgaagacgtcgagtccaaccatacacagtaacacaccgtaccaacgaacctagttcctccccgtagaacgtcctcgaacgctcgtagtcgacccgcgtggccggacgacggccggttagttacttagttcggtcggacggtaggtaacgtttacctttttttactaggtttgggtttaccggggtattttagttaacgtaacggtagggttgggggttacttttaggaacgttacgtcggtacggggaccgtaaagggaccgtaaagttcgggtacctacccgttcttaccgttcgaaccgtccccttaccgaaccggtaaacccgggtaccctaccggtttacccgggtcccccttttaccccccggtcgggtaccccccttaacccctttaccccgtaaccgtaaaccgggttcccgacccttaaaccccgggttcccggggttaccgggggaacctacccgggtaaccggggtcccggtaccccgggttggggaacccttcccgggtaccggttacgggtaccgtaacgtacccttaaccgtaccgtacgacgtacgtacgtacgtacggtaccggccgggtcgtgggaccgnggtccg

SEQ ID NO: 79528 - DNA, 722 bp, Homo sapiens
  misc_feature: GYAE6OF02IM3P4.36.29.C07.1.454.CMB.1.raw
tcagtacgctgtctcacgaccggtgctcgatttagagtgctacgaagggaaagggtctgcgaagccttcgcagaccctgtccctcacctgcactgtctctggtggctccatcagtacttactactggagttggatccggcagcccccaggggaagggactggagtggattgggtatatgtatcacagtgggagaaccaactacagtccctccctcaagagtcgagtcaccatatcagtagaccacgtccaaagaaccagttcctccctgaagctgagctctgtcgaccgctggccggacgacggccgtgttagtttattggtgcggagtagtttacttttttacgtagttgggttacggggtattagttaagtaacggtagggttgggggtcttttaggagttacgtcggtcggggaccgaaggggtaactaagttcggtacctaccgttcttcttaccgacgtaccctacccgaaccgtacgggccctacgttccggttacccttccccccggtgtaccccgttaccccgttacccgtacccgaaacgtaccgtcccgtaccgttcgggtaccgggggaccaaccggacgggccccgggtcccgttcggggtacccgtcggaccccgttgggtaaccgtaacgggtacctacccggttaccgaacggacgtacggtccgtaacggcgggccgggtacgtcgggaccgtacgggaccgtagg

SEQ ID NO: 79529 - DNA, 776 bp, Homo sapiens
  misc_feature: GYAE6OF02H97RG.36.29.C07.1.454.CMB.1.raw
  modified_base (425)..(425): a, c, t, g, unknown or other
  misc_feature (425)..(425): n is a, c, g, or t
tcagtacgctgtctcacgaccggtgctcgatttagagtgctacgaagggaaagggtctgcgaaggcttcaccagtcctggacctcctgtgcaagaacatgaaacatctgtggttcttccttctcctggtggcagctcccagatgggttctgtcccaggtgcagctgcaggagtcgggccaggactggtgaagccttcgcagaccctcgtcctcacctgcactgtctctggtcgctcatcacgtacttactacgtggacgttggactccggacacggtcccccgagggaacgggctagggagtggagtttgggtattacgttaggtactacgtaacgtaggtacggggaaacgtaaaccgtaactaaccgtaccgttccctacccctacgaaacgtacgtacggtaacgttaccgaactaacttanaccgtaacggttaacgacctaccgggtaccaaacgtaaaccctacggtttacctacccgtaagaacggtactcggtaaccgtcgttccgttacgggtaccgtaacccggtcgtccgggacgggtaacccggtaccgggtacccggtttacgttaacgttttacgttggtaccgtacggtaacgtttaacgttttaccgtttttttacgtaaggttcgggtttaacggggtttaatttacgtttacggttaaccgggttaggggtttggggttacttttaggttaacgttacggttcgggttaacggggtacggtaaacgggtaaccgttaagtaccggttacctaacccgg

SEQ ID NO: 79530 - DNA, 723 bp, Homo sapiens
  misc_feature: GYAE6OF02HW0AW.36.29.C07.1.454.CMB.1.raw
  modified_base (184)..(184): a, c, t, g, unknown or other
  misc_feature (184)..(184): n is a, c, g, or t
tcagtacgctgtctcacgaccggtgctcgatttagagtgctacgaagggaaagggtctgcgaagccttcgcagaccctgtccctcacctgcactgtctctggtggctccatcagtacttactactggagttggatccggcacgcccccgagggaaggactggagtggatgggtatatgtatcangtggagaaccaactacacgtccctcctacagacgtcgagtcacatatcagtagacacgtacaacgaccagttctacctgaacgctacgagctactgtcgacgctgcggacacggcgtgtattatgtcgcgagtagtacttttttacagttggttacggggtatttagttagtaacggtaggtcggggttacttttggagttagtcgtacggggaccgaagggtactaaacgtcgggtacctaccgtccgttctttacgacgttcctccccgaaaccgaccgggaccttagtacccgggttacccttccccgtaggtcccctaccccttcccgtaaccgaaccggacgtcccgaaccgttcgggtacgggggaccctaacccgggtcgggacccggttccccggtacggggtcccgttcccgccgggtttacggggaacccgtacgggtaacccttaccgtttacccgaacggttccggaacggtacccgttacgacgggtaccgggtaccgggtccggagggtacccgtaaggtcccgg

SEQ ID NO: 79531 - DNA, 751 bp, Homo sapiens
  misc_feature: GYAE6OF02JNPNC.36.29.C07.1.454.CMB.1.raw
tcagtacgctgtctcacgaccggtgctcgatttagagtgctacgaagggaaagggtctgcgaagccttcgcagaccctgtccctcacctgcactgtctctggtggctccatcagttacttactactggagttggatccggcacgccccccgaggggaagggacgtggaggtggattgggtatatgtatcacaggtgggaagaaccaactacacgtccctcctacaagagtcgagtcacctatactcagtacgacaccgtaccaaacgaaccagttcctccctagaacgcgtagacgtcttcgtaggtcgaccgacgtcggccggacgaccggccgtagttaactttagttcggtggtacgaggttaacgttttaacctttttttacgtagtttcggggttacggggttagtttaagttaaggtaacgggtaggggttgggggttacttttggtaagttacgttcggtacggggacgtaaacggggacgtaaggtcggttacccgtaccgtttcttccgttacgtacgtccctaccgtaaccggaaccggtaccctacggttccggttcccgttccccggtccgtaccctaccctacccgtaccgaacgtacgacctaccggttccggtcggggacaccggacggccggtccggtacggtccgtcggtaccgtgggtaccgtacggtacctaccgttcgacggacgtaccggtcgtaacgcggacggtccggtcggtcggacgtacggacgg

SEQ ID NO: 79532 - DNA, 662 bp, Homo sapiens
  misc_feature: GYAE6OF02GQXDB.36.29.C07.1.454.CMB.1.raw
  modified_base (213)..(213): a, c, t, g, unknown or other
  misc_feature (213)..(213): n is a, c, g, or t
tcagtacgctgtctcacgaccggtgctcgatttagagtgctacgaagggaaagggtctgcgaaggcttcaccagtcctggacctcctgtgcaagaacatgaaacatctgtggttcttccttctcctggtggcagctcccagatgggtcctgtcccaggtgcagctgcaggagtcgggcccaggactggtgaagccttgcagaccctgtccctnacctgcactgtctctggtgctccatcagtacttactactcggagttggatccggcacgcccccgaggggaacgggactggagtggattgggtatagtgtatcgacgagtgggaacgaaaccaactacacgttccctcctacgaagacgtcgagtcaccatatacagtagaactacgtaccaaacgaacctagtttcctaccctagaacgtcgtagtaacgcttacgtgtacgaccgtcgtcggaccggacgaccggtccgttaggttactttaagttcggtacgacggtaagtaacgttttaaccgtttttttaagtaggttacggggtttagggtagtttaagtttaacggtaacgggtaaggggtttcgggggttactttttaggtaacgttaggttcggttacggggtaccgtaaaggggtactaaggttcggtaccgttacccgg

SEQ ID NO: 79533 - DNA, 577 bp, Homo sapiens
  misc_feature: GYAE6OF02IEU66.36.29.C07.1.454.CMB.1.raw
  modified_base (237)..(237): a, c, t, g, unknown or other
  misc_feature (237)..(237): n is a, c, g, or t
  modified_base (289)..(289): a, c, t, g, unknown or other
  misc_feature (289)..(289): n is a, c, g, or t
  modified_base (355)..(355): a, c, t, g, unknown or other
  misc_feature (355)..(355): n is a, c, g, or t
  modified_base (379)..(379): a, c, t, g, unknown or other
  misc_feature (379)..(379): n is a, c, g, or t
  modified_base (388)..(388): a, c, t, g, unknown or other
  misc_feature (388)..(388): n is a, c, g, or t
  modified_base (423)..(423): a, c, t, g, unknown or other
  misc_feature (423)..(423): n is a, c, g, or t
  modified_base (441)..(441): a, c, t, g, unknown or other
  misc_feature (441)..(441): n is a, c, g, or t
  modified_base (458)..(458): a, c, t, g, unknown or other
  misc_feature (458)..(458): n is a, c, g, or t
  modified_base (487)..(487): a, c, t, g, unknown or other
  misc_feature (487)..(487): n is a, c, g, or t
tcagtacgctgtctcacgaccggtgctcgatttagagtgctacgaagggaaagggtctgcgaaggcttcaccagtcctggacctcctgtgcaagaacatgaaacatctgtggttcttccttctcctggtggcagctcccagatgggtcctgtcccaggtgcagctgcaggagtcgggcccaggactggtgaagccttcgcagaccctgtccctcacctgcactgtctctggtgctcntcagtactatcgtggagttggatccggcacgccccgagggaacggtcgtggnggtggtacgttgggtatagtgtatcgacgaggtgggtaacaaccgaactacgtacgtccctcctanaacgtcgtacgacgtacacatacncagtacacncgtacaacgtacctattcctcctagaactcgtagngactcgtgtcgtaccgcncggacgcgcggtccgtntattgtcgtgcgagttagttacttttagngttggttcgggtattagttaggtaggtggttcgggttctttagtagttacgttcggtagggtaccgtaagggactaggttcggactccgg

SEQ ID NO: 79534 - DNA, 818 bp, Homo sapiens
  misc_feature: GYAE6OF02HFY5Y.36.29.C07.1.454.CMB.1.raw
tcagtacgctgtctcacgaccggtgctcgatttagagtgctacgaagggaaagggtctgcgaaggcttcaccagtcctggacctcctgtgcaagaacatgaaacatctgtggttcttccttctcctggtgcagctcccagatggtcctgtcccaggtgcagctgcaggagtcgggccaggactggtgaagccttcgcacgaccctgtccctcacctgcactgtctcgtggtagctccatcagtacttactactggtagttcggactccggcacgtcccccgagggtacggacgtggaggtcggagttgggtatagtgtactaccgagtaggtagggacgaaaccgaaacgttaccgaaccggttcccctacccgtaactaacggtacgttccgaacgttaccaaccgtacttaagtccgtaagtaacgtaaaccgtaccgttaaccgaaaacgtaaacccgttaccgtttaccccgtacccgtttaaggaaaccgtacgtttacggaaccgttccgttaccggttcgtaccggtaacccggtcgttacggggcccgaacccggacccgggttacccttaggttaaccgtttttacgttaacggtcggtacggttaaccgttaacggtttaaccgtttttttttaacccttaaggtttcgggggtttttaaccggggttacggttttaagttttaaacgggttacgggtttacgggggttacgggggttacgttttttaggtaaacgttttccggttacggttccggggtaaccgttaacggggtaacgttaacgttacgggttacccgttaacccggg

SEQ ID NO: 79535 - DNA, 673 bp, Homo sapiens
  misc_feature: GYAE6OF02FK5Z5.36.29.C07.1.454.CMB.1.raw
tcagtacgctgtctcacgaccggtgctcgatttagagtgctacgaagggaaagggtctgcgaaggcttcaccagtcctggacctcctgtgcaagaacatgaaacatctgtggttcttccttctcctggtggcagctcccagatgggtcctgtcccaggtgcagctgcaggaggtccgggcccaggtactggtgaagccttcgctacgaccctgtcccctcacctgacactgtcctcgtggtggcctaccattcagttacttactactggagttggatccggcaccgcccccgagggaacggctgggtgcggtagttggtatagtgtactcgactaggtggacgtaaccactacgacgtccctacctacgaacgtcgtacgacgtacaacctagtactcgtaagcacgaccgtaccaaagtaccctagttccaccgtaacgacgtcgtagacgcctacggtcgtaccggtaccgtcgtcggacccggtcggaccgggtccttagttactttagtggtacgtacggtacgttacgttttacgttttttcgtagtttcgggttacgggttaatttacgttaacggtacggtaggggttcggggttacttttaggtacgtttacgttacggtacggggttaaccgacggggtaactacgggtcggttcgtaacccgg

SEQ ID NO: 79536 - DNA, 733 bp, Homo sapiens
  misc_feature: GYAE6OF02IV06W.36.29.C07.1.454.CMB.1.raw
tcagtacgctgtctcacgaccggtgctcgatttagagtgctacgaagggaaagggtctgcgaaggcttcaccagtcctggacctcctgtgcaagaacatgaaacatctgtggttcttccttctcctggtggcagctcccagatgggtcctgtcccaggtgcagctgcaggagtcgggcccaggactggtgttaagccttcgcagaccctgtccctcacctgcactgtctgtggtcgctccatcagttacttactacgtggtagttggactccggacaccggacccccgaaggggaacgggtacgtagggaggtaggtagttgggtattagtagtatacgacgtaggtagggaacgaaaccaactacgacgtaccctacctacgaagtacgtacgtacgtacactaatactacgtaagtacgaacctaacgtacgaaacgtaacctacgttacctaccgtagaacgtcgtacgacgtactcgtagtacgaccgtacgtacggaccgtacgaccggtacgttagttaacgtttagttacggtacggtacgtaacggtttaacgttttaacgttttttaacgtacggtttacggggtttaacggggttaagttttacgttaacggttaacggggtttacggggttacggggtttcgttttacggtaacgtttacggttaccggtacgggggtaacggtaacgggtaacttaacgggttacggtacccgttaaccgg

SEQ ID NO: 79537 - DNA, 909 bp, Homo sapiens
  misc_feature: GYAE6OF02H8Y2E.36.29.C07.1.454.CMB.1.raw
  modified_base (252)..(252): a, c, t, g, unknown or other
  misc_feature (252)..(252): n is a, c, g, or t
tcagtacgctgtctcacgaccggtgctcgatttagagtgctacgaagggaaagggtctgcgaagccttcgcagaccctgtccctcacctgcactgtctctggtggctccatcagtacttactactggagttggatccggcacgccccgaggggaagggactggagtggattgggtatatgtatcacaggtagggaacgaacctaactacacgttcccctcctacaagacgtcgagtccaccatactcagtanacaccgtacaacgaacctagttcctcccgtagtaacgtctaggacgtccttcgtcggtccggaacccgtcgtcggaccgggaaccgtaccggtcccggttaggtttaattttaagtttgggacggtaccggtaacggttaacgttttaaccgtttttttttaactaagggtttcgggggtttacggggttaacgttttaagttaacggttaaacgggtacgggggtttacgggggtttacgtttttagaagtttacgtcgggttacggggaacgtaaacgggggtaactacggttacgggtccgtaacccggtttcgtttaccgttacgtaccggtacccctaaccccggtaacccggaaacccggggtccccgtacgttaccccgggttcccccgtttcccccggtacgggtacccctaacccccgtttccgtaacccgaaacggtacccgaacccgtcccggttcggggtacccggggtaacctaaccggtaccgggtacccgggttccccggggttcgggtcccgtccggggttaacccgttcggggaaccgttaaccggtaccgtttaacccgtcggaaccgtacggtaaccggttaccggtaacggttcgggacgggtccgggtacggtccggggtaaccgacgggtaccgg

SEQ ID NO: 79538 - DNA, 703 bp, Homo sapiens
  misc_feature: GYAE6OF02H5TR8.36.29.C07.1.454.CMB.1.raw
tcagtacgctgtctcacgaccggtgctcgatttagagtgctacgaagggaaagggtctgcgaaggcttcaccagtcctggacctctgtgcaagaacatgaaacatctgtggttcttccttctctggtggcagcctccagagtcgggtcctgtcccaggtgcagctgcgagggacggtccgggcccagggctgggtggaactccgttcgcacgaccctgtccctcacctgctacgtgtctgtggtcgcctcatctacgttacttactacgtggtagttggactccggcaccgaccccgagggaaggcgtgggacgtggacggtttgggtaatagttagtagtccgaacgtaggtagggaacgtaaccgaaacgttaccgacgtccccctaccgtacgaacggacgttacgacgtaccacctaatactacgtaagtaacgacctaccggtaaccaacgtaaccgtacgtttcctaccgtagaacgcgtgtacgcttggtacgtcggaccgtcggtcgaccggcggtcccgaggttcttaagttcgttacggtcgaggttctaccgtttttaactttttaacgtcggttagggtttacgggttagtttaaggttaactaacggggttggggttcggtttagttttaggacgtttggtaccgggtcgggtaccgtacgggtaactaggttaccggtcgttaacccgg

SEQ ID NO: 79539 - DNA, 852 bp, Homo sapiens
  misc_feature: GYAE6OF02H3GIX.36.29.C07.1.454.CMB.1.raw
tcagtacgctgtctcacgaccggtgctcgatttagagtgctacgaagggaaagggtctgcgaagccttcgcagaccctgtccctcacctgcactgtctctggtggctccatcagtacttactactggagttggatccggcacgcccccagggaagggactggagtggagttgggtatagtgtatcactaggtgggacgaaccaactacacgtcccctacctcaagacgtcgagtcacatactacgagtagaccgtaaccgtaccaaacgaacctaacgtttcctacccgtagtaaacgcgtaggacgcttctgtcgaccgtcgtcggacggtaacgtaccgcccggttagttaatttagtttacgtcggtacggtaacgtacggttttacttttttttaacgttaggtttacggggtttacggggttaaggttttaagtttaacggtaaaccgggttaggggttaccggggggttgttttttacggaagtttacggttaccggttacggggtaaccgggaaaggggtaacgtaaacgtttacggggtaccgtaacccggtttccgttaccgtttaccgaaccgttccccttaccccggaaaacccggtaacccggggaccccctaacgggtttcccgggttaccctttccccccgggtaccgttaccctaaccccccgttaacccgtacccgaaaggtcccacccgtaccggtccggttaccgggggaccacggaccgtccgggtacccggcgggttaccgccgtacgttcgggtaacgacggtacccttacgtcccgtaacgtacgaccggtacgtacgtacggcggtaccggcggtcggacggataccgg

SEQ ID NO: 79540 - DNA, 1033 bp, Homo sapiens
  misc_feature: GYAE6OF02G7BV2.36.29.C07.1.454.CMB.1.raw
tcagtacgctgtctcacgaccggtgctcgatttagagtgctacgaagggaaagggtctgacgaaggcttcaccagtcctggacctcctgtgcaagaacatgaaacatctgtaggttccttccttctcctggtggcagcctccagtatgggtcctgtcccagggtcgcagctcgacgaggacggttccgggcccaaggtcgttgggtacgaacgtccgtttcgccgaacgtacccttcggttcccctacctaccgttcggaccttaccgttcggttccttacggttcggttcggccttaccgtacgttccgtaaggtttacccttacgtaccggttaggtacgggtttacgtaccgtacccgggtctaaccccggtacccccggtaaagggggaaccggttaggtacggggtacggttaggggtaacggtttaggggtttaacttaacgttacggtaacgtaccggtaaccggtaacggggtttacggggaaaaccttaaaaccccgtaaaccgttaacccggttacccccggtttacccccgtaaccccttaaacgggtaacgggtttaaaccgttcccggggtaaaccggtttaaccccaacggttaaaacgtttacccgttaaggttaaacgtaccggaaacccgttaaccgtaaaaccggtaaccccgtaaacggttaacccggtttaacccctaccgggttaactaccgggttaccgtaacggtaccgttaacccgttccgttaacggttaaccccggtcccggtaacgtttccgggaacccgggtaacccggtaaccggtacggtttaaccgtttcgttaacgtttacgggacccggttacgtaacgggtttttaagttttacccgtttttaaaggtttccgggttaacggttttacgggtttaacgttttaacggttacggttaaggggtttaccggggtttcggggtttactttacggttacgttacgggttacgggaaccgggttacggtaacggttaacgtacggttaccgtccgttaacccgg

SEQ ID NO: 79541 - DNA, 777 bp, Homo sapiens
  misc_feature: GYAE6OF02JJQN2.36.29.C07.1.454.CMB.1.raw
tcagtacgctgtctcacgaccggtgctcgatttagagtgctacgaagggaaagggtctgcgaaggcttcaccagtcctggacctcctgtgcaagaacatgaaacatctgtggttcttccttctcctggtgcagctccagatggtcctgtcccaggtgcagctgcaggaggtccgggcccaggacgtggtaggaacgtccttcgcgacgacccttcgtcccttcaccgtgctactgtctcgtggttcgcctaccatacagtacttactacgtggagttacggacgtccggacaccggaccccgaagggaacggcgtggagtaggtagttgggtatagtagtacgtacacgtaggtcgggtaaacgaacctaacgtacaccggttccctacccgtagaacggtaggtaccgaagtaccaactaacgtactcgtaacgtaacgaacctaaccgaccgtaaacgtaacgttaccggtttactaacccgtaggaaactcgtaggtaccgtctaccggtagtaccggaacgtccgtaccggtacgtaacccgccgggttaccgtttagtaatttcggtagtaccgtacgtacggttagtttttaaaccgttttttcgtaacgggtttacgggttttaaccggggtagtttttaaacttacgggttaaacgggtcggggggtttcggtttaacttttagggtaaccttttagggtacccggggtttaaggggtacccggaaaggttaaccggttaacgggttaccgggttaacccgttcccggg

SEQ ID NO: 79542 - DNA, 438 bp, Homo sapiens
  misc_feature: GYAE6OF01BHJU1.44.61.F06.1.454.CMB.1.raw
  modified_base (146)..(146): a, c, t, g, unknown or other
  misc_feature (146)..(146): n is a, c, g, or t
  modified_base (434)..(438): a, c, t, g, unknown or other
  misc_feature (434)..(438): n is a, c, g, or t
tcagacagtatatacacgaccggtgctcgatttagctacgctctaagggaaagggcctgatgtgggtctcacgtattaacaccgatgggactatcactggttactcagacgccgtgaagggccgattcatcatctccagagacaangttttcgaaaacacggtgtatttacaaatgaacagtctaagagtcgaggacacggctgtctactattgtgtgagaccttatgatttcacttgggggagttatcgtttgggcccacactggggccagggaaccttggtcgtcgtctcctcagcttccaccaagggccccatcggtcttccccctggcgccctgctccaggagcacctctgggggcacagcggccctgggctgcctggtcaaggactacttcctatatactgtctgagcgggctggcaaggcgcatacgnnnnn

SEQ ID NO: 79543 - DNA, 152 bp, Homo sapiens
  misc_feature: GYAE6OF02IE7N8.44.61.F06.1.454.CMB.1.raw
tcagacagtatatacacgaccggtgctcgatttagctacgctctaagggaaagggacacgacttgagattaagcgaactgtggctgcaccatctgtcttcatcttcccgccatctgatatatactgtctgagcgggctggcaaggcgcatag

SEQ ID NO: 79544 - DNA, 411 bp, Homo sapiens
  misc_feature: GYAE6OF02ISRC8.44.61.F06.1.454.CMB.1.raw
  modified_base (403)..(411): a, c, t, g, unknown or other
  misc_feature (403)..(411): n is a, c, g, or t
tcagacagtatatacacgaccggtgctcgatttagctacgctctaagggaaaggggctggagtgggttggccgtattagaaccaaagctgacggtgggacagcagactacgctgcacccgtgaaaggcagattcaccatctcaagagatgattcaaaagatacggtgtctctgcagatgaacagcctgaacaccgaggacacagccgtctattactgtctgggatggtttcattcgggccagggaaccctggtcaccgtctcctcagcctccaccaagggcccatcggtcttccccctggcgccctgctccaggagcacctctgggggcacagcggccctggggctgtctggtcaaggactacttccacgtctactgctgagcgggctggcaaggcgcatagnnnnnnnnn

SEQ ID NO: 79545 - DNA, 506 bp, Homo sapiens
  misc_feature: GYAE6OF02I8NO3.44.61.F06.1.454.CMB.1.raw
  modified_base (242)..(242): a, c, t, g, unknown or other
  misc_feature (242)..(242): n is a, c, g, or t
  modified_base (490)..(490): a, c, t, g, unknown or other
  misc_feature (490)..(490): n is a, c, g, or t
tcagacagtatatacacgaccggtgctcgatttagctacgctctaagggaaagggggggtcacaagaggcagcgctctcgggacgtctccaccatggcctgggctctgctgctcctcactctcctcactcaggacacagggtcctgggcccagtctgccctgactcagcctgcctccgtgtctggttctcctggacagtcgatcaccatctcctgcactgggtccagcaatgacattggganatataaccttgtctcctggtatcaacaacatccaggcaaagcccccaaactcatacttttgagtccagtgagcggccgtcaggtgttctaatcgcttctctgctcaagtctggccacacggcctcctgtcgactctctgggctccggctgaggacgagctgactattactgcgctcatatacaagtggaactactttactattcggcgacgacggacaagtcctgaccgtctaggtcagccaacggcncgcccctcggctaccg

SEQ ID NO: 79546 - DNA, 521 bp, Homo sapiens
  misc_feature: GYAE6OF02GEKAO.44.61.F06.1.454.CMB.1.raw
  modified_base (224)..(224): a, c, t, g, unknown or other
  misc_feature (224)..(224): n is a, c, g, or t
  modified_base (320)..(320): a, c, t, g, unknown or other
  misc_feature (320)..(320): n is a, c, g, or t
  modified_base (508)..(508): a, c, t, g, unknown or other
  misc_feature (508)..(508): n is a, c, g, or t
tcagacagtatatacacgaccggtgctcgatttagctacgctctaagggaaaggggggggtcacaagaggcagcgctctcgggacgtctccaccatggcctgggctctgctgctcctcactctcctcactcaggacacagggtcctgggcccagtctgccctgactcagcctgcctccgtgtctgggtcgcctggacagtcggtcaccatctcctgcactgganccagcggtaatattcttagtcttaacttgtctcctggtatcaacatcatccaggtaaagcccccaaatcatcatctatgagcctataagagccctnagggtttctaatcgcttcactgcctccaagtccgcaacacgcctccctgacatctctggctccaggctgaggacgaggctgatttattattgttgctcagtattgttcgtcgctatctactttatgttcttacgggaagtcgggaccaaggtccaccgtcctaggtcacgtcccaaggcccaacccgntcgtcaccttccg

SEQ ID NO: 79547 - DNA, 741 bp, Homo sapiens
  misc_feature: GYAE6OF02JTUVL.44.61.F06.1.454.CMB.1.raw
  modified_base (212)..(212): a, c, t, g, unknown or other
  misc_feature (212)..(212): n is a, c, g, or t
  modified_base (216)..(216): a, c, t, g, unknown or other
  misc_feature (216)..(216): n is a, c, g, or t
tcagacagtatatacacgaccggtgctcgatttagctacgctctaagggaaaggggggggtcgtcgaggaggcagcgctctcgggacgtctccaccatggcctgggctctgctattcctcacctcctcactcaggtcacagggtcctgggcccagtctcgccctgactcagcctgcctccgtgtctgggtccacctggacagtcgatcaccntccncctgcattcgggaacccagcagtcgactattcgggtagttataacgttatcgttacttccgtaggttaacccaaactaaccaaccccgaaggaccaaaccgacccccccaaaactcctaacgtacgtacttaccacttagaagttcgtactaacgttaacgtaccgtacccgttacggtacggggttttacgtcgggtccgtactttccgtacgttcgggtccttaccgtaacggtccgttacgggacctaaaccggccgggtaccctacccgtcgtaccctacgttctacggtcggtacctccgacgggtcacgggtacgacggtgtaccgtagaccgttaagttccgtcgacgtacgctacgtaacgtaaacgtaaacaggacctaaacgtaacttcgttaataccggttacgggacggtaacgggtaccaacggtaccggtcgttaacccggtccgtaaggtacccggtaagaccccggtaggacccgttaccccggccccggtttacggacccttacccgg

SEQ ID NO: 79548 - DNA, 240 bp, Homo sapiens
  misc_feature: GYAE6OF01C7L71.16.12.B01.1.454.CMB.1.raw
  modified_base (237)..(240): a, c, t, g, unknown or other
  misc_feature (237)..(240): n is a, c, g, or t
tcagtgtactactccacgaccggtgctcgatttagtagtgtagatttggggacccgatgcttatgatagctgggccaagggacaatggtcaccgtctcttcagcctccaccaagggcccatcggtcttcccctggcaccctcctccaagagcacctctgggggcacagcggccctgggctgcctggtcaaggactacttccgagtagtacactgagcgggctggcaaggcgcatagnnnn

SEQ ID NO: 79549 - DNA, 239 bp, Homo sapiens
  misc_feature: GYAE6OF01C19QS.16.12.B01.1.454.CMB.1.raw
  modified_base (236)..(239): a, c, t, g, unknown or other
  misc_feature (236)..(239): n is a, c, g, or t
tcagtgtactactccacgaccggtgctcgatttagtagtgtagatttggggacccgatgcttatgatagctggggccaagggacaatggtcaccgtctcttcagcctccaccaagggcccatcggtcttcccctggcaccctctccaagagcacctctggggcacagcggccctgggctgcctggtcaaggactacttccgagtagtacactgagcgggctggcaaggcgcatagnnnn

SEQ ID NO: 79550 - DNA, 502 bp, Homo sapiens
  misc_feature: GYAE6OF01CX0MP.16.12.B01.1.454.CMB.1.raw
  modified_base (492)..(492): a, c, t, g, unknown or other
  misc_feature (492)..(492): n is a, c, g, or t
tcagtgtactactccacgaccggtgctcgatttagtagtgtagattccgcggggctgggcctcaggaagcagcatcggaggtgcctcagccatggcatggatccctctcttcctcggcgtccttgcttactgcacagtatcggtggcctcctatcagttgactcagccaccctcagtgtccgtgtccccaggacagacggccagcatcatctgctctggagataacttgggggataaatatactttctggtatcagcagaaggccggccagtcccctgtattggtcatctttcaagataccgagcggccctcagagatccctgagcgattctctggctccaactctgggaacacagccactctgaccatcagcgggccagactatggatgagctgactatactgtcaggcgtgggacagcaagttctgtgtagttttcggcggaggaccagttcgaccgtcgtaggtcacgcccgaggctcgcccctggtcncgtcgtcccg

SEQ ID NO: 79551 - DNA, 509 bp, Homo sapiens
  misc_feature: GYAE6OF01EVQBO.16.12.B01.1.454.CMB.1.raw
  modified_base (442)..(442): a, c, t, g, unknown or other
  misc_feature (442)..(442): n is a, c, g, or t
  modified_base (498)..(498): a, c, t, g, unknown or other
  misc_feature (498)..(498): n is a, c, g, or t
tcagtgtactactccacgaccggtgctcgatttagtagtgtagattccgcggggctgggcctcaggaagcagcatcggaggtgcctcagccatggcatggatccctctcttcctcggcgtccttgcttactgcacagtatcggtggcctcctatcagttgactcagccaccctcagtgtccgtgtccccaggacagacggccagcatcatctgctctggagataacttgggggataaatatactttctggtatcagcagaaggccggccagtcccctgtattggtcatctttcaagataccgagcggccctcagagatccctgagcgattctctggctccaactctgggaacacagccactctgaccatcagcgggccagactatggatgaggctgactattactgtcaggcgtgggacaggcaattctgtgtagtttcggnggagggacctaagtgtaccggtcgtaggtcgacgcccaaggctcgcccctggtccncgtcgttcccg

SEQ ID NO: 79552 - DNA, 516 bp, Homo sapiens
  misc_feature: GYAE6OF01A7YXT.16.12.B01.1.454.CMB.1.raw
tcagtgtactactccacgaccggtgctcgatttagtagtgtagattccgcggggctgggcctcaggaagcagcatcggaggtgcctcagccatggcatggatccctctcttcctcggcgtccttgcttactgcacagtatcggtggcctcctatcagttgactcagccaccctcagtgtccgtgtccccaggacagacggccagcatcatctgctctggagataacttgggggataaatatactttctggtatcagcagaaggccggccagtcccctgtattggtcatctttcaagataccgagcggccctcagagatccctgagcgattctctggctccaactctgggaacacagccactctgaccatcagcgggcccagactatggatgagctgactattactgtcaggcgtgggacagcaattcgtgtgtagttttcgggcggtagggaccaaggttcggaccgtccgtagggtcacggacccaaggctcgccccctcggctacgtccgtccg

SEQ ID NO: 79553 - DNA, 508 bp, Homo sapiens
  misc_feature: GYAE6OF01B9HMK.16.12.B01.1.454.CMB.1.raw
  modified_base (303)..(303): a, c, t, g, unknown or other
  misc_feature (303)..(303): n is a, c, g, or t
tcagtgtactactccacgaccggtgctcgatttagtagtgtagattccgcgggctgggcctcaggaagcagcatcggaggtgcctcagccatggcatggatccctctcttcctcggcgtccttgcttactgcacagtatcggtggcctcctatcagttgactcagccaccctcagtgtccgtgtccccaggacagacggccagcatcatctgctctggagataacttgggggataaatatactttctggtatcagcagaaggccggccagtcccctgtattggtcatctttcaagataccgancggccctcagagatccctgagcgattctctggctccaactctgggaacacagccaactctgaccatcagcgggccagactatggatgaggctgactattactgtcaggcgtggggactagcaaattctggttgtagttttcggcggagggaccaagttgaccgtctaggtcagcccaaggctcgcccctggtccacgtcgtcccg

SEQ ID NO: 79554 - DNA, 550 bp, Homo sapiens
  misc_feature: GYAE6OF01B0P1X.16.12.B01.1.454.CMB.1.raw
tcagtgtactactccacgaccggtgctcgatttagtagtgtagattccgcggggctgggcctcaggaagcagcatcggaggtgcctcagccatggcatggatccctctcttcctcggcgtccttgcttactgcacagtatcggtggcctcctatcagttgactcagccaccctcagtgtccgtgtccccaggacagacggccagcatcatctgctctggagataacttgggggataaatataactttctggtatcagcagaaggccggccagtcccctgtattggtcatctttcaagataccgagcggcctcagagatccctgagcgattctctggctccaactctgggaacacagccactctgaccatcagcgggccagactatggatgagctgactattacgtgtcaggcgtgggacagacaagtttctgttagtagttttcgggcggtacgggtaaccgtaaggttcgacccggttaccgtaggtccgacggtacccgaaacgggccgtaccggccccccgttcggtcctaccgttccgttaccccg

SEQ ID NO: 79555 - DNA, 550 bp, Homo sapiens
  misc_feature: GYAE6OF01A3JIU.16.12.B01.1.454.CMB.1.raw
tcagtgtactactccacgaccggtgctcgatttagtagtgtagattccgcggggctgggcctcaggaagcagcatcggaggtgcctcagccatggcatggatccctctcttcctcggcgtccttgcttactgcacagtatcggtggcctcctatcagttgactcagccaccctcagtgtccgtgtccccaggacagacggccagcatcatctgctctggagataacttgggggataaatatactttctggtatcagcagaaggccggccagtcccctgtattggtcatctttcaagataccgagcggccctcagagatccctgagcgattctctggctccaactctgggaacacagccactctgaccatcgacgcgggcccagactatggatgaggctgactagttactgtcgaggcgtgggacagactaattcgtgttgtagttttcgggcggtacgggtaaccgtaaggttacgtacccggtccgtacggtacgcggaccccgaagggtccgtccggcccccgtcggtccctccgttccgttaccccg

SEQ ID NO: 79556 - DNA, 229 bp, Homo sapiens
  misc_feature: GYAE6OF01CKMGX.16.12.B01.1.454.CMB.1.raw
  modified_base (226)..(229): a, c, t, g, unknown or other
  misc_feature (226)..(229): n is a, c, g, or t
tcagtgtactactccacgaccggtgctcgatttagtagtgtagattccgcggggcccgagactatggatgaggctgactattactgtcaggcgtgggacagcaattctgtgattttcggcggagggaccaagttgaccgtcctaggtcagcccaaggctgccccctggtcactctgttcccaccctcctcgagtagtacactgagcgggctggcaaggcgcatagnnnn

SEQ ID NO: 79557 - DNA, 535 bp, Homo sapiens
  misc_feature: GYAE6OF01ANX46.16.12.B01.1.454.CMB.1.raw
  modified_base (531)..(531): a, c, t, g, unknown or other
  misc_feature (531)..(531): n is a, c, g, or t
  modified_base (534)..(535): a, c, t, g, unknown or other
  misc_feature (534)..(535): n is a, c, g, or t
tcagtgtactactccacgaccggtgctcgatttagtagtgtagatttgggcttggaacagcctggggggtccctgagactctcctgtgcaacctctggattcacctttaccagctatgccatgagctgggtccgccaggctccagggaaggggctggagtgggtcgcagccattagtggtattcgtaatgccacatactacgcagactccgtgaggggccggttcaccatctccagcgacacttccaggagcacgttgtatctgcaaatgaacagcctgagagtcgaggacacggccctatattactgtgcgaaagataagatttggggacccgatgcttatgatagctggggccaagggacaatggtcaccgtctcttcagcctcaccaacgggcccatcggtccttccccctcggccaccctcctccaacgacgcacctcgtcggggcacgacgccggcccgtgggctcgccgtggtcaaggacctacttccgagtacgtacgctgaggcgggcgtggcaacggcgacntgnn

SEQ ID NO: 79558 - DNA, 569 bp, Homo sapiens
  misc_feature: GYAE6OF01AJN6X.16.12.B01.1.454.CMB.1.raw
tcagtgtactactccacgaccggtgctcgatttagtagtgtagattccgcggggctgggcctcaggaagcagcatcggaggtgcctcagccatggcatggatccctctcttcctcggcgtccttgcttactgcacagtatcggtggcctcctatcagttgactcagccaccctcagtgtccgtgtccccaggacagacggccagcatcatctgctctggagataacgttggggataaatatactttctggtatcagcagaaggccggccacgtcccctgtattggtcatctttcaagataccgagcggccctcagagactccctgagcgtattctctggctccaactctacgggaacacacgccactctcgaccatcgaggccgggcccagactagtgatgaggctagactattactgtcgaggcgtagggacctaggactaattctggttcggttagttttaccgggcgggtacgggaccgtaagggttcgaccgttcccgtagggtaccaccggacccagggtcccgtccggtccccccgttcggtccctacgttcccgttaccccg

SEQ ID NO: 79559 - DNA, 801 bp, Homo sapiens
  misc_feature: GYAE6OF01DW0F4.16.12.B01.1.454.CMB.1.raw
  modified_base (175)..(175): a, c, t, g, unknown or other
  misc_feature (175)..(175): n is a, c, g, or t
  modified_base (197)..(197): a, c, t, g, unknown or other
  misc_feature (197)..(197): n is a, c, g, or t
  modified_base (225)..(225): a, c, t, g, unknown or other
  misc_feature (225)..(225): n is a, c, g, or t
tcagtgtactactccacgaccggtgctcgatttagtagtgtagattccgcggggctgggcctcaggaagcagcatcggaggtgcctcagccatggcatggatccctctcttcctcggcgtccttgcttactgcacagtatcggtgcctctatgagttgactcagtccttcccctnagtcgtccgtcgtccccggganagacagccagcatcacctgctcgtgganactaaccgtagggtaaattaaattttactttcgtggtatcgaggacggaacgccaaggcctacgttcccgttggttttacggtcctattactaaataaaagaagtacggtaatcccggacccttacgaacgaacctacttaccccgtaggacggtactacgtttccgtcgtcggtacccttaccgacggtccttacgtaacgggaaaaccaccgaccgtaccctaccgttaccgaccgaacccgtacgtaccccggaaccccggggaaccccaagtaccgtaaggttacggaattacggaaacgtcgttagtaaacctttaacgttaccgttaggtccgtaacggggtcgggtaacgggaaccggacgggtacccggtaccgttaacgggtttcggggttttaccgggggtttacccggggaaccgggggttaaacgggtaacccgtaacgggtacccgtaccgggttaaccccgttccggtaccgggtaccgtacccggacccgtaacggtcccgtccccggtccccgttacggtcctaccgttcccgttccccggtccccgtcccgttacccgg

SEQ ID NO: 79560 - DNA, 559 bp, Homo sapiens
  misc_feature: GYAE6OF01CG6FZ.16.12.B01.1.454.CMB.1.raw
  modified_base (285)..(285): a, c, t, g, unknown or other
  misc_feature (285)..(285): n is a, c, g, or t
  modified_base (419)..(419): a, c, t, g, unknown or other
  misc_feature (419)..(419): n is a, c, g, or t
  modified_base (519)..(519): a, c, t, g, unknown or other
  misc_feature (519)..(519): n is a, c, g, or t
tcagtgtactactccacgaccggtgctcgatttagtagtgtagattcgtcggggggtaggtcagactcagtcaggacacgagcataggacatgagggtccccgctcagctcctggggtctcctgctgctctggcctcccaggtatcaaagtgtgacatccagatgaccctagtctccttccaccctgtctgcatcgtgcggagacagagtcaccatcacttgccgggccagtcagtagtgttggtacctggttggcctggtatcgagcaagaaaccagggaaacncccctaagcctcctgatctatgtatgtctccaagtagtagggtaaacggtcggggtacccagtcgaaaggtttcaaggcggctaaggtggatcgtagggacagtacttcactcgtacacagtcagcacgctacngtctgatgtattttggactactttatatcgacctaatagttaattagtagtttacttacgttaacgtttcggaccctagggacctaagtgtaggtactanacgtaacgtagtcgtagcgtacacgacctagtctgttacc

SEQ ID NO: 79561 - DNA, 628 bp, Homo sapiens
  misc_feature: GYAE6OF01DTVIB.16.12.B01.1.454.CMB.1.raw
  modified_base (400)..(400): a, c, t, g, unknown or other
  misc_feature (400)..(400): n is a, c, g, or t
tcagtgtactactccacgaccggtgctcgatttagtagtgtagattccgcggggctgggcctcaggaagcagcatcggaggtgcctcagccatggcatggatccctctcttcctcggcgtcattgcttactgcacagtatcggtgcctcctatcagttgactcacgccaccctcagtgtccgtgtccccaggacagacggccagcatcatctgctcgtggagataacgttggggaataaatattactttctggtatcagcaagaaggccgccacgtcccctgtacttggctatctttcaaagtactaccggagccggccctacgagacggactcccgtgacggcgtacttctcgtggcctaccaactcgtacgggaacaccagccctaactctcgaaccntccgacggcccggggaaccagtaacgttagacggagtacggacggtcttaacgacttaacgttacctggttaccgagggtcggtagggaaccacggtacttaacgttcgtgtttacggttacggtttacgggacgggtacggtaccgtaaggttaccgtaccggtaccgtagggtcacccggacccgaacggttccgacccgtccccgtacggtcctacgttccccgg

SEQ ID NO: 79562 - DNA, 750 bp, Homo sapiens
  misc_feature: GYAE6OF01DCZLY.16.12.B01.1.454.CMB.1.raw
  modified_base (548)..(548): a, c, t, g, unknown or other
  misc_feature (548)..(548): n is a, c, g, or t
tcagtgtactactccacgaccggtgctcgatttagtagtgtagattccgcggggctgggcctcaggaagcagcatcggaggtgcctcagccatggcatggatccctctcttcctcggcgtccttgcttactgcacagtatcggtcgcctcctatcagttgactcacgccctaccctcgacggttcgtcccgtcgtaccccgaggaccgacggaccggccaagccatcatcgtgcttcgtaggagtaacgttaacggttaggggtaattaaattacttacgtttacgttggttaactcgaagacgacggaaccggccggtacctacggttcccttggttacttcggttactacttactttacgaagcgttaccggacgccgcccgtacaggacctacgtccctaggacgtaccgtacttccgtcgtacggacccttacccgaacgttcggaaccggtaaaccacgtaccggacctacgtacgtaccgaacccgtacgggtccccaaggggccccgggtaactaggaacctttggacgtagtggaccgtntacgtacttcgtacggtcgtaggaaccgtgtacggaaacttcggtaacgtttcgtacggtttcggtacggttacggttaaccgggaccgggtacggtaaccccgttggtaccgttacccgacggttaccgtacggcccgtaccgggtaccccgtcggtcccccttaacccggttggaccctttccggtcccgttacccccgg

SEQ ID NO: 79563 - DNA, 539 bp, Homo sapiens
  misc_feature: GYAE6OF01BY4NW.16.12.B01.1.454.CMB.1.raw
tcagtgtactactccacgaccggtgctcgatttagtagtgtagattccgcggggctgggcctcaggaagcagcatcggaggtgcctcagccatggcatggatccctctcttcctcggcgtccttgcttactgcacagtatcggtggcctcctatcagttgactcagccaccctcagtgtccgtgtccccaggacagacggccagcatcatctgctctggagataacttgggggataaatataactttctggtatcagcagaaggccggcagtcccctgtattggtcatctttcaagataccgagcggccctcagagatccctgagcgattctctggctccaactctggaaacacagccaactctgaccatcgaccgggaccagactatggatgaagctgacctattactgtcaggcgtggactggcggcacgtggttggtttcggcgggtaggaccgaagtccgtggaccgtccgtcggttacacggccccaacggtcctcggacccccgttcggtaccactccgttcgttaccccccg

SEQ ID NO: 79564 - DNA, 609 bp, Homo sapiens
  misc_feature: GYAE6OF01CIA3S.16.12.B01.1.454.CMB.1.raw
tcagtgtactactccacgaccggtgctcgatttagtagtgtagatttgggcttggaacagcctggggggtccctgagactctcctgtgcaacctctggattcacctttaccagctatgccatgagctgggtccgccaggctccagggaaggggctggagtgggtcgcagccattagtggtattcgtgatgccacatactacgcagactccgtgaggggccgttcaccatctccagcgacacttccaggagcacgttgtatctgcaaatgaacagcctgagagtcgaggacacggccctatattactgtgacgaaagataagtagtttcggggacccagtgacttagtgatagcgtgggccaaagggacaagtggtccaccgtcttcttcacgccctaccacccgaacgggccccagttccggtcccttcccccgtcggtcccacccctccctaccgaacgacgccaccgtcgtcggggccacgacggccggtacccgtcgggcgtcgccgtacggtaccgaacggtaccgttactccggtaacgtacgtaacgacgttcgggacggccgggtacggtcgggaccgaacgggtcccgacgtagtggtacg

SEQ ID NO: 79565 - DNA, 551 bp, Homo sapiens
  misc_feature: GYAE6OF01A7LNP.16.12.B01.1.454.CMB.1.raw
tcagtgtactactccacgaccggtgctcgatttagtagtgtagattccgcggggctgggcctcaggaagcagcatcggaggtgcctcagccatggcatggatccctctcttcctcggcgtccttgcttactgcacagtatcggtggcctcctatcagttgactcagccaccctcagtgtccgtgtccccaggacagacggccagcatcatctgctctggagataacgttgggggataaatatactttctggtatcagcagaaggccggcagtcccctgtattggtcatcttcaagataccgagcggccctcagagatccctgagcgattctctggctccaactcgtgggaacacacgccactctgaccatcaggccgggccagacctagtaggatgaggctgactattactgcgaggcggtggacagactagttctggtgtagtttcgggcgggtacgggtaccgtaggttacgacccggttcgtaggtaccgacgacccgaaggcccgttaccggccccccgttacggtccctccgttccgttacccccg

SEQ ID NO: 79566 - DNA, 225 bp, Homo sapiens
  misc_feature: GYAE6OF01DEG16.16.12.B01.1.454.CMB.1.raw
  modified_base (225)..(225): a, c, t, g, unknown or other
  misc_feature (225)..(225): n is a, c, g, or t
tcagtgtactactccacgaccggtgctcgatttagtagtgtagattccgcggggcccagactatggatgaggctgactattactgtcaggcgtgggacagcaattctgtgattttcggcggagggaccaagttgaccgtcctaggtcagcccaaggctgccccctggtcactctgttcccaccctcctcgagtagtacactgagcgggctggcaaggcgcatagn

SEQ ID NO: 79567 - DNA, 647 bp, Homo sapiens
  misc_feature: GYAE6OF01EEVJL.16.12.B01.1.454.CMB.1.raw
  modified_base (255)..(255): a, c, t, g, unknown or other
  misc_feature (255)..(255): n is a, c, g, or t
tcagtgtactactccacgaccggtgctcgatttagtagtgtagattccgcggggctgggcctcaggaagcagcatcggaggtgcctcagccatggcatggatccctctcttccctcggcgtccttgcttactgcacagtatcggtggcctcctatcagttgactcacgccaccctcagtcgtccgtcgtcccaggacagacgccagcatcatctgctctggagataacgtggggaataaatatacttctggtatnagcaggaacggccgccacgtcccctgtatggtcatcttacaagactaccgagccggccctcagagactccctgagcgattcgtctcgggctaccaactcgtacgggaaccacacgcccactcacgaccatacgacggcccggggacccagtacttaagtcggtatagggacgacgtacggtacttaagtttacgtcgttacgacgggtcggtacgggacgacgacgtaactttcgttaggttaggtacgttttcggggacgggtaacgggtaaccgtaaggttacggtaacccggttcccgtaagggttaccggaccggaccccgtaaacgggtccgttacccggtaccccccggttaccggttaccctacccgttcccgtttacccccggg

SEQ ID NO: 79568 - DNA, 455 bp, Homo sapiens
  misc_feature: GYAE6OF01DFMEO.16.12.B01.1.454.CMB.1.raw
  modified_base (138)..(138): a, c, t, g, unknown or other
  misc_feature (138)..(138): n is a, c, g, or t
  modified_base (221)..(221): a, c, t, g, unknown or other
  misc_feature (221)..(221): n is a, c, g, or t
  modified_base (281)..(281): a, c, t, g, unknown or other
  misc_feature (281)..(281): n is a, c, g, or t
  modified_base (369)..(369): a, c, t, g, unknown or other
  misc_feature (369)..(369): n is a, c, g, or t
  modified_base (415)..(415): a, c, t, g, unknown or other
  misc_feature (415)..(415): n is a, c, g, or t
  modified_base (417)..(417): a, c, t, g, unknown or other
  misc_feature (417)..(417): n is a, c, g, or t
  modified_base (422)..(455): a, c, t, g, unknown or other
  misc_feature (422)..(455): n is a, c, g, or t
tcagtgtactactccacgaccggtgctcgatttagtagtgtagattccgcggggctgggcctcaggaagcagcatcgggaggtgcctcagccatggcatggatccctctcttccctcggcgtccttgcttactgcacngtatcggtgcctcctatcagttgactcacgcccaccctcagtcgtcccgtcgtccccaggacacgacggccagcaatcatctnctcgtaggagtaacgttaacggttaggggaaattaaattacttaccgtttagtggttaanccgagacacggacggccggcctacgtcccttgtacttggtaccttacgttacttacgaaaggtaccgtacggaccgccggtaccctanacgtacgacctcccggtagacgggcggcgtacggacagggtaccanancgcannnnnnnnnnnnnnnnnnnnnnnnnnnnnnnnnn

SEQ ID NO: 79569 - DNA, 591 bp, Homo sapiens
  misc_feature: GYAE6OF01C0HWS.16.12.B01.1.454.CMB.1.raw
tcagtgtactactccacgaccggtgctcgatttagtagtgtagattccgcggggctgggcctcaggaagcagcatcggaggtgcctcagccatggcatggatccctctcttcctcggcgtccttgcttactgcacagtatcggtggcctcctatcagttgactcagccaccctcagtgtccgtgtccccaggacagacggccagcatcatctgctctggagataacgttggggataaatattacttctggtatcagcagaacggccgccagtcccctgtattggtctatctttacaagtactaccgagccggcctcagagactccctagacgcgtacttctcgtggtcctacctaactcgtagggaactacgacgaccactctacgacctatcgacggccgggacccagactagtggataggacgctagtacttattacgtgtcgaggtcgtgggaacagactaagttcgtagtagttacgtttcgggacgggtacggtaccgtaggttcggaccgtccggtaggtaccgacggacccgaacgggtccgtcccggtacccccgttggtaaccctccgttcccgttaccccg

SEQ ID NO: 79570 - DNA, 770 bp, Homo sapiens
  misc_feature: GYAE6OF01EJ4CG.16.12.B01.1.454.CMB.1.raw
  modified_base (223)..(223): a, c, t, g, unknown or other
  misc_feature (223)..(223): n is a, c, g, or t
tcagtgtactactccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagttgactcagtccttccctcagtgtccgtgtccccgggacagacagccagcatcacctgctctgganactaaccgtgggtaaattaaattttctttctggtatcgagcggaagccaggcctagtcccttagtttcggctatctaataaagagtaaggaacgtccggccctacgacgaccacttcccgtgacgtcgtacttcgtcgtggcctccgagtcctacgtacggaaacacgacgacctacgtcgtacgacctacgtacccggacccgggacctacgtaacgtagtacggtactaacggacgtacgtaacggtaaccttaacgtttaaccggtcggtaccggtacgggtaccgggtacggggaaccgtacgggtccgggtacgttaccggtttcggggtttaccggggttttaccggggaaccgggtacgggtaacccgtaacggccggttaccgggtacccggtttcccggtacccgggttacccggaccgggtaaccccggtaaaccggggttccccgtaccccccgggttacccccgttacccgggttaccccgttacccgtttccccgggtttccccggtttccccccggtccccgtttaacccggg

SEQ ID NO: 79571 - DNA, 661 bp, Homo sapiens
  misc_feature: GYAE6OF01CE7OH.16.12.B01.1.454.CMB.1.raw
  modified_base (308)..(308): a, c, t, g, unknown or other
  misc_feature (308)..(308): n is a, c, g, or t
tcagtgtactactccacgaccggtgctcgatttagtagtgtagattccgcggggctgggcctcaggaagcagcatcggaggtgcctcagccatggcatggatccctctcttcctcggcgtccttgcttactgcacagtatcggtggcctcctatcagttgactcagccaccctcagtgtccgtgtccccaggcagacggccagcatcatctgctctggagataacttggggataaagtatactttctggtatcagcagaaggccgcagtcccctgtattggtcatctaataagataggaatcggcctnagacatccctgagcgtattctcgtcggtctccaggtctcgtacggaaacacgacgccgtactctcgaaccctacgtacccgaacccggggaccctaacggaaccttaagtacgggtaactagggtaaacgtcccgttaggtaaccttaagtttaacctggtacccgtaaggtccgggttagggacctacgggccggtacctacggttggtttcgggttttaccgggacgggtaacgggacctacgggtccgtacgggtaccccgtccggttaccgggtccgaaccggttaccccgaaacggtcccttacccgggcccccctttacgggtccctaccgtcccgtttacccccgg

SEQ ID NO: 79572 - DNA, 598 bp, Homo sapiens
  misc_feature: GYAE6OF01DWPZH.16.12.B01.1.454.CMB.1.raw
  modified_base (404)..(404): a, c, t, g, unknown or other
  misc_feature (404)..(404): n is a, c, g, or t
tcagtgtactactccacgaccggtgctcgatttagtagtgtagattccgcggggctgggcctcaggaagcagcatcggaggtgcctcagccatggcatggatccctctcttcctcggcgtccttgcttactgcacagtatcggtggcctcctatcagttgactcagccaccctcagtgtccgtgtccccaggacagacggccagcatcatctgctctgagataacgtgggggataaatatacttctggtatcagcagaaggccggccacgtcccctgtattggtctattctttcaagtataccgagccggcctcagagatccctgagcgattctcgtggctccaactcgtacgggaacacacgccactctagaccatcgacggccgggaccagactagtcgganggaggctaggacttactagtcgtcgagggcggttgggaacacgtacgaatttcgtggttagttacggttttccgggacgggtaacgggtaaccgtaacggttcggtacccggtaccgttacggggtacctacggaccccgtaaggtcccgttcccggaccccccgttacgggtccctacgttccgttacccccg

SEQ ID NO: 79573 - DNA, 244 bp, Homo sapiens
  misc_feature: GYAE6OF01CND7W.16.12.B01.1.454.CMB.1.raw
  modified_base (236)..(244): a, c, t, g, unknown or other
  misc_feature (236)..(244): n is a, c, g, or t
tcagtgtactactccacgaccggtgctcgatttagtagtgtagatttggggacccgatgcttatgatagctggggccaagggacaatggtcaccgtctcttcagcctccaccaagggcccatcggtcttcccctgcaccctcctccagagcacctcgtggggcacagccggccctgggctgcctggtcaaggactactccgagtagtacactgagcgggctggcaaggcgcatagnnnnnnnnn

SEQ ID NO: 79574 - DNA, 811 bp, Homo sapiens
  misc_feature: GYAE6OF01EI49H.16.12.B01.1.454.CMB.1.raw
tcagtgtactactccacgaccggtgctcgatttagtagtgtagattccgcggggctgggcctcaggaagcagcatcggaggtgcctcagccatggcatggatccctctcttcctcggcgtccttgcttactgcacagtatcggtggcctcctatcagttgactcacgcccaccctcagtcgtccgtcgtccccgaggacagaccggccagcatcatctcgtctcgtaggagtaattaacggttagggggtaattaaagttacgttacttttcgtaggttatacgagtacgaaggaccgggcccggccacgttcccctagtacgttcggtactagttcctttacgaacggtacgtaccggacggtcccggtacccctacgaacggacgtaccgtacccgttaggacggtaccgttactttccgtaccgttaccggtacccttaacccgtaaccgttccggtaaccgggtaaaccaccgtaccgtacccctacgttacccgttaccgaacctaccggttaccggacccgggacccggggtacccctaaggtacccgttaggtacgggaagttacgggacgtacgtacgtaaccgttacgttacgtcggtagtacgggacgtacgggaacgtagtacgttacgttcggttagttacggttacggttaccggggtaacgggtaaccggtacccgtaaaggttcccggttaaccggtccggttaacggacccggacccggtaacccggtaaccggccccgttacccccggtacccccgtccggttacccgttcccggttcccggttacccccccgg

SEQ ID NO: 79575 - DNA, 686 bp, Homo sapiens
  misc_feature: GYAE6OF01CGMPA.16.12.B01.1.454.CMB.1.raw
tcagtgtactactccacgaccggtgctcgatttagtagtgtagattccgcggggcgtgggccgtcaggaagcagcatcggaggtgcctcagccatggcatggatccctctcttcctcggcgtccttgcttactgcacagtatcggtggcctctatctagttgactcacgccaccctcagtcgtccgtcgtcccaggacagacggccgagcatcacgtctgctctggaagtacgtaacgttaggggataaatattactttcgtggtatcgagacgagaacggccgacgtacgtccccgtgttatcggtactacttcttacgaagacgtaccgacggccggcctacgagacgactcccgtagacgtcgtacttctacgcggtccctaccactcggtacgaacactaccgactacttcgtacgacacgtacgaccgggaccgggaccctaggtaacgttaggacggtactacgggacggtacttacggtaacttacgttacgtggtacggacgggtacggtacggacgaagtacctagttcgtgttaagttccgggttcggaacggggtaacggtaccgtaacgggttacggttaacccggtcggttaacgaccgggtaacccacccgggtaaccgttcccgtcccggaacccccgttggtaacccctcggtttccccgttacccccgg

SEQ ID NO: 79576 - DNA, 597 bp, Homo sapiens
  misc_feature: GYAE6OF01A4CQO.16.12.B01.1.454.CMB.1.raw
  modified_base (332)..(332): a, c, t, g, unknown or other
  misc_feature (332)..(332): n is a, c, g, or t
  modified_base (394)..(394): a, c, t, g, unknown or other
  misc_feature (394)..(394): n is a, c, g, or t
tcagtgtactactccacgaccggtgctcgatttagtagtgtagattccgcggggctgggcctcaggaagcagcatcggaggtgcctcagccatggcatggatccctctcttcctcggcgtccttgcttactgcacagtatcggtggcctcctatcagttgactcagccaccctcagtgtccgtgtcccaggacagacggccagcatcatctgctctgagataacgttggggataaatatacttctggtatcagcagaaggccgccagtcccctgtattggtcatcttcaagacgtaccgagccgcctcgagagactccctgacgcgacttcnctgctccaactcgtacgggaacacacgccactctacgaccatcgagccgggaccagactagnggagtggacgcgtagtactagtacgtgacgtacgggacgtcgggactagaccgtaagttccgtaggttacgttacggttttcgggacgggtacgggtaaccgtaaggtttaccggacccggttaccggtaggtaccgaccggaccccgtaaggtcccgttacccgcccccggttaccggtcctaccgttcccggttacccccg

SEQ ID NO: 79577 - DNA, 545 bp, Homo sapiens
  misc_feature: GYAE6OF01A55EK.16.12.B01.1.454.CMB.1.raw
  modified_base (536)..(536): a, c, t, g, unknown or other
  misc_feature (536)..(536): n is a, c, g, or t
tcagtgtactactccacgaccggtgctcgatttagtagtgtagattccgcggggctgggcctcaggaagcagcatcggaggtgcctcagccatggcatggatccctctcttcctcggcgtccttgcttactgcacagtatcggtggcctcctatcagttgactcagccaccctcagtgtccgtgtccccaggacagacggccagcatcatctgctctggagataacgttgggggataaatatactttctggtatcagcagaaggccggccacgtcccctgtattggtcattctttcaagactaccgagccggccctcagacgactcccctgacgcgtattctctcggcctacccaactcgtagggaacacgacgccactctacgaccatcgacggccggggacccagactagtggatggacgctagtactattactgtcgaggtcgtagggacagtctaagttcgtagtgtagtttcgggacggtagggacctaggtcgaccgtcgtagtcacgcccgagcctccgcccctcgtcncctctcccg

SEQ ID NO: 79578 - DNA, 675 bp, Homo sapiens
  misc_feature: GYAE6OF01A1P90.16.12.B01.1.454.CMB.1.raw
  modified_base (134)..(134): a, c, t, g, unknown or other
  misc_feature (134)..(134): n is a, c, g, or t
  modified_base (252)..(252): a, c, t, g, unknown or other
  misc_feature (252)..(252): n is a, c, g, or t
tcagtgtactactccacgaccggtgctcgatttagtagtgtagatttgggcttggaacagcctggggggtccctgagactctcctgtgcaacctctggattcacctttaccagctatgccatgagctgggtccnccaggctccagggaaggggctggagtgggtcgcagccatttagtggtattcgtgatgccacatactacgcagactccggtgaggggccgttcaccatctccagcgacacttccagganccaggttgtatctgcaaatgaacagcctgagagtcgaggaccgacggccctatattactgtgacgaaagataagatttcggggacccatgcttatgatagcgtggggaccaagggacagtggcctaccgtctcgttcacgtaccctccgaaccgtaacgggaccctaacgtccggttcccttacccccgtgggacccctacccctcccttacccgaaacggtaccgtaccgacccgtttccgggtacgggggacctaaccggacgggtcccgggtccccgttacggggtccttcggtcccgttcgggtacctaaacgggtacccgttaccggtttacccgaaggttaaccgttaaccgtacggtacgggtacgggaccgggttccgtaacgggtaccggaacggtccggtacgtagtcggacg

SEQ ID NO: 79579 - DNA, 726 bp, Homo sapiens
  misc_feature: GYAE6OF01CZK6G.16.12.B01.1.454.CMB.1.raw
  modified_base (468)..(468): a, c, t, g, unknown or other
  misc_feature (468)..(468): n is a, c, g, or t
  modified_base (671)..(671): a, c, t, g, unknown or other
  misc_feature (671)..(671): n is a, c, g, or t
tcagtgtactactccacgaccggtgctcgatttagtagtgtagattccgcggggctgggcctcaggaagcagcatcggaggtgcctcagccatggcatggatccctctcttcctcggcgtccttgcttactgcacagtatcggtggcctcctatcagttgacctcacgcccaccctcagtcgtccgtcgtcccccgaggacagaccggccagccatcatctcgctcgtaggagtagtaacggttagggggaattaaaacttgttaccgttttcgttaggtacttacgaggacgaacggaacgggccccggtacctaccggttccccgttggtttacgttcggtactacgtttacctttaacgaaacgtacgtacccggacggcccggttccacgaacgacgtaccgtcccgtaggacgtacgtactttcgtcgtgtccctaccgtaacgtcgtacggaacctacgacnccgtaccttcgaccacctacgtaccggacggtcccgggtaccaacgtacgtagttacggaggtcggtaacgcgttaacgtaacgtttagttcgtacggtcgtaacgggccggttacggaactacgttacttacgttccggtggttaagttccgggtttacgggacggtaaccggttaccgtaggttacccggaccgttacggnggtacccacggcccgtagcccggtcccgtcccgtactacctcgttccgtcccccg

SEQ ID NO: 79580 - DNA, 614 bp, Homo sapiens
  misc_feature: GYAE6OF01DR8E1.16.12.B01.1.454.CMB.1.raw
  modified_base (345)..(345): a, c, t, g, unknown or other
  misc_feature (345)..(345): n is a, c, g, or t
  modified_base (585)..(585): a, c, t, g, unknown or other
  misc_feature (585)..(585): n is a, c, g, or t
tcagtgtactactccacgaccggtgctcgatttagtagtgtagatttgggcttggaacagcctgggggggtccctgagactctcctgtgcaacctctggattcacctttaccagctatgccatgagctgggtccgccaggctccagggaaggggctggagtgggtcgcagccattagtggtattcgtgatgccacatactacgcagactccgtgaggggccggttcaccatctccagcgacaccttccaggagcacgttgtatctgcaaatgaacagcctgagagtcgaggacacggccctatattactgtgcgaaagataagagtttagggacccgatgcttangatagctgggccaaggacaatggtcacgtctcttcagcctccaccgaacggcccagttccggtccttcccccgtggcccacccctccctacccgaacgaccgccacccgtcggtcgggggaccaccgaacgcccgggccccgttcggggccttcggtccccgttaggggtaccgtaaacgggacccttaccgttacccggtaacggttacgtaaacccgtacgtacggacgggcccgggngtcgggaccggaagggccgacagtagacg

SEQ ID NO: 79581 - DNA, 876 bp, Homo sapiens
  misc_feature: GYAE6OF01C4LQF.16.12.B01.1.454.CMB.1.raw
tcagtgtactactccacgaccggtgctcgatttagtagtgtagattccgcggggctgggcctcaggaagcagcatcgggaggtgcctcagccatggcatggatccctctcttcctcggcgtccttgcttactgcacagtatcgggtggcctcctatctagttgacctcacgcccaccctcagtcgtccgtcgtccccgacggacacggacggccagcatcactcgtcgtccttcgtagggaagtaacgttaacgggtttagggggaaattaaaattactttaacgttttgttacggttactacgacggacgaacgggaaccgggacccggaccgtaccgttcccgttagttacgttcggtacctagtttcctttaacgaagtaaccgtaccgaccggtccggaccctacgaacgacgtacgtcccgtagacggtcgtactttccgtccgtacggtaccctacccgtaacgttacggtaacgggaaccaccgaccgtccctaacgtacgtaccgaaccgtacgtccgggacccgggggcccgggtaccgtaacgtacgtaggtacgggtaacgtaggggtaccgtacgtttaccgtaaccgtttaacggttacgttcgggtacggacgggggtacgggttacgggaaacgttacgggtaacctttagttacgggtttacgggttacggtttaaccgggggtttaccgggggaacgggggttaaccggggttaaaccccgtaagggggttttaccccgtaacccggggttaccggtaacccgggggttaccggaacccggttacccgggtaacccggtcccgttcccccggttaccccggttccgggttaacccctaccggtttccccggttaccccg

SEQ ID NO: 79582 - DNA, 819 bp, Homo sapiens
  misc_feature: GYAE6OF01DOFUI.16.12.B01.1.454.CMB.1.raw
  modified_base (208)..(208): a, c, t, g, unknown or other
  misc_feature (208)..(208): n is a, c, g, or t
tcagtgtactactccacgaccggtgctcgatttagtagtgtagattcggcgggggcaggagtcagactcagtcaggacacagcatggacatgacgggtccccgctcagctcctggggctcctgctgctctggcctcccagtatcaaatgtgacatccagatcgacccagtcctccttcccaccgtgtctgctattcgtggtaccgganacgaggtactaccacctatccgtaccgttcggacccgggtcctaggtcaagggtgttcggttcgggttaccgttgggttcggtcccgttagggtactcgtaacggaccgaaacggaaaacccggaaacggggtaaaccgtaccccccgttaaggacccgtttacccgtagtacgttaccttaagttcggtaacgtttaccggtaccttaccgtaaattaacggttacggggtaaaacgggttccggggtaccctaacggtacggttaaacgggtttccggaggccggtacgtaaggtacggtacgtacgggtagggtaacctaggttaacttaccaccttacgtacccttaccgaattcgaacgtaccgaccgtaaccggtaacctacggttaccgtcggtaagtttacgtttacgtttacgtacgtttactttactttacgttacaaccgtaataacggttaagttaaagtttcgtttaaactttacgttaccgtttacccggtaccggttaacggtaaccgttacgtaggttaacggttaattaacggtacccgttaaaacgggtacttacggggtacgtaacgacccgttactaccgttcgttaccgg

SEQ ID NO: 79583 - DNA, 229 bp, Homo sapiens
  misc_feature: GYAE6OF01DAWSP.16.12.B01.1.454.CMB.1.raw
  modified_base (223)..(223): a, c, t, g, unknown or other
  misc_feature (223)..(223): n is a, c, g, or t
  modified_base (225)..(225): a, c, t, g, unknown or other
  misc_feature (225)..(225): n is a, c, g, or t
  modified_base (228)..(229): a, c, t, g, unknown or other
  misc_feature (228)..(229): n is a, c, g, or t
tcagtgtactactccacgaccggtgctcgatttagtagtgtagattccgcggggcccagactatggatgaggctgactattactgtcaggcgtgggacagcaattctgtgattttcggcggagggaccaagttgaccgtcctaggtcagcccaaggctcgccccctcggtcactctcgttcccaccctcctacgagtagtacactgagcggctggcaaggcgnanagnn

SEQ ID NO: 79584 - DNA, 792 bp, Homo sapiens
  misc_feature: GYAE6OF01CHK6S.16.12.B01.1.454.CMB.1.raw
  modified_base (167)..(167): a, c, t, g, unknown or other
  misc_feature (167)..(167): n is a, c, g, or t
  modified_base (202)..(202): a, c, t, g, unknown or other
  misc_feature (202)..(202): n is a, c, g, or t
tcagtgtactactccacgaccggtgctcgatttagtagtgtagattcggcggggggtcagactcagtcaggacacagcatggacatgacgggtccccgctcagctccgtggggctcctgctgctctggctcccgaggtatacaaatgtgacatccagactcgacccngtcctcctcccacctgtctgctatcgtggacgganacgagacgtaccacctactccgtacgtcggccgggacctagtacgaggttagggttcgtttcgggtaccgttggggtcgtccgttaggtactaccgaagaacgaaacggtaaaaccggaacggggtaaacccgtaccccgttaacggtcctaccgtagaactttctaagtacgtactcgtacctaacgtaagtacggtagggtaacggtcggtacctatacggaaggtcgaacggcgtacgtagggtaggtacgtacgggtaacggacgtaactaccttacgtacctcctaaccacccgttagtaccgagtaccgaaccgtacctaacgacgttctaggttaacttaggtttaccgtttaacggtactttaaacgttttactacgtaacgtaacccgtaaacgttagttaaaacgttaacggttaacttttacggttaacccgtttacggttacccggaccggttaaggaacccgttaaggttcgtaaacggttaacttaaccgggtaaaccgtaaacgggttacggttcggttaccgggacccttaccgaaccgttactttattcccggttaacgttccctttaacccg

SEQ ID NO: 79585 - DNA, 662 bp, Homo sapiens
  misc_feature: GYAE6OF01C3A75.16.12.B01.1.454.CMB.1.raw
  modified_base (247)..(247): a, c, t, g, unknown or other
  misc_feature (247)..(247): n is a, c, g, or t
  modified_base (254)..(254): a, c, t, g, unknown or other
  misc_feature (254)..(254): n is a, c, g, or t
  modified_base (257)..(257): a, c, t, g, unknown or other
  misc_feature (257)..(257): n is a, c, g, or t
  modified_base (292)..(292): a, c, t, g, unknown or other
  misc_feature (292)..(292): n is a, c, g, or t
  modified_base (327)..(327): a, c, t, g, unknown or other
  misc_feature (327)..(327): n is a, c, g, or t
  modified_base (329)..(329): a, c, t, g, unknown or other
  misc_feature (329)..(329): n is a, c, g, or t
tcagtgtactactccacgaccggtgctcgatttagtagtgtagattccgcggggctgggcctcaggaagcagcatcggaggtgcctcagccatggcatggatccctctcttcctcggcgtccttgcttactgcacagtatcggtgcctcctatcagttgactcagcccaccctcagtcgtccgtcgtccccaggacagacggccagcatcatctgctcgtggagatacgtggggataaatatacttntggtatnagnagaacggccgccacgtccctgtatgtctatcttanagacgtaccgagccgcctagagacgacttccccgngntacgtacttctccgtacgtcctacccaacgtcgtacggaacaccgcgacctactctacacgtactaccgacggcccggggacctagaccgttaagtggaacgtagggacggtcctacgaacgtttacttacggtcgtacgcggggtacggtacgggaacgacgtagttacgttcgtagggttacgttacggtttcgggacggtaccgggtaacgtacgggttccgtaccccggttaccgtaccggtaccggaaacccggtacccggtaaaccggtccccgtacccggtacccccgtttccgggaccccgtacccgtttcccggtaccccccgg

SEQ ID NO: 79586 - DNA, 874 bp, Homo sapiens
  misc_feature: GYAE6OF01CUXMB.16.12.B01.1.454.CMB.1.raw
tcagtgtactactccacgaccggtgctcgatttagtagtgtagattcggcgggggtcagactcagtcaggacacagcatggacatgacgggtccccgctcagctccgtggggctcctgctgctctcggctcccaggtatacaatgtcgacatccgagactcgaccctacgttcctcccttccacctgtctcgctatcgtggtacggagacgacgactcacctatccgtacgttccggaccgggtaccacgtacgtaggtggttcggtttacgggttacggttcgggttacgggtcccgttagggttaactaccggaagaacccggaaacggaaaacccggaacggggtaaacccctaccccgtaaagttccccgttacgtagtaacgtttcgttaacggttgtaccgttcgtacctaaaccgtaaggttaacggtaaggggttaacggttaccgggaaccgttacgttaccggtaaggtaccggacggtaccgggattaacggggtacggtagttaccgggtaggtaaaccgttaagttacccttaccggtaacctccgtacaacgtaccacgtacggtaccaccggttccgaaccgtacggtagttacttaggtaacgttttcgtttacgtaacgtttaaacttgtttaaccgacggtaaaccttaacgttaaaagggtttctttaaaccgggtttacgttttaaacccgttacccgggttttacccggttaacccggtaccggggttaactaaccggtttacggttaaggttaaccgttaaacgtaacggttaaaacccgttaagggtcggttaacgggtccgtaacttaccgacgttttacccgtattttccggttacgtttccttacccg

SEQ ID NO: 79587 - DNA, 700 bp, Homo sapiens
  misc_feature: GYAE6OF01DMR3K.16.12.B01.1.454.CMB.1.raw
  modified_base (218)..(218): a, c, t, g, unknown or other
  misc_feature (218)..(218): n is a, c, g, or t
tcagtgtactactccacgaccggtgctcgatttagtagtgtagattccgcggggctgggcctcaggaagcagcatcggaggtgccctcagccatggcatggatccctctcttcctcggcgtccttgcttactgcacagtatcggtggcctcctatcagttgactcagccaccctcagtgtccgtcgtccccaggacagacggccagcatcatctgctntggagataacgtggggataaatattacttctggtatcagcaggacggccgaccacgtcccctgtattggtctattcttacagactaccgagccggtcctcgagacgactccctagacgtactcttctcgtcggtacctaccctaacgtaccgtacgggaaacctacgacggtaccctacttcctacgaccctacgttaccgaaccccggggttccggggacccctaaggtaaccgttacggtaggtacgttacgggacgggttcctacggttaaccttacgtttacggttaccggtaccggtacggggtacccggtaggggtaacctacggtaacttaaccggtttcgtttacgggtttacggtttacggttttaccggggacgggtaacccgggtaaccggttaacggtcggtacccgtacgttaccggaccgccgaccggacgtcccgtaccgccccgtcgtacctcgttcctccccggg

SEQ ID NO: 79588 - DNA, 808 bp, Homo sapiens
  misc_feature: GYAE6OF01CFPWM.16.12.B01.1.454.CMB.1.raw
  modified_base (750)..(750): a, c, t, g, unknown or other
  misc_feature (750)..(750): n is a, c, g, or t
  modified_base (796)..(796): a, c, t, g, unknown or other
  misc_feature (796)..(796): n is a, c, g, or t
  modified_base (802)..(802): a, c, t, g, unknown or other
  misc_feature (802)..(802): n is a, c, g, or t
tcagtgtactactccacgaccggtgctcgatttagtagtgtagattcggcgggggagtcagactcagtcaggacacagcatggacatgacgggtccccgctcagcctccgtggggcctcctgctgctctggcctccgaggtatacaaatgtgacactccagtactcgaccctacgtcctcccttcccaccctgtctgcctagtcgtcggacggacgacgacgacgtaccaacctacgtacgtaccggttccgggaccccggggtaccacggtacgtaggttagggttcgggtttaccgggtacccggtttggggttcgggtccggtttaggtaactcgaacggaaccggaaaaccggaaaaccggaacggggtaaaacccgtacccccgtaacggtcccttaccggtacgtaattccgttaagtacgtaacgttcgtaccgtaacgtaaaggtaaggtacggggtaaacgggttcccgggtaacctaacggtaccggttaaacgggttacggaacgggtacggtacggtaggtacggtagtaccggtaggaactacggtaacttccgacttacctcgaacctagacctacgtacaaccgtactaccgtacgtaccgttagtacgttagtttacgtttacggtacctttagtttactaacgttaacgaccgttaaatggttaaacgttacgttaacgttactttaaccgtacccggttaccggaccgttaagacgttaagtaccgggttanaacgttaccgtaagtaagtccgttagtacgataccgacttaccgtntcggtnttcccg

SEQ ID NO: 79589 - DNA, 803 bp, Homo sapiens
  misc_feature: GYAE6OF01EKN7E.16.12.B01.1.454.CMB.1.raw
  modified_base (621)..(621): a, c, t, g, unknown or other
  misc_feature (621)..(621): n is a, c, g, or t
  modified_base (630)..(630): a, c, t, g, unknown or other
  misc_feature (630)..(630): n is a, c, g, or t
tcagtgtactactccacgaccggtgctcgatttagtagtgtagattccgcggggctgggcctcaggaagcagcatcggaggtgcctcagccatggcatggatccctctcttcctcggcgtccttgcttactgcacagtatcggtggcctcctatcagttgactcacgccaccctcagtcgtccgtcgtccccgaggacacgacggccagcatcatctgctcgtacggagtaacgttaacggttagggggtaattaaaacgttacttaactttttacgtagggttaactaccgaagaccgagggaaaccggggcccggaccgtaaccggttacccccgttacggttaacgtttcgggttaccttactttccttttaccgaaaaggtaccgtaaacccggtacggacccgggtccccctacggagaacggtaccttccccgtaggacggtcgtaacgtttccgtacgttcggaccttacccgtaaccgttaccgggtaacggaaaccgaacgacccgtaccctacgttccgtaaccgaaccctacgtaccggaccggtacccggggacccaggtaccgttaaggacgtagtcggacgtacctaggtaacctttaggttaccgngttaacggngggtacggtacggaactacggttaactacggtttacgttacggttacggtttaccgggtacgggaccggggtaaacggtacgttaacgggtaccgttaccggtaccggttacgacggacccggtaccgtacgtcccgtcccgtacccggtattaccctccgttccgtaccccg

SEQ ID NO: 79590 - DNA, 737 bp, Homo sapiens
  misc_feature: GYAE6OF01ES13M.16.12.B01.1.454.CMB.1.raw
  modified_base (410)..(410): a, c, t, g, unknown or other
  misc_feature (410)..(410): n is a, c, g, or t
  modified_base (582)..(582): a, c, t, g, unknown or other
  misc_feature (582)..(582): n is a, c, g, or t
tcagtgtactactccacgaccggtgctcgatttagtagtgtagattccgcggggctgggcctcaggaagcagcatcggagtgcctcagccatgacatgtatccctctcttcctcggcgttccttgcttactgacacagtctcggtcgtcctacctatcgagttgactcacgccaccctgagtcgtccgtcgtccccgaggtacaggccgaccgagactactccagttccgtgtaccgttcggtaagggtaacgtaagttaaccgggttaggggtaaattaaagttacttttaacgttttcgtagttacacgaacgcggaaggaaccggcccggacctaccgttccccgttaggttacgttcggtcttacgtttaccttagaacgtaccgtaccggaccgcccgtccgtanaggtaccgaacttcccggtagacgtctacgttcgtcgtcgtacctaccgacgttcgaacgtaacaccgcgtaccgtactacgtacaccgtagaccggacgggcccgacgtagttacgtaggtacgtagcgtacgtgtacctaacgtttacgttcgtagacggtcgggtacgnggtaactacgtcgttaacgttcgttagtcgtttaacgggtcggacggtacgggtaaccgtttggacccgttacggttaccgtacggacggttaccgacgggtaaccgtcccgttaccccggccttaccggtcccttacccgtcccgtttaccccg

SEQ ID NO: 79591 - DNA, 1078 bp, Homo sapiens
  misc_feature: GYAE6OF01BDOUV.16.12.B01.1.454.CMB.1.raw
  modified_base (224)..(224): a, c, t, g, unknown or other
  misc_feature (224)..(224): n is a, c, g, or t
tcagtgtactactccacgaccggtgctcgatttagtagtgtagattccgcggggctgggcctcaggaagcagcatcggaggtgcctcagccatggcatggatccctctcttcctcggcgtccttgcttactgcacagtatcggtggcctcctatcagttgactcagccaccctcagtgtccgtcgtccccaggacagaccggccagcatcatctgctcgtgganagtaacgttggggaataaatatactttctggtatcagacgaggaacggtcccggacctacgttcccccgtaggtttacgttacgggttcctatttaccgttttaccaaacggtaccgttaacccggaaccgggtcccgggaccccgttacgaacgggtaacgtaaccgttacccccgtacgggtaacggtccggttacttttccgttccgttaccgggtacccttaaccccgttaaaccgtttccggttaaaccgggggtaaaccctaacccggtaacccgtaacccgttacccggtttacccgttaacccggtaaccccgtaacggttaacccgggaacccgggggtacccccggggggtaacccccggtaaaccgggttaaacccgggtttaaccgggttaacggggttaacggtaccgggtaacggggttaccgttaaacgggttaaacccgttttaaaccgttttaccggtttaccggggttaacccgggttaccggggtaaccggggtttaaccgggggtaaccggtaacccggttaaccggtttaaaacccgttttccgggttttaacggggtttaaccggggttttaacccggggtttttacccgggggttaacccgggggggtaaaccgggggtaaaccccgggtttaaaccggggtttaccggggttaaacccccgggtttcccgggtttaaaaaaacccggggttccccggttaaaccccggggtaaacccccgggtaaacccggggtacccccgggtttacccccgggttacccccccgggtttaccccgggtttaacccccggtttaccccggtttcccccggttttaacccccccccgggg

SEQ ID NO: 79592 - DNA, 879 bp, Homo sapiens
  misc_feature: GYAE6OF01A47G7.16.12.B01.1.454.CMB.1.raw
tcagtgtactactccacgaccggtgctcgatttagtagtgtagattccgcggggctgggcctcaggaagcagcatcggaggtgcctcagccatggcatggatccctctcttcctcggcgtccttgcttactgcacagtatcggtggcctcctatcagttgactcacgcccaccctcacgtcgtccgtcgtccccaggacagaccgccagcatcatctgtctcgaggagtaacgttaacggttaggggaattaaattacttacgtttcgtggttactacgaggaccaaggtaacggcccggacctaccggttcccccttaggttacgttcggtacctacgtttacctttacgtaacggtaaccgttacccggacggcccggtaccgttaccgaacggtacgtaccgtccccgtaggaccggtacgttacgtttcccgtacgttcggtaccttacccgtaaccgttacgggttaaccggtaaaccgaaccgtacccgtacccgtaccgttacctaccgtaacctaccgtacggaacccggggaccccggggacccctaaggtaacccttaaggtacgggtaacgttcggaacgggttacgttaaccggttaactttacgtttaccgtttacgggtaccggtacggggtaccgggtagggtaacctaggttaaccgttaacgttttccgggttaaggttacggtttaccggggttttaggggaacccggggtaaaccgggtaccgttaagggtttaccccggtaacccggttcgggttaacccgggttacccgtaccgggaaccccggttacggtccccggttacccccggttaccccggttaccggtttaccttccccggttttcccgttaccccccgggg

SEQ ID NO: 79593 - DNA, 686 bp, Homo sapiens
  misc_feature: GYAE6OF01DICUN.16.12.B01.1.454.CMB.1.raw
  modified_base (309)..(309): a, c, t, g, unknown or other
  misc_feature (309)..(309): n is a, c, g, or t
  modified_base (476)..(476): a, c, t, g, unknown or other
  misc_feature (476)..(476): n is a, c, g, or t
tcagtgtactactccacgaccggtgctcgatttagtagtgtagattcggcggggggtcagactcagtcaggacacagcatggacatggacgggtccccgctcagcctccgtggggctcctgctgctcgtcggcctacccgaggtactacaaagttggtagacctactaccgagacgtaccgaaccctgttccctccctttacccacccttgtcctgactactcgtacggtacggacgacgagtactaccacactaccgtcgtcgggccgtacaggcagtggttcgttacggtcgtggtcgtcgtagtancgagaacgaaggtaaaccgacggaaccacccgtagcctcagtactcgtagctatcgtactagtaagtaggaagggtacggtacggtaccagtacggtaagtcgacggcgaggtagtaccgtagggagtacggaactagtaacttcgacctctaacatactacgaacncggtacctacgtacgtacgtacgtaggtactttaggttacttacgtaacgttaagttaacttacgttacctaaacgtaacgtaattaacggtaacgttacgttaccgttacgttaccggttaccggtaccggtacgtacgtagtacgtataactaacgtaacgtaagacctaggtacgtacgtactacgtatacctcttactccgttacg

SEQ ID NO: 79594 - DNA, 932 bp, Homo sapiens
  misc_feature: GYAE6OF01B20UC.16.12.B01.1.454.CMB.1.raw
  modified_base (164)..(164): a, c, t, g, unknown or other
  misc_feature (164)..(164): n is a, c, g, or t
tcagtgtactactccacgaccggtgctcgatttagtagtgtagattcggcggggggtcagactcagtcaggacacagcatggacatggagggtccccgctcagctccgtggggctcctgctgctctggctcccaggtatcaatgtagacactcagatcgacccngtcctccctcccacctgtctgctactcgtggtcggagacaggactccaccatccgtaccgttcggcccgggtaccagtacgaggttaggttcggttacggttaccggttcgggttcggtccgttaggtacgtacgacggaaccgaaacgggaaacccgggtaaacggggaaaccctaccccccgttaacggtcccttacccgttacgggttaactttaccgttaagttaccgggttacgttcccggttaccctaacgttaaaggttaacgggttaaaccgggggtaacggggtttacccccggggtaccttaacggttaacggtaacgggttaccggacgggtaccccggtaggtaacggggtacggtaacgttaccgggtaacgggtaacgttaacggttaacccttcctaacccgttaccctaacccgtaaccgttacgttaaccgtaccgaacccgtaacgtaccccgtacggtaacccggttacgtaaggttaccgtttaggttttaccgttacggttaaccttttaagttttactacggttaacccgaacgttaaccgttaaaggttaacggttaacggttttaactttaacccgggttacccggtttaacggtttccccggggaaccggttacggtactttaagggtcgggttaacgttaaacctaaccggttaaagggtaaacccttcgggtacggttacccggaacttcccggaacctttacggtaccccgtttttcgtacccgtttacccgtttccccg

SEQ ID NO: 79595 - DNA, 607 bp, Homo sapiens
  misc_feature: GYAE6OF01AUAC6.16.12.B01.1.454.CMB.1.raw
  modified_base (248)..(248): a, c, t, g, unknown or other
  misc_feature (248)..(248): n is a, c, g, or t
  modified_base (309)..(309): a, c, t, g, unknown or other
  misc_feature (309)..(309): n is a, c, g, or t
tcagtgtactactccacgaccggtgctcgatttagtagtgtagattccgcggggctgggcctcaggaagcagcatcggaggtgcctcagccatggcatggatccctctcttcctcggcgtccttgcttactgcacagtatcggtggcctcctatcagttgactcagccaccctcagtgtccgtgtccccaggacagacggccagcatcatctgctctggagataacgttgggggataaatatactttntggtatcagcagaaggccgccacgtcccctgtattcggtctatctttacgaagataccggngccggccctcagtagactcctgagctattctcgtggtctccaactcgtcgggaacacacgcccatccacaccatccgacggccggggacccagactagtaggagtggacggtctagtaacttacttacgtgtcgaggtcggtggactacgacgtaattcgttcgttggttacgttttcgggaccggtacggaaccgttacggttacggtaccgttacccgttacgggtcgaacccggtcccggaaacggtccgtacccgggccccccgttggtacccgtcgttcccgtttcccccggg

SEQ ID NO: 79596 - DNA, 696 bp, Homo sapiens
  misc_feature: GYAE6OF01BZHAI.16.12.B01.1.454.CMB.1.raw
  modified_base (196)..(196): a, c, t, g, unknown or other
  misc_feature (196)..(196): n is a, c, g, or t
tcagtgtactactccacgaccggtgctcgatttagtagtgtagattccgcggggctgggcctcaggaagcagcatcggaggtgcctcagccatggcatggatccctctcttcctcggcgtccttgcttactgcacagtatcggtggcctcctatcagttgactcagccaccctcagtgtccgtcgtccccaggacngacggccagcatcatctgctctggagataacgttgggggaataaatattactttctcgtatcagcaaggaaggccggccacgtccccgttgtattggtctaatctttacaaacgacttaccggagccgggtccctacgaagacgtactccccgtaggacgcgtaacttcgtcgtcgggacccttaccgaactcgtacgggaaccacgacgaccactctacgaccagtaccgacggcccgggaccaagtacgtaagtcggtaatcgggaagtcgtacggttaactacgtttacgtcggtacgtagggtccgggttacgggactaggaccctaaggtttccgtaggttcgtttacgggttttaccgggcggggtaaacggtaaccggtaaaggtttccggaacccggttccgtaaggggttacctaaccgggtacccgtaaacgggcccgtttacccggaccccccggtttacgggactaccccggtccgtttacccccggg

SEQ ID NO: 79597 - DNA, 750 bp, Homo sapiens
  misc_feature: GYAE6OF01DBD42.16.12.B01.1.454.CMB.1.raw
  modified_base (578)..(578): a, c, t, g, unknown or other
  misc_feature (578)..(578): n is a, c, g, or t
tcagtgtactactccacgaccggtgctcgatttagtagtgtagattccgcggggctgggcctcaggaagcagcatcggaggtgcctcagccatggcatggatccctctcttcctcggcgtccttgcttactgcacagtatcggtggcctcctatcagttgactcagccaccctcagtcgtccgtcgtccccagacacgacggccagctactcatctcgctcgtggagagttaacgtagggggtaataaagtattacgtttcgtaggttatcgagtacaaggtaaccggcccggacctaccgtaccccgttagttacgttcgtctacgtttccgtttactaaacgtaacgtacccggacggtcccggtaccctcgtaacggtaacgtacctcccgttacggacggtacgttaacgtttcctcgttaccggaccttaaccgtaaccgttacggtacgggaaacctaccggcgtacccgtacttcgacgaacctacgtccgaccgggtaccggacccgaacgtactaggtcgaggtacgacgtcgtacgtacttaagtaccgtgtacgacgggtgacgganacgtacgtaacgttcgttaggtacggttacggttacgggtacgggtaaccggttaaccgtaacggttaccggtaccgttaacggttaccggtaccgtaacccggacccgtaacggtccccgtaccccggtacccccgtacggttacccttcccggtcccgtttaccccccgg

SEQ ID NO: 79598 - DNA, 892 bp, Homo sapiens
  misc_feature: GYAE6OF01BVQT4.16.12.B01.1.454.CMB.1.raw
tcagtgtactactccacgaccggtgctcgatttagtagtgtagattccgcggggcgtgggcctcaggaagcagcatcgggaggtgcctcacgccatggcatggactccctctccttcctcggcgtccttgcttactgacacagtacgtcggtcgcctctatctagttcgactcaccacccacctcgtacgttcgtccggtaccgtacccgacggaccgacggaccggaccgacgactatctactcgtcgtcgtacggtaggacgtaacgttaacggttagggtaaattaaacgttactttacgtttacgtagttactacgacgtaacgaacggtaccggacccgtaccgtaccgttacccgttaggttacgttcgtacgttaacgtttacgttaacgtaacgtaccgtaacccggaccggtaccgtaccgtacgaacgtaacgtaccgtaccgtacgacgtacttacgttcgtacgtccgtaccgtaccgtaccgtacggaacggtaaccacgtaccgtacctaccgtaccgtacgtaacctaacgggtaccggacccgggtaccccgaacgtaacgtagggtaggtaagaccggtaaggtaccggtactacgtaattaccgtacgtacggtacccgggtaggtcggtaacgtagttaacgtacgttttacggtcccggttaaggttttacccgggttagggtacccgggaacgggtttaacccgggtaaccgttttaaacccgggggtaccccttaacggggtttcccgttaaaggggaacccccggtaaccccgggtaaccccgttacccggggtttaccccccgacccccgtttttacccgggaaacccgttttccccgttacccccgggtttcccggtaacccccccg

SEQ ID NO: 79599 - DNA, 586 bp, Homo sapiens
  misc_feature: GYAE6OF01EWWIJ.16.12.B01.1.454.CMB.1.raw
  modified_base (252)..(252): a, c, t, g, unknown or other
  misc_feature (252)..(252): n is a, c, g, or t
tcagtgtactactccacgaccggtgctcgatttagtagtgtagattccgcggggctggggcctcaggaagcagcatcggaggtgcctcagcccatggcatggatccctctcttcctcggcgtccttgcttactgcacagtatacggtggcctcctatcagttgactcacgccacccttcagtgtccgtcgtccccaggacagacggccagcatcatctgctctgagataacgttggggataatatactttcnggtatcagcagaaggccgccagtcccctagtagttacggtactacttacttacagataccggacgtcggaccctcacgtacgagtcctcgagcgtacttcgtctcggactcctaacgtactacggaacaccacgccactctacgaccactcgacggcggggacccgacgactatcggagatgagtctctactattacgtgtcgacggacgtacggactagtacgtaagttacttacggtacggtaggtttacggacggtacgggtaccgacgttacgtaccggtacgtacggtacgacgcccgtaccgtccgtaccgtcccgtccgtccgtacc

SEQ ID NO: 79600 - DNA, 723 bp, Homo sapiens
  misc_feature: GYAE6OF01D4IRB.16.12.B01.1.454.CMB.1.raw
  modified_base (218)..(218): a, c, t, g, unknown or other
  misc_feature (218)..(218): n is a, c, g, or t
  modified_base (255)..(255): a, c, t, g, unknown or other
  misc_feature (255)..(255): n is a, c, g, or t
tcagtgtactactccacgaccggtgctcgatttagtagtgtagattccgcggggctgggccctcaggaagcagcatcgggaggtgccgtcagccatggcatggatccctctcttcctcggcgtccttgcttactgcacagtatcggtggcctcctatcagttgactcacgccaccctcagtcgtccgtcgtcccaggacagacggccagcatcatctnctctggagagtaacgttgggggaataatattactttntggtatacagcgagaacgggccggccgacgtccccgtgtagttgtcattctttacaacgtactaccgaggccggccctcgacgacgactcccgtagacgcgtacttctcgtcgtacctcctaactcgtacgggaaccacgacgaccctacgtcctacgaaccctacgtaccggaacgggcccggggaccccgtaacggtaaccgttaagtacggggtaacgtacgggtacgggtaccgttacgtaacctttaacgttaccgttaggtaccgggtacgggtaccgggttacgggaaccgtaacgtaccgtaacgtttcgttacggttcgttacggttttccggggacgggtaacgggtaccgttagggttaccggtacccggttaccggttacggaccgtaccggtaccccggaccgtccggtacccccgtcccccggttaccggtacccgtccgttccgttacccccg

SEQ ID NO: 79601 - DNA, 906 bp, Homo sapiens
  misc_feature: GYAE6OF01BN3GB.16.12.B01.1.454.CMB.1.raw
  modified_base (159)..(159): a, c, t, g, unknown or other
  misc_feature (159)..(159): n is a, c, g, or t
  modified_base (627)..(627): a, c, t, g, unknown or other
  misc_feature (627)..(627): n is a, c, g, or t
tcagtgtactactccacgaccggtgctcgatttagtagtgtagattccgcgggctgggcctcaggaagcagcatcggaggtgcctcagccatggcatgactccctctcttcctcggtccgtccttgcttacgtgcacagtacgtcggtcgcctctactntagttcgactcacgcccaccctctacgtcgttccgttccgtaccccgaacggacgtaccgaccggccgacgacgtactctactcgtcgacttcgaggtacgtaagttaacgggttagggtaattaaacgttacttacgtttacgtacggttacttacggacggaacgaacggtaccgggtcccggacccgttaaccgttcccgtagttacgttcggttaccgtacttttacgttacgtaacgtaccggtaccggtacggtacccgtccgtaacgagtaccggtacccgtaccgtacgtcgtaccgtagtttcccgtcgttaccgtacccttaccgtacgttaccggtaaccgaacaccgtaccgacccttaacgtctacgtacgaccgttccgaaccggggcccgtaaccttaagggtacgttagggaccggttaacgtaggtaaccggtactttaaacccgggtttnttaaccgggtttacttccggggtacgggtaacgggtacccgggtttagggtaaccggtacctttaacggtttaccgttttacgggttacgggtttaacccgttttacggggttaacgggggacccggtttaaacccggttgttaaacccggggtttacccgaccgggttaaactccccgggggtaaacccgttcccggaaaaccgggtttcccccaccccggttccggtaaacccccgtttccggaaaccccgttccgtttaaccccccgggttccccc

SEQ ID NO: 79602 - DNA, 266 bp, Homo sapiens
  misc_feature: GYAE6OF02HGA99.16.12.B01.1.454.CMB.1.raw
  modified_base (161)..(161): a, c, t, g, unknown or other
  misc_feature (161)..(161): n is a, c, g, or t
  modified_base (259)..(266): a, c, t, g, unknown or other
  misc_feature (259)..(266): n is a, c, g, or t
tcagtgtactactccacgaccggtgctcgatttagtagtgtagattccgcgggcccgagactatggatgaggctgactattactgttcaggcgtgggacagactaattctgtgttacttttcggcgggacgggaacctaagttcgacccgtccgtacggtnacgacccaaggtctccgcccccgtcggtaccactctcgttcccccaccctcccgtacgagtagtaccactgaggcggctggacgaaggcgactatagnnnnnnnn

SEQ ID NO: 79603 - DNA, 240 bp, Homo sapiens
  misc_feature: GYAE6OF02HJUX5.16.12.B01.1.454.CMB.1.raw
  modified_base (237)..(240): a, c, t, g, unknown or other
  misc_feature (237)..(240): n is a, c, g, or t
tcagtgtactactccacgaccggtgctcgatttagtagtgtagatttggggacccgatgcttatgatagctggggccaagggacaatggtcaccgtctcttcagcctccaccaagggcccatcggtcttcccctggcaccctcctccaagagcacctctggggcacagcggccctgggctgcctggtcaaggactacttccgagtagtacactgagcgggctggcaaggcgcatagnnnn

SEQ ID NO: 79604 - DNA, 240 bp, Homo sapiens; identical to SEQ ID NO: 79603
  misc_feature: GYAE6OF02GVTZH.16.12.B01.1.454.CMB.1.raw
  modified_base (237)..(240): a, c, t, g, unknown or other
  misc_feature (237)..(240): n is a, c, g, or t

SEQ ID NO: 79605 - DNA, 502 bp, Homo sapiens
  misc_feature: GYAE6OF02F0VIT.16.12.B01.1.454.CMB.1.raw
tcagtgtactactccacgaccggtgctcgatttagtagtgtagattccgcggggctgggcctcaggaagcagcatcggaggtgcctcagccatggcatggatccctctcttcctcggcgtccttgcttactgcacagtatcggtggcctcctatcagttgactcagccaccctcagtgtccgtgtccccaggacagacggccagcatcatctgctctggagataacttgggggataaatatactttctggtatcagcagaaggccggccagtcccctgtattggtcatctttcaagataccgagcggccctcagagatccctgagcgattctctggctccaactctgggaacacagccactctgaccatcagcgggccagactatggatgaggctgactattactgtcaggcgtgggacagcaattctgtgtagtttcggcggagggacctagttgaccggtctaggtcacgccgaaggctcggcccctcggtcactctccg

SEQ ID NO: 79606 - DNA, 239 bp, Homo sapiens
  misc_feature: GYAE6OF02GIWMY.16.12.B01.1.454.CMB.1.raw
  modified_base (238)..(239): a, c, t, g, unknown or other
  misc_feature (238)..(239): n is a, c, g, or t
tcagtgtactactccacgaccggtgctcgatttagtagtgtagatttggggacccgatgcttatgatagctggggccaagggacaatggtcaccgtctcttcagcctccaccaagggcccatcggtcttcccctggcaccctcctccaagagcacctctgggggcacagcggccctgggctgcctggtcaaggactacttccgagtagtacactgagcgggctggcaaggcgcatagnn

SEQ ID NO: 79607 - DNA, 521 bp, Homo sapiens
  misc_feature: GYAE6OF02H0J88.16.12.B01.1.454.CMB.1.raw
  modified_base (389)..(389): a, c, t, g, unknown or other
  misc_feature (389)..(389): n is a, c, g, or t
tcagtgtactactccacgaccggtgctcgatttagtagtgtagattccgcggggctgggcctcaggaagcagcatcggaggtgcctcagccatggcatggatccctctcttcctcggcgtccttgcttactgcacagtatcggtggcctcctatcagttgactcagccaccctcagtgtccgtgtccccaggacagacggccagcatcatctgctctggagataacttgggggataaatatactttctggtatcagcagaaggccggccagtcccctgtattggtcatctttcaagataccgagcggccctcagagatccctgagcgattctctggctccaactctagggaacacagcccactctgaccatcacgcgggcccagactanggatggaggctagactattactgtcgaggcgtgggacagcaagttctgtgtagtttcggacggagggtaccagttcgaccgtcgtaggtcagcccgaaggcctcggcccccgttcggtctacctcttcccgg

SEQ ID NO: 79608 - DNA, 241 bp, Homo sapiens
  misc_feature: GYAE6OF02FXGC6.16.12.B01.1.454.CMB.1.raw
  modified_base (239)..(241): a, c, t, g, unknown or other
  misc_feature (239)..(241): n is a, c, g, or t
tcagtgtactactccacgaccggtgctcgatttagtagtgtagatttggggacccgatgcttatgatagctggggccaagggacaatggtcaccgtctcttcagcctccaccaagggcccatcggtcttccccctggcaccctcctccaagagcacctctgggggcacagcggccctgggctgcctggtcaaggactacttccgagtagtacactgagcgggctggcaaggcgcatagnnn

SEQ ID NO: 79609 - DNA, 503 bp, Homo sapiens
  misc_feature: GYAE6OF02GV869.16.12.B01.1.454.CMB.1.raw
tcagtgtactactccacgaccggtgctcgatttagtagtgtagattccgcggggctgggcctcaggaagcagcatcggaggtgcctcagccatggcatggatccctctcttcctcggcgtccttgcttactgcacagtatcggtggcctcctatcagttgactcagccaccctcagtgtccgtgtccccaggacagacggccagcatcatctgctctggagataacttgggggataaatatactttctggtatcagcagaaggccggccagtccccctgtattggtcatctttcaagataccgagcggccctcagagatccctgagcgattctctggctccaactctgggaacacagccactctgaccatcagcgggcccagactatggatgaggctgactattactgtcaggcgtgggacagcaattctgtgtagtttcggcggagggacagttcgaccgtctaggtcacgcccaggctcgccccctcggtcctactctccg

SEQ ID NO: 79610 - DNA, 858 bp, Homo sapiens
  misc_feature: GYAE6OF02IN5AH.16.12.B01.1.454.CMB.1.raw
tcagtgtactactccacgaccggtgctcgattttagtagtgtagattcgtcggggggttcgggacgacgtcgagtcaaggacacgagcatcggacagtcgagggtccccgcctcagtcctccctcggggcctccctgcctgctctggcgtcccaggtatcgaaactcgtgacatccagatgacccagtcctccgttccaccctgtctcgcatctgtccggagacagacgtcaccatcgacttgtccgggtccagtacagagtgttggtaccttggtcgcctggtatcagcgacgaaccgacggaacgcccctaagcttacctagatacgtatgagtgtcctccctaagtagtcggaaacgttggggtaccccagtacgtaacggttccaggccggtccaggtcggacgtacggtacgggaaccaggtaacttccctacttccgtacctaccctataccgacggacctaccggacccgttaaccgaacggtacccgtaggaacgttcggttaacgttttttacggaccgttttaaaccgttttagttttaaacgtttaccgtaacccctaaacgttaacgttaaacgtttaaaacggttaacgttttaaacctttttaaacccgttaaaacccgttttttttccccggggtaacccccggttttacgggggtaaacccccgtttaaagggttaccggggtttacggggtaaaccgtttaaaccggttaacccggtaaaaaaccccgggttaacccggttttaacggggttaacccggggttacccgttacccgggaacccccgttaacccggtaaccccggttttaccccgttccccggttttcccgttttaacccccg

SEQ ID NO: 79611 - DNA, 243 bp, Homo sapiens
  misc_feature: GYAE6OF02IJ0RH.16.12.B01.1.454.CMB.1.raw
  modified_base (239)..(243): a, c, t, g, unknown or other
  misc_feature (239)..(243): n is a, c, g, or t
tcagtgtactactccacgaccggtgctcgatttagtagtgtagatttggggacccgatgcttatgatagctggggccaagggacaatggtcaccgtctcttcagcctccaccaagggcccatcggtcttccccctggcaccctcctccaagagcacctctgggggcacagcggccctgggctgcctggtcaaggactacttccgagtagtacactgagcgggctggcaaggcgcatagnnnnn

SEQ ID NO: 79612 - DNA, 524 bp, Homo sapiens
  misc_feature: GYAE6OF02GVHL7.16.12.B01.1.454.CMB.1.raw
tcagtgtactactccacgaccggtgctcgatttagtagtgtagattccgcggggctgggcctcaggaagcagcatcggaggtgcctcagccatggcatggatccctctcttcctcggcgtccttgcttactgcacagtatcggtggcctcctatcagttgactcagccaccctcagtgtccgtgtccccaggacagacggccagcatcatctgctctggagataacttgggggataaatatactttctggtatcagcagaaggccggccagtcccctgtattggtcatctttcaagataccgagcggccctcagagatccctgagcgattctctggctccaactctgggaacacagccactctgaccatcaggccgggcccagactatggatgaggctgactattactgtcaggcgtgggacagcaattctgttgtagtttcggcgggacgggaccgtagttcggaccgtccgtaggtccacgacccgaaggctccggcccccgtcggtcctaccgtcgtcccg

SEQ ID NO: 79613 - DNA, 526 bp, Homo sapiens
  misc_feature: GYAE6OF02HVTT7.16.12.B01.1.454.CMB.1.raw
  modified_base (423)..(423): a, c, t, g, unknown or other
  misc_feature (423)..(423): n is a, c, g, or t
  modified_base (428)..(428): a, c, t, g, unknown or other
  misc_feature (428)..(428): n is a, c, g, or t
  modified_base (453)..(453): a, c, t, g, unknown or other
  misc_feature (453)..(453): n is a, c, g, or t
  modified_base (523)..(523): a, c, t, g, unknown or other
  misc_feature (523)..(523): n is a, c, g, or t
tcagtgtactactccacgaccggtgctcgatttagtagtgtagatttgggcttggaacagcctggggggtccctgagactctcctgtgcaacctctggattcacctttaccagctatgccatgagctgggtccgccaggctccagggaaggggctggagtgggtcgcagccattagtggtattcgtgatgccacatactacgcagactccgtgaggggccggttcaccatctccagcgacacttccaggagcacgttgtatctgcaaatgaacagcctgagagtcgagacacggccatatattactgtgcccgagggaggttttactatgatattactggttaacaaaaagggtctacttgactatgggccaggaaccctggtcacgtctcctcagcctcaccaaggcccatcgtcttccccncggcnccctgctccaggacgcacctccganaaccacgacgcggccctggcctgcctggcaaggactacgtccgagtgtaccagtgagcggctggcagggnacg

SEQ ID NO: 79614 - DNA, 544 bp, Homo sapiens
  misc_feature: GYAE6OF02IDJ5I.16.12.B01.1.454.CMB.1.raw
tcagtgtactactccacgaccggtgctcgatttagtagtgtagattccgcggggctgggcctcaggaagcagcatcggaggtgcctcagccatggcatggatccctctcttcctcggcgtccttgcttactgcacagtatcggtggcctcctatcagttgactcagccaccctcagtgtccgtgtccccaggacagacggcagcatcatctgctctggagataacgttggggataaatatactttctggtatcagcagaaggcgcagtccctgtattggtcatctttcaagataccgagcggccctcgagagactccctgagcgacttctctggctccaactcgtgggaacacagccactctacgaccactcaggccgggcccagactagtggactagaggtcagtacttattacgtgtacacgggcgtgggacagactaattcgtgtgtagtttcggacgggtaggacctaggtcggtacgtccgtacggtcacggacccgaaggtcctacgtcccccgtcggtaccctacgtcgtaccccgg

SEQ ID NO: 79615 - DNA, 497 bp, Homo sapiens
  misc_feature: GYAE6OF02FJ1OL.16.12.B01.1.454.CMB.1.raw
tcagtgtactactccacgaccggtgctcgatttagtagtgtagattccgcggggctgggcctcaggaagcagcatcggaggtgcctcagccatggcatggatccctctcttcctcggcgtccttgcttactgcacagtatcggtggcctcctatcagttgactcagccaccctcagtgtccgtgtccccaggacagacggccagcatcatctgctctggagataacttgggggataaatatactttctggtatcagcagaaggccggccagtccccctgtattggtcatctttcaagataccgagcggccctcagagatccctgagcgattctctggctccaactctgggaacacagccactctgaccatcagcggggcccagactatggatgaggctgactattactgtcaggcgtgggacagcaattctgtgatttcggcgtagggaccagttgaccgtctaggtcagccaagctcgcccctcggtcactctccg

SEQ ID NO: 79616 - DNA, 242 bp, Homo sapiens
  misc_feature: GYAE6OF02F0I9Y.16.12.B01.1.454.CMB.1.raw
  modified_base (239)..(242): a, c, t, g, unknown or other
  misc_feature (239)..(242): n is a, c, g, or t
tcagtgtactactccacgaccggtgctcgatttagtagtgtagatttggggacccgatgcttatgatagctggggccaagggacaatggtcaccgtctcttcagcctccaccaagggcccatcggtcttccccctggcaccctcctccaagagcacctctgggggcacagcggccctgggctgcctggtcaaggactacttccgagtagtacactgagcgggctggcaaggcgcatagnnnn

SEQ ID NO: 79617 - DNA, 671 bp, Homo sapiens
  misc_feature: GYAE6OF02HEX37.16.12.B01.1.454.CMB.1.raw
tcagtgtactactccacgaccggtgctcgatttagtagtgtagattccgcggggctgggcctcaggaagcagcatcggaggtgcctcagccatggcatggatccctctcttcctcggcgtccttgcttactgcacagtatcggtggcctcctatcagttgactcagccaccctcagtgtccgtgtccccaggacagacggccagcatcatctgctctggagataacgttgggggataaatatacttctggtatcagcagaaggccggccagtcccctgtattggtcattcttcaagtactaccgaggccggccctcgagagactcccgtgagtcgtacttctcgtcggcctaccaactcgtacgggaaccacgacgacccactccgtacgaacctagtaccgacgggcccggggaccccaaggtaaccttaggtgggtactcgggtaacggtccgtaggttaactttacgttacgtgtacgacggggtccggtacgggaacctaggtacctaagtttccgtaggttacgtttacggtttacgggacgggttacgggtaaccgttagggttccggtaacccggttccggttaaccgggtccaaccggtacccgtaacggtcccgttcccggtaccccccggttcggtacccttaccgttccgttacccccgg

SEQ ID NO: 79618 - DNA, 227 bp, Homo sapiens
  misc_feature: GYAE6OF02GJ51B.16.12.B01.1.454.CMB.1.raw
  modified_base (226)..(227): a, c, t, g, unknown or other
  misc_feature (226)..(227): n is a, c, g, or t
tcagtgtactactccacgaccggtgctcgatttagtagtgtagattccgcggggcccagactatggatgaggctgactattactgtcaggcgtgggacagcaattctgtgattttcggcggagggaccaagttgaccgtcctaggtcagcccaaggctgccccctcggtcactctgttcccaccctcctcgagtagtacactgagcgggctggcaaggcgcatagnn

SEQ ID NO: 79619 - DNA, 614 bp, Homo sapiens
  misc_feature: GYAE6OF02HZJ0V.16.12.B01.1.454.CMB.1.raw
tcagtgtactactccacgaccggtgctcgatttagtagtgtagatttgggcttggaacagcctggggggtccctgagactctcctgtgcaacctctggattcacctttaccagctatgccatgagctgggtccgccaggctccagggaaggggctggagtgggtcgcagccattagtggtattcgtgatgccacatactacgcagactccgtgaggggccggttcaccatctccagcgacacttccaggagcacgttgtatctgcaaatgaacagcctgagagtcgaggacacggccctatattactgtgacgaaagataagagtttcggggacccatgcttatgatagcgtggggccaaagggacaagtcggtactaccgtctcttcacgccctcccaaccgaacgggccccaacgttcccggttcccgtttccccccgtcgggccctacccccttcccttacccaaacgacgccaaccctccgtcggggccacgacggccggccccgtgggccgtcgcccgttcggtaccgaacggtacctaccgttccggaacgttacgtaacaccgtggacggtccgggcgtcgggacgtaacgggccgacacgtagtcg

SEQ ID NO: 79620 - DNA, 540 bp, Homo sapiens
  misc_feature: GYAE6OF02FNYKP.16.12.B01.1.454.CMB.1.raw
tcagtgtactactccacgaccggtgctcgatttagtagtgtagattccgcggggctgggcctcaggaagcagcatcggaggtgcctcagccatggcatggatccctctcttcctcggcgtccttgcttactgcacagtatcggtggcctcctatcagttgactcagccaccctcagtgtccgtgtccccaggacagacggccagcatcatctgctctggagataacttgggggataaatatactttctggtatcagcagaaggcggccagtcccctgtattggtcatctttcaagataccgagcggccctcagagactccctgagcgattctctgctccaactctgggaacacagccactctcgaccatcacgcgggcccagactagtgatgaggctgactacttacgtgtcgaggcgtgggacgagtcgaatttcgtgttgtacgttttcggacggtacgggacctaggttcgaccggttcgtacggtcgacgacccgaaggcctccggtcccccgtcggtccaccgttcgttacccgg

SEQ ID NO: 79621 - DNA, 572 bp, Homo sapiens
  misc_feature: GYAE6OF02FJH1R.16.12.B01.1.454.CMB.1.raw
tcagtgtactactccacgaccggtgctcgatttagtagtgtagattccgcggggctgggcctcaggaagcagcatcggaggtgcctcagccatggcatggatccctctcttcctcggcgtccttgcttactgcacagtatcggtggcctcctatcagttgactcagccaccctcagtgtccgtgtcccaggacagacggccagcatcatctgctctggagataacgttgggggataaatatactttctggtatcagcagaaggccggccacgtcccctgtattggtctatctttcaagataccgagccggccctcagagactccctgacgcgattctcgtcggcctaccaactcgtagggaaccacgacgccactctcgaccatcgacggccggggccagactagtggatagaggctgacttattactgtacaggcggtagggacagactagttcttggttgttacgttttcgggacgggtacgggaccgtaggttacgtaccggttaccgtaggtaccgacgacccgtacggccgtcccggtccccgtcggtccctaccttccgttccccg

SEQ ID NO: 79622 - DNA, 540 bp, Homo sapiens
  misc_feature: GYAE6OF02FPGJJ.16.12.B01.1.454.CMB.1.raw
tcagtgtactactccacgaccggtgctcgatttagtagtgtagattccgcggggctgggcctcaggaagcagcatcggaggtgcctcagccatggcatggatccctctcttcctcggcgtccttgcttactgcacagtatcggtggcctcctatcagttgactcagccaccctcagtgtccgtgtccccaggacagacggccagcatcatctgctctggagataacttgggggataaatatactttctggtatcagcagaagccgcagtcccctgtattggtcatctttcaagtataccgagccggccctcagagactccctgacgcgacttctctggctcccaactctagggaacacacgccactctcgaccatcagccgggccagactatggatggagctagactattactgtcgaggcgtcgggacagctaagtttctgttgtacgttttcggacggtacgggacctaggttcgaccgttcgtacggtccgacgtacccgaaggcctacggcccccgtggtcctaccgtcttcccgg

SEQ ID NO: 79623 - DNA, 520 bp, Homo sapiens
  misc_feature: GYAE6OF02F4CYC.16.12.B01.1.454.CMB.1.raw
  modified_base (427)..(427): a, c, t, g, unknown or other
  misc_feature (427)..(427): n is a, c, g, or t
  modified_base (512)..(512): a, c, t, g, unknown or other
  misc_feature (512)..(512): n is a, c, g, or t
tcagtgtactactccacgaccggtgctcgatttagtagtgtagattcgcaggggtcagactcagtcaggacacagcatggacatgagggtccccgctcagctcctggggctcctgctgctctggctcccaggtatcaaatgtgacatccagatgacccagtctccttccaccctgtctgcatctgtcggagacagagtcaccatcacttgccgggcagtcagagtgtggtacctggttggcctggtatcagcagaaaccagggaaagcccctaagctcctgatctatgatgtctaccaatataggaaagtggggtaccattcaaggttcagcggcagtggatcgtggacagtaatcactctcacatcagtcacgctacagtcctagatagtatttgcgttactttattacttgacctaaatagtaanaagtattattactaacgtttccgaccctagggtaacctaagtgttagagttaacgtaccaaacggtaactggttagctgctaccntctgttac

SEQ ID NO: 79624 - DNA, 597 bp, Homo sapiens
  misc_feature: GYAE6OF02HMOAW.16.12.B01.1.454.CMB.1.raw
tcagtgtactactccacgaccggtgctcgatttagtagtgtagattccgcggggctgggcctcaggaagcagcatcggaggtgcctcagccatggcatggatccctctcttcctcggcgtccttgcttactgcacagtatcggtggcctcctatcagttgactcagccaccctcagtgtccgtgtccccaggacagacggccagcatcatctgctctggagataacgttggggataaagtatactttctggtatcagcagaaggccggcagtcccctgtattggtcatcttcaagataccggagcggcctcagacgactcctgagcgtacttctcgtggctaccaactcgtagggaacctacacgccctactccagacccatcacggtccggggaccagctagtggatggacggctagacttacttacgtgtcgtaggcgtaggacgagtctaacgttcgtaggttagttacggttttcgggacgggtaacggggtacctaggttaccggtacccggttcgtacgggtacctaacggtacccgaacggtcccgttacccggcccccgttacggtacccgtacttccgttaccccggg

SEQ ID NO: 79625 - DNA, 552 bp, Homo sapiens
  misc_feature: GYAE6OF02G97PV.16.12.B01.1.454.CMB.1.raw
  modified_base (432)..(432): a, c, t, g, unknown or other
  misc_feature (432)..(432): n is a, c, g, or t
  modified_base (522)..(522): a, c, t, g, unknown or other
  misc_feature (522)..(522): n is a, c, g, or t
  modified_base (543)..(543): a, c, t, g, unknown or other
  misc_feature (543)..(543): n is a, c, g, or t
tcagtgtactactccacgaccggtgctcgatttagtagtgtagattccgcggggctgggcctcaggaagcagcactggtggtgcctcagccatggcctggaccgttctcctcctcggcctcctctctcactgcacaggctctgtgacctcctatgtcctgactcagccaccctcggtgtccgtggccccaggacagacggccagcataacctggtgggggaaacgccttggacgtaaaagtgtgcactggtaccagcagaagccaggccaggcccctgtgctggtcgtctatgatgatagccgaccggccctcgagggactcccgtagacgcgtattcctcgtggcctccaactcgtagggaacgcggcccaccgtgaccatcagcgagggtcgaagggccgggatggaggccgattatcgtgtcgaggtgnggataggtagtagtgatactagttatgttcgttggattcgaggtaccgtaggtcctacgtcctaggtcacggtcccaaggaccccaaccngtcgtctacgtctcgtccccnccgtctacg

SEQ ID NO: 79626 - DNA, 565 bp, Homo sapiens
  misc_feature: GYAE6OF02HPJBP.16.12.B01.1.454.CMB.1.raw
  modified_base (540)..(540): a, c, t, g, unknown or other
  misc_feature (540)..(540): n is a, c, g, or t
  modified_base (559)..(559): a, c, t, g, unknown or other
  misc_feature (559)..(559): n is a, c, g, or t
tcagtgtactactccacgaccggtgctcgatttagtagtgtagattccgcggggctgggcctcaggaagcagcatcggaggtgcctcagccatggcatggatccctctcttcctcggcgtccttgcttactgcacagtatcggtggcctcctatcagttgactcagccaccctcagtgtccgtcgtcccaggacagacggccagcatcatctgctctgagataacgtggggataatatactttctggtatctagcaggaaggccggccagtccccctgtattggtactacttctttacaagtactaaccggacgccggccctagacgacgactcccgtgacgtcgtaacttctacgtcggctaccaactcgtacggaactacgacgcccactcgacgaccagtcgacggccggggacccagactagtcggagtggaggtctagtacttattacgtgtacgacggtcggtgggacagtacgtaatcgtgtgttacgttggacgtacgacgtagtcgaccggtcaggtacacgtaccgagcnccgtcccgtcggtctcctntccccg

SEQ ID NO: 79627 - DNA, 670 bp, Homo sapiens
  misc_feature: GYAE6OF02JIUAX.16.12.B01.1.454.CMB.1.raw
  modified_base (277)..(277): a, c, t, g, unknown or other
  misc_feature (277)..(277): n is a, c, g, or t
  modified_base (313)..(313): a, c, t, g, unknown or other
  misc_feature (313)..(313): n is a, c, g, or t
tcagtgtactactccacgaccggtgctcgatttagtagtgtagattccgcggggctgggcctcaggaagcagcatcggaggtgcctcagccatggcatggatccctctcttcctcggcgtccttgcttactgcacagtatcggtggcctcctatcagttgactcagccaccctcagtgtccgtcgtcccaggacagacggccagcatcatctgctcgtggagagtaacgttaggggaataaatattactttctaggtatacagacaaggaacggccngggtccccaggtaccccttggtacttaggtccttanacgttcaacgataccggactacggacctacgaagtaccgagtaccctagaacgtccgaacttcgacttcggaacttcccaacgtaacctacgggaaacaccgaacgtcccaacgtaccctagtacccaagtaccggacgaccggggaccccaagtaccgtagtacggaagtacgaggacgtagtaaccttagttactaggtacctagggacgtagggactaagtactaagttcgttagtttcggaacgtttacgggacggtaacggtaccgtaacggttaccggaaccggttcgtaacggtccgtaaggtacccgtaacggtacccgtacggtaccccgtacggttccacgttaccc

SEQ ID NO: 79628 - DNA, 527 bp, Homo sapiens
  misc_feature: GYAE6OF02IVQHQ.16.12.B01.1.454.CMB.1.raw
  modified_base (353)..(353): a, c, t, g, unknown or other
  misc_feature (353)..(353): n is a, c, g, or t
tcagtgtactactccacgaccggtgctcgatttagtagtgtagattccgcggggctgggcctcaggaagcagcatcggaggtgcctcagccatggcatggatccctctcttcctcggcgtccttgcttactgcacagtatcggtggcctcctatcagttgactcagccaccctcagtgtccgtgtccccaggacagacggccagcatcatctgctctggagataacttgggggataaatatactttctggtatcagcagaaggccggcagtcccctgtattggtcatctttcaagataccgagcggccctcagagatccctgagcgattctctggctccaactctgggacacngccactctgacccatccaggtcgggcccagacctagtggatggacggctgactattactgtcaggcggtggacaggctaagttgtggtgttacgtttcggcgggagggacctaggttcgtacccgtcgttacgggcagcccgaaggcgtcgccccgtcggtcctacgtctccgg

SEQ ID NO: 79629 - DNA, 737 bp, Homo sapiens
  misc_feature: GYAE6OF02I9FLW.16.12.B01.1.454.CMB.1.raw
  modified_base (577)..(577): a, c, t, g, unknown or other
  misc_feature (577)..(577): n is a, c, g, or t
tcagtgtactactccacgaccggtgctcgatttagtagtgtagattccgcgggcgtgggcctcaggaagcagcatcggaggtgcctcagccatggcatggatccctctcttcctcggcgtccttgcttactgcacagtatcggtggcctcctatcagttgactcagccaccctcagtgtccgtgtccccaggacagacggccagcacgtcagtctgtctacgtggagtataaccgttgggggaataaaactcgttaacttttccgtagggttataccgacgtacgtaacggaacggtcccggtaccgtaaccggttcccccttaggtaacgtttcgggtacctaacgtttaccgttttacgaaacggttaacttaacccgggaacggtcccgggtaccccttaccggtaagacggtaccgttacccgtacggtacgccggttacttaccttcggtacggtacctacccgtaacgttcgtacgggaaacctccgacgtccaccttcgtccgaccaagtccgaacggtcccgggaccaggtacctagtggacgtgaaggtctacgtaatacgtttacgntaccgtaggcggttacggactacgggtactaagttcctagtaacgttcgttccgggacggtacggaacttacgggtaccgtaccggttcgtacggttcgaacccggtccgtaacggtccttcccggccctttacggacccttaccgtccggttcccccgg

SEQ ID NO: 79630 - DNA, 802 bp, Homo sapiens
  misc_feature: GYAE6OF02IHOCR.16.12.B01.1.454.CMB.1.raw
  modified_base (332)..(332): a, c, t, g, unknown or other
  misc_feature (332)..(332): n is a, c, g, or t
  modified_base (388)..(388): a, c, t, g, unknown or other
  misc_feature (388)..(388): n is a, c, g, or t
tcagtgtactactccacgaccggtgctcgatttagtagtgtagatttgggcttggaacagcctggggggtccctgagactctcctgtgcaacctctggattcacctttaccagctatgccatgagctgggtccgccaggctccgaggggaaggggctgggagtgggtcgcagccattagtggtattcgtgatgccacatactacgcagactccggtggaggggtccgttcaaccgatcctccgagcgacctacttccgaggagcctacgttgtatcctgacaaatgaacacgctagagacggtcgaagtaccgaccggaccttatattacgngtacgaacgtaagaacttaaggtacgtttcggggaaccctagttacgtacttaagngaacgttaggacggttacggggaaccaaagggtaacaaaggtttcgggtaaccctaccggtttccgttaaccttaccggtaccgtaacccgttacccgaaacccggtaacccggggtacccccttaaagttccccgggtttccctttaaccccggtccggtaaccccgttaacccctttccccgaaccgttaaaacggtccgacccgttaaccggttccggggtacggggaaccaacggtaaccgggtccccgggtaacccggtgggtaaccgttcggtacccggtttaacggtacccggtaaaacggtcccgtttaaaccgttacccggtaaggttaaccggtaaccgtaacggtcgggtaaccgggtccggtacgttacgggaccggtaacgggaccctaacggtaatcggc

SEQ ID NO: 79631 - DNA, 618 bp, Homo sapiens
  misc_feature: GYAE6OF02FQ1R1.16.12.B01.1.454.CMB.1.raw
tcagtgtactactccacgaccggtgctcgatttagtagtgtagattccgcggggctgggcctcaggaagcagcatcggaggtgcctcagccatggcatggatccctctcttcctcggcgtccttgcttactgcacagtatcggtggcctcctatcagttgactcagccaccctcagtgtccgtgtccccaggacagacggccagcatcatctgctctggagattaacgtgggggataaaatatactttctggtatcagcagaagccggccagtcccctgtattggtcatctttcaagataccgagcggccctcagagctcctgagcgattctctggcctccaactctgggaacacagcccactctacgacctagtcacgggtccgggccaacggactacgtaggactagggacggaccttaggaacttacgtttacttcggtacgacgggtcggtacgggacgacgtcgaaacgtttcgtgttacgtacgtttttcggacgggtaacgggtaccgttaaggttcggaaccggtttcccgtaacggttaccgaacggtaccccgaagggtccgttacccggcccccgttacggttcccgtacccgttcgtttaccccgg

SEQ ID NO: 79632 - DNA, 535 bp, Homo sapiens
  misc_feature: GYAE6OF02F6JYZ.16.12.B01.1.454.CMB.1.raw
tcagtgtactactccacgaccggtgctcgatttagtagtgtagattccgcggggctgggcctcaggaagcagcatcggaggtgcctcagccatggcatggatccctctcttcctcggcgtccttgcttactgcacagtatcggtggcctcctatcagttgactcagccaccctcagtgtccgtgtccccaggacagacggccagcatcatctgctctggagataacttgggggataaatatactttctggtatcagcagaaggccggccagtccccctgtattggtcatctttcaagtataccgagcggccctcagagatccctgagcgattctctggctccaactcgtggaacacagccactctcgaccatcagcgggcccagactatggatgaggctgactattactgtcaggcgtacgggacagactaacgttcgtagttgtagttttcgggacggtagggtacctaggttcggaccgtccgtaggtccgacgacccgaaggcctcgcccccgtcggtccacgtcctcccgg

SEQ ID NO: 79633 - DNA, 730 bp, Homo sapiens
  misc_feature: GYAE6OF02HC6O6.16.12.B01.1.454.CMB.1.raw
tcagtgtactactccacgaccggtgctcgatttagtagtgtagattccgcggggctgggcctcaggaagcagcatcggaggtgcctcagccatggcatggatccctctcttcctcggcgtccttgcttactgcacagtatcggtggcctcctatcagttgactcagccacctcagtcgtccgtgtccccaggacacgacggccagcatcactctgctcgtaggagaataacgttggggaataaatactactttcgtggtatcagcaaggaacggccgccacgttcccctgtacttcggtcacttctttacaagactaccgagccgtaccctcgacgacgtactcccgtagacgtcgtagtctcgtaggtcctaccgaacgtccgtacgggaacacgaacgcctaaccgtctacgaacctcgtaccgtacggacccggggaccccgtaggaacccgtttaggtacgggtaacgtacggtacgggtacttacggtaacgtttaacgttttacgtacggttaccgacggtacgggtcggggtaacgaaccggttacgttaaactttcggttagttacgggtttaacggttttacccgggtaccggggtaacggttaaccggtaaccggtttaggtaacccggtaccggttaaccggacgtaacccgtaacccgtaaccggtccgtaccccgggttccctccggggttaacctacccgttaccgttacccccgg

SEQ ID NO: 79634 - DNA, 638 bp, Homo sapiens
  misc_feature: GYAE6OF02GU4BM.16.12.B01.1.454.CMB.1.raw
  modified_base (247)..(247): a, c, t, g, unknown or other
  misc_feature (247)..(247): n is a, c, g, or t
tcagtgtactactccacgaccggtgctcgatttagtagtgtagattccgcggggctgggcctcaggaagcagcatcggaggtgcctcagccatggcatggatccctctcttcctcggcgtccttgcttactgcacagtatcggtggcctcctatcagttgactcagccaccctcagtgtccgtgtcccaggacagacggccagcatcatctgctctggagataacgttggggaataaatatactttntaggtatcagcgaaggtaacggccggaccacgtccctgtagttcggtctatctttacgaacgtacgtaccgagccggccctcaacgtacgaccttcccgtgaacgcgtacgttcgtcgtggcctaccgtaaccgtcggtacgggaacaccgtacgaccctactccgtacgaacctacgtaccgacggcccgggtaccaagtaacgtagtaggtagttcggaaggtcgtagtaactttactacgtcgtagacgggtacggtcgggactacgactcgttacgtggttacgttacgtttcggacggtacgtaccgtaggttccgaccggttcgtaacggtcgaccgtaccgaccggtcgtcccgtcccgtacggtccctacgtccttaccccgg

SEQ ID NO: 79635 - DNA, 771 bp, Homo sapiens
  misc_feature: GYAE6OF02HLB71.16.12.B01.1.454.CMB.1.raw
  modified_base (230)..(230): a, c, t, g, unknown or other
  misc_feature (230)..(230): n is a, c, g, or t
  modified_base (378)..(378): a, c, t, g, unknown or other
  misc_feature (378)..(378): n is a, c, g, or t
tcagtgtactactccacgaccggtgctcgatttagtagtgtagattccgcggggctgggcctcaggaagcagcatcggaggtgcctcagccatggcatggatccctctcttcctcggcgtccttgcttactgcacagtatcggtggcctcctatcagttgactcacgccctaccctcagttcgtccgtcgtccccaggacacggacggccagcatcatctgctcgtgganatacggtagggaataaatattactttctaggtatcgagacgaaggacggccgcctacgtccccttagtacgttggtactacgttctttacgaagtactaccggacgcccggtaccctacgacgacgtacctccgagacgcgtacttcncgtcgtcctcaacgtcggtacggaacacgaccgtacctaccttcacgtacctacgtaccggccgggtacccgggaccccgtaagtaacgttaggtacggtaggtacgggtaacggtcctaacgggtttaacctttacggttaaccgtcggttaccgacggggtacggttaccggggaacgttaaccggtaccgttaacgtttccggttacggttaacggttttcccgggtttaacggggaaccggggtaacggggttaacccggttaaccgggtttccgggttaaccccggttacggttaacccggttaccgaaacccgggttaacccggacggtttccccggtcccggtcccccggtttaaccggtcccgttacccgttacccgtacccccg

SEQ ID NO: 79636 - DNA, 714 bp, Homo sapiens
  misc_feature: GYAE6OF02FUQEN.16.12.B01.1.454.CMB.1.raw
  modified_base (136)..(136): a, c, t, g, unknown or other
  misc_feature (136)..(136): n is a, c, g, or t
  modified_base (217)..(217): a, c, t, g, unknown or other
  misc_feature (217)..(217): n is a, c, g, or t
  modified_base (222)..(222): a, c, t, g, unknown or other
  misc_feature (222)..(222): n is a, c, g, or t
tcagtgtactactccacgaccggtgctcgatttagtagtgtagattccgcggggctgggcctcaggaagcagcatcggaggtgcctcagccatggcatggatccctctcttcctcggcgtccttgcttactgcacngtatcggtggcctcctatcagttgactcacgccaccctcagtcgtccgtcgtccccaggacacgacggccagcatcatctnctcgnggagatacggtggggaataaatattactttcgtaggtatcgagcaaggaacggccgccacgttccctgtactggtctattcttacaagtactaccggacgccggtccctagaacgtacgtaccgtcccgtaggacgcggttacttccgttccgtcggtaccctaccgtaaccgttcggtaacgggaaccacgtaccgacctaccgttacgaccggtactaccgtcggaacccgggtcccgggaaccaggtaacgtaggtacggtacgcgggaacggttctacggttaacttaacggtttaccgtcggtacgtaggggtcggtacggaacttacggtacgttacgttccgtaggtttacgggttccgtttacgggaacgggtaccgtaaccggttagttcccggtaaccgttccggaacggttacccgaccggttaacccggcgttcccgacccggttaccccgttcggtaaccttcccgtacccgtttcccc

SEQ ID NO: 79637 - DNA, 915 bp, Homo sapiens
  misc_feature: GYAE6OF02H5XJW.16.12.B01.1.454.CMB.1.raw
  modified_base (507)..(507): a, c, t, g, unknown or other
  misc_feature (507)..(507): n is a, c, g, or t
tcagtgtactactccacgaccggtgctcgatttagtagtgtagattccgcggggctgggcctcaggaagcagcatcggaggtgcctcagccatggcatggatccctctcttcctcggcgtccttgcttactgcacagtatcggtggcctcctatcagttgactcagcccaccctcagtcgtccgtcgtaccccgaggaccacgaccggccagacatccattcctgtactcgaggtaagtaagttaaccggttggggaacttaaagttacttactttacgtaggttactacgaacggtacgtaacggaaaccgggtccccggtaccgtaaccggttcccccttaggtttacgttacggttactaacgtttctttaccggaaagtaccgtacccgggacgcccggtccctagacgtaacgtaccttaccggtacggaccgtacgtactttccgtaccggttccggtaccttaacccgtaaccgtttaccgggaaaaccggggtaaaccncgtaacccgtacccgtaccgtacccggttaaacaaccccgtaaggttcccgaacccggggtacccgggtaaccctaaacggtaaccgtaagggtacggtaaggtacgggtacggtaccgttaacggttaactttaaccggttacggttacgggttaccgggaggttaccggggtacggtaaccgtaacggttaacctttaagttcggtttccggttaagttttaaccgggtttaccgggaaaccgggggttaaccggttaacccggttaacgggttacccgggtaacccggtttcgggttaacccggtaaccgtaaccccgggtacccgtaaccgggtcccccgtttaccccggtaccccccggtttagggtccccttttaacccggttccccgtttaacccccccgg

SEQ ID NO: 79638 - DNA, 660 bp, Homo sapiens
  misc_feature: GYAE6OF02GXYMK.16.12.B01.1.454.CMB.1.raw
  modified_base (212)..(212): a, c, t, g, unknown or other
  misc_feature (212)..(212): n is a, c, g, or t
  modified_base (234)..(234): a, c, t, g, unknown or other
  misc_feature (234)..(234): n is a, c, g, or t
  modified_base (237)..(237): a, c, t, g, unknown or other
  misc_feature (237)..(237): n is a, c, g, or t
  modified_base (254)..(254): a, c, t, g, unknown or other
  misc_feature (254)..(254): n is a, c, g, or t
  modified_base (267)..(267): a, c, t, g, unknown or other
  misc_feature (267)..(267): n is a, c, g, or t
  modified_base (316)..(316): a, c, t, g, unknown or other
  misc_feature (316)..(316): n is a, c, g, or t
  modified_base (323)..(323): a, c, t, g, unknown or other
  misc_feature (323)..(323): n is a, c, g, or t
  modified_base (650)..(650): a, c, t, g, unknown or other
  misc_feature (650)..(650): n is a, c, g, or t
  modified_base (657)..(657): a, c, t, g, unknown or other
  misc_feature (657)..(657): n is a, c, g, or t
tcagtgtactactccacgaccggtgctcgatttagtagtgtagatttgggcttggaacagcctggggggtccctgagactctcctgtgcaacctctggattcacctttaccagctatgccatgagctgggtcccgccgaggcctccgaggggaaggggtctggaggtgggtccgcaggcctattagtggttattcgtgatgccacatactcncagactcgtgagggccgtcacntcnccagcgacactccaggncagttgtatcgtnacaaagtgaacacgccgttgacgagtcggagtaccgaacgtccctaatntttacgngtcgaacgaaaagtagtaataccggtttacggggacctatacggtcttaaggtcgtagtaaccggtcgttcgggggaaccgttaacggacgaagttcgggtactacccggttctcttaccgactcccgtaccgaaccgtaaccgggcccttacgtcccgtttcccgttaccccgtagggtacccctacccctacccgtccgaaacgttccgccaccgtttcgggacggccgacgacggtacccggccgggtcgtcgtcccggcttacggacgtaacgtccgtacttcgagtaccgacgtacacggcggtcggctaggcgtaccggcncgtaagngtc

SEQ ID NO: 79639 - DNA, 718 bp, Homo sapiens
  misc_feature: GYAE6OF01C9VRZ.39.5.A05.1.454.CMB.1.raw
tcagtcgcactagtcacgaccggtgctcgatttagatagatagacaggggggggagaggagccccagccgtgagattcccaggagtatccacctggagatcagcactgaacacagaccaccaaccatggaattcgggctaaactgggttttctttgtggctatcttggaaggtgtccaatgtgaagtgcaactggtggagtcgtgggggacacgttggcccagccaggccacgtccctgacactgtcgtgtaaagcgtcgtgggttcgcctttggtgtatttcgcttttgaggtttgggtgtcgccagacgtccgacgggaacgggccgtgggaggtggtagtttaggtttaagttagaagttaaaactcgtacggtgggaactagtgaatacgcctctatctgtagaaggcagtactttacatctacacgagactgatacgaacctaaaatctcgtacttacttccttaacaaattacgaaacgtacgtacccgtaggaacgggacgggtaaccgaacgacggacccgaccgagtaacttaccgttactttacgttcggtttacgttaccggtacccgtttacggttttccggggtaccggtacccgggttaaccccttaaaaagtttacccggtaaaaccggtaacccgggttcccgggggggaacccccgggttaacgtttcccccgggttagggtttcccgttttacccccggg

SEQ ID NO: 79640 - DNA, 630 bp, Homo sapiens
  misc_feature: GYAE6OF02GFDIR.39.5.A05.1.454.CMB.1.raw
  modified_base (554)..(554): a, c, t, g, unknown or other
  misc_feature (554)..(554): n is a, c, g, or t
tcagtcgcactagtcacgaccggtgctcgatttagatagatagacaggggggggagaggagccccagccgtgagattcccaggagtatccacctggagatcagcactgaacacagaccaccaaccatggaattcgggctaaactgggttttctttgtggctatcttggaaggtgtccaatgtgaagtgcaactggtggagtctgggggacacttggcccagccaggccagtccctgacactgtcgtgtaaagcgtactgggttcgcctttggtgatttcgtctttgaggtttgggtgcgtccagagtccgaacgggaagggcctgggagtgggaagtttgggtttaaattaagtaaacgtaaaaactctacggttgggaactaggttgaaatacggacctcaatctaggtagaaaggcagtactttaccatctacacgtagatagatacgaactaaaaactactacgaccttataccttaaccaaatagaaaccacggtaccctaggaacggaccggacgaaccacgaccgccaaggacttaactctattcgtnttccgactacgttcggcgtaggtaccctaaattcgaacgtacggtccggggaccggtactccgttcgttcgttccg

SEQ ID NO: 79641 - DNA, 566 bp, Homo sapiens
  misc_feature: GYAE6OF02IY16Y.39.5.A05.1.454.CMB.1.raw
  modified_base (189)..(189): a, c, t, g, unknown or other
  misc_feature (189)..(189): n is a, c, g, or t
  modified_base (264)..(264): a, c, t, g, unknown or other
  misc_feature (264)..(264): n is a, c, g, or t
  modified_base (298)..(298): a, c, t, g, unknown or other
  misc_feature (298)..(298): n is a, c, g, or t
  modified_base (368)..(368): a, c, t, g, unknown or other
  misc_feature (368)..(368): n is a, c, g, or t
  modified_base (380)..(380): a, c, t, g, unknown or other
  misc_feature (380)..(380): n is a, c, g, or t
  modified_base (382)..(382): a, c, t, g, unknown or other
  misc_feature (382)..(382): n is a, c, g, or t
  modified_base (435)..(435): a, c, t, g, unknown or other
  misc_feature (435)..(435): n is a, c, g, or t
  modified_base (444)..(444): a, c, t, g, unknown or other
  misc_feature (444)..(444): n is a, c, g, or t
  modified_base (474)..(474): a, c, t, g, unknown or other
  misc_feature (474)..(474): n is a, c, g, or t
tcagtcgcactagtcacgaccggtgctcgatttagatagatagacaggggggggagaggagccccagccgtgagattcccaggagtatccacctggagatcagcactgaacacagaccaccaaccatggaattcgggctaaactgggttttctttgtggctatcttggaaggtgtccaatgtgaagtgnaactggtggagtctgggggacacttggcccagccaggccagtccctgacactgtcgtgtaaagcgtctgggttcncctttggtgatttcgctttgagttgggtgcgcanaggtcacggaagggcctggagtggattggttaatagaagtaaaactctacgtggacagttgaatacgccnatctgtgaaagnanatttaccatctcaagagatgatgaaccaaaatactgacctatctacaaattanaacagaccngaggacgacgacgagccgacaggatatctnttacgtgttcgactacgtttcggcggttacggcccaaaagttcgaacctaacggtcgggggtacccggaagttcccgtaggttcctttccgg

SEQ ID NO: 79642 - DNA, 836 bp, Homo sapiens
  misc_feature: GYAE6OF02JRU1F.39.5.A05.1.454.CMB.1.raw
  modified_base (539)..(539): a, c, t, g, unknown or other
  misc_feature (539)..(539): n is a, c, g, or t
tcagtcgcactagtcacgaccggtgctcgatttagatagatagacagggggggagaggagccccagccgtgagattcccaggagtatccacctggagatcagcactgaacacagaccaccaaccatgaattcggctaaacgtggtttcttgtggctatcttggagtgtccatgtgaagtgcaactggtggagtcgtggggactacgttcggaccagccgtaggccgacgtcccgtcgaccacgttacgttacgtcgttaaacgccggttcgttcgggttccgtaccgttttgggttacgtacgttttcggtacgttttaggttacggttcgggtggtccgtacccggaaggtacgtaccgtacgggaacgggtccgtaggtcggtacggttagtttacggtttaaagttaaggtaaagttaaaacctcgtaacgttagggtacctaggttagtaactacggtcctacgtacttcgttacggtacgtaaagtcgtaagtacgtttacgtattaccgtacctacgtaactaggttaaccgngttaaaccccgaaacgtaaaactttcgaccgtttacctaaccgttacgtaacgaacttagtaacccgtacgtcgtacgaaacggtaaccggtaccaccgtaggtaccgggtaacctacggttaactcccgttaaggtcccttaaggtaccgggtttacccaacgggttttacgttccgggtaaagggttcccctaaacgttaaaaccggttttcccggaagggttttaacccccgggtcggggtacccccgggtttaaaacgttcccggtttacccgggtttacccgtttaccccgg

SEQ ID NO: 79643 - DNA, 253 bp, Homo sapiens
  misc_feature: GYAE6OF01B9ZS8.53.70.G04.1.454.CMB.1.raw
  modified_base (252)..(253): a, c, t, g, unknown or other
  misc_feature (252)..(253): n is a, c, g, or t
tcagcgcgtatacacacgaccggtgctcgatttagtgtagtgtgaagggaaagggacaagtttcacactgaacatcagccgggtggaggctgacgatgttggcatttattattgcatgcaaagcagaaaccttccgctcactttcggcggtgggaccaggatacagatcaatcgaactgtggctgcaccatctgtcttcatcttcccgccatctgatcgtactgcgctgagcgggctggcaaggcgcatagnn

SEQ ID NO: 79644 - DNA, 255 bp, Homo sapiens
  misc_feature: GYAE6OF01A811F.53.70.G04.1.454.CMB.1.raw
  modified_base (214)..(214): a, c, t, g, unknown or other
  misc_feature (214)..(214): n is a, c, g, or t
  modified_base (249)..(255): a, c, t, g, unknown or other
  misc_feature (249)..(255): n is a, c, g, or t
tcagcgcgtatacacacgaccggtgctcgatttagtgtagtgtgaagggaaagggacaagtttcacactgaacatcagccgggtggaggctgacgatgttggcatttattattgcatgcaaagcagaaaccttccgctcactttcggcggtgggaccaggatacagatcaatcgaactgtggctgcaccatctgtcttcatccttccgccatcngatcgtactgcgctgagcggctggcagcgcaatgnnnnnnn

SEQ ID NO: 79645 - DNA, 273 bp, Homo sapiens
  misc_feature: GYAE6OF01EGSN6.53.70.G04.1.454.CMB.1.raw
  modified_base (192)..(192): a, c, t, g, unknown or other
  misc_feature (192)..(192): n is a, c, g, or t
  modified_base (228)..(228): a, c, t, g, unknown or other
  misc_feature (228)..(228): n is a, c, g, or t
  modified_base (257)..(273): a, c, t, g, unknown or other
  misc_feature (257)..(273): n is a, c, g, or t
tcagcgcgtatacacacgaccggtgctcgatttagtgtagtgtgaagggaaagggacaagtttcacacttaacatcagccgggtggaggctgacgatgttggctatttattattgcatgacaaagcagaaaccttccgctcactttcgggcggtgggaccaggatacagatcaatcgaactgtggctgcacntctgtcttcatcctcccgccatctgatcgtactgcncgtgagcgggctggactaggcgcagtagnnnnnnnnnnnnnnnnn

SEQ ID NO: 79646 - DNA, 254 bp, Homo sapiens
  misc_feature: GYAE6OF01BG26O.53.70.G04.1.454.CMB.1.raw
  modified_base (253)..(254): a, c, t, g, unknown or other
  misc_feature (253)..(254): n is a, c, g, or t
tcagcgcgtatacacacgaccggtgctcgatttagtgtagtgtgaagggaaagggacaagtttcacactgaacatcagccgggtggaggctgacgatgttggcatttattattgcatgcaaagcagaaaccttccgctcactttcggcggtgggaccaggatacagatcaatcgaactgtggctgcaccatctgtcttcatccttcccgccatctgactcgtactgcgctgagcggctggcaaggcgcatagnn

SEQ ID NO: 79647 - DNA, 255 bp, Homo sapiens
  misc_feature: GYAE6OF02HQFGF.53.70.G04.1.454.CMB.1.raw
  modified_base (252)..(255): a, c, t, g, unknown or other
  misc_feature (252)..(255): n is a, c, g, or t
tcagcgcgtatacacacgaccggtgctcgatttagtgtagtgtgaagggaaagggacaagtttcacactgaacatcagccgggtggaggctgacgatgttggcatttattattgcatgcaaagcagaaaccttccgctcactttcggcggtgggaccaggatacagatcaatcgaactgtggctgcaccatctgtcttcatcttcccgccatctgatcgtactgcgctgagcgggctggcaaggcgcatagnnnn

SEQ ID NO: 79648 - DNA, 253 bp, Homo sapiens; identical to SEQ ID NO: 79643
  misc_feature: GYAE6OF02HQ2GF.53.70.G04.1.454.CMB.1.raw
  modified_base (252)..(253): a, c, t, g, unknown or other
  misc_feature (252)..(253): n is a, c, g, or t

SEQ ID NO: 79649 - DNA, 309 bp, Homo sapiens
  misc_feature: GYAE6OF02GXCIP.53.70.G04.1.454.CMB.1.raw
  modified_base (220)..(220): a, c, t, g, unknown or other
  misc_feature (220)..(220): n is a, c, g, or t
  modified_base (260)..(261): a, c, t, g, unknown or other
  misc_feature (260)..(261): n is a, c, g, or t
  modified_base (263)..(263): a, c, t, g, unknown or other
  misc_feature (263)..(263): n is a, c, g, or t
  modified_base (265)..(309): a, c, t, g, unknown or other
  misc_feature (265)..(309): n is a, c, g, or t
tcagcgcgtatacacacgaccggtgctcgatttagtgtagtgtgaagggaaagggacgaagtttcacgactgaacatcagccgggtggaggctgacgatgttggcatttattattgcatgcaagcagaaacttccgctcactttcggcggtggaccaggatcagatcaatcgactgtgctgcacatctgtcttcatcttacccgcatcctgatcctagtnccgctgaggtccgggcctggacgtacggcgctaagtacgnngntnnnnnnnnnnnnnnnnnnnnnnnnnnnnnnnnnnnnnnnnnnnnn

SEQ ID NO: 79650 - DNA, 177 bp, Homo sapiens
  misc_feature: GYAE6OF01BJRJM.30.89.I01.1.454.CMB.1.raw
  modified_base (174)..(177): a, c, t, g, unknown or other
  misc_feature (174)..(177): n is a, c, g, or t
tcagcacgctacgtcacgaccggtgctcgatttagtatgctagtatgggtcacagtgttgggtgttcggcggaggaccaagctgaccgtcctaggtcagcccaaggctgcccctcggtcactctgttcccgcctcctcacgtagcgtgctgagcgggctggcaaggcgcatagnnnn

SEQ ID NO: 79651 - DNA, 178 bp, Homo sapiens
  misc_feature: GYAE6OF01CYKZ7.30.89.I01.1.454.CMB.1.raw
  modified_base (177)..(178): a, c, t, g, unknown or other
  misc_feature (177)..(178): n is a, c, g, or t
tcagcacgctacgtcacgaccggtgctcgatttagtatgctagtatggggtcacagtgttgggtgttcggcggagggaccaagctgaccgtcctaggtcagcccaaggctgcccctcggtcactctgttcccaccctcctcacgtagcgtgctgagcgggctggcaaggcgcatagnn

SEQ ID NO: 79652 - DNA, 176 bp, Homo sapiens
  misc_feature: GYAE6OF01D4BXF.30.89.I01.1.454.CMB.1.raw
  modified_base (175)..(176): a, c, t, g, unknown or other
  misc_feature (175)..(176): n is a, c, g, or t
tcagcacgctacgtcacgaccggtgctcgatttagtatgctagtatgggtcacagtgttgggtgttcggcggagggaccaagctgaccgtcctaggtcagcccaaggctgcccctcggtcactctgttcccacctcctcacgtagcgtgctgagcgggctggcaaggcgcatagnn

SEQ ID NO: 79653 - DNA, 178 bp, Homo sapiens
  misc_feature: GYAE6OF01DNGRC.30.89.I01.1.454.CMB.1.raw
  modified_base (177)..(178): a, c, t, g, unknown or other
  misc_feature (177)..(178): n is a, c, g, or t
tcagcacgctacgtcacgaccggtgctcgatttagtatgctagtatggggtcactgtgttgggtgttcggcggagggaccaagctgaccgtcctaggtcagcccaaggctgcccctcggtcactctgttcccgccctcctcacgtagcgtgctgagcgggctggcaaggcgcatagnn

SEQ ID NO: 79654 - DNA, 200 bp, Homo sapiens
  misc_feature: GYAE6OF01BMMO7.30.89.I01.1.454.CMB.1.raw
  modified_base (178)..(200): a, c, t, g, unknown or other
  misc_feature (178)..(200): n is a, c, g, or t
tcagcacgctacgtcacgaccggtgctcgatttagtatgctagtatgggggtcgacagtgttgggtgttcggcggagggaccaagctgaccgtcctaggtcagcccaaggctgcccctcggtcactctgttcccacctcctcacgtagcgtgctgagcgggctggcaaggcgcatagnnnnnnnnnnnnnnnnnnnnnnn

SEQ ID NO: 79655 - DNA, 188 bp, Homo sapiens
  misc_feature: GYAE6OF01BCNK1.30.89.I01.1.454.CMB.1.raw
  modified_base (178)..(188): a, c, t, g, unknown or other
  misc_feature (178)..(188): n is a, c, g, or t
tcagcacgctacgtcacgaccggtgctcgatttagtatgctagtatggggtcacgagtgttgggtgttcggcggagggaccaagctgaccgtcctaggtcagcccaaggctgcccctcggtcactctgttcccaccctcctcacgtagcgtgctgagcgggctggcaaggcgcatagnnnnnnnnnnn

SEQ ID NO: 79656 - DNA, 178 bp, Homo sapiens; identical to SEQ ID NO: 79651
  misc_feature: GYAE6OF01DOQFQ.30.89.I01.1.454.CMB.1.raw
  modified_base (177)..(178): a, c, t, g, unknown or other
  misc_feature (177)..(178): n is a, c, g, or t

SEQ ID NO: 79657 - DNA, 177 bp, Homo sapiens
  misc_feature: GYAE6OF01DKWZ7.30.89.I01.1.454.CMB.1.raw
  modified_base (176)..(177): a, c, t, g, unknown or other
  misc_feature (176)..(177): n is a, c, g, or t
tcagcacgctacgtcacgaccggtgctcgatttagtatgctagtatggggtcacagtgttgggtgttcggcggagggaccaagctgaccgtcctagtcagcccaaggctgcccctcggtcactctgttcccaccctcctcacgtagcgtgctgagcgggctggcaaggcgcatagnn

SEQ ID NO: 79658 - DNA, 187 bp, Homo sapiens
  misc_feature: GYAE6OF01AI8GC.30.89.I01.1.454.CMB.1.raw
  modified_base (178)..(187): a, c, t, g, unknown or other
  misc_feature (178)..(187): n is a, c, g, or t
tcagcacgctacgtcacgaccggtgctcgatttagtatgctagtatggggtcaccagtgttgggtgttcggcggagggaccaagctgaccgtcctaggtcagcccaaggctgcccctcggtcactctgttcccaccctcctcacgtagcgtgctgagcgggctggcaaggcgcatagnnnnnnnnnn

SEQ ID NO: 79659 - DNA, 178 bp, Homo sapiens
  misc_feature: GYAE6OF01BEJ3Z.30.89.I01.1.454.CMB.1.raw
tcagcacgctacgtcacgaccggtgctcgatttagtatgctagtatgggggtcacagtgttgggtgttcggcggagggaccaagctgaccgtcctaggtcagcccaaggctgccccctcggtcactctgttcccgccctcctcacgtagcgtgctgagcgggctggcaaggcgcatag

SEQ ID NO: 79660 - DNA, 196 bp, Homo sapiens
  misc_feature: GYAE6OF01EM0W6.30.89.I01.1.454.CMB.1.raw
  modified_base (178)..(196): a, c, t, g, unknown or other
  misc_feature (178)..(196): n is a, c, g, or t
tcagcacgctacgtcacgaccggtgctcgatttagtatgctagtatgggggtcacagtgttgggtgttcggcggagggaccaagctgaccgtcctaggtcagcccaaggctgcccctcggtcactctgttcccgccctcctcacgtagcgtgctgagcgggctggcaaggcgcatagnnnnnnnnnnnnnnnnnnn

SEQ ID NO: 79661 - DNA, 178 bp, Homo sapiens; identical to SEQ ID NO: 79651
  misc_feature: GYAE6OF01BQ7DN.30.89.I01.1.454.CMB.1.raw
  modified_base (177)..(178): a, c, t, g, unknown or other
  misc_feature (177)..(178): n is a, c, g, or t

SEQ ID NO: 79662 - DNA, 181 bp, Homo sapiens
  misc_feature: GYAE6OF01EPNMX.30.89.I01.1.454.CMB.1.raw
  modified_base (179)..(181): a, c, t, g, unknown or other
  misc_feature (179)..(181): n is a, c, g, or t
tcagcacgctacgtcacgaccggtgctcgatttagtatgctagtatgggggtcacagtgttgggtgttcggcggagggaccaagctgaccgtcctaggtcagcccaaggctgccccctcggtcactctgttcccaccctcctcacgtagcgtgctgagcgggctggcaaggcgcatagnnn

SEQ ID NO: 79663 - DNA, 177 bp, Homo sapiens
  misc_feature: GYAE6OF01A12CS.30.89.I01.1.454.CMB.1.raw
  modified_base (175)..(177): a, c, t, g, unknown or other
  misc_feature (175)..(177): n is a, c, g, or t
tcagcacgctacgtcacgaccggtgctcgatttagtatgctagtatgggtcacagtgttgggtgttcggcggagggaccaagctgaccgtcctaggtcagcccaaggctgcccctcggtcactctgttcccacctcctcacgtagcgtgctgagcgggctggcaaggcgcatagnnn

SEQ ID NO: 79664 - DNA, 178 bp, Homo sapiens
  misc_feature: GYAE6OF01AFVFL.30.89.I01.1.454.CMB.1.raw
  modified_base (177)..(178): a, c, t, g, unknown or other
  misc_feature (177)..(178): n is a, c, g, or t
tcagcacgctacgtcacgaccggtgctcgatttagtatgctagtatggggtcacagtgttgggtgttcggcggagggaccaagctgaccgtcctaggtcagcccaaggctgcccctcggtcactctgttcccgccctcctcacgtagcgtgctgagcgggctggcaaggcgcatagnn

SEQ ID NO: 79665 - DNA, 179 bp, Homo sapiens
  misc_feature: GYAE6OF01C8QNE.30.89.I01.1.454.CMB.1.raw
  modified_base (177)..(179): a, c, t, g, unknown or other
  misc_feature (177)..(179): n is a, c, g, or t
tcagcacgctacgtcacgaccggtgctcgatttagtatgctagtatggggtcacagtgttgggtgttcggcggagggaccaagctgaccgtcctaggtcagcccaaggctgcccctcggtcactctgttcccaccctcctcacgtagcgtgctgagcgggctggcaaggcgcatagnnn

SEQ ID NO: 79666 - DNA, 179 bp, Homo sapiens
  misc_feature: GYAE6OF01E146V.30.89.I01.1.454.CMB.1.raw
  modified_base (178)..(179): a, c, t, g, unknown or other
  misc_feature (178)..(179): n is a, c, g, or t
tcagcacgctacgtcacgaccggtgctcgatttagtatgctagtatggggtcacagtgttgggtgttcggcggagggaccaagctgaccgtcctaggtcagcccaaggctgccccctcggtcactctgttcccaccctcctcacgtagcgtgctgagcgggctggcaaggcgcatagnn

SEQ ID NO: 79667 - DNA, 179 bp, Homo sapiens
  misc_feature: GYAE6OF01EZSMD.30.89.I01.1.454.CMB.1.raw
  modified_base (179)..(179): a, c, t, g, unknown or other
  misc_feature (179)..(179): n is a, c, g, or t
tcagcacgctacgtcacgaccggtgctcgatttagtatgctagtatgggggtcacagtgttgggtgttcggcggagggaccaagctgaccgtcctaggtcagcccaaggctgccccctcggtcactctgttcccaccctcctcacgtagcgtgctgagcgggctggcaaggcgcatagn

SEQ ID NO: 79668 - DNA, 180 bp, Homo sapiens
  misc_feature: GYAE6OF01BRC05.30.89.I01.1.454.CMB.1.raw
  modified_base (179)..(180): a, c, t, g, unknown or other
  misc_feature (179)..(180): n is a, c, g, or t
tcagcacgctacgtcacgaccggtgctcgatttagtatgctagtatgggggtcacagtgttgggtgttcggcggagggaccaagctgaccgtcctaggtcagcccaaggctgccccctcggtcactctgttcccaccctcctcacgtagcgtgctgagcgggctggcaaggcgcatagnn

SEQ ID NO: 79669 - DNA, 181 bp, Homo sapiens; identical to SEQ ID NO: 79662
  misc_feature: GYAE6OF01C827P.30.89.I01.1.454.CMB.1.raw
  modified_base (179)..(181): a, c, t, g, unknown or other
  misc_feature (179)..(181): n is a, c, g, or t

SEQ ID NO: 79670 - DNA, 192 bp, Homo sapiens
  misc_feature: GYAE6OF01ATWU1.30.89.I01.1.454.CMB.1.raw
  modified_base (179)..(192): a, c, t, g, unknown or other
  misc_feature (179)..(192): n is a, c, g, or t
tcagcacgctacgtcacgaccggtgctcgatttagtatgctagtagtggggtcacagtgttgggtgttcggcggagggaccaagctgaccgtcctaggtcagcccaaggctgccccctcggtcactctgttcccaccctcctcacgtagcgtgctgagcgggctggcaaggcgcatagnnnnnnnnnnnnnn

SEQ ID NO: 79671 - DNA, 212 bp, Homo sapiens
  misc_feature: GYAE6OF01ASF0Z.30.89.I01.1.454.CMB.1.raw
  modified_base (143)..(143): a, c, t, g, unknown or other
  misc_feature (143)..(143): n is a, c, g, or t
  modified_base (179)..(212): a, c, t, g, unknown or other
  misc_feature (179)..(212): n is a, c, g, or t
tcagcacgctacgtcacgaccggtgctcgatttagtatgctagtatggggggtcacagtgttgggtgttcggcggagggaccaagctgaccgtcctaggtcagcccaaggctgccccctcggtcactctgttcccacctcctnacgtagcgtgctgagcgggctggcaaggcgcatagnnnnnnnnnnnnnnnnnnnnnnnnnnnnnnnnnn

SEQ ID NO: 79672 - DNA, 180 bp, Homo sapiens; identical to SEQ ID NO: 79668
  misc_feature: GYAE6OF01E10M0.30.89.I01.1.454.CMB.1.raw
  modified_base (179)..(180): a, c, t, g, unknown or other
  misc_feature (179)..(180): n is a, c, g, or t

SEQ ID NO: 79673 - DNA, 178 bp, Homo sapiens
  misc_feature: GYAE6OF01B6E4O.30.89.I01.1.454.CMB.1.raw
  modified_base (176)..(178): a, c, t, g, unknown or other
  misc_feature (176)..(178): n is a, c, g, or t
tcagcacgctacgtcacgaccggtgctcgatttagtatgctagtatggggtcacagtgttgggtgttcggcggagggaccaagctgaccgtcctaggtcagcccaaggctgcccctggtcactctgttcccaccctcctcacgtagcgtgctgagcgggctggcaaggcgcatagnnn

SEQ ID NO: 79674 - DNA, 180 bp, Homo sapiens
  misc_feature: GYAE6OF01AI6TF.30.89.I01.1.454.CMB.1.raw
  modified_base (179)..(180): a, c, t, g, unknown or other
  misc_feature (179)..(180): n is a, c, g, or t
tcagcacgctacgtcacgaccggtgctcgatttagtatgctagtatgggggtcacagtgttgggtgttcggcggagggaccaagctgaccgtcctaggtcagcccaaggctgccccctcggtcactctgttcccgccctcctcacgtagcgtgctgagcgggctggcaaggcgcatagnn

SEQ ID NO: 79675 - DNA, 181 bp, Homo sapiens
  misc_feature: GYAE6OF01BWF99.30.89.I01.1.454.CMB.1.raw
  modified_base (179)..(181): a, c, t, g, unknown or other
  misc_feature (179)..(181): n is a, c, g, or t
tcagcacgctacgtcacgaccggtgctcgatttagtatgctagtatgggggtcacagtgttgggtgttcggcggagggaccaagctgaccgtcctaggtcagcccaaggctgccccctcggtcactctgttcccgccctcctcacgtagcgtgctgagcgggctggcaaggcgcatagnnn

SEQ ID NO: 79676 - DNA, 232 bp, Homo sapiens
  misc_feature: GYAE6OF01DDHT3.30.89.I01.1.454.CMB.1.raw
  modified_base (194)..(232): a, c, t, g, unknown or other
  misc_feature (194)..(232): n is a, c, g, or t
tcagcacgctacgtcacgaccggtgctcgatttagtatgctagtatgggggttcggacagtggttggggtgttcggcggagggaccaagcgtgaccgtcctaggtccagcccaaggctgccccctggtcactctcgttcccgccctcctcaccgtagcggtgctggagcggggcctgggcaagggccgcatagnnnnnnnnnnnnnnnnnnnnnnnnnnnnnnnnnnnnnnn

SEQ ID NO: 79677 - DNA, 172 bp, Homo sapiens
  misc_feature: GYAE6OF01D27UK.30.89.I01.1.454.CMB.1.raw
  modified_base (171)..(172): a, c, t, g, unknown or other
  misc_feature (171)..(172): n is a, c, g, or t
tcagcacgctacgtcacgaccggtgctcgatttagtatgctagtatcgcgggggggtgttcggcggagggaccaaactgaccgtcctaggtcagcccaaggctgccccctcggtcactctgttcccaccctcctcacgtagcgtgctgagcgggctggcaaggcgcatagnn

SEQ ID NO: 79678 - DNA, 191 bp, Homo sapiens
  misc_feature: GYAE6OF01DNI72.30.89.I01.1.454.CMB.1.raw
  modified_base (178)..(191): a, c, t, g, unknown or other
  misc_feature (178)..(191): n is a, c, g, or t
tcagcacgctacgtcacgaccggtgctcgatttagtatgctagtatgggggtcacagtgttgggtgttcggcggaggaccaagctgaccgtcctaggtcagcccaaggctgccccctggtcactctgttcccaccctcctcacgtagcgtgctgagcgggctggcaaggcgacatagnnnnnnnnnnnnnn

SEQ ID NO: 79679 - DNA, 202 bp, Homo sapiens
  misc_feature: GYAE6OF01EOPUY.30.89.I01.1.454.CMB.1.raw
  modified_base (177)..(202): a, c, t, g, unknown or other
  misc_feature (177)..(202): n is a, c, g, or t
tcagcacgctacgtcacgaccggtgctcgatttagtatgctagtatgggggtcacagtgttgggtgttcggcggagggaccaagctgaccgtcctaggtcagcccaaggctgccccctggtcactctgttcccacctcctcacgtagcgtgctgagcgggctggcaaggcgcatagnnnnnnnnnnnnnnnnnnnnnnnnnn

SEQ ID NO: 79680 - DNA, 191 bp, Homo sapiens
  misc_feature: GYAE6OF01BHXZC.30.89.I01.1.454.CMB.1.raw
  modified_base (175)..(191): a, c, t, g, unknown or other
  misc_feature (175)..(191): n is a, c, g, or t
tcagcacgctacgtcacgaccggtgctcgatttagtatgctagtatgggggtcacagtgttgggtgttcggcggagggaccaagctgaccgtcctaggtcagcccaaggctgcccctggtcactctgttcccacctcctcacgtagcgtgctgagcggctggcaaggcgcatagnnnnnnnnnnnnnnnnn

SEQ ID NO: 79681 - DNA, 184 bp, Homo sapiens
  misc_feature: GYAE6OF01CD0TE.30.89.I01.1.454.CMB.1.raw
  modified_base (176)..(184): a, c, t, g, unknown or other
  misc_feature (176)..(184): n is a, c, g, or t
tcagcacgctacgtcacgaccggtgctcgatttagtatgctagtatgggggtcacagtgttgggtgttcggcggagggaccaagctgaccgtcctaggtcagcccaaggctgccccctggtcactctgttcccgcctctcacgtagcgtgctgagcgggctggcaaggcgcatagnnnnnnnnn

SEQ ID NO: 79682 - DNA, 179 bp, Homo sapiens; identical to SEQ ID NO: 79667
  misc_feature: GYAE6OF01CBQXO.30.89.I01.1.454.CMB.1.raw
  modified_base (179)..(179): a, c, t, g, unknown or other
  misc_feature (179)..(179): n is a, c, g, or t

SEQ ID NO: 79683 - DNA, 179 bp, Homo sapiens
  misc_feature: GYAE6OF01E2OSW.30.89.I01.1.454.CMB.1.raw
  modified_base (179)..(179): a, c, t, g, unknown or other
  misc_feature (179)..(179): n is a, c, g, or t
tcagcacgctacgtcacgaccggtgctcgatttagtatgctagtatgggggtcacagtgttgggtgttcggcggagggaccaagctgaccgtcctaggtcagcccaaggcctgccccctggtcactctgttcccaccctcctcacgtagcgtgctgagcgggctggcaaggcgcatagn

SEQ ID NO: 79684 - DNA, 187 bp, Homo sapiens
  misc_feature: GYAE6OF01AL3OE.30.89.I01.1.454.CMB.1.raw
  modified_base (179)..(187): a, c, t, g, unknown or other
  misc_feature (179)..(187): n is a, c, g, or t
tcagcacgctacgtcacgaccggtgctcgatttagtatgctagtatgggggtcacagtgttgggtgttcggcggagggaccaagctgaccgtcctaggtcagcccaaggctgccccctcggtcactctgttcccaccctcctcacgtagcgtgctgagcgggctggcaaggcgcatagnnnnnnnnn

SEQ ID NO: 79685 - DNA, 182 bp, Homo sapiens
  misc_feature: GYAE6OF01EFRUO.30.89.I01.1.454.CMB.1.raw
  modified_base (141)..(141): a, c, t, g, unknown or other
  misc_feature (141)..(141): n is a, c, g, or t
  modified_base (170)..(170): a, c, t, g, unknown or other
  misc_feature (170)..(170): n is a, c, g, or t
  modified_base (175)..(182): a, c, t, g, unknown or other
  misc_feature (175)..(182): n is a, c, g, or t
tcagcacgctacgtcacgaccggtgctcgatttagtatgctagtatgggggtcacagtgttgggtgttcggcggaggaccaagctgaccgtcctaggtcagcccaaggctcgccccctggtcactctcgtcccacctcctnacgtagcgtgctgagcggctggcaaggcncatgnnnnnnnn

SEQ ID NO: 79686 - DNA, 182 bp, Homo sapiens
  misc_feature: GYAE6OF01EDH1M.30.89.I01.1.454.CMB.1.raw
  modified_base (157)..(157): a, c, t, g, unknown or other
  misc_feature (157)..(157): n is a, c, g, or t
  modified_base (173)..(173): a, c, t, g, unknown or other
  misc_feature (173)..(173): n is a, c, g, or t
  modified_base (178)..(182): a, c, t, g, unknown or other
  misc_feature (178)..(182): n is a, c, g, or t
tcagcacgctacgtcacgaccggtgctcgatttagtatgctagtatgggggtcacagtgttgggtgttcggcggaggaccaagctgaccgtcctaggtcagcccaaggctcgccccctggtcactcgtcgttcccgccctctcaagtagcgtgctgngcgggctggcaaggcncatgnnnnn

SEQ ID NO: 79687 - DNA, 230 bp, Homo sapiens
  misc_feature: GYAE6OF01ETPXI.30.89.I01.1.454.CMB.1.raw
  modified_base (59)..(59): a, c, t, g, unknown or other
  misc_feature (59)..(59): n is a, c, g, or t
  modified_base (178)..(230): a, c, t, g, unknown or other
  misc_feature (178)..(230): n is a, c, g, or t
tcagcacgctacgtcacgaccggtgctcgatttagtatgctagtatcgcggggggggtnttcggcggagggaccaaactgaccgtcctaggtcagcccaaggctcgccccctggtcactctcgttcccgccctcctcacgtagcgtgactgacggcgggctggacaaggcgcagtagnnnnnnnnnnnnnnnnnnnnnnnnnnnnnnnnnnnnnnnnnnnnnnnnnnnnn

SEQ ID NO: 79688 - DNA, 178 bp, Homo sapiens; identical to SEQ ID NO: 79651
  misc_feature: GYAE6OF02FFGHA.30.89.I01.1.454.CMB.1.raw
  modified_base (177)..(178): a, c, t, g, unknown or other
  misc_feature (177)..(178): n is a, c, g, or t

SEQ ID NO: 79689 - DNA, 178 bp, Homo sapiens
  misc_feature: GYAE6OF02G807G.30.89.I01.1.454.CMB.1.raw
  modified_base (174)..(178): a, c, t, g, unknown or other
  misc_feature (174)..(178): n is a, c, g, or t
tcagcacgctacgtcacgaccggtgctcgatttagtatgctagtatgggtcacagtgttgggtgttcggcggagggaccaagctgaccgtcctaggtcagcccaaggctgcccctcggtcactctgttcccacctcctcacgagcgtgctgagcgggctggcaaggcgcatagnnnnn

SEQ ID NO: 79690 - DNA, 178 bp, Homo sapiens; identical to SEQ ID NO: 79651
  misc_feature: GYAE6OF02ISKGZ.30.89.I01.1.454.CMB.1.raw
  modified_base (177)..(178): a, c, t, g, unknown or other
  misc_feature (177)..(178): n is a, c, g, or t

SEQ ID NO: 79691 - DNA, 178 bp, Homo sapiens
  misc_feature: GYAE6OF02H01GZ.30.89.I01.1.454.CMB.1.raw
  modified_base (176)..(178): a, c, t, g, unknown or other
  misc_feature (176)..(178): n is a, c, g, or t
tcagcacgctacgtcacgaccggtgctcgatttagtatgctagtatggggtcacagtgttgggtgttcggcggagggaccaagctgaccgtcctaggtcagcccaaggctgcccctcggtcactctgttcccgcctcctcacgtagcgtgctgagcgggctggcaaggcgcatagnnn

SEQ ID NO: 79692 - DNA, 186 bp, Homo sapiens
  misc_feature: GYAE6OF02HZ323.30.89.I01.1.454.CMB.1.raw
  modified_base (177)..(186): a, c, t, g, unknown or other
  misc_feature (177)..(186): n is a, c, g, or t
tcagcacgctacgtcacgaccggtgctcgatttagtatgctagtatggggtcacagtgttgggtgttcggcggagggaccaagctgaccgtcctaggtcagcccaaggctgcccctcggtcactctgttcccaccctcctcacgtagcgtgctgagcgggctggcaaggcgcatagnnnnnnnnnn

SEQ ID NO: 79693 - DNA, 190 bp, Homo sapiens
  misc_feature: GYAE6OF02IFDGS.30.89.I01.1.454.CMB.1.raw
  modified_base (178)..(190): a, c, t, g, unknown or other
  misc_feature (178)..(190): n is a, c, g, or t
tcagcacgctacgtcacgaccggtgctcgatttagtatgctagtatgggggtcgacagtgttgggtgttcggcggagggaccaagctgaccgtcctaggtcagcccaaggctgcccctcggtcactctgttcccacctcctcacgtagcgtgctgagcgggctggcaaggcgcatagnnnnnnnnnnnnn

SEQ ID NO: 79694 - DNA, 179 bp, Homo sapiens
  misc_feature: GYAE6OF02G8X3N.30.89.I01.1.454.CMB.1.raw
  modified_base (177)..(179): a, c, t, g, unknown or other
  misc_feature (177)..(179): n is a, c, g, or t
tcagcacgctacgtcacgaccggtgctcgatttagtatgctagtatgggggtcacagtgttgggtgttcggcggagggaccaagctgaccgtcctaggtcagcccaaggctgcccctcggtcactctgttcccacctcctcacgtagcgtgctgagcgggctggcaaggcgcatagnnn

SEQ ID NO: 79695 - DNA, 180 bp, Homo sapiens
  misc_feature: GYAE6OF02IEQ9I.30.89.I01.1.454.CMB.1.raw
  modified_base (177)..(180): a, c, t, g, unknown or other
  misc_feature (177)..(180): n is a, c, g, or t
tcagcacgctacgtcacgaccggtgctcgatttagtatgctagtatggggtcacagtgttgggtgttcggcggagggaccaagctgaccgtcctaggtcagcccaaggctgcccctcggtcactctgttcccaccctcctcacgtagcgtgctgagcgggctggcaaggcgcatagnnnn

SEQ ID NO: 79696 - DNA, 178 bp, Homo sapiens; identical to SEQ ID NO: 79651
  misc_feature: GYAE6OF02H43MY.30.89.I01.1.454.CMB.1.raw
  modified_base (177)..(178): a, c, t, g, unknown or other
  misc_feature (177)..(178): n is a, c, g, or t

SEQ ID NO: 79697 - DNA, 180 bp, Homo sapiens; identical to SEQ ID NO: 79668
  misc_feature: GYAE6OF02HU546.30.89.I01.1.454.CMB.1.raw
  modified_base (179)..(180): a, c, t, g, unknown or other
  misc_feature (179)..(180): n is a, c, g, or t

SEQ ID NO: 79698 - DNA, 180 bp, Homo sapiens
  misc_feature: GYAE6OF02H6HS9.30.89.I01.1.454.CMB.1.raw
  modified_base (178)..(180): a, c, t, g, unknown or other
  misc_feature (178)..(180): n is a, c, g, or t
tcagcacgctacgtcacgaccggtgctcgatttagtatgctagtatgggggtcacagtgttgggtgttcggcggagggaccaagctgaccgtcctaggtcagcccaaggctgcccctcggtcactctgttcccgccctcctcacgtagcgtgctgagcgggctggcaaggcgcatagnnn

SEQ ID NO: 79699 - DNA, 191 bp, Homo sapiens
  misc_feature: GYAE6OF02JDF5R.30.89.I01.1.454.CMB.1.raw
  modified_base (181)..(191): a, c, t, g, unknown or other
  misc_feature (181)..(191): n is a, c, g, or t
tcagcacgctacgtcacgaccggtgctcgatttagtatgctagtatgggggtcacagtggttgggtgttcggcggagggaccaagctgaccgtcctaggtcagcccaaaggctgccccctcggtcactctgttcccgccctcctcacgtagcgtgctgagcgggctggcaaggcgcatagnnnnnnnnnnn

SEQ ID NO: 79700 - DNA, 179 bp, Homo sapiens
  misc_feature: GYAE6OF02HBLRF.30.89.I01.1.454.CMB.1.raw
  modified_base (178)..(179): a, c, t, g, unknown or other
  misc_feature (178)..(179): n is a, c, g, or t
tcagcacgctacgtcacgaccggtgctcgatttagtatgctagtatgggggtcacagtgttgggtgttcggcggagggaccaagctgaccgtcctaggtcagcccaaggctgcccctcggtcactctgttcccaccctcctcacgtagcgtgctgagcgggctggcaaggcgcatagnn

SEQ ID NO: 79701 - DNA, 178 bp, Homo sapiens
  misc_feature: GYAE6OF02HV8Q5.30.89.I01.1.454.CMB.1.raw
  modified_base (178)..(178): a, c, t, g, unknown or other
  misc_feature (178)..(178): n is a, c, g, or t
tcagcacgctacgtcacgaccggtgctcgatttagtatgctagtatggggtcacagtgttgggtgttcggcggagggaccaagctgaccgtcctaggtcagcccaaggctgccccctcggtcactctgttcccaccctcctcacgtagcgtgctgagcgggctggcaaggcgcatagn

SEQ ID NO: 79702 - DNA, 211 bp, Homo sapiens
  misc_feature: GYAE6OF02IT7KA.30.89.I01.1.454.CMB.1.raw
  modified_base (179)..(211): a, c, t, g, unknown or other
  misc_feature (179)..(211): n is a, c, g, or t
tcagcacgctacgtcacgaccggtgctcgatttagtatgctagtagtgggggtctacagtgttgggtgttcggcggagggaccaagctgaccgtcctaggtcagcccaaggctgcccctcggtcactcgttcccacctcctcacgtagcgtgctgagcgggctggcaaggcgcataggnnnnnnnnnnnnnnnnnnnnnnnnnnnnnnnnn

SEQ ID NO: 79703 - DNA, 178 bp, Homo sapiens
  misc_feature: GYAE6OF02HXF5V.30.89.I01.1.454.CMB.1.raw
  modified_base (178)..(178): a, c, t, g, unknown or other
  misc_feature (178)..(178): n is a, c, g, or t
tcagcacgctacgtcacgaccggtgctcgatttagtatgctagtatgggggtcacagtgttgggtgttcggcggagggaccaagctgaccgtcctaggtcagcccaaggctgccccctcggtcactctgttcccgcctcctcacgtagcgtgctgagcgggctggcaaggcgcatagn

SEQ ID NO: 79704 - DNA, 173 bp, Homo sapiens
  misc_feature: GYAE6OF02IXRGI.30.89.I01.1.454.CMB.1.raw
  modified_base (170)..(173): a, c, t, g, unknown or other
  misc_feature (170)..(173): n is a, c, g, or t
tcagcacgctacgtcacgaccggtgctcgatttagtatgctagtatcgcggggggtgttcggcggagggaccaaactgaccgtcctaggtcagcccaaggctgccccctcggtcactctgttcccaccctcctcacgtagcgtgctgagcgggctggcaaggcgcatagnnnn

SEQ ID NO: 79705 - DNA, 182 bp, Homo sapiens
  misc_feature: GYAE6OF02GPG4L.30.89.I01.1.454.CMB.1.raw
  modified_base (179)..(182): a, c, t, g, unknown or other
  misc_feature (179)..(182): n is a, c, g, or t
tcagcacgctacgtcacgaccggtgctcgatttagtatgctagtatgggggtcacagtgttgggtgttcggcggagggaccaagctgaccgtcctaggtcagcccaaggctgccccctcggtcactctgttcccaccctcctcacgtagcgtgctgagcgggctggcaaggcgcatagnnnn

SEQ ID NO: 79706 - DNA, 234 bp, Homo sapiens
  misc_feature: GYAE6OF02H5XQ8.30.89.I01.1.454.CMB.1.raw
  modified_base (183)..(234): a, c, t, g, unknown or other
  misc_feature (183)..(234): n is a, c, g, or t
tcagcacgctacgtcacgaccggtgctcgatttagtatgctagtatagggggtcacagtgttgggtgttcggcggagggaccaagctgaccgtcctaggtcagcccaaggctgcccctcggtcactctggttcccaccctcctcacgttagcgtgctgagacgggctggcaaggcgcaatagnnnnnnnnnnnnnnnnnnnnnnnnnnnnnnnnnnnnnnnnnnnnnnnnnnnn

SEQ ID NO: 79707 - DNA, 178 bp, Homo sapiens
  misc_feature: GYAE6OF02GYV8Z.30.89.I01.1.454.CMB.1.raw
tcagcacgctacgtcacgaccggtgctcgatttagtatgctagtatgggggtcacagtgttgggtgttcggcggagggaccaagctgaccgtcctaggtcagcccaaggctgccccctcggtcactctgttcccaccctcctcacgtagcgtgctgagcgggctggcaaggcgcatag

SEQ ID NO: 79708 - DNA, 194 bp, Homo sapiens
  misc_feature: GYAE6OF02GCHAF.30.89.I01.1.454.CMB.1.raw
  modified_base (179)..(194): a, c, t, g, unknown or other
  misc_feature (179)..(194): n is a, c, g, or t
tcagcacgctacgtcacgaccggtgctcgatttagtatgctagtatgggggtcacagtgttgggtgttcggcggagggaccaagctgaccgtcctaggtcagcccaaggctgccccctcggtcactctgttcccaccctcctcacgtagcgtgctgagcgggctggcaaggcgcatagnnnnnnnnnnnnnnnn

SEQ ID NO: 79709 - DNA, 179 bp, Homo sapiens; identical to SEQ ID NO: 79667
  misc_feature: GYAE6OF02I4TT5.30.89.I01.1.454.CMB.1.raw
  modified_base (179)..(179): a, c, t, g, unknown or other
  misc_feature (179)..(179): n is a, c, g, or t

SEQ ID NO: 79710 - DNA, 213 bp, Homo sapiens
  misc_feature: GYAE6OF02F9T5L.30.89.I01.1.454.CMB.1.raw
  modified_base (67)..(67): a, c, t, g, unknown or other
  misc_feature (67)..(67): n is a, c, g, or t
  modified_base (175)..(175): a, c, t, g, unknown or other
  misc_feature (175)..(175): n is a, c, g, or t
  modified_base (181)..(213): a, c, t, g, unknown or other
  misc_feature (181)..(213): n is a, c, g, or t
tcagcacgctacgtcacgaccggtgctcgatttagtatgctagtatgggggtcgacagtgttgggtnttcggcggagggaccaagcctgaccgtcctaggtcagcccaaggctgccccctcggtcactctgttcccaccttcctcacgtagcgtgctgagcgggctggcaaggcncatagnnnnnnnnnnnnnnnnnnnnnnnnnnnnnnnnn

SEQ ID NO: 79711 - DNA, 181 bp, Homo sapiens
  misc_feature: GYAE6OF02JCIT1.30.89.I01.1.454.CMB.1.raw
  modified_base (177)..(181): a, c, t, g, unknown or other
  misc_feature (177)..(181): n is a, c, g, or t
tcagcacgctacgtcacgaccggtgctcgatttagtatgctagtatgggggtcacagtgttgggtgttcggcggagggaccaagctgaccgtcctaggtcagcccaaggctgcccctcggtcactctgttcccacctcctcacgtagcgtgctgagcgggctggcaaggcgcatagnnnnn

SEQ ID NO: 79712 - DNA, 179 bp, Homo sapiens
  misc_feature: GYAE6OF02HZZNS.30.89.I01.1.454.CMB.1.raw
  modified_base (178)..(179): a, c, t, g, unknown or other
  misc_feature (178)..(179): n is a, c, g, or t
tcagcacgctacgtcacgaccggtgctcgatttagtatgctagtatgggggtcacagtgttgggtgttcggcggagggaccaagctgaccgtcctaggtcagcccaaggctgccccctggtcactctgttcccgccctcctcacgtagcgtgctgagcgggctggcaaggcgcatagnn

SEQ ID NO: 79713 - DNA, 181 bp, Homo sapiens; identical to SEQ ID NO: 79675
  misc_feature: GYAE6OF02GZ7JZ.30.89.I01.1.454.CMB.1.raw
  modified_base (179)..(181): a, c, t, g, unknown or other
  misc_feature (179)..(181): n is a, c, g, or t

SEQ ID NO: 79714 - DNA, 192 bp, Homo sapiens
  misc_feature: GYAE6OF02FNQE9.30.89.I01.1.454.CMB.1.raw
  modified_base (179)..(192): a, c, t, g, unknown or other
  misc_feature (179)..(192): n is a, c, g, or t
tcagcacgctacgtcacgaccggtgctcgatttagtatgctagtatgggggtcacagtgttgggtgttcggcggagggaccaagctgaccgtcctaggtcagcccaaggctgccccctcggtcactctgttcccaccctcctcacgtagcgtgctgagcgggctggcaaggcgcatagnnnnnnnnnnnnnn

SEQ ID NO: 79715 - DNA, 197 bp, Homo sapiens
  misc_feature: GYAE6OF02I8SKO.30.89.I01.1.454.CMB.1.raw
  modified_base (173)..(197): a, c, t, g, unknown or other
  misc_feature (173)..(197): n is a, c, g, or t
tcagcacgctacgtcacgaccggtgctcgatttagtatgctagtatcggcgggggggtgttcggcggagggaccaaactgaccgtcctaggtaagcccgaaaggctgccccctggtcactctgttcccaccctctcaccgtagcgtgctgagcgggctggcaaggcgcatagnnnnnnnnnnnnnnnnnnnnnnnnn

SEQ ID NO: 79716 - DNA, 181 bp, Homo sapiens; identical to SEQ ID NO: 79662
  misc_feature: GYAE6OF02FIWYF.30.89.I01.1.454.CMB.1.raw
  modified_base (179)..(181): a, c, t, g, unknown or other
  misc_feature (179)..(181): n is a, c, g, or t

SEQ ID NO: 79717 - DNA, 182 bp, Homo sapiens
  misc_feature: GYAE6OF02GA8BM.30.89.I01.1.454.CMB.1.raw
  modified_base (177)..(182): a, c, t, g, unknown or other
  misc_feature (177)..(182): n is a, c, g, or t
tcagcacgctacgtcacgaccggtgctcgatttagtatgctagtatgggggtcacagtgttgggtgttcggcggagggaccaagctgaccgtcctaggtcagcccaaggctgccccctggtcactctgttcccacctcctcacgtagcgtgctgagcgggctggcaaggcgcatagnnnnnn

SEQ ID NO: 79718 - DNA, 184 bp, Homo sapiens
  misc_feature: GYAE6OF02HO15F.30.89.I01.1.454.CMB.1.raw
  modified_base (179)..(184): a, c, t, g, unknown or other
  misc_feature (179)..(184): n is a, c, g, or t
tcagcacgctacgtcacgaccggtgctcgatttagtatgctagtatgggggtcacagtgttgggtgttcggcggagggaccaagctgaccgtcctaggtcagcccaaggctgccccctcggtcactctgttcccgccctcctcacgtagcgtgctgagcgggctggcaaggcgcatagnnnnnn

SEQ ID NO: 79719 - DNA, 179 bp, Homo sapiens
  misc_feature: GYAE6OF02F02GC.30.89.I01.1.454.CMB.1.raw
  modified_base (179)..(179): a, c, t, g, unknown or other
  misc_feature (179)..(179): n is a, c, g, or t
tcagcacgctacgtcacgaccggtgctcgatttagtatgctagtatgggggtcacagtgttgggtgttcggcggagggaccaagctgaccgtcctaggtcagcccaaggctgtcccctcggtcactctgttcccaccctcctcacgtagcgtgctgagcgggctggcaaggcgcatagn

SEQ ID NO: 79720 - DNA, 185 bp, Homo sapiens
  misc_feature: GYAE6OF02JEXWR.30.89.I01.1.454.CMB.1.raw
  modified_base (139)..(139): a, c, t, g, unknown or other
  misc_feature (139)..(139): n is a, c, g, or t
  modified_base (177)..(185): a, c, t, g, unknown or other
  misc_feature (177)..(185): n is a, c, g, or t
tcagcacgctacgtcacgaccggtgctcgatttagtatgctagtatggggtcacagtgttggtgttcggcggaggaccaagctgaccgtcctaggtcagcccaaggctgccccctggtcactctgttcccaccctcctnacgtagcgtgctggaggcgggctggcaaggcgcatagnnnnnnnnn

SEQ ID NO: 79721 - DNA, 192 bp, Homo sapiens
  misc_feature: GYAE6OF02FRVC8.30.89.I01.1.454.CMB.1.raw
  modified_base (177)..(192): a, c, t, g, unknown or other
  misc_feature (177)..(192): n is a, c, g, or t
tcagcacgctacgtcacgaccggtgctcgatttagtatgctagtatgggggtcacagtgttgggtgttcggcggagggaccaagctgaccgtcctaggtcagcccaaggctgccccctggtcactctgttcccacctcctcacgtagcgtgctgagcgggctggcaaggcgcatagnnnnnnnnnnnnnnnn

SEQ ID NO: 79722 - DNA, 170 bp, Homo sapiens
  misc_feature: GYAE6OF01ENPMH.37.43.D10.1.454.CMB.1.raw
  modified_base (170)..(170): a, c, t, g, unknown or other
  misc_feature (170)..(170): n is a, c, g, or t
tcagtagtgtagatcacgaccggtgctcgatttagactagcagtaagggcccatcggtcttcccctggcgccctgctccaggagcacctccgagagcacagcggccctgggctgcctggtcaaggactacttccatctacactactgagcgggctggcaaggcgcatagn

SEQ ID NO: 79723 - DNA, 171 bp, Homo sapiens
  misc_feature: GYAE6OF02GUWSW.37.43.D10.1.454.CMB.1.raw
  modified_base (170)..(171): a, c, t, g, unknown or other
  misc_feature (170)..(171): n is a, c, g, or t
tcagtagtgtagatcacgaccggtgctcgatttagactagcagtaagggcccatcggtcttcccctggcgccctgctccaggagcacctccgagagcacagcggccctgggctgcctggtcaaggactacttccatctacactactgagcgggctggcaaggcgcatagnn

SEQ ID NO: 79724 - DNA, 171 bp, Homo sapiens; identical to SEQ ID NO: 79723
  misc_feature: GYAE6OF02GM19P.37.43.D10.1.454.CMB.1.raw
  modified_base (170)..(171): a, c, t, g, unknown or other
  misc_feature (170)..(171): n is a, c, g, or t

SEQ ID NO: 79725 - DNA, 169 bp, Homo sapiens
  misc_feature: GYAE6OF02IMINU.37.43.D10.1.454.CMB.1.raw
  modified_base (169)..(169): a, c, t, g, unknown or other
  misc_feature (169)..(169): n is a, c, g, or t
tcagtagtgtagatcacgaccggtgctcgatttagactagcagtaagggcccatcggtcttcccctggcgccctgctccaggagcacctccgagagcacagcggccctgggctgcctggtcaaggactacttccatcacactactgagcgggctggcaaggcgcatagn

SEQ ID NO: 79726 - DNA, 216 bp, Homo sapiens
  misc_feature: GYAE6OF01EFBES.25.35.D02.1.454.CMB.1.raw
  modified_base (215)..(216): a, c, t, g, unknown or other
  misc_feature (215)..(216): n is a, c, g, or t
tcagactgtacagtcacgaccggtgctcgatttagcacacgatagttgggtttgggctcggtactactgctcagcatgggactctgagctcgctgctcaggtcttcggcgggggacccggttgaccgtcctaggtcagcccaaggctgccccctcggtcactctgttcccaccctcctcactgtacagtctgagcgggctggcaaggcgcatagnn

SEQ ID NO: 79727 - DNA, 606 bp, Homo sapiens
  misc_feature: GYAE6OF01AMYQH.25.35.D02.1.454.CMB.1.raw
  modified_base (389)..(389): a, c, t, g, unknown or other
  misc_feature (389)..(389): n is a, c, g, or t
  modified_base (464)..(464): a, c, t, g, unknown or other
  misc_feature (464)..(464): n is a, c, g, or t
tcagactgtacagtcacgaccggtgctcgatttagcacacgatagttgggtttggggctctgggagaggagcccagcactagaagtcggcggtgtttccatccggtgatcagcactgaacacagaggactcagcatggagtttgggctgcgcttgggttttcctcgttgcttcttttaagaggtgtccagtgtcagatgcaactggcggaggtcggggggagcgtggtccaggccggggaagtccctgagactctccgtgtgcagtcgtccgcgtccaccttccgtcgtttggctattccacgtcgggtcccgccgaggcctccgaggcgaaggggctgggaggtgggtggcggtcagtagtgggtgggatggaagtatgactatttangcagtactcggtagaacgggccactccacctatcctaccgaggacgcacgcctaccgaagtaaccttacctttanctagactaattacgaaaccgtgaacgtacctacgaacgacgtacggtctagtactatacgtcggtcgggtacgggtctaggaaacggacggtacggggtccgggacccgtacggtacggactacggtcgggaccggtccggg

SEQ ID NO: 79728 - DNA, 539 bp, Homo sapiens
  misc_feature: GYAE6OF01CK7Q8.25.35.D02.1.454.CMB.1.raw
  modified_base (372)..(372): a, c, t, g, unknown or other
  misc_feature (372)..(372): n is a, c, g, or t
  modified_base (433)..(433): a, c, t, g, unknown or other
  misc_feature (433)..(433): n is a, c, g, or t
  modified_base (480)..(480): a, c, t, g, unknown or other
  misc_feature (480)..(480): n is a, c, g, or t
tcagactgtacagtcacgaccggtgctcgatttagcacacgatagttgggtttggggggagaggagcccagcactagaagtcggcggtgtttccatccggtgatcagcactgaacacagaggactcagcatggagtttgggctgcgctgggttttcctcgttgctcttttaagaggtgtccagtgtcagatgcaactggcggaggtcggggggaggcgtggtccaggccggggaagtccctgagactctcctgtgcagtgtccgcgtccaccttccgtcgttttggcattcactgggtccgccaggctccaggcaaggggactggagtggggtggcggtcagtagtggtgggatggaagtaatgctatttangcagactccgtgaacgggccgactcgaccatctccagagcagctacaagaactacctttanctgctaattgaaaaccgtgaacactcgaacgacacgctgtctatacngcgcgggtctagaagacgaggtcgggctcgacggcagtcggacgccgtggggccaaggg

SEQ ID NO: 79729 - DNA, 215 bp, Homo sapiens
  misc_feature: GYAE6OF01BJEJ1.25.35.D02.1.454.CMB.1.raw
  modified_base (215)..(215): a, c, t, g, unknown or other
  misc_feature (215)..(215): n is a, c, g, or t
tcagactgtacagtcacgaccggtgctcgatttagcacacgatagttgggtttgggctcggtactactgctcagcatgggactctgagctcgctgctcaggtcttcggcgggggacccggttgaccgtcctaggtcagcccaaggctgccccctcggtcactctgttcccaccctcctcactgtacagtctgagcgggctggcaaggcgcatagn

SEQ ID NO: 79730 - DNA, 544 bp, Homo sapiens
  misc_feature: GYAE6OF01BMRPK.25.35.D02.1.454.CMB.1.raw
  modified_base (340)..(340): a, c, t, g, unknown or other
  misc_feature (340)..(340): n is a, c, g, or t
  modified_base (369)..(369): a, c, t, g, unknown or other
  misc_feature (369)..(369): n is a, c, g, or t
  modified_base (398)..(398): a, c, t, g, unknown or other
  misc_feature (398)..(398): n is a, c, g, or t
  modified_base (402)..(402): a, c, t, g, unknown or other
  misc_feature (402)..(402): n is a, c, g, or t
  modified_base (424)..(424): a, c, t, g, unknown or other
  misc_feature (424)..(424): n is a, c, g, or t
  modified_base (444)..(444): a, c, t, g, unknown or other
  misc_feature (444)..(444): n is a, c, g, or t
  modified_base (478)..(478): a, c, t, g, unknown or other
  misc_feature (478)..(478): n is a, c, g, or t
  modified_base (489)..(489): a, c, t, g, unknown or other
  misc_feature (489)..(489): n is a, c, g, or t
  modified_base (501)..(501): a, c, t, g, unknown or other
  misc_feature (501)..(501): n is a, c, g, or t
tcagactgtacagtcacgaccggtgctcgatttagcacacgatagttgggtttgggggggagaggagcccagcactagaagtcggcggtgtttccatccggtgatcagcactgaacacagaggactcagcatggagtttgggctgcgctgggttttcctcgttgcttcttttaagaggtgtccagtgtcagatgcaactgggcggaggtcggggggaggcgtggtccaggccggggaatccctgagacctctcctgtgcagtcgtccgcgtccaccttccgtcgtttgctattcacgtggtccgccaggctccgaggcaagggctggagtgggtggcgtnatagtggtggatggaagtatgctatttangcagactcgtagaagggccactcacatcncagngcagctacaagaactactttanctgactaattacgaaacgtnacgactcgaacgacgacggtctagtactatacgnggcgtcgggtnacggaagtacgngggtcgggcctacgacggcacgtggaccgcgtgggccaacggg

SEQ ID NO: 79731 - DNA, 591 bp, Homo sapiens
  misc_feature: GYAE6OF01B337T.25.35.D02.1.454.CMB.1.raw
  modified_base (373)..(373): a, c, t, g, unknown or other
  misc_feature (373)..(373): n is a, c, g, or t
  modified_base (437)..(437): a, c, t, g, unknown or other
  misc_feature (437)..(437): n is a, c, g, or t
tcagactgtacagtcacgaccggtgctcgatttagcacacgatagttgggtttgggggggagaggagcccagcactagaagtcggcggtgtttccatccggtgatcagcactgaacacagaggactcagcatggagtttgggctgcgctgggttttcctcgttgctcttttaagaggtgtccagtgtcagatgcaactggcggaggtcggggggaggcgtggtccaggccggggaagtccctgagactctcctgtgcagtgtccgcgtccaccttccgtcgtttgctattcacgtgggtccgccaggctccgaggcaaggggctgggaggtgggtggcggtcagtagtggtgggatggaagtatgctatttangcagactcgtagaacggccactcaccatcctaccgagagcagcctaccaagtactaccttttanctgactaacttacgaaaccgtgaacgtacgtacgaacgacgacgtcttacgtactacttacgtcggccggtcggggtactaggaacggacggtagggtccggggccgtacgtacgggctacgtacgggaccgtccggtggggcccgtaacgggg

SEQ ID NO: 79732 - DNA, 705 bp, Homo sapiens
  misc_feature: GYAE6OF01B6EUR.25.35.D02.1.454.CMB.1.raw
  modified_base (388)..(388): a, c, t, g, unknown or other
  misc_feature (388)..(388): n is a, c, g, or t
  modified_base (434)..(434): a, c, t, g, unknown or other
  misc_feature (434)..(434): n is a, c, g, or t
  modified_base (534)..(534): a, c, t, g, unknown or other
  misc_feature (534)..(534): n is a, c, g, or t
  modified_base (605)..(605): a, c, t, g, unknown or other
  misc_feature (605)..(605): n is a, c, g, or t
tcagactgtacagtcacgaccggtgctcgatttagcacacgatagttgggttggggggagaggagcccagcactagaagtcggcggtgtttccatccggtgatcagcactgaacacagaggactcagcatggagtttgggctgcgcgttgggttttcctcgttgcttacttttaaagagtgtccagtgtcagatgacaacgtgggcgggagggtcggggggaggcgtggtccgagggccggggtaatcccgtgagcctctccgtgtcgacgaggttcgtcccgccgttccctacccgttttccggttcggttttggactagtttccacgttcggggtccccgccgaggccctaccgaggacgaagggctgggaggtggggtggcggtnagtaggtgggtagggatagggtaaagtaagtgtacttagttttagngacaacggtaccgtccggtagggaaaccgggccctactaccaacccgtattcccgtacgaggacggactacgacctaaccgaaataacccttacttttanctagactaaagttacgaaaccgtgaacgacctcggaaccgacgacggtcttacggttactaagttaccggnggccgggtcgggtactaaggaacggacggtaggggtcccgggccgttacgaccggacgtacggtacgggacccggtccgggtaaggggacccgaaacggg

SEQ ID NO: 79733 - DNA, 640 bp, Homo sapiens
  misc_feature: GYAE6OF01CT4RL.25.35.D02.1.454.CMB.1.raw
  modified_base (312)..(312): a, c, t, g, unknown or other
  misc_feature (312)..(312): n is a, c, g, or t
  modified_base (400)..(400): a, c, t, g, unknown or other
  misc_feature (400)..(400): n is a, c, g, or t
tcagactgtacagtcacgaccggtgctcgatttagcacacgatagttgggtttggggctctgggagaggagcccagcactagaagtcggcggtgtttccatccggtgatcagcactgaacacagaggactcagcatggagtttgggctgcgctgggttttcctcgttgctcttttaagaggtgtccagtgtcagatgcaactggcggaggtcggggggagcgtggtccgaggccgggggaatcccgtgagactctcctgtgcagtcgtccgcgtccaccttcgttcgttttggctattcacgttgggtcccnccgaggcctccgaggccgaagggactgggaggtggggtcggcggtcagtagtgggtagggacttgggaaagtaagtgactaattttgngacctagacctccggtagaacgggccgtaactcgaacctagtcctacccgaggaggccaacggccttaaccgaaacgtaaccttaccttttaagcctaggtaacctaagttacgaaaacgttgaacgaccgtaccgaacgaccgacggtacttgtaccttaagttacgcggtccggtacggggtctaggaacggaaccgtaggggtccgggcgtacgtacggcagtcgggccgtaccggg

SEQ ID NO: 79734 - DNA, 621 bp, Homo sapiens
  misc_feature: GYAE6OF01DOMWC.25.35.D02.1.454.CMB.1.raw
  modified_base (384)..(384): a, c, t, g, unknown or other
  misc_feature (384)..(384): n is a, c, g, or t
  modified_base (466)..(466): a, c, t, g, unknown or other
  misc_feature (466)..(466): n is a, c, g, or t
tcagactgtacagtcacgaccggtgctcgatttagcacacgatagttgggtttgggggggagaggagcccagcactagaagtcggcggtgtttccatccggtgatcagcactgaacacagaggactcagcatggagtttgggctgcgctgggttttcctcgttgcttcttttaagaggtgtccagtgtcagatgcaactggcggaggtcggggggagcgtggtccaggccggggaagtccctgacgactctcctgtgcagtcgtccgcgtccaccttccgtcgttttgactattcacgtcgggtccgccaggctccgaggcgaagggactgggagtggggtggcggtcagtagtggtgggatggaagtaatgtactattttagngacagtacgtccggtaggaacgggccactacgacctatccgtaccgaggacgcaacgcctaccaaagtaacctaccttttancctagactaattacgaaaccgtgacgactacgacgactacggtctgtacttagtacgtggccggtcgggtctagggaaacgtaacggtcggggtaccgggtccctacgtacggactacggtacgggacccggccggtggggacccgtaaacgggg

SEQ ID NO: 79735 - DNA, 569 bp, Homo sapiens
  misc_feature: GYAE6OF01CVNY4.25.35.D02.1.454.CMB.1.raw
  modified_base (301)..(301): a, c, t, g, unknown or other
  misc_feature (301)..(301): n is a, c, g, or t
  modified_base (385)..(385): a, c, t, g, unknown or other
  misc_feature (385)..(385): n is a, c, g, or t
  modified_base (516)..(516): a, c, t, g, unknown or other
  misc_feature (516)..(516): n is a, c, g, or t
tcagactgtacagtcacgaccggtgctcgatttagcacacgatagttgggtttggggctctgggagaggagcccagcactagaagtcggcggtgtttccatccggtgatcagcactgaacacagaggactcagcatggagtttgggctgcgctgggttttcctcgttgctcttttaagaggtgtccagtgtcagatgcaactggcggagtcgggggagcgtggtccagccggggaatccctgagactctcctgtgcagtcgccgcgtccaccttccgtcgtttggctattcactgggtccnccaggcctccgaggccaagggtactgggacggtgggtggcggtcagtagtgggtggggatagggaagtaactggctagttttanggcagtaccgtccgtggaacgggccacgtcacccatcctaccgaggcgcgagcctaccaacgaacctaccttttagctgactaattacgaaaccgtgacgaactcgacgacgaacgtctagtactattacngcggcgggtcaggaagacgaggtcgggaccgtcgtacggcaggcggacgccgg

SEQ ID NO: 79736 - DNA, 854 bp, Homo sapiens
  misc_feature: GYAE6OF01DCWP8.25.35.D02.1.454.CMB.1.raw
tcagactgtacagtcacgaccggtgctcgatttagcacacgatagttgggtttgggggggagaggagcccagcactagaagtcggcggtgtttccatccggtgatcagcactgaacacagaggactcagcagtggagtttgggctgcgcttgggttttcctcgttgcttacttttaagaggtgtccagtgtcaggtgcagcgtggtggagtcgtgggggagcgtggtccagccgtagggaactcctgacgctctcgtgtgacaacatctggtacttccgtcctttacgtaagttaaccgtttggacctacgtccccgtaacggttcggggttccccgaccgaacgggtccctacccggaacgggaccggaaacggggtaccgtaagggtaaccgggttgggggttaacgtttaaccgttttttaaggtacggggactaaggttcggtaaggttcgggacctaaggttaacgtaaaacgttaaaaccggtcccttaagtcgaacccgaaggtacccgttacccgggtaaccgaaacgggggtcccccttcgtttacccgtaccctaacgttcccgtaacccgaaggaaaccgaaacccgaaaccggacccgtaaaaggtaaccggtaccggttttacctttaacggaaacttaaaagtaaccgaaaacggtcccgttaaggaaccggtaaccccggaggaaccgtaccgggttacttagtaaccgtttaacgttacgtacggtacggtaccggtaacggacggtaacccggtaagggttagggaaacggttacggggtcgggtaaccgggtacgggttcccgggtacccgggttaaccggggttaaccccggggg

SEQ ID NO: 79737 - DNA, 760 bp, Homo sapiens
  misc_feature: GYAE6OF01DUXIN.25.35.D02.1.454.CMB.1.raw
  modified_base (313)..(313): a, c, t, g, unknown or other
  misc_feature (313)..(313): n is a, c, g, or t
tcagactgtacagtcacgaccggtgctcgatttagcacacgatagttgggtttggggggggagaggagcccagcactagaagtcggcggtgtttccatccggtgatcagcactgaacacagaggactcagcatggagtttgggctgcgcttgggtttttcctcgttgcttcttttaagaggtgtccagtgtcagatgcaacgtgggcggaggtcggggggaggcgtggtccaggccggggaagtccctgagactctcctgtcgcagtcgtccgcgtcctaccttccgtcgttttgctattcacgtcgggtccnccgaggcctccgaggcgaagggacgtggaggtgggtcggcgtcagtagtgggtagggagtagggaaagttagtcgtacttaattttagcgtacgtaaggtaccgttaccggtaggaaaccgggtcccgtacctaccgaccgtactcccgtaccgaaggacggacacggtaccctaaccgaaacgttaacccttacccgtttttataccgttacgaaccgttaaagttaacggtaaaacccgtggtaaacgtaccgtaacggaaccgaacgtaccggtacttacggttacttaacgttaccgtccgggtaccgggtacggggttaccaagggtaaaaccggtaaccgggtacgggggttacccggggtcccgttaaccggtaccgggaccgtaagggttacccgggacccgggtccgggtaaccggggggacccgtaaaacccggggg

SEQ ID NO: 79738 - DNA, 722 bp, Homo sapiens
  misc_feature: GYAE6OF01COMC8.25.35.D02.1.454.CMB.1.raw
  modified_base (427)..(427): a, c, t, g, unknown or other
  misc_feature (427)..(427): n is a, c, g, or t
  modified_base (467)..(467): a, c, t, g, unknown or other
  misc_feature (467)..(467): n is a, c, g, or t
  modified_base (515)..(515): a, c, t, g, unknown or other
  misc_feature (515)..(515): n is a, c, g, or t
tcagactgtacagtcacgaccggtgctcgatttagcacacgatagttgggtttggggctctgggagaggagcccagcactagaagtcggcggtgtttccatccggtgatcagcactgaacacagaggactcagcagtggagtttgggctgcgtcttgggttttcctcgttgtcttcttttaagaggtgtccagtgtcagatgcaactggcgggaggtcggggggaggccggtggtccgaggccgggggaagtcccgtggacgtaccttcgtccgtgtcgcagtcgtccgccgtcctacccgttccgttcgtttggctatttcgacgtcgggtcccgccgacggcctccgaggaccgaagggacgtgggaggtgggtggtcggtcgagtaggtgggtaggagtaggaaagtagtagtcttagtttagngtacgaagtacgtcggtagggaacggccgtactaccaacnctaccgacgaggtacgacacggacctacgtaactaaccttactttacncgtacgaactaacgttaacgaacggtacgaacgtaccgacgtacgaccgtagtaccttaggtaccttaacgttaccggacgggtccgggtaccgggttacgaagggtaaaccggtaaaccgggtacccggggtacccgggggtacccggttaaccgggttaacccgggaggttaaccgggttccggggaacccgggttacccggggg

SEQ ID NO: 79739 - DNA, 764 bp, Homo sapiens
  misc_feature: GYAE6OF01DA7BM.25.35.D02.1.454.CMB.1.raw
tcagactgtacagtcacgaccggtgctcgatttagcacacgatagttgggtttgggggggagaggagcccagcactagaagtcggcggtgtttccatccggtgatcagcactgaacacagaggactcagcatggagtttgggctgcgcttgggttttcctcgttgcttctttaagaggtgtccagtgtcagatgcaacgtggcgggaggtcggggggaggcgtggtccgaggccggggaagtcccctgagactctcctgtgcagtcgtccgcgtccctacccgtttccgtcgttttggctattcacgtcgggtccgccaggcctccgaggcgaagggctgggaggtggggtggcggtcagttagtggggtagggagtagggaaagttaagtggtacttaagtttttagcgtacgtaaggtaaccgttcccgggtagggaaaccggggcccctaacgttacccgaaccctattcccgtaccccgaaggaccggccaacggtacccttaaccgaaaacgtaaacccttacccttttttaagccgtacgtaacctaaagtttaacggaaaaacccgtgaaacgtaccgtaaccgaaccgtaaccgtacgggtccttaggttaccttaagtttaccgtcgggacccgggtcgggggtacttagggaaaaccggtaaccggtacgggggttccggggacccgttaccggaaccgggtcgtaacggtacggggaccccggtccggtacgggggaccccgtaaaacggggg

SEQ ID NO: 79740 - DNA, 776 bp, Homo sapiens
  misc_feature: GYAE6OF01DIITC.25.35.D02.1.454.CMB.1.raw
  modified_base (322)..(322): a, c, t, g, unknown or other
  misc_feature (322)..(322): n is a, c, g, or t
  modified_base (554)..(554): a, c, t, g, unknown or other
  misc_feature (554)..(554): n is a, c, g, or t
tcagactgtacagtcacgaccggtgctcgatttagcacacgatagttgggtttggggctctgggagaggagcccagcactagaagtcggcggtgtttccatccggtgatcagcactgaacacagaggactcagcatggagtttgggcttcgcttgggttttcctcgttgcttcttttaagaggtgtccagtgtcagatgcaacgtggcggaggtcggggggaggcgtggtccgaggccggggaatcccgtgacgacctctccgtgtgcagtcgtcccgcgtccctaccgttccgttcgttttggctattcacgtcgggtccnccgacggcctccgaggcgaagggacgtgggaggtggggtggcggtactagtagtgggtagggagtaggtaaagtaatcgtacttaagtttttagacggtacaaggtaccgttcccgggtaaggaaaccggggtccccgtaacgtacccaacccgtagtttacccgacccgaagggacgggtacccaacgggtaccctaaccgaaaaacggtaccctttaaccgtttttaacnccgtttaacgaaccttaaaacgttttaaaccggaaaacccggttggaaaccgtacccgttaccggaaccgtaaccggtaccggtcctttagttaccttaacgttacggtcggaccgggtacgggttacgtacggaaaacgggacccggtcgggggttcccgggacccgttacggtacccgggacgtaagggttcccggggaccgtcccggggtaaccggggg

SEQ ID NO: 79741 - DNA, 711 bp, Homo sapiens
  misc_feature: GYAE6OF01CLQEH.25.35.D02.1.454.CMB.1.raw
  modified_base (414)..(414): a, c, t, g, unknown or other
  misc_feature (414)..(414): n is a, c, g, or t
  modified_base (533)..(533): a, c, t, g, unknown or other
  misc_feature (533)..(533): n is a, c, g, or t
tcagactgtacagtcacgaccggtgctcgatttagcacacgatagttgggtttggggctctgggagaggagcccagcactagaagtcggcggtgtttccatccggtgatcagcactgaacacagaggactcagcatggagtttgggctgcgctgggttttcctcgttgctcttttaagaggtgtccagtgtcagatgcaacgtgggcgggaggtcggggggaggcggtggtccgaggccgggggaagtcccgtggacgactctccgtgtgcagtcgtccgcgtcctacctttccgttcgttttggctattcacgtcgggtccgccaggcctccgaggccgaagggcgtgggaggtggggtggcggtcagttaggtgggtggggatgggaaagttaatggtacttagtttttagnggactaagtaccgttcccgggtaagggaaccggggacccgtactacccgaaccctacttcccgtacccgaagggaccggaccaacggacctaacccgaaagtaacccttacctttttanccgttacgaacttaaagtttaacgaaaaccggttgaacgtacgttaccggaaccgtacgtacggtcttacgttacttaacgttcgcggtccgggtacgggtactagggaaaccggtaacgggtcgggttcccggggaccgttacggaccggtacgaggtccgggacccggtcccgggg

SEQ ID NO: 79742 - DNA, 702 bp, Homo sapiens
  misc_feature: GYAE6OF01B3H2Y.25.35.D02.1.454.CMB.1.raw
  modified_base (399)..(399): a, c, t, g, unknown or other
  misc_feature (399)..(399): n is a, c, g, or t
tcagactgtacagtcacgaccggtgctcgatttagcacacgatagttgggtttgggggggagaggagcccagcactagaagtcggcggtgtttccatccggtgatcagcactgaacacagaggactcagcatggagtttgggctgcgctgggttttcctcgttgcttcttttaagaggtgtccagtgtcagatgcaactggcggaggtcggggggaggcgtggtccgaggccggggaagtcccgtgacgactctcctgtgcagtcgtccgcgtccaccttccggtcgttttggctattcacgtcgggtcccgccaggcctccgagggcgaaggggacgtgggaggtggggtggcggtcagtagttgggttgggataggaagttaagtgtactattttangcagtacgtcggtaggaacgggtcccgactccacctatcctaccgaaggacggacacggtccctaaccgaaacgtaaccttaccctttttaatccgttagacctaaagttaacggaaaaccgtgaacgtacgtacggaaccgaccgacggtcttacgttacttacgttaccgtcgggtccgggtcggggttactaacgggaacggtaaaccgggtacgggggtccccgggggtacccgttccggtaaccgggcgtacggtacggggacccggtcccgggtacgggggaccccgtaaacggggg

SEQ ID NO: 79743 - DNA, 736 bp, Homo sapiens
  misc_feature: GYAE6OF01DV6DT.25.35.D02.1.454.CMB.1.raw
  modified_base (364)..(364): a, c, t, g, unknown or other
  misc_feature (364)..(364): n is a, c, g, or t
  modified_base (400)..(400): a, c, t, g, unknown or other
  misc_feature (400)..(400): n is a, c, g, or t
  modified_base (443)..(443): a, c, t, g, unknown or other
  misc_feature (443)..(443): n is a, c, g, or t
  modified_base (500)..(500): a, c, t, g, unknown or other
  misc_feature (500)..(500): n is a, c, g, or t
tcagactgtacagtcacgaccggtgctcgatttagcacacgatagttgggtttgggggggagaggagcccagcactttagaagtcggcggtgtttccatccggtgatcagcactgaacacagaggactcagcatggagtttgggctgcgcttgggttttcctcgttgcttcttttaagaggtgtccagtgtcagatgcaacgtggcggaggtcggggggagcgtggtccgaggccggggaagtccctgacgacctctcctgtgcagtcgtccgccgtccctacctttccggttcgttttggctattcacgttcgggtcccgccaggcctccgaggcgaaggggactgggaggtgggtggcggtnagtagtgggtgggatggaaagtatgacttatttagngcaaggtaccgtccggtaggaaccgggccgaactccaaccgtntccgtaccgaaggacgggccaacggtccctaccgaaaacgtaccttaccgtttttanccgtagaccgtaaagttacggaaaaccgtgaaacgtaccgaccggaacgaaccggtacggtctttacgttacttaacgttccgcgggtccgggttaccgggggttactaacgggaaacgggtaacccgggttaccgggggttcccgggggtaccccgttaccgggtaacccggggactaacgggttccgggaaccccgggtccccggggtaacgggggaccccgtaaaaccggggg

SEQ ID NO: 79744 - DNA, 750 bp, Homo sapiens
  misc_feature: GYAE6OF01AQEL6.25.35.D02.1.454.CMB.1.raw
  modified_base (179)..(179): a, c, t, g, unknown or other
  misc_feature (179)..(179): n is a, c, g, or t
  modified_base (244)..(244): a, c, t, g, unknown or other
  misc_feature (244)..(244): n is a, c, g, or t
  modified_base (260)..(260): a, c, t, g, unknown or other
  misc_feature (260)..(260): n is a, c, g, or t
  modified_base (388)..(388): a, c, t, g, unknown or other
  misc_feature (388)..(388): n is a, c, g, or t
tcagactgtacagtcacgaccggtgctcgatttagcacacgatagttgggtttggggctctgggagaggagcccagcactagaagtcggcggtgtttccatccggtgatcagcactgaacacagaggactcagcatggagtttgggctgcgctgggttttcctcgttgctcttttaagnggtgtccagtgtcagatgcaactggcggaggtcgggggagcgtggtccaggccggggaagtcccngagactctcctgtgcngtgtccgcgtccaccttccgtcgttttggctattcacgtgggtcccgccaggcctccgaggcgaacgggactgggaggtggggtcggcggtcagtagtgggtggagtggaagtatggactagttttangtacgagtaccgttccggtaggaaacggggccctaacttccgaacccgtactccgttaccccgaagggaacggtccaacgggtccccttaaccccgaaaggtaaacccctttaacccgttttttaatccgttacggtaacctaaacgtttaccgggaaaaacccgttggaaaccgtaccgtaccggaaccggaacctacgggtcttaggttacttaacgtttaccggtcggtcccgggtaccgggggtttcaagggtaaacgggtaacccggttaccggggggttacccggggggttacccccgttacggggttaacccgggtcccgtaaacgggttccggggaaaccccgggtcccggggg

SEQ ID NO: 79745 - DNA, 590 bp, Homo sapiens
  misc_feature: GYAE6OF01BBHT4.25.35.D02.1.454.CMB.1.raw
  modified_base (367)..(367): a, c, t, g, unknown or other
  misc_feature (367)..(367): n is a, c, g, or t
  modified_base (374)..(374): a, c, t, g, unknown or other
  misc_feature (374)..(374): n is a, c, g, or t
  modified_base (376)..(376): a, c, t, g, unknown or other
  misc_feature (376)..(376): n is a, c, g, or t
  modified_base (398)..(398): a, c, t, g, unknown or other
  misc_feature (398)..(398): n is a, c, g, or t
  modified_base (432)..(432): a, c, t, g, unknown or other
  misc_feature (432)..(432): n is a, c, g, or t
  modified_base (511)..(511): a, c, t, g, unknown or other
  misc_feature (511)..(511): n is a, c, g, or t
tcagactgtacagtcacgaccggtgctcgatttagcacacgatagttgggtttgggggggagaggagcccagcactagaagtcggcggtgtttccatccggtgatcagcactgaacacagaggactcagcatggagtttgggctgcgctgggtttttcctcgttgcttcttttaagaggtgtccagtgtcagatgcaactgggcggaggtcggggggagcgtggtccaggccggggaagtccctgagactctcctgtgcagtgtccgcgtccaccttccgtcgtttggcattcacgtcgggtccgcaggcctccgaggcgaagggctggaggtggggtggcggtcagtagtggtggatggaatatgntatttangnagactcgtgacggccatcactntctcagacgcagctaccgaagtaactacctttanctacgactaattacggaaaccgtgaacgtactcgaaccgacgacggtacttcgtacttattaccgtggccggtcgggtntaacggaacgacggtacgggtaccggggtccgtacgacggactaggtccgggacgtcccgggtcgggacgtaaccgggg

SEQ ID NO: 79746 - DNA, 660 bp, Homo sapiens
  misc_feature: GYAE6OF01C4184.25.35.D02.1.454.CMB.1.raw
  modified_base (373)..(373): a, c, t, g, unknown or other
  misc_feature (373)..(373): n is a, c, g, or t
  modified_base (552)..(552): a, c, t, g, unknown or other
  misc_feature (552)..(552): n is a, c, g, or t
tcagactgtacagtcacgaccggtgctcgatttagcacacgatagttgggtttgggggggagaggagcccagcactagaagtcggcggtgtttccatccggtgatcagcactgaacacagaggactcagcatggagtttgggctgcgctgggttttcctcgttgctcttttaagaggtgtccagtgtcagatgcaactggcggagtcgggggagcgtggtccaggccggggaatcccctgagactctcctgtgcagtcgtccgcgtcccacctttccggtcgttttggctattcacgtcgggtccgccaggctccaggcaagggctggagtgggtggcgtcagtagtggtgggattggaagtatgctatttangcagactccgtggaacggccatccactctcgtcccaggacgcacgtacctaccgaaacgtaaccttacctttttacgtaccttacggaacctaacgtttaccggtaaaaacccggtgtaaccgaacccgttacggaaccgtaaccggacgggtccttaggttcccttaagttttaccgngggtcccgggtcggggttcctaggaaacggtaccggtacggggtacccgggtccgtacgtaccgggctaacggtcgggaccggtcccggtggggacccgtaaacgggg

SEQ ID NO: 79747 - DNA, 728 bp, Homo sapiens
  misc_feature: GYAE6OF01EJGGO.25.35.D02.1.454.CMB.1.raw
  modified_base (533)..(533): a, c, t, g, unknown or other
  misc_feature (533)..(533): n is a, c, g, or t
tcagactgtacagtcacgaccggtgctcgatttagcacacgatagttgggtttgggggggagaggagcccagcactagaagtcggcggtgtttccatccggtgatcagcactgaacacagaggactcagcatggagtttgggctgcgctgggttttcctcgttgcttcttttaagaggtgtccagtgtcagatgcaactggcggaggtcggggggaggcgtggtccaggccggggaagtccctgagactcctccgtgtgcagtcgtccgcgtccctaccttccgttcgtttggctattcaccgtcgggtcccgccgaggtcctccgaggcaaggggcctgggaggtgggtggcggtcgagtagtgggtagggatgggaaagttaatcgtacgttaattttagtgacgtaacggtaccgtacccgggttagggaacggggtccccgtaactccccggtaaccctaactttcccgtacccgaaggaccgggacaacggtcccctaaccgaaaccgtaaccttacccgtttttaanccgttagtaacctaaagttaaccggtaaaaccgttcggaacgtaacccgttaccggaaccggtacctaccgggtcttacgtacttacgtacgtcggccggtcgggtacagggtaaacgacggtaggggtcccgggtccgttaccgaacggtacgtacggacgggacccggacccggtgggggacccaaaccgggg

SEQ ID NO: 79748 - DNA, 641 bp, Homo sapiens
  misc_feature: GYAE6OF01ANFW3.25.35.D02.1.454.CMB.1.raw
  modified_base (309)..(309): a, c, t, g, unknown or other
  misc_feature (309)..(309): n is a, c, g, or t
  modified_base (429)..(429): a, c, t, g, unknown or other
  misc_feature (429)..(429): n is a, c, g, or t
  modified_base (481)..(481): a, c, t, g, unknown or other
  misc_feature (481)..(481): n is a, c, g, or t
tcagactgtacagtcacgaccggtgctcgatttagcacacgatagttgggtttgggggggagaggagcccagcactagaagtcggcggtgtttccatccggtgatcagcactgaacacagaggactcagcatggagtttgggctgcgctgggttttcctcgttgctcttttaagaggtgtccagtgtcagatgcaactggcggaggtcggggggaggcggtgggtccaggccggggaagtccctgacgactctcctgtgcagtcgtccgcgtccacctttccgtcgttttggctattcacgtgggtccnccgaggcctccgaggccaagggaccgtggaggtcggggtggcggtcgagtagtggtgggatagggtaagtaatgctatttagtgcagtacttcgtagtcggaacgggcctacgtcaaccntccgtaccaggtacggcgacgtccgtaccaaaggtaacccttaccgttttanccgttagacctaagttacgaaaacccgttgaacgtaccgtaccggaacgaccgtacgtctagttacctataccgtggcggtcgggtctaggaacgtacgggacgggttccgggaccgttcgacgggcctaggtaccgggcggcccggtgggggaaccccg

SEQ ID NO: 79749 - DNA, 720 bp, Homo sapiens
  misc_feature: GYAE6OF01CULX1.25.35.D02.1.454.CMB.1.raw
  modified_base (381)..(381): a, c, t, g, unknown or other
  misc_feature (381)..(381): n is a, c, g, or t
  modified_base (425)..(425): a, c, t, g, unknown or other
  misc_feature (425)..(425): n is a, c, g, or t
tcagactgtacagtcacgaccggtgctcgatttagcacacgatagttgggtttgggggggagaggagcccagcactagaagtcggcggtgtttccatccggtgatcagcactgaacacagaggactcagcatggagtttgggctgcgtcgttgggttttcctcgttgcttcttagtaaaaggtgtccattgtcaggtgctaggttggtgcaggtcgtgggggagcgtggtccagccgtgggacggtccctgacgactctcctgtcgaacgtccttcgtggtattttagtttcaggttggttctggcatgcacgtcgggtcccgccgaggcctccgagggccggaacggggggccgtaggttgggttcggacgtaggttaanacggcaacagttaggatagggtaacgtttcagtaattattacgngacgtagtaccgttccggaggtacggggtccctaacgttccaaccgtaacgtaccgtacccgaaggtaaccgaaacctaaccggttaccccggaaattcggtttacgtacgtttaacgtttaggaaacgtttcgggtacgaaccggtcgtaaggacggtacgttacgggaacggtaccgtcggttcttacgttagttacgtttacgtgggtacgacggtaacggtagggttccgggggtaggtttacgggttaacgggtttaacggtttacccggtacggggccgacgttaaggg

SEQ ID NO: 79750 - DNA, 646 bp, Homo sapiens
  misc_feature: GYAE6OF01DI1VG.25.35.D02.1.454.CMB.1.raw
  modified_base (321)..(321): a, c, t, g, unknown or other
  misc_feature (321)..(321): n is a, c, g, or t
  modified_base (400)..(400): a, c, t, g, unknown or other
  misc_feature (400)..(400): n is a, c, g, or t
tcagactgtacagtcacgaccggtgctcgatttagcacacgatagttgggtttggggctctgggagaggagcccagcactagaagtcggcggtgtttccatccggtgatcagcactgaacacagaggactcagcatggagtttgggctgcgctgggttttcctcgttgcttcttttaagaggtgtccagtgtcagatgcaacgtggcggaggtcggggggagcgtggtccgaggccggggaagtccctgagactctcctgtgcagtcgtcccgcgtccctaccgttccggttcgttttggctattccgacgtggggtcccnccgaggcctccgaggccgaagggactgggaggtgggtggcggtcagtagtgggtaggagtggaaagtatgactatttancgtacagtaccgtcggtaggaacgggccgactcacctatcctaccgaggacgtccacgtcctaacgaacgtaaccttacttttagctagaacttaagtacgaaacgtgaacgtaccgtaccgacgacgtacggtacttcggtacttacgttacgcggtccgggtacgggttactagggaaacgtaccggtacggggtcccgggtaccgtacgtaccgggactacggttcggacccggtacccgggg

SEQ ID NO: 79751 - DNA, 855 bp, Homo sapiens
  misc_feature: GYAE6OF01EAQ2P.25.35.D02.1.454.CMB.1.raw
  modified_base (380)..(380): a, c, t, g, unknown or other
  misc_feature (380)..(380): n is a, c, g, or t
tcagactgtacagtcacgaccggtgctcgatttagcacacgatagttgggtttggggctctgggagaggagcccagcactagaagtcggcggtgtttccatccggtgatcagcactgaacacagaggactcagcatggagtttgggctgcgcttgggtttttcctcgttgcttctttttaagaggtgtccagtgtcagatgcaacgtgggcgggaggtcggggggaggcggtgggtcccaggccggggaagtccccgtgacgacctctccgtgtcgcgagtcgtcccgccgtccctaccgtttccgttcgttttggcctattcacgtcgggtcccgccgaggcctccgaggcgaacgggcgtgggagtgggtcggcggtntagtagtgggtagggtagtagggaaagttaagtgtacctttaagtttttaagcggtacgtaacggtacccggttacccgggtaaggggaaaccggggtcccccgtaacttacccgaacccgtacgtccccgttacccgaacggggtaaccggccgtaacgtaccccgtaacccggaaaaccgtaaacccttacccctttttaagtacccgttagaaacccgttaaagtttaaccgggaaaaacccggttgaaaccggtacccgtaaccgggtaaacccgtaacccggacggttacccttacgggttaacctttaacggttacccgtcggggtacccggggttaccgggggtttaccgtaaaggggaaaaccgggtaacccggggtaacccgggggttaccccgggggaccccgttttaaccgggacccgggttacccggtaacggttacccgggggacccgggttaacccggggg

SEQ ID NO: 79752 - DNA, 723 bp, Homo sapiens
  misc_feature: GYAE6OF01BO2D9.25.35.D02.1.454.CMB.1.raw
  modified_base (368)..(368): a, c, t, g, unknown or other
  misc_feature (368)..(368): n is a, c, g, or t
  modified_base (397)..(397): a, c, t, g, unknown or other
  misc_feature (397)..(397): n is a, c, g, or t
  modified_base (521)..(521): a, c, t, g, unknown or other
  misc_feature (521)..(521): n is a, c, g, or t
tcagactgtacagtcacgaccggtgctcgatttagcacacgatagttgggtttggggggggagaggagcccagcactagaagtcggcggtgtttccatccggtgatcagcactgaacacagaggactcagcatggagtttgggctgcgcttgggttttcctcgttgcttcttttaagaggtgtccagtgtcagatgcaacgtggcggaggtcgggggaggcgtggtccaggccggggaatcccgtgacgctctcctgtgcagtcgtccgcgtccctaccgttccgttcgtttggctattccgacgtcgggtcccgcgacggcctccgaggcgaacgggctgggaggtgggtggcggtcagtggtaggnggactaggaacgtatgtacttattttagngacctaggtcctaccgggtaggaaaccggggtccctaaccgtccgtaacccgtacgtacccttacccggaaggtaccggaccacggtaccctaaacccgtaaacgtaacccttacccgttttanccgttagaaaccttaacgtaacggtaaaccgttaggaacgtaccgtacggaaccgaccggtacgtcgttacgttacgttacgttaccggcggtacccgggtacgggttacaagggtaaccgtaccggggtacgggtccggggtaccccttacgggacgtacgtacgggtcgaacccgggtcggtaccggggctaaacccggg

SEQ ID NO: 79753 - DNA, 629 bp, Homo sapiens
  misc_feature: GYAE6OF01BCSM1.25.35.D02.1.454.CMB.1.raw
  modified_base (378)..(378): a, c, t, g, unknown or other
  misc_feature (378)..(378): n is a, c, g, or t
  modified_base (451)..(451): a, c, t, g, unknown or other
  misc_feature (451)..(451): n is a, c, g, or t
tcagactgtacagtcacgaccggtgctcgatttagcacacgatagttgggtttgggggggagaggagcccagcactagaagtcggcggtgtttccatccggtgatcagcactgaacacagaggactcagcatggagtttgggctgcgctgggttttcctcgttgctcttttaagaggtgtccagtgtcagatgcaactggcggaggtcggggggaggcgtggtccaggccggggaagtccctgagactctcctgtgcagtgtccgcgtccaccttccgtcgtttggctattcactcgggtccgccgaggcctccgaggcaagggactgggagtgggtggcggtcagtagtggtgggagtggaagtaatgactatttangcagtactccgtaggaacgggccactcaccatcctaccgagacgcacgcctaccaaagtaacctaccttttancttagaccttaagttacgaaaccgtgaacgactcggaacaccgacggtcttagttacttagttaccgtacggccgggtcgggttacaaggaaacggtaaccggtaggggttccccggggtcctacggtaaccggcgtaacggtcgggaacccggcccggtgggggacccaaacggggg

SEQ ID NO: 79754 - DNA, 830 bp, Homo sapiens
  misc_feature: GYAE6OF01DHFQ1.25.35.D02.1.454.CMB.1.raw
tcagactgtacagtcacgaccggtgctcgatttagcacacgataggttgggtttggggggggagaggagcccagcactagaagtcggcggtgtttccatccggtgatcagcactgaacacagaggactcagcatggagtttgggctgcgtcttgggttttcctcgttgcttcttttaagaggtgtccagtgtcagatgcaacgtgggcggaggtcggggggaggcgtggtccaggccggggaagtcccgtgacgactctcctgtgcgagtcgtccgccgttccctaccgtttccgtcgttttcggctattccgacgtcgggtccgccgaggtcctcgagggcgaacggggtcgtgggaggtggggtcggcggtacagtaggtgggtagggatagggaaagttacgtgactttaagttttagcgtacgacgtaccgttaccgggtagggaaacgggcccccgtacttacccaacccgtacgttacccgtacccgaagggtaaccgggcctaacgggtacccttaaaccccggaaaacgttaaaccctttacctttttaacgtcttaaccggacttaaacgtttaaccggaaaaccggttcggaacgtacccgtaccgggaaccgtaaccgtaccgggtaccttcggttaacctttaacgtttaccggtcgggtccccggggttacgggtaccgttagggtaaaaccggtaaacccggggttaccgggggtcccgggggttaccccgttaaccgggttacccgggaaccgtacgggttaacccggggaccccgttacccgggggtccgggggaaccccggtaaaaccggggg

SEQ ID NO: 79755 - DNA, 773 bp, Homo sapiens
  misc_feature: GYAE6OF01ENQ5M.25.35.D02.1.454.CMB.1.raw
  modified_base (476)..(476): a, c, t, g, unknown or other
  misc_feature (476)..(476): n is a, c, g, or t
tcagactgtacagtcacgaccggtgctcgatttagcacacgatagttgggtttggggctctgggagaggagcccagcactagaagtcggcggtgtttccatccggtgatcagcactgaacacagaggactcagcagtgggagtttgggctgcgcgttgggttttcctcgttgtctcttttaaggaggtgtccgagtgtcagatgcaacgtgggcggagggtcgggggaggcgtcggtccgaggccggggaacgtcccgtgacgactcctccgtgtgccagtcgcccgcgtccctacccgttccggttcgttttcggctacgttccgtacgtcgggtcccgaccgacgggcccttccggacggaccggaacgggtacggtggggtaagggttcgggggtcggccgggttacctaagttacggttggggtagggtaagtaggggtaaacgttaagttggtaacctttagttttaacgnggaccgtaacggtacgttcccggtaggaacggggcccacgttccaaccgtacgtccgtaccgaaggacgggtacccacggtactaaccccgaaacgttaacccttaccgttttaagtccgtacgaacgttaaacgtacggaaaacccgtgaaccgtaccgtaccgggaacgtaaccgaccgtcgtaccggttactacggttacgtcgggaccgggtcgggtactaaggtaacggaaccgggtcggggttacccggacccgttacggaccggagtacgggtccggtaccggcccgggg

SEQ ID NO: 79756 - DNA, 729 bp, Homo sapiens
  misc_feature: GYAE6OF01D1IGQ.25.35.D02.1.454.CMB.1.raw
tcagactgtacagtcacgaccggtgctcgatttagcacacgatagttgggtttggggctctgggagaggagcccagcactagaagtcggcggtgtttccatccggtgatcagcactgaacacagaggactcagcatggagtttgggctgcgcttgggttttcctcgttgcttacttttaaggagtgtccagtgtcagatgcaacgtgggcggaggtcgggggagcggtcggtccaggccggggtaatcccgtgacgacctcgtccgtgtcgcgtagtcgtccgcgtcctaccgttccgttcgtttggctattcgacgtcggtcccgcgacgctaccgaggcgaacgggtctgggacggtgggtgcggtcaagtgtgggtaggagtaggaagtaagtggtacttaagtttaagcgtacgtaacggtacccgttcggtaaggaaaccgggtcccgtaactcccgaacgtactccgtaccgaaggtacggacgacgacctaaaccgaaacgtaacctttaaccgttttacgtaccgtaacgaaccgtttaaagttaaaccgaaaacccgggttgtaacgtaaccgtacgggaaccgtaaccgtaccggtcgttacgtaccgttaaacgttcggtacggccggttacggggtcttaaagggaaacggtaccgggtacggggtcccgggtacccgttacgaccgggtaataccgggttacggccgtacccgggg

SEQ ID NO: 79757 - DNA, 220 bp, Homo sapiens
  misc_feature: GYAE6OF01BIB14.25.35.D02.1.454.CMB.1.raw
  modified_base (214)..(220): a, c, t, g, unknown or other
  misc_feature (214)..(220): n is a, c, g, or t
tcagactgtacagtcacgaccggtgctcgatttagcacacgatagttgggtttgggctcggtactactgctcagcatgggactctgagctcgctgctcaggtcttcggcgggggacccggttgaccgtcctaggtcagcccaaggctgccccctggtcactctgttcccgccctcctcactgtacagtctgagcgggctggcaaggcgcatagnnnnnnn

SEQ ID NO: 79758 - DNA, 747 bp, Homo sapiens
  misc_feature: GYAE6OF01DZ6YW.25.35.D02.1.454.CMB.1.raw
  modified_base (436)..(436): a, c, t, g, unknown or other
  misc_feature (436)..(436): n is a, c, g, or t
tcagactgtacagtcacgaccggtgctcgatttagcacacgataggttggggtttggggggggagaggagcccagcactagaagtcggcggtgtttccatccggtgatcagcactgaacacagaggactcagcagtggtagtttgggctgcgtcgttcgggtttttcctcgttgtcttacgttttaaggaggttgtcctagtgtcagtatgacgaacgtgggcgggtaggggtcggggggaggtcggtcgggtccgacgggccggggtaactcccgtagacgtccttccgtccgtggtcgcgtaggtccggtcccgccgttacccgtacccgtttccggtttcggttttggccttagtttccgaccggttccgggtcccgccgtaggtccctacggacggacgtaggggactgggggagttgggggtcgaccggtnaagtggtggggtagggtaataggtaaagttatggtactttagtttagcgacgtaacgtaccggtacggtagggaaccgggtcctactaccacccgtagttccgacgaggcgactacgcgtaaccaacgtaccttacttagactagtaactagtaacgaacgtagaccgtagtaccgaacgtacgacgtactcgttacttacgtacgtggtccggtacgggttacgaaggaaccggtacgggtcggggtacccggtcgtaccggacggacgtcgggtacggaacccggcggggtacggacccggtaaccggg

SEQ ID NO: 79759 - DNA, 789 bp, Homo sapiens
  misc_feature: GYAE6OF01CW5GQ.25.35.D02.1.454.CMB.1.raw
  modified_base (179)..(179): a, c, t, g, unknown or other
  misc_feature (179)..(179): n is a, c, g, or t
  modified_base (246)..(246): a, c, t, g, unknown or other
  misc_feature (246)..(246): n is a, c, g, or t
  modified_base (265)..(265): a, c, t, g, unknown or other
  misc_feature (265)..(265): n is a, c, g, or t
  modified_base (314)..(314): a, c, t, g, unknown or other
  misc_feature (314)..(314): n is a, c, g, or t
tcagactgtacagtcacgaccggtgctcgatttagcacacgatagttgggtttggggggagaggagcccagcactagaagtcggcggtgttccatccggtgatcagcactgaacacagaggactcagcagtggagtttgggctgcgtcgttgggttttccctgttgcttcgttttaagnggtgtccagtgtcagatgcaacgtggcggaggtcggggagcgtcggtccgaggccggggaatcccgngacgtactcctcctgtgcngtcgtccgcgtccctacgtttccgtgtttgcctattcgacgtcggtccnccgaggccgtccgaggccgaacggggtctagggaggttggggtcggtaccggtacgtagttagtggggtagggacgtagggtaaagtagttgtacgtttattttacgcggtacaacggtacccgttacgggtagggaaaccgggcccgtaaccgtcccaaccgttactaccgtacccgagggtacgaccctaacggaccttaacccggaaaacgtaaaccctttaccgtttttaacgcctttaacggtaacgttaaaaccggtttacggaaaaacccgggttgtaaccggaacccttccggaaccgttaacccggacggttacttacgttacgttaaccgttaccggtcggtacccgggtaccggggtactacgggtaaaccgaacggggttccggggtacccgggtccccggtacgtacgggccgtacgggtacgggaccccgggtacggtacccggggaaccgtaacccgggg

SEQ ID NO: 79760 - DNA, 636 bp, Homo sapiens
  misc_feature: GYAE6OF01BTBHO.25.35.D02.1.454.CMB.1.raw
  modified_base (388)..(388): a, c, t, g, unknown or other
  misc_feature (388)..(388): n is a, c, g, or t
  modified_base (484)..(484): a, c, t, g, unknown or other
  misc_feature (484)..(484): n is a, c, g, or t
  modified_base (543)..(543): a, c, t, g, unknown or other
  misc_feature (543)..(543): n is a, c, g, or t
tcagactgtacagtcacgaccggtgctcgatttagcacacgatagttgggtttgggggggagaggagcccagcactagaagtcggcggtgtttccatccggtgatcagcactgaacacagaggactcagcatggagtttgggctgcgctgggttttcctcgttgcttcttttaagaggtgtccagtgtcagatgcaactggcggagtcggggggagcgtggtccagccggggaatccctgacgactcctcctgtcgcagtgtccgcgtccacctttccgtcgttttggctattcacgtcgggtcccgccgaggcctccgaggcaaggggcctgggagtggggtggcggtcattagtgggtgggatgggaagtaatcgactattttagngcagacctccggtagaacgggtccaaccgttccgaacctagttccctaccgaggacggctaacggtcctaaccgaacgtaacccttaccgttttanactacgactaagtacgaaaaccgtgactactacgacgacgcggtacttgtcttatacgngtccggcgggttacaggaaacggcgtacggggtaccggggcctacggtaccgggtacacggtacgaccggtccggtgggggaccctaacgggg

SEQ ID NO: 79761 - DNA, 687 bp, Homo sapiens
  misc_feature: GYAE6OF01DRZT7.25.35.D02.1.454.CMB.1.raw
  modified_base (177)..(177): a, c, t, g, unknown or other
  misc_feature (177)..(177): n is a, c, g, or t
  modified_base (531)..(531): a, c, t, g, unknown or other
  misc_feature (531)..(531): n is a, c, g, or t
tcagactgtacagtcacgaccggtgctcgatttagcacacgatagttgggtttgggggggagaggagcccagcactagaagtcggcggtgtttccatccggtgatcagcactgaacacagaggactcagcatggaggtttgggctgcgctgggttttcctcgttgcttcttttaagngtgtccagtgtcagatgcaacgtggcggaggtcgggggagcgtggtcaggccggggaactcccgtgactctcctccgtgtgctacgtcggtcccgcgttccctacctttccggttcggttttcggcttacgttccgtacgttccgggtcccgtaccgacggtcccttaccggaggaaccggtaaaggggtccgtggggtaggtcggggtcggacgtactagttacgtgggtagggagtaggtaagtaatcgtacttagtttgcgtacgactaccgtccggtaggacggtcctactccacgtacgttcacgaacggacgcaacgtcctaccaaacgtacgtttacctttagctanacgtaagtaccgtaaacgtgaacgtcgaacgacgtaaccgacgtcttacgtacttaacgtacgcggtccggtcgggtaactaaggaacggtaccggtgggtccggtacccgtacggtacgcgtacggaccgacgtcgggtacggaccggtaaacgg

SEQ ID NO: 79762 - DNA, 828 bp, Homo sapiens
  misc_feature: GYAE6OF01DOTPU.25.35.D02.1.454.CMB.1.raw
  modified_base (463)..(463): a, c, t, g, unknown or other
  misc_feature (463)..(463): n is a, c, g, or t
tcagactgtacagtcacgaccggtgctcgatttagcacacgatagttgggtttgggggggagaggagcccagcactagaagtcggcggtgttccatccggtgatcagcactgaacacagaggactcagcatggagtttgggctgcgcgttgggtttttcctcgttgcttcgttttaaagaggtgtccagtgtcagatgacaacgtggcggagggtcgggggagcggtggtccgaggccggggaatccctgacgactctccgtgtcgcgagtcgtccgtccgttccctaccgtttcccggttcgttttggacctacgttccgacggtccggggtcccgccgacggtcctacccgaagggaccgaaggggtacgtgggtagggtcggggtcggtcggtactaagttacgggtggggtagggtaagttagggtaaacgttaagttcgtaacgtttaagttttacgnggtaaccgtaacgggtacccgtttaccggggagggtaaacccgggaccccgttacccgttaccgaaaccccgttactacccgttaacccgaagggtaaccggaccgtaaccgtaaccccgtaaccgtaaaacgttaaccctttaaccgttttactaccgtacgtaacgtaaacgttaacggtaaaaccggtggaaccgtaccgtaaccggaccgtaaccggaccgttacgttacgttaccttagttaccggtcggtaccgggtgggtacgtaacggaaacggtaccggtcgggtacccgggtccgttaccgggtaccgacggtacggtaccggacccggaccgggtcgggaacccggtaaccggg

SEQ ID NO: 79763 - DNA, 795 bp, Homo sapiens
  misc_feature: GYAE6OF01EZO7C.25.35.D02.1.454.CMB.1.raw
  modified_base (138)..(138): a, c, t, g, unknown or other
  misc_feature (138)..(138): n is a, c, g, or t
tcagactgtacagtcacgaccggtgctcgatttagcacacgatagttgggtttgggggggaggaggtagcccagcactagaagtcggcggtgtttccactccggtgatcagcactgaacacagacgactcagcatggngtttgggctgcgcttgggttttcctgttgcttacttttaagaggtgttccgaggtgtcgagactgctaaacgttcgggtcgggacgggttcggggggggtagcggtgggtcccgagggcccgggggaacgtcccgtagacgtacctccttccgtgtcgtcgagtcgtcccgcgtcccaccgtttccggtcgttttcggctattccgacgtggtccgccaggtctcgacggcgaagggtctgggtagtcgggtcggtcgtactagtcgtgggtgggagtgggaagtagcgtacttagtttagcgacgtaacggtaccttacgggtacggaccggtaccgtaactcctaacctacgtttcccgaccgtaacggtacgggtacctacgacccgtaaaccgaaacggtaaaccctttaccgtttaacgtacgtacgaacttaaacggttaccgtaaaaccggtgtaacgtaccgtaaccgaaccggtacgtaacggttcgttacgttaacccgttacgtaccggtcggtaaccggggttcccgggttaaacgaacgggttaaaccggtaaccggttcggggggtcccgggtacccggtaccggttacgggacctaacgggtccgggaacccggttccgggaaacgggacccggtaaacggg

SEQ ID NO: 79764 - DNA, 866 bp, Homo sapiens
  misc_feature: GYAE6OF01EC6IV.25.35.D02.1.454.CMB.1.raw
tcagactgtacagtcacgaccggtgctcgatttagcacacgataggttggggtttggggggggagaggagcccagcactagaagtcggcggtgtttccatccggtgatcagcactgaacacgagaggactcagcagtggtagtttgggctgcgtcgttgggttttcctcgttgctttacgttttaaggaggttcgtaccgtaggtcgtacgaggtatcgaccaacggtcggggacggggtaggggtcgggggggaggtccggtcgggtaccgacggggaccgggggtaactcccgtaggaacgtccgttccgtccgtagtcggcgtacggttcgtacccgtccgttacccgttacccgttttccggtttcggttttcggaccttacgtttccggtacggttccggggcccgaccggtacgggtccctaccggacggggacggtaacggggtccggtggggtacggggttcgggtcgggtaccggttagtaaggttacgggttggggtaagggtaggtaagggtaaagttagtcgttacgtttaatttagcggtacgtaacggttaccggtacgggtagggacccggtaccgtactacccacgtctaccgacggaaggacgtacgacctaccgtaaaccgtaaacgttacctttacgttacaccgtaagtaaccgttaacggtaacgaaccgttagacctaacgtaccggaaccgtacgcgttcgttaagttacttaacggtccggtcggtaccggggtacgtaacgtaacgggaaccgggtcggggtacgggtcccgggtaccgtccggtaacggacggttacgggacccgggtacccgggacggtacccggggaacggtaaccgg

SEQ ID NO: 79765 - DNA, 723 bp, Homo sapiens
  misc_feature: GYAE6OF01EP3PZ.25.35.D02.1.454.CMB.1.raw
  modified_base (258)..(258): a, c, t, g, unknown or other
  misc_feature (258)..(258): n is a, c, g, or t
tcagactgtacagtcacgaccggtgctcgatttagcacacgatagttggggtttggggctctgggagaggagcccagcactagaagtcggcggtgtttccatccggtgatcagcactgaacacagaggactcagcagtggagtttggcttaactgttcttttccttgttgcttagttttaaagtgtaccaatgtgaggtgacaacgtgggtggaggtcggtggggggagtcttggtacacgccgacgggcccgtcccngaccactcctcctgcacacgtcttccggacttccgtaccgtttggtcgagtcagttcgactagtaccggtacccggttcgggtcccgccgacggtcctacgggaaggggtacggtcggtggtacggtcggttacggtttcgggtactagttacgaacggtacgacgtcgtagtgggcggacaacacgtacgtaccgccgtacgtacgtaaggtaacggctaagtacttacgaccgtacctacgtagaaacgagtatacgaactaacccgaaagtcctaacgtcctaaccgttactcgtacgacccaagtactcggtaacgcccgtacgaccgtaagggaacggtaaccggacgggtaaccgtaccttaccgggacgggtttaccggttaactttaacgtttcgtttaacccgttttagtttaaccgttacgtaggtttacggtaaagggttaacggttttaaggg

SEQ ID NO: 79766 - DNA, 913 bp, Homo sapiens
  misc_feature: GYAE6OF01BEVBQ.25.35.D02.1.454.CMB.1.raw
tcagactgtacagtcacgaccggtgctcgatttagcacacgatagttgggtttgggctctgggagaggagcccagcactagaagtcggcggtgtttccatccggtgatcagcactgaacacagagactcagcatggagtttgggctgcgtcgttcgggttttcctcgttgtcttctttttaaggaggttgtccaggtgtcagatcgcaacgtggcgggaggtcggggggagtcggtggtaccgagggtccggggaacgtcccgtagacgaccttccgtcctggtgactggtcgtccgtccgtcccgtccgtttccggttcggttttcggaccttacgtttccgacggttccggggtcccgccggaacgggtcctaccggacgggtaccgtaaaggggtccgttggggacggtcgggggttacgggtccggttacgtaagtttacgggtggggttacgggggaagttaaggggaaagtttaaacgttggtaactttaagtttttagacggacgtaaccggaacgtttcccggaaggggtaacccgggtacccgtaaccgttacccaaaccgtccgttaaccggaccgaagggacggtacccgaacggtacccttaaaacccggaaaccttaaacccttttacctttagtaacccgttagaacccgtttaaacggttaaaccgtaaaacccgttcgtaaaacggttacccgacccgggtaaactacccgggttaacgggtaccctttcggttaaacttacccggtttaccgcgggttaacccgggtaaccgggggttacttaaagggggaaaccgtaaaacggggggttccccggggtaccgggtaaccccgtttaggggtaacccgggtacgttaacccgggttaccggggaccccggttaaacccccgggggg

SEQ ID NO: 79767 - DNA, 678 bp, Homo sapiens
  misc_feature: GYAE6OF01BG9U8.25.35.D02.1.454.CMB.1.raw
  modified_base (514)..(514): a, c, t, g, unknown or other
  misc_feature (514)..(514): n is a, c, g, or t
tcagactgtacagtcacgaccggtgctcgatttagcacacgatagttgggtttggggctctgggagaggagcccagcactagaagtcggcggtgtttccatccggtgatcagcactgaacacagaggactcagcatggagtttgggctgcgcttgggttttcctcgttgcttcttttaagaggtgtccagtgtcagatgcaacgtggcgggaggtcgggggggaggcgtgggtccgaggcccgggggaagtccccgtggacgacctctccgtgtgcagtgtcccgcgtcccaccgtttccgttcgttttggctattccacgtcgggtcccgccgaggcctccgaggccgaagggctgggaggtgggtggcggtcagtagtgggtgggagtggaaagtaagtgtcttattttagcgactacggaccttcggtaggaacgggtcccgaactccgaaccctagttccaccgaggacggaccacggtcctaacccgaaagtaacccttaccttttaancctagacctaaagtttacggaaaaccgtggaacgtaccgtacggaaccgaccgacggtcttagttacctagttaccgtcggacccgggtcgggtactaaggaacggtaaccggcggggttcccgggaccgttacgtacggcgaacggtcgggaccggtcccggg

SEQ ID NO: 79768 - DNA, 949 bp, Homo sapiens
  misc_feature: GYAE6OF01A5XU8.25.35.D02.1.454.CMB.1.raw
  modified_base (313)..(313): a, c, t, g, unknown or other
  misc_feature (313)..(313): n is a, c, g, or t
tcagactgtacagtcacgaccggtgctcgatttagcacacgatagttgggtttggggggggagaggagcccagcactagaagtcggcggtgtttccatccggtgatcagcactgaacacagaggactcagcatggagtttgggctgcgctgggttttcctcgttgcttcttttaagaggtgtccagtgtcagatgcaacgtggcggaggtcggggggaggcgtggtccaggccggggaagtccctgacgactctcctgtgcagtcgtccgcgtccctacctttccgtcgttttggctattcacgtgggtcccncaggcctccgaggcaagggctgggaggtggggtggcgtcagtagtgggtgggatggaagtaagtgtacttaattttagcgacgtaacggtaccgttccggtagggaacggggtccccgtaacgttacccgaacccgtaaccgttcccggtaacccggaaagggtaccgggtcgtaaaccggtaccccttaacccgtaaaacggttaaaccccttttacccgtttttaacgtcccgttaacggaacccttaaaacggtttaacccgggaaaaacccgggttcggtaaaccgggtaacccgtttaaccccgggaaacccgggttaaacccggttaaccccggggttaccgttttaccgggtttaaacccgtttaaaccggttttacccggggtaccggggtaaccccggggggtttaccggggggtttaaaacccttaaccggggggtaaaaaccccggggttaaaccggggttaaccccggggggggggtttacccccgggggtccccgggttttaaaaacccgggggtacccggggtacccggttaaaccgggggtttacccggggggtaaacccccggggttccccggggggttaaacccggggggggtaaaccccggtaaaaaccccggggggg

SEQ ID NO: 79769 - DNA, 784 bp, Homo sapiens
  misc_feature: GYAE6OF01AIWY7.25.35.D02.1.454.CMB.1.raw
tcagactgtacagtcacgaccggtgctcgatttagcacacgatagttgggtttgggggggagaggagcccagcactagaagtcggcggtgtttccatccggtgatcagcactgaacacagaggactcagcatggagtttgggctgcgtcttgggttttcctcgttgcttcttttaagaggtgtccagtgtcagatgcaacgtgggcggaggtcggggggagcgtggtccagggccggggaagtcccgtgacgctcgtccgtgtgcagtcgtccgcgtccctaccgtttccggttcgtttgctattccgacgtcgggtccgccgaggtcctccgaggcgaacgggtcgtgggacggtggggtcgccggttcagttacggtggggtagggtagtaaggtaagttaagtcgtacttattttacgagccgtacgtaccgtccggtagggaaccgggtccctacctaccaacccgttccgtaccgtaccggaggtaccggacctacggtaccctaaccgaaacgttaccctttaaccttttactaccggttacggaaacgttaaacgttaacccggtaaaacggtcggtaaaccgtaccggtaaccggaacgtacccgtaccggtaccttcggttacttaaccggttacggtacgggaccggggttacgggttaacgtaacggtaaacgggtaaccgggtaccggggtcccgggtaccgttaccgtaacccgggtgtaaccgggtccggtaaacccgggtccgggttaacggggccccggtaaaccggg

SEQ ID NO: 79770 - DNA, 643 bp, Homo sapiens
  misc_feature: GYAE6OF01ECLIP.25.35.D02.1.454.CMB.1.raw
  modified_base (304)..(304): a, c, t, g, unknown or other
  misc_feature (304)..(304): n is a, c, g, or t
  modified_base (378)..(378): a, c, t, g, unknown or other
  misc_feature (378)..(378): n is a, c, g, or t
  modified_base (458)..(458): a, c, t, g, unknown or other
  misc_feature (458)..(458): n is a, c, g, or t
tcagactgtacagtcacgaccggtgctcgatttagcacacgatagttgggtttggggctctgggagaggagcccagcactagaagtcggcggtgtttccatccggtgatcagcactgaacacagaggactcagcatggagtttgggctgcgctgggttttcctcgttgctcttttaagaggtgtccagtgtcagatgcaacgtggcggagtcgggggagcgtggtccaggccgggaatccctgagactctcctgtgcagtgtccgcgtccaccttccgtcgttttggctattcactgggtcccnccaggcctccgaggcaagggactgggagtggggtggcggtcatagtcggtgggatggaagtatggctattttangcacggtactccggaggaacgggccactcacccatcctccgaggacgacgacgtcctaccgaagaacccttaccttttanccttaggactaattcggaaaacctggaactacgtcgggaaccgtaacaccgggcttacggtacttaattaccggtcggacgggttccgggggtacctagggtaaacggtaaccgggtacggggtacccgggggtacccgttacggtaccggggacctagggtacccggggccggtaccccggggg

SEQ ID NO: 79771 - DNA, 660 bp, Homo sapiens
  misc_feature: GYAE6OF01B6NUZ.25.35.D02.1.454.CMB.1.raw
  modified_base (390)..(390): a, c, t, g, unknown or other
  misc_feature (390)..(390): n is a, c, g, or t
  modified_base (481)..(481): a, c, t, g, unknown or other
  misc_feature (481)..(481): n is a, c, g, or t
tcagactgtacagtcacgaccggtgctcgatttagcacacgatagttgggtttgggggggagaggagcccagcactagaagtcggcggtgtttccatccggtgatcagcactgaacacagaggactcagcatggagtttgggctgcgcttgggttttcctcgttgcttcttttaagaggtgtccagtgtcagatgcaacgtgggcgggaggtcggggggaggcgtggtccaggccggggaagtccctgagactctcctgtgcagtcgtccgcgtcctaccttccgttcgttttggcctattccacgtcgggtccgccaggcctccgaggcaagggctgggaggtggggtggcggtcatagtgggtggagtggaaagtatgacttatttangcagactccggtaggaacgggccctactccacctactccgtaccgaaggacggacacggtccctaacccgaaagtaaccttacccttttanccgtagacctaaagttacgaaacccgtgaaccgtactccggaacgacgacggtctcgttactacttacgcggcgggtccgggtactaggaaacggtaccggtggggtacccggggccgtacgtaaccgggactacggtccgggaacccggtcccggggtcggggaccccgtaaacgggg

SEQ ID NO: 79772 - DNA, 758 bp, Homo sapiens
  misc_feature: GYAE6OF01BPO4D.25.35.D02.1.454.CMB.1.raw
  modified_base (425)..(425): a, c, t, g, unknown or other
  misc_feature (425)..(425): n is a, c, g, or t
tcagactgtacagtcacgaccggtgctcgatttagcacacgatagttgggtttggggctctgggagaggagcccagcactagaagtcggcggtgtttccatccggtgatcagcactgaacacagaggactcagcatggagtttgggctgcgcttgggttttcctcgttgctcttttaagaggtgtccagtgtcagatgcaacgtggcgggaggtcgggggagcgtggtccaggccgggaagtcccgtgacgactctccgtgtcgcgagtcgtccgcgtcctaccgttccgttcgtttggctattccgacgtcggtcccgccaggccctaccgaggtaccgaagggcgtgggtacggtggggtcggcggttacagttaggtgggttaggagttagggaaagttaaagtcgacgttaatttttacgngacgtacgtaccgttccggtaaggaaccggggccctaacgtcctaacccgtacgttacctaccggaaggacgggaccaaggtccccgtaaccgaaacgtaaacccgtttaccgttttaacgtccgtacgtaactaaacgtttaacggaaaacccgtgaaccgtaaccgtaccggaaaccgtacgtaaccgggtcttacgttaccttaacgttccgacgggtaccgggtcggggttacgtaagggaaacccggtaaacgggtaccgggggtacccggggttaccccgtacggttaacccgggagtacccggtaggggaccccgtacccgggggg

SEQ ID NO: 79773 - DNA, 232 bp, Homo sapiens
  misc_feature: GYAE6OF01COGIP.25.35.D02.1.454.CMB.1.raw
  modified_base (220)..(232): a, c, t, g, unknown or other
  misc_feature (220)..(232): n is a, c, g, or t
tcagactgtacagtcacgaccggtgctcgatttagcacacgatagttgggtttgggctcggtactactgctcagcatgggactctgagctcgctgctcaggtcgttcggcggggggacccggttgaccgtcctaggtcagcccaaggctcgccccctcggtcactctcgttccccaccctcctcactgtacagtctgagcgggctggcaaggcgcatagnnnnnnnnnnnnn

SEQ ID NO: 79774 - DNA, 955 bp, Homo sapiens
  misc_feature: GYAE6OF01ET73V.25.35.D02.1.454.CMB.1.raw
tcagactgtacagtcacgaccggtgctcgatttagcacacgatagttggggttgggggggagaggagcccagcactagaagtcggcggtgtttccatccggtgatcagcactgaacacagaggactcagcagtggagtttgggctgcgtcgttgggttttcctcgttgcttcgttttaaggaggtgtccagtgtcagatgcaacgtgggcggagggtcggggggaggtcggtcgggtaccgacgggacccgggggtaacgtccccgtaggacgtaccttcctccgtggtcgcgtacggtcgtccccggtccgttaccccgttacccgtttcccggttcggttttcggacctacgtttccgtaccggttccggggtcccccgacccgtaacgggtcccgttacccggaagggggaccggtaaacgggggtaccggttggggggtaacggggtttcggggggtaccggggtccgggttaacgtaaggtttaacgggttggggggttaggggtaaggttaaaggggtaaaggtttaaaggtcggtaacgtttaagtttttagacggacgtaaacgggtaccgttaccggggtaacgggaaccgggggtaccctaaccgtaacccgtacctaaccgttaccgtacccgggaaacgggtaacctaaacgttaacccggaaacggtaaacccgtaaccccttataaccgtaccgtaacgtaaacgtaaaaccgtaacgtaaacctaacggttacgaagggtaaccggtaacgggaacgggttaccggttaacccggtttaccgttttaagttccgtcgggtacccgtaccgtaaccgttcgggaggtaaccgggttcgggtaaacggttaaagggaaaacggtttcggtaaccgttccctaacccgttaccccggttaccggtaccccggttacccggtcgggtaacccggggtaccccgg

SEQ ID NO: 79775 - DNA, 812 bp, Homo sapiens
  misc_feature: GYAE6OF01A7UP9.25.35.D02.1.454.CMB.1.raw
tcagactgtacagtcacgaccggtgctcgatttagcacacgatagttgggtttgggggggagaggagcccagcactagaagtcggcggtgtttccatccggtgatcagcactgaacacagaggacctcagcagtgggaggtttgggctggccgtcgttgggttttccctcgttgcttcgttttaaggaggttctccgagtgtcagatgacaacgtgggcggagggtcggggggagcggtcggtaccgaggggcccggggtaatcccgtaggacgtaccgtctccgtgtcgcaggtcgtcccgacgtccctaccgttccggttcgttttaggcctcttaccgacgtcgggtccccgccgacggtccctaccggaggaccggaacgggtcgtaggggtagggtggggtcggtaccggtacgtaagttagggtgggggtaacgggtaggttagggtaaacgttagtggtaacttagtttagcgcgtacggttaccgtacggtacgggaaacgggccctaaccgtaccaccgtaacgttccgtacccggaaggtaaccgccgtaacgtacccgtaaaccgaaaaccgtaacctttaccttttacgaccgtactaaaccgttaaacggttaaccggaaaccgtggaaccgtacgaaccgaaccgtacgtccggttacttacgtctttaacgtacgcgggtacccggtaaggtcccgtaaaggaaccggacggggttcggggtaccccggtcgggttaaccgaccgggtacgtaccgggttacgaaccccgggtcgggtcccggggaaacgtaccggg

SEQ ID NO: 79776 - DNA, 795 bp, Homo sapiens
  misc_feature: GYAE6OF01EBM19.25.35.D02.1.454.CMB.1.raw
tcagactgtacagtcacgaccggtgctcgatttagcacacgatagttgggtttgggggggagaggagcccagcactagaagtcggcggtgtttccatccggtgatcagcactgaacacagaggactcagcatggagtttgggctgcgctgggttttcctcgttgctcttttaagaggtgtccagtgtcagatcgcaacgtggcgggaaggtcgggggggaggcggtgggtcccgaggccggggaacgtccccgtggacgtactccgtcctggtgcgagtcgtcccgcgtccctaccgttccggttcgttttggctattccgacgtcgggtcccgccgaggcctaccgagggacgaacggggtaccgtgggtaggtggggtcgggtcggtcagtagtgggtagggagtagggaagttaacgtgtacttaagttttagacgtccgtaaggtaccgttaccgggtacgggaacgggtaccccgaacttcccgaacccgtaacgttccctacccggaaggacgggtaccaaccggtacccgttaacccgaaaacggttaacccgtttaacccttttttaacgtaccgttagtaacccgtaaagtttaacccgggaaaaacccgttggaaaccgtaccgttaccggaaacccgtaccggaccggttctacggttacttaacgttacggtcgccgggtaccggggtactaggaaacgtaccgggtacgggggtccgggtccctaccggacggtccgtaaggtccgggaccggtcccgggttcggggaaccgtaaaccgggg

SEQ ID NO: 79777 - DNA, 718 bp, Homo sapiens
  misc_feature: GYAE6OF01EI65D.25.35.D02.1.454.CMB.1.raw
  modified_base (354)..(354): a, c, t, g, unknown or other
  misc_feature (354)..(354): n is a, c, g, or t
  modified_base (450)..(450): a, c, t, g, unknown or other
  misc_feature (450)..(450): n is a, c, g, or t
  modified_base (542)..(542): a, c, t, g, unknown or other
  misc_feature (542)..(542): n is a, c, g, or t
tcagactgtacagtcacgaccggtgctcgatttagcacacgatagttgggtttggggctctgggagaggagcccagcactagaagtcggcggtgtttccatccggtgatcagcactgaacacagaggactcagcatggagtttgggctgcgtcttgggttttcctcgttgcttctttttaagaggtgtccagtgtcagatgcaacgtgggcggaggtcggggggaggtcgtggtccgaggcccggggtaatcccgtggacgactctcgtgtgactaggtcgtcccggccgttacccctacccgttttccggttcggtttttcggcctagttccgtacggttcggggttaccccnccgacggtcctaccgaggcgaaaggggtctggggtaggtggggtggcggtacaagttaggtgggtagggatagggaagtagtgactttagttttangactaggtaccgtcggtagaaccgggccgtactaccgactacgtccgtaccgaggtacgacacgtccctacaaacgtaacttaccgttttancgtacaacttaacgttagaacgtgaactacgtaccgacgtaccgcggtaccttgtacttaacggttacgccggggtaccgttacgggggtataagggaaacccggaccgggtaaccgggggttcccggtccgttaccggtaacggccggtccggttacggggcccgtacccggggg

SEQ ID NO: 79778 - DNA, 852 bp, Homo sapiens
  misc_feature: GYAE6OF01BGCOU.25.35.D02.1.454.CMB.1.raw
tcagactgtacagtcacgaccggtgctcgatttagcacacgatagttgggttggggggggagaggagcccagcactagaagtcggcggtgtttccatccggtgatcagcactgaacacagaggactcagcagtgggtagtttgggctggcgtcgttgggttttcctcgttgtcttacgttttaaggaggtcgtccagtgtcagatgcaacgtgggcgggagggtcggggggaggtcggtcggtccgaggggcccggggaactcccgtggacgtaccgtccgtccgtggtcgcgtacggttccggtcccggtccgttccccgttacccgttttccggtttccggtttttcggaccttaacgttccgtaccggttccggggtaccccgacccgtaacgggtcccgtacccggagggaccggtaaacgggggtcgttcgggggagggttcggggtacgggtcggttacgtaaggttagggtgggggtagggtaagtagggtaaagtaagtcggtaactttaagtttacgcgtacggtaacgtaccggtaccgggtaacggaaccggggtacccctaacgtacccaaccgtactccccggtacgacgggtacggaccgtaaccgtacccgtaacgtaaaccgttaacctttacgtttaacgccgttacgaaacttaacggtaaccgaacgtgaaccgtaccgacgaacgaccgtacgtacttacgttctaacggtcgacggtccgggtacggtacgtaacggaaaccggtccgggtaccggggtccggtaacccgtaggtaccggtacgtaccgggtccgggaccggacgggtaccggggtaaacccgtaccgggg

SEQ ID NO: 79779 - DNA, 764 bp, Homo sapiens
  misc_feature: GYAE6OF01D6823.25.35.D02.1.454.CMB.1.raw
  modified_base (564)..(564): a, c, t, g, unknown or other
  misc_feature (564)..(564): n is a, c, g, or t
tcagactgtacagtcacgaccggtgctcgatttagcacacgatagttgggtttggggctctgggagaggagcccagcactagaagtcggcggtgttccatccggtgatcagcactgaacacagaggactcagcagtggagtttgggctgcgtcgttgggttttccctcggttgtcttacgttttaaggaggtcgtccaggttgtcaggatgacaacgtggcgggagggtcgggggagcgtggtccgaggccgggaatcccgtgacgctcgtccgtgtgcgtagtcgtcccgtcgtccctaccgttccgttgtttcggctacgttcgacgtcgggtcccgcgtacggccgtaccgaggacgaagggtcgtgggaggttcggggtggtccggtactagttaggtgggtaggggagtagggtaaagtagtcgtactttaagttttacgacgtacgtaacggtaccgttacgggtaacggaaccggggtaccctacctaccgaacctacgtcccgtaacggaaggacggtcaacggtaccctaaccgaacgttaaccttaccttttancgtacgaacttaagttaccgggaaacgtgtaacggtaccgtaccggtaaccgtaccgtaccggtattaccggttacttaacgttaccggcgggtacccgggttacgggtaacctaagggaaaccggtaccggggttacggggtcccgggttaccgtacgtaacgggtcgtaccgggtacggggtcccggtaacccggggg

SEQ ID NO: 79780 - DNA, 930 bp, Homo sapiens
  misc_feature: GYAE6OF01EYYCI.25.35.D02.1.454.CMB.1.raw
tcagactgtacagtcacgaccggtgctcgatttagcacacgatagttgggtttggggggggagaggagcccagcactagaagtcggcggtgtttccatccggtgatcagcactgaacacagaggactcagcagtggaggtttgggctgcgtcgttcgggtttttcctcgtttgtcttactttttaaaggaggttcgttaccaggttgtacagatgactaacgtgggccgggaggggtccgggggggaggtcggtcgggtaccgacggggaccgggggtaacgttccccgtaggtaacgtaccttccgtccgtggtggaccgtaggttcggtcccggccgttcccctacccgtttccggttcggttttcggacttacgttccgtacggttcgggtcccgccgacggtcctaccggacgggacggaacggggtcgtaggggtacgggttcgggggtcggtaccggtactaggtttacgggtggggtaggggtaggtaacggggtaaagtttaaacgtggtaactttaaggtttttacgacgtacccggtaaacggtacccggttccgggtaacgggaaaccgggtcccgtaaccttaccgaaccgttacttcccgtaaccggagggtaccgtacccgtaacgttacccctaaacccggtaaagttaaccccttttaacccgtttttaacgccgttaaacgtaacgtaaacggtttaacccggaaacggttacgggaacgtaaccggtaccggaaccggtaccggaacgtttcgttacggtttaccgttaagttccggtcgggtcggggtacccgggttataaaccggggaaacggtaaccggggttcgggggtaccccgggttcggtacccgggtacccggaggtacccgggacgggtacccgacccggggttaggggccccggtaaacggg

SEQ ID NO: 79781 - DNA, 803 bp, Homo sapiens
  misc_feature: GYAE6OF01A0LWG.25.35.D02.1.454.CMB.1.raw
tcagactgtacagtcacgaccggtgctcgatttagcacacgatagttgggtttgggggggagaggagcccagcactagaagtcggcggtgtttccatccggtgatcagcactgaacacagaggactcagcatggagtttgggctgcgctgggttttcctcgttgctcttttaagaggtgtccagtgtcagatgcaacgtggcggaggtcggggggagcgtggtccgaggcccggggaatccctgacgacctctccgtgtgcagtcgtccgcgtccaccttccgtcgtttaggctacttcacttcggtccgccgacgctccgaggccaaggggtcctgggtacgtgggtggcggtcgagtaggtgggtagggtagtacgggtaagttaagtcggtacttaagtttttagacggtacctaacggtaccgttaccgggtagggtaaaccggggccgtaacccgtaccgaacccgtacgttcccgttaaccggaacggtacgggacccgtacggtaccccgtaaaccgtaaacggtaaacccttttaacccgtttttaacgtcccgttaacgtaacccgttaaacgtttaaccgggaaaaccccggtgggtaacccggtaacgtaacccggtaacggaccgtaccgggttacttaccggttacttaacgttacgtcgggtccgggtaccgggttcaacgggtaacgtaaacccgggttcggggacccgggttacccgttacgtaacccgggtacctacgggtaccgggacccgggtcccgggttaacggggacccggtaaaccgggg

SEQ ID NO: 79782 - DNA, 722 bp, Homo sapiens
  misc_feature: GYAE6OF01DTQCL.25.35.D02.1.454.CMB.1.raw
  modified_base (318)..(318): a, c, t, g, unknown or other
  misc_feature (318)..(318): n is a, c, g, or t
  modified_base (407)..(407): a, c, t, g, unknown or other
  misc_feature (407)..(407): n is a, c, g, or t
tcagactgtacagtcacgaccggtgctcgatttagcacacgatagttgggtttggggggggagaggagcccagcactagaagtcggcggtgtttccatccggtgatcagcactgaacacagaggactcagcatggagtttgggctgcgcttgggttttcctcgttgcttcttttaagaggtgtccagtgtcagatgcacgtggcggaggtcggggggaggcgtggtccgaggccggggaagtccctgacgactctcctgtgcagtcgtccgccgtcccaccgtttccgttcgttttggctattccgacgtcgggtccnccgacggtcctccgaggacgaagggcgtgggacggtgggtggcggtctagtagtgggtaggagtaggtaagtatgtacttaattttagngacagtacctccggtaggaacgggcccgactccaactactcctaccgaggacgcacgaccctaaccgaaacgtaacccttacctttttacgacgttacaaccgtaaagtttaaccggaaacccgtagaacgtaaccgtaccggaacccgtaaccgtaccgggtcttacgtttacgttaacgttccggtcgggtacccgggtacggggttaccgtagggaaaaccggtaccgggtaggggggtcccgggtacccgtacggtaccgggagtacggtcccgggaccggtaccccgggtaggggacccgtaaaaccggg

SEQ ID NO: 79783 - DNA, 774 bp, Homo sapiens
  misc_feature: GYAE6OF01D7SGT.25.35.D02.1.454.CMB.1.raw
  modified_base (349)..(349): a, c, t, g, unknown or other
  misc_feature (349)..(349): n is a, c, g, or t
  modified_base (378)..(378): a, c, t, g, unknown or other
  misc_feature (378)..(378): n is a, c, g, or t
tcagactgtacagtcacgaccggtgctcgatttagcacacgatagttgggtttgggctctgggagaggagcccagcactagaagtcggcggtgtttccatccggtgatcagcactgaacacagaggactcagcagtggtagtttgggctgcgtcttgggttttcctcgttgcttcgtttttaaagaggttgtccagttgtcagtatcgacaacgtgggcggtagggtcgggggatcggtcggtccgacgggccgggtaacgtccccgtagaacgtccttccgtcgtgtcgctaggtcgtccgccgtcccttaccgttccgttcgtttcgctacttcgacgtcggtcccncgtacggcgtaccgaggcgaggacgtggnggtgggtggcgtacgtagtggtcggtaggtacgtaggaagtacgtgtaccgttaagttttagacggtactacggtaccgttaccgggaggtaaacccgggccgtaaccttacccgaaccgttactacccgtacggaacgtaccggacgtacgaacccgttaacgtaaccgttaaaccctttacccttttaccgtacgtacgtaacgtaacgttaaaccgtaacgtacgacgtaacccgtaccgggaccgttaaccggccgtacgtttaccgttaacgtacgtttccggcggtaccgggttacgggtaacgtaggaaacccggttacggggacgggtaccccgggttaccggtacccgggttaacgacggtaccgggtccggccgggtaccccgggg

SEQ ID NO: 79784 - DNA, 1010 bp, Homo sapiens
  misc_feature: GYAE6OF01BYYU5.25.35.D02.1.454.CMB.1.raw
tcagactgtacagtcacgaccggtgctcgatttagcacacgatagttgggtttggggctctgggagaggagcccagcactagaagtcggcggtgtttccatccggtgatcagcactgaacacagaggactcagcatggtagtttggctgcgtcgttgggttttcctcgttgtcttacttttaaggaggtgtccgagtgtcagatgacgaacgtggcggaggtcgggggagcgtggtccgaggccggggaagtcccgtggacgtaccttccgtccgtggtcgcgtaggtcggtcccgtccgtccctacccgtttccggttcgttttcggactacgtttccgaccggttcggggtccccgccggtacgggtccctaccggaacgggtaccggtaaacggggtaccgttggggtaacgggttgggggtcgggtaccgggttactaacggttagggttagggtaggggtaagtaggggtaaagttaagtgtacttaagttttagcggtacgtacggtaccgttaccggtaggaaaccgggtccctaacctaccgacccgtaacgttaccgtacccgaaggtaaccggtaccgtaacggtaaacccgttaaaccgaaaaccggtttaaaccctttaacccgttttttaacgtaaccgttaccggtaaaaccgtttaaaacggtttaaaacccggtaaaaacccgggttacgggtaaacccggtaaaccccggtttaacccgggtaaaaccccggtaaacccgggtaacccgggttaccgtttaaccgggtttaaccccgtttaaacgggtttaaccgggtacccgggggtaacccggggttacccggggggtttaacctaaaaccggggggtaaaacccgggtttaaaaccccgggggtaacccgggggggtttaaccccgggggttaaccccccggttaaccgggttaaacccgggggaacccgttaaacggggttacccccgggggggtaaccccggtaaccccccggggggg

SEQ ID NO: 79785 - DNA, 791 bp, Homo sapiens
  misc_feature: GYAE6OF01DLBP9.25.35.D02.1.454.CMB.1.raw
  modified_base (635)..(635): a, c, t, g, unknown or other
  misc_feature (635)..(635): n is a, c, g, or t
  modified_base (665)..(665): a, c, t, g, unknown or other
  misc_feature (665)..(665): n is a, c, g, or t
tcagactgtacagtcacgaccggtgctcgatttagcacacgatagttgggtttggggctctgggagaggagcccagcactagaagtcggcggtgtttccatccggtgatcagcactgaacacagaggactcagcagtggagtttcgggctgcgtcgttcgggttttcctcgttgtcttctttttaaggaggtgtccagtgtcagatgcaacgtgggcggagggtcggggggagcggtcggtacccgaggcccgggggtaactcccgtggacgtacctcttccgtaggtgacctaggtcgtcccgtcccgttaccctacccgtttcccggtttcggtttacggacttacgttaccgtacggtccggggttaccccgccgtacgggtccttacccgggagggtaccgaacggggtaccgttggggacggttggggtcgggacggtcgtaagttacggtgggggtaggtagtaacgggaagttaagttcggtactttaagtttttaggaccgtacgtaaccgtaccggttacccggtaaggggtaacccgggtcccgaaccgttacccctaaccgtacgtttacccacggaacggtaccggcacgtaccgtaacccgaaattaccgttaccgttttanccgtacgacttaagtaacggtaaaccggtntaacgggtaccctaccgggtaaccgaccgtacggtacttacgttactaagttcgtggacccggtgggtacagggaacgtacggcggggttccggaccgtacggtacgacgtggtccggccgtcggg

SEQ ID NO: 79786 - DNA, 730 bp, Homo sapiens
  misc_feature: GYAE6OF01D86ID.25.35.D02.1.454.CMB.1.raw
  modified_base (187)..(187): a, c, t, g, unknown or other
  misc_feature (187)..(187): n is a, c, g, or t
  modified_base (275)..(275): a, c, t, g, unknown or other
  misc_feature (275)..(275): n is a, c, g, or t
  modified_base (331)..(331): a, c, t, g, unknown or other
  misc_feature (331)..(331): n is a, c, g, or t
  modified_base (350)..(350): a, c, t, g, unknown or other
  misc_feature (350)..(350): n is a, c, g, or t
  modified_base (368)..(368): a, c, t, g, unknown or other
  misc_feature (368)..(368): n is a, c, g, or t
  modified_base (470)..(470): a, c, t, g, unknown or other
  misc_feature (470)..(470): n is a, c, g, or t
tcagactgtacagtcacgaccggtgctcgatttagcacacgatagttgggtttgggggggagaggagcccagcactagaagtcggcggtgtttccatccggtgatcagcactgaacacagaggactcagcatggagtttgggctgcgtcgttgggttttcctgtttgctttcgttttaaagacggtntaccagtgtcagtagtgacacgtgggcggaggtcgggggagcgtggccacggcgggtaactcctagagtccttcgtccgtggtcgacngtccgtccgtcgtccctaccgttccggtttgttcgctacttcacgtcggtccacgngctccggagcgaaggtcgnggtaggtgggtggcgtanagtcgttgggtaggatagggtagtaagtcgtacttagtttacggtaacctagtaccgttcgggaagacggtcccacttaccgactacgttccgacgtaacgnggaactacgtactaaccgtaaacgtaactttaccgtttacacgtagtacctaaacgtacggtaaacgtcgtacggtactaccggaacgtaccggttaccgtatttaccgttacgttacgttaccgggtacgggtacccggtacgggttagaaacgggtaaacccgggtaacgggtcccggggtaacccgggtctaacccgggagtaacccgggttacggcgggtaaaccccgtcccgggtaaaggggccccggtaaacgg

SEQ ID NO: 79787 - DNA, 763 bp, Homo sapiens
  misc_feature: GYAE6OF01B9LNU.25.35.D02.1.454.CMB.1.raw
  modified_base (180)..(180): a, c, t, g, unknown or other
  misc_feature (180)..(180): n is a, c, g, or t
  modified_base (248)..(248): a, c, t, g, unknown or other
  misc_feature (248)..(248): n is a, c, g, or t
  modified_base (441)..(441): a, c, t, g, unknown or other
  misc_feature (441)..(441): n is a, c, g, or t
tcagactgtacagtcacgaccggtgctcgatttagcacacgatagttgggtttggggctctgggagaggagcccagcactagaagtcggcggtgtttccatccggtgatcagcactgaacacagaggactcagcatggagtttggctgcgcttgggttttcctcgttgcttcttttaagnggtgtccagtgtcagatgcaacgtggcggaggtcgggggagcggtggccgaggccggggaactcccgngacgtactcgtccgtgtgcgtagtcgtccgtccgtccctaccgttccgttcggttttggctagttccgacgtcgggtccgccgtaggcctccgaggacgaaggggaccttagggtacggtggggtacgggcggttacgacgttaggtgggtagggtagtagggtaagttaagtcgtacgttacgtttttaacnggtactacggtaccgttaccgggtaggaaacggggtacccgtaccgtacccgaaccctacgttccgtaccccggaaggtacggacccgtaacggtacccgtaacccgaaacggttaaccctttaacccgttttacgccgttacgtaaacctaaggtttaaaccgaaaccgtgaaccggttaccgaccggtaaccgaacgtaccggttacgttacttacgttaccgtaacgtcggaccgggttacggtacgtacggaacggtaccgggtaccggggtacggtccccgtaggtaccggtagacggtcgggaccgtacccggggg

SEQ ID NO: 79788 - DNA, 863 bp, Homo sapiens
  misc_feature: GYAE6OF01B32VD.25.35.D02.1.454.CMB.1.raw
  modified_base (180)..(180): a, c, t, g, unknown or other
  misc_feature (180)..(180): n is a, c, g, or t
tcagactgtacagtcacgaccggtgctcgatttagcacacgatagttgggtttgggggagaggagcccagcactagaagtcggcggtgtttccatccggtgatcagcactgaacacagacggactcagcagtggtagtttggctgcgcgttcggttttcctgttgacgttgttttaaggnggttgtccgagttgtcgagatgacgacgtgggcggagggtcggggaggtcgtggtaccgacgggccggggtaacgtcccgtggacgtacctccgttccgtaggtcggcgagttccggtacccgtccgttacccgttacccggttttccggtttacggtttttcggaccttacgtttaccggtaccggttccgggttaccccgacccggtacggtaccgtaccccgggacggtaaccgggtaacgggtcgttaggggacgggtttacggggtcgggtacggtacgttacggttagggttaggggtaggtaacggttaaggtaaacggttaattcggtaacgtttaagttttacggacgtaaccgtagttacccggtacggtacgggaacccggtcccgtactacccgtaccgtaccgttaccgtaccggaacggtaccgtaaccgtacgttaacccgtaaccggttaaacctttaacccgtttaccttttacgtaccgtaacgtaacgtaaacggttaaccgtaaacgtggaccgtaacgacgtaaccgacgtaccggttacgttagtccgttaacgttacgccggttaccggaggtccgtaaacgggtacggacggttacggggtccggtaccgtcgacgggtacgtaccggacggtaccggtacggccgggtacgaaccggg

SEQ ID NO: 79789 - DNA, 887 bp, Homo sapiens
  misc_feature: GYAE6OF01EJ5R4.25.35.D02.1.454.CMB.1.raw
tcagactgtacagtcacgaccggtgctcgatttagcacacgatagttgggtttggggctctgggagaggagcccagcactagaagtcggcggtgtttccatccggtgatcagcactgaacacagaggactcagcatggagtttgggctgcgcgttgggttttcctcgttgcttcttttaagaggtgtccagtgtcagatgcaacgtggcggaggtcggggggagcggtcggtccgaggcccggggtaatcccgtgacgtactcctccgtgtagtcgtagttcggtacccgtccgttaccctacccgtttccggttcggttttcggactacgttccgacggttccggggtacccgaccgacggggtccctaccggaacggggtacgaacggggtacgtggggtaacgggttggggtcgggaccggttacgtaggttaggtggggtaggggaagttaggggtaaaagttaacgttcggtactttaagttttaaggacggtacgaacggtacccgttaccgggtaacgggaaaccgggtccctaacgtaccgtaaccctacgttaccgtaccgaacgggtacgtaccgtacggtaccctaaccgtaaacgtaaccctttacgttttacgccgttaacgtaacgttaaacggttaacgtaaaacccggtggaaacccgttacggtaacccgggtaacccgtaaccgggtaacccggttcgtttaaccggttaacgttaaccgttacgggtcccgggtacccgggggttaccgggttaaccgttaagggaaaaccgggtcccgggttaaccgggggtccccgggttaaccccggtaacccgggttaacgggaccgttaacggggtccccgggtaccgggtaacccccggggg

SEQ ID NO: 79790 - DNA, 933 bp, Homo sapiens
  misc_feature: GYAE6OF01CRX0U.25.35.D02.1.454.CMB.1.raw
  modified_base (175)..(175): a, c, t, g, unknown or other
  misc_feature (175)..(175): n is a, c, g, or t
  modified_base (393)..(393): a, c, t, g, unknown or other
  misc_feature (393)..(393): n is a, c, g, or t
tcagactgtacagtcacgaccggtgctcgatttagcacacgatagttgggtttgggggggagaggagcccagcactagaagtcggcggtgtttccatccggtgatcagcactgaacacagaggactcagcatggtagttgggctgcgcttgggtttcctcgttgcttctttaagnggtgtccagtgtcagatgacgaacgtgggcgggagggtcggggggagcggtcggtacccgagggcccggggtaattccccgtagaacgtcctccgttccgtggcgcgtaggttcggtcccgccgtccctaccgtttccggttcgttttggctattccacgtcggtcccgcgaggcctccgaaggcgaacgggtcgtggacggtggggtggccggttanaagttaggtgggtagggagtagggaaacgttactggtacttagttttacgaggacctacggtaccgttacccgggtaagggtaaccgggtcccgtaacttacccgaacccttacgtacccgtaaccgaacgggtaccgggtaccaaacggttacccccgtaaaccgtaaacgttaaaccccgttttaccgttttaacctaccgttaaccggtaaaccgtttaaacgtttaaaacccgggaaaaacccggttacgggaaacccgtaaccccgggtttaaccgaaaccccgggttaacccggtaaccccggttaaccgggtttaccttaaacccgttttaacgggtttaccggtccgggggttaacccggggttacccggggttaacgtaaaccggggtaaaacgggtaaaccccgggggttcccggggggttaccccggggttaccccggttaaccgggtaaacccgggtacgtaccggggttacccggggaccccgggttaacccgggggcccgggggtaaacccggtaaaccccggggg

SEQ ID NO: 79791 - DNA, 880 bp, Homo sapiens
  misc_feature: GYAE6OF01DKIUE.25.35.D02.1.454.CMB.1.raw
  modified_base (190)..(190): a, c, t, g, unknown or other
  misc_feature (190)..(190): n is a, c, g, or t
  modified_base (640)..(640): a, c, t, g, unknown or other
  misc_feature (640)..(640): n is a, c, g, or t
tcagactgtacagtcacgaccggtgctcgatttagcacacgatagttgggtttgggggggagaggagcccagcactagaagtcggcggtgttccatccggtgatcagcactgaacacagaggactcagcagtggtagtttgggctgcgtcgttcgggttttccctcggttcgtctttacgttttaaaggngggtcgtccgagtgtcagatgacaacgtgggcgggagggtcggggggaggcggtcggtccgacgggcccggggtaatcccgaggacgtacctccgtccgtgtggctacgtcgtcccgccgtcccgtaccgtttcccggttgtttcgacttacgttccgacggtccggtccgccgacggtcctaccggacgggacggaacggggtacggtcggggtagggttcggggtcgggaccgttacgtaggttagggttacggggtagggtaagtagggtaaagtttagtacggtacttttaagtttacgtcgggtaactaacgtacccgttacggggtacgggaaccggggtaccccaacgttacccgaacccgtacgttaccccgtacgggaaccggaacgtcccgtaacggtacccttaaccgtaaaacgtttaacccttacgtttttaacccncggttaacgtaaccgtaaaggttaaacccggtaaaaccggtacggtaacctaccggtaccggaaaccgttacggaccggttcgttaacgttaccttaaggttcccggtcgggacccgggttacgggtacccgtaaagggaaacccggtaaccggggtacccgggttccgggtcccgtacggaaccggtcgtaaacggttccggggaccggttaccgggacggggtaacccgaaaccgggg

SEQ ID NO: 79792 - DNA, 844 bp, Homo sapiens
  misc_feature: GYAE6OF01EUW5G.25.35.D02.1.454.CMB.1.raw
tcagactgtacagtcacgaccggtgctcgatttagcacacgataggttggggtttgggggggagaggagcccagcactagagtcggcggtgttccagtccggtgatcagcactgaacacagaggactcagcagtggtagtttggctgcgtcgttcgggttttcctcgttagtccttacgttttaaggaggttcgtaccgtagtgtcagtacgtgacgtacggtgggcggtagggtccggggggagtccggtcggtaccgagggaccggggtaactcccgtagaacgtcctctccgagtgacgtcgtcggcccgtaccgtcctaccgttccgttcgttacggggctactcgtacgtcggtccgcgacggccgtacggaggacgtaggtacgtaggtcgggtacggtcggtcgtacgtagtaggtggtagggtagtaaggtaacgtacgtagttacgttaagttacgtacgtaacggtaacggtcggttacggtaacggggtaacgtacccggtactacccggtactaacgtccgtaaccggtaacggaccggtacgtaccgtaacccgtaaccgtaaacgttaacccggttactttaacggttacgtacgttaaccgttaacgtaaccggtaacgtaccgtaacgtaccgtaaccggaaccgttaccgtaacgttaccgttacgttaagttaccgttacggtccggtacgggtacgggttaaccggtaaaggtaacccgggtaacgggttaccggggaacccgggttccggtaacccggtacggtaaccggtacgggttacgggaacccggttccggggtaaacccgggacccggtaaaccgggg

SEQ ID NO: 79793 - DNA, 865 bp, Homo sapiens
  misc_feature: GYAE6OF01ADT45.25.35.D02.1.454.CMB.1.raw
  modified_base (206)..(206): a, c, t, g, unknown or other
  misc_feature (206)..(206): n is a, c, g, or t
  modified_base (672)..(672): a, c, t, g, unknown or other
  misc_feature (672)..(672): n is a, c, g, or t
tcagactgtacagtcacgaccggtgctcgatttagcacacgatagttggggtttgggggggagaggagcccagcactagaagtcggcggttgttccatccggtgatcagcactgaacacagaggactcagcagtggtaggtttgggctgcgtcgtttcgggttttcctcgttgtcttacgtttaaggacggtgtccagtgtacagntcgcacggtgggacgggaggggtcggggagcgtcggtccgacgggccgggtactccgtgactctccgtcgtaggtcgcgtacgtccgtcccgccgttacccttcgtttccggttcgttagcttctcgtcggtccgggccgcctaggtccgtaccgggaggaccggtacgggtacgtggggtgggtcgggtcggtctaggtagttgggtggggtacggtagtaggtaacgtaagttccgtagtttataggcgtacgtacggacggtttcggaaacggtaccgggtcctacctaccgtacctaccgttaccgacggtaaccgggtctaccggaaaccgttaaccctaaaccgttaaaccgtttacctttaacccgtttgtaaccgttaacggtaaacccttttaacggttaaaccccggggtaacgtacccggtaaaccgggttaacccgtacccggaaaccccgggngtttaacccgttacgttaacccgtttaggttacccgggttacccgggacgggttccccggggtaacggtttaaaccgaacgggtaaccccgggggtacggggttccccggggtacgtcccggtaccggaaaggtcccggtacggggtaacccgtaccccggggcggggaaaccggttaaccgtaacccggggg

SEQ ID NO: 79794 - DNA, 717 bp, Homo sapiens
  misc_feature: GYAE6OF01A6Z51.25.35.D02.1.454.CMB.1.raw
  modified_base (349)..(349): a, c, t, g, unknown or other
  misc_feature (349)..(349): n is a, c, g, or t
  modified_base (509)..(509): a, c, t, g, unknown or other
  misc_feature (509)..(509): n is a, c, g, or t
tcagactgtacagtcacgaccggtgctcgatttagcacacgatagttgggtttgggggggagaggagcccagcactagaagtcggcggtgtttccatccggtgatcagcactgaacacagaggactcagcatggagtttgggctgcgcgttgggttttcctcgttgcttcttttaagaggtgtccagtgtcagatgcaacgtgggcggaggtcggggggaggcggtggtccgacgggccggggaacgtccctgacgactctcctgtcgcgtagtcgtccgcgtccctccgttccgttcgtttgctattcacgtcggtcccgcgacgcctcgaggcgaagggacgtgggnggtcgggtggcgtctagtaggtgggtagggtacgtagggtaagtagtcgtacttagtttagacgcgtaacgtaccgtccgggtacgggaaccggtaccgtactaccaccgtactccgtaccgaggacggccacgtccctaacgaactaccttactttacncacgtactaacgttaacgaacgtgaaccgtacgtaccgaaccgtacgtacggtcttacgtacgttaacgtacgtcggaccgggtaccggtacgaaaggggtaacggtaaccgggtcgggggtccccggggtaccgttaacccgggtccgtaaccggttcgggacccggacccgggtaccggggtaccggggaacccgtaaacccgggg

SEQ ID NO: 79795 - DNA, 689 bp, Homo sapiens
  misc_feature: GYAE6OF01A48GQ.25.35.D02.1.454.CMB.1.raw
  modified_base (354)..(354): a, c, t, g, unknown or other
  misc_feature (354)..(354): n is a, c, g, or t
  modified_base (361)..(361): a, c, t, g, unknown or other
  misc_feature (361)..(361): n is a, c, g, or t
  modified_base (397)..(397): a, c, t, g, unknown or other
  misc_feature (397)..(397): n is a, c, g, or t
tcagactgtacagtcacgaccggtgctcgatttagcacacgatagttgggtttggggctctgggagaggagcccagcactagaagtcggcggtgtttccatccggtgatcagcactgaacacagaggactcagcatggagtttgggctgcgcttgggttttcctcgttgctcttttaagaggtgtccagtgtcagatgcaacgtggcggaggtcgggggagcgtggtccgaggccgggaagtccctgacgtactctccgtgtcgcagtcgtccgcgtccctaccgttccgttcgtttcggctattccacgtcgggtccgccgaggcctccgaggcgaagggcgtggaggtgggnggcggtnagtagtggtggagtggaaagtactgactagttttangtactagacgttaccggaggaaccgggtccaactaccgacctacgtccgtaccgaggtacggacacgtacctaacccgaagtaaccttacctttaactcctagactaagttacgaaaccgttgaacgtacgtacgtaacccgacgtaccggtactacggtaccttaacgttaccgtcgggtaccgggtaccgggttacgttaacgggaaacggtaacccgggtacggggtacccgggttacccggttacggtacccgggtacgtaccggtacggggtcccggtaacccgggg

SEQ ID NO: 79796 - DNA, 794 bp, Homo sapiens
  misc_feature: GYAE6OF01EZOX7.25.35.D02.1.454.CMB.1.raw
  modified_base (188)..(188): a, c, t, g, unknown or other
  misc_feature (188)..(188): n is a, c, g, or t
  modified_base (760)..(760): a, c, t, g, unknown or other
  misc_feature (760)..(760): n is a, c, g, or t
tcagactgtacagtcacgaccggtgctcgatttagcacacgatagttgggtttggggctctgggagaggagcccagcactagaagtcggcggtgtttccatccggtgatcgagcactgaacacagaggactcagcagtgggtagtttgggctgcgtcttgggttttcctcgttgcttcgtttttaagnggttgtccagtgtcagatgacaacgtgggcgggaggtcggggggagtcggttcggccgagggcccggggtaagtcccgtggacgtcctctcgtggtgccagtcgtccgaccgtccctacgtttccggttcgtttggcttattccacgtcgggtccgcgacggtcctcgaggacggaacgggtactggggaggttggggacgggtccggtacgtagtaggttggggagggtaagtacgggtaaagtaaggttcgtacgtttaagttttacggtacggcgtaaacggtacccgttacgggtaagggacccgggacccgtactacccgtaccctaacgttcccgacggaggtacgcccgaacgttcccgaaacccgtaaaccgtttaacccttacccgtttttaagacccgttaacgtaaacccgttaacggtaaaaccggtaaaccgttggtaaaaccgtcccgtaacccgggtaacgtaccccgaaggttcgtacccgtttataaaccggttaccggcgttacccggggtacggttgaaacggtaagaccggggtacgggtccggttacccgngttacccggagtacggtcgggacccggttcgggg

SEQ ID NO: 79797 - DNA, 800 bp, Homo sapiens
  misc_feature: GYAE6OF01A01RO.25.35.D02.1.454.CMB.1.raw
tcagactgtacagtcacgaccggtgctcgatttagcacacgatagttgggtttgggggggagaggagcccagcactagaagtcggcggtgtttccatccggtgatcagcactgaacacagaggactcagcatggagtttgggctgcgctgggttttcctcgttgctcttttaagaggtgtccagtgtcagatgcaacgtggcggaggtcggggggaggcgtggtccgaggcccgggggaagtccccgtgagacctctccgtgtgcagtcgtccgcgtcctaccttccgttcgttttggctattccacgtcgggtcccgccgacggcctccgagggaccgaacggggactggggaggttgggggtcgggcggttacagttaggtggggtagggtagtaggggtaaagttaaagtggtacttaagtttttatcggacgtaacggtaccgttacccggggtagggaaacggggtccccgtaacgtaccctaacccgtacttcccgtacccgaagggaacggacctaacggtccctaacccgaaacgtaaaccctttaccctttttactccgttacgtaccttaaaacgttaccggtaaaacccggttcgaacgtacccgttaccggaaccgtaaccgtaccgggtacttacggttaccttaacgtttaccgcgggtccgggtaccggggttactaagggaaacggtaccggtacgggggttcccgggggtcccgttaaccggtacccgggtacgtaagggtaccgggacccggtcccggggtcggggaacccgtaaaccgggg

SEQ ID NO: 79798 - DNA, 585 bp, Homo sapiens
  misc_feature: GYAE6OF01ESOJ0.25.35.D02.1.454.CMB.1.raw
  modified_base (194)..(194): a, c, t, g, unknown or other
  misc_feature (194)..(194): n is a, c, g, or t
  modified_base (372)..(372): a, c, t, g, unknown or other
  misc_feature (372)..(372): n is a, c, g, or t
  modified_base (437)..(437): a, c, t, g, unknown or other
  misc_feature (437)..(437): n is a, c, g, or t
  modified_base (506)..(506): a, c, t, g, unknown or other
  misc_feature (506)..(506): n is a, c, g, or t
tcagactgtacagtcacgaccggtgctcgatttagcacacgatagttgggtttggggggggagaggagcccagcactagaagtcggcggtgtttccatccggtgatcagcactgaacacagaggactcagcatggagtttgggctgcgctgggttttcctcgttgctcttttaagaggtgtccagtgtcagatncaacgtggcggaggtcggggggagcgtggtccagccggggaatccctgagactctcctgtgcagtgtccgcgtccacctttccgtcgtttggctattcacgtgggtccgcagcctccgaggcaaaggggctggagtgggtggcggtcagtatggtggatggaagtaatgactatttangacagactcgtagaacgggccacgtcacctatctacagaggcagctaccaagtaactacttttanactgtactaaattacggaaaacgtgaacgactaccgaacgacacgggtcttaggtctaacgtttaccgngaacggtccggggtatagaaacggacgtaggggtcccggcgtacgtacgactagagggacctcgggcgggaccgaacgg

SEQ ID NO: 79799 - DNA, 746 bp, Homo sapiens
  misc_feature: GYAE6OF01EMF3T.25.35.D02.1.454.CMB.1.raw
  modified_base (193)..(193): a, c, t, g, unknown or other
  misc_feature (193)..(193): n is a, c, g, or t
tcagactgtacagtcacgaccggtgctcgatttagcacacgatagttgggtttgggggggagaggagcccagcactagaagtcggcggtgtttccatccggtgatcagcactgaacacagaggactcagcagtgggtaggtttgggctggcgtcgtttcgggtttttcctcgtttgtcttactttttaaaggnggttcgtccagtgtacaagatgacgaacggtgggacggggaggggtcgggggggacggtcggttcggtacccggacgggacccgggggtaacttccccgtaggacgtaccttcctccgtggtcgcgtacggttccgtcccgcccgttccctacccgtttccggtttcggttttcgacttacttccgaccggttcgggtccccgccgtacggtccgtaccgagggaccgaagggggtcgtgggagggttggggtcggtcggtatagttgggtagggtggtaaggtaggtaacgttagtcgtacttagtttagcgtacgacgtaccgtcgggtaagggaccgtaccgactaccgacctcgtaccgtacggagacggcgtaccgaccttaaaccgaacttaccgtttaccttttcaccgttatacgtaacgtacgaaaccgtgaacggtacgcgaaccgtcgtacgttcttacgttctacgtcggccgtggcgtagacgtacggtacgggcgggtcgtccgacgtgccgtagacggccggtcgggcggcgtaacgg

SEQ ID NO: 79800 - DNA, 789 bp, Homo sapiens
  misc_feature: GYAE6OF01DNTX1.25.35.D02.1.454.CMB.1.raw
  modified_base (105)..(105): a, c, t, g, unknown or other
  misc_feature (105)..(105): n is a, c, g, or t
  modified_base (182)..(182): a, c, t, g, unknown or other
  misc_feature (182)..(182): n is a, c, g, or t
  modified_base (186)..(186): a, c, t, g, unknown or other
  misc_feature (186)..(186): n is a, c, g, or t
  modified_base (198)..(198): a, c, t, g, unknown or other
  misc_feature (198)..(198): n is a, c, g, or t
  modified_base (225)..(225): a, c, t, g, unknown or other
  misc_feature (225)..(225): n is a, c, g, or t
  modified_base (410)..(410): a, c, t, g, unknown or other
  misc_feature (410)..(410): n is a, c, g, or t
  modified_base (471)..(471): a, c, t, g, unknown or other
  misc_feature (471)..(471): n is a, c, g, or t
tcagactgtacagtcacgaccggtgctcgatttagcacacgatagttggggtttggggggggaggggagcccagcactagaagtcggcggtgtttccatccggtnatcagcactgaacacagaggactcagcatgggtagtttgggctgcgtcgttgggttttcctgttgcttactttaagnggtntccagtctcagntgcaacgtgggcggaggtcggggggancgtgtaccgaggaccggggaacttcctaggtactacctctccgtaggtcgtacacggtcctcccggtcgttcccttacccgtttccggtttcggtttggacctactttccgaccggttccggacccgcgtacggaccttaccggacgggtaaccggtaagggacggtcggggtaggttcgggggnggtaccgttagaggtttcggagggtggtaagtaccgggtaaatagtcgtatttaagtttcncggtacgaggtaccttacggacggacgacccgtactaccaactcgtaaccgtaccggaagtacggaccaacgtaacgtaacccgtaaacctaactttaacgttacggtactagtaaaccttaagtaaccgtaaacgtacggtaactcgtaaaccggacgaccggtaccgtgttaccgtaattccgttacggacggaccgggtaaccgtagtaaccggaaacggttaccgggtaccggggtacccggacggtttcccgaacgggtctaaacggtccggggtaaaccgtagggtaccccggggaaagtccgggtaaaccg

SEQ ID NO: 79801 - DNA, 891 bp, Homo sapiens
  misc_feature: GYAE6OF01DH9K9.25.35.D02.1.454.CMB.1.raw
  modified_base (168)..(168): a, c, t, g, unknown or other
  misc_feature (168)..(168): n is a, c, g, or t
  modified_base (296)..(296): a, c, t, g, unknown or other
  misc_feature (296)..(296): n is a, c, g, or t
tcagactgtacagtcacgaccggtgctcgatttagcacacgataggttggggttgggggggagaggagcccagcactagaagtcggcggtgttccatccggtgatcagcactgaacacgagaggactcagcagtgggtagttcggctggcgtcgttggggtttttccncggttgaccttagttttaaggaggttcgtccgagtcgtacagactgacacggtgggcgggagggtcggggggagtcggtaggccgagggtacccggggaatcccgtaggaacgtccgtcgtccgtggngaccgtaggttccgtcccgtccggtacccttaccgtttccggttgttttacggaccttctttaccgacggtccgggtaccccgacggtaacggtcccgtaccggaaggtacggaaacgggtcgtcggggaggttgggggtcggtacggttataggttagggtacggggttagggaattaaggggtaaagtacgtacggacttttagtttacgacggacgtaaccgggaccgttacggggaaacggaccgtacccgtactaccaaccgtcgttaccgacgacgggtacgaccgtaacgcccgttaaaaccgaaacggttaacctttaccttttaacgacgttaaaccggtaaacgtttaaacggttaacccggtaaacggtgtaaacccgaaccgggtaccggtaaacccgtacggttaccgggtacctttaacggttaacttaaccggtttacgacggggtacgggtaccgggtaccctaaaggggaaaccggtaccgggtacggggttacccggtcccggttaacggtaaccgggacgttacggggtaacccggaccccgggtaacgggtaaccggggaaccgtaaaaccgggg

SEQ ID NO: 79802 - DNA, 885 bp, Homo sapiens
  misc_feature: GYAE6OF01AU58V.25.35.D02.1.454.CMB.1.raw
tcagactgtacagtcacgaccggtgctcgatttagcacacgatagttgggtttgggggggagaggagcccagcactagaagtcggcggtgtttccatccggtgatcagcactgaacacagaggactcagcatggaggtttgggctgcgcttgggttttcctcgttgcttcgtttttaagaggtgtccagtgtcagatgacacgtgggcgggagggtccgggggggaggcggtcggtccgacgggacccggggtaacgtccccgtgacgtaccgttcctccgttggtcgccgtaggtccggtccccggtcccgttacccccgtaccccgtttttcccggttccggttttttcggccttaactttccgtaccggttcggggtccccgtccgtaaggccccttaccggacgggaccgaaacggggtccttaggggaggttcgggggtcgggccggttacgtagttaacggttgggggtaggggaatagggttaaagtaacgttggtaactttaagttttacggacggtaccgtaacggtaccgttcccggggtaagggtaaaccggggtccccctaacctaccccgaacctaccgttaccccgtacccggaagggtacggtacccgaacgttacccccgttaaaaccaaacccggttaaccttttaaccccgttttagtaccgtaccgtaacgtaaacgttaacgggtaaaaccgtgaaaccgtaccgtaacgaaccggtacgtaccggtcttaccgtacttaccgttacgcggtccgggtacgggtactaacggaaccggtcgggtagggttcccggggtaccgtacggtaaccggcgtacgggtaccgggtaccgggcccgggtaccggggaacccgtaaacgggg

SEQ ID NO: 79803 - DNA, 770 bp, Homo sapiens
  misc_feature: GYAE6OF01D5RFK.25.35.D02.1.454.CMB.1.raw
  modified_base (578)..(578): a, c, t, g, unknown or other
  misc_feature (578)..(578): n is a, c, g, or t
  modified_base (645)..(645): a, c, t, g, unknown or other
  misc_feature (645)..(645): n is a, c, g, or t
  modified_base (668)..(668): a, c, t, g, unknown or other
  misc_feature (668)..(668): n is a, c, g, or t
tcagactgtacagtcacgaccggtgctcgatttagcacacgatagttgggtttggggctctgggagaggagcccagcactagaagtcggcggtgtttccatccggtgatcagcactgaacacagaggactcagcagtggtagtttgggctgcgtcgttcgggttttcctcgttgcttacgttttaagaggtcgtcctagtgtcagatgacgaacgtgggcgggtacgggtcgggggggagcggtcggtcccgacggggacccggggtaacgttcccgtaggtaccgaccttccgtaccgtggtcgactaggttccgtccccgtaccgtcccgtacccgtttccggttcgttttcggactacgttccgaccggttcgggtccccgaccgacggtcccttaccggaacgggtaccgaaaggggttccgtaggggtacgggtggggtacgggtcggtactaaggttacgggtggggtaagggtagtaagggaaagttaacgttggtaactttaagttttacgacggtacctagggtacccggtcggtacgggaaaccggtcccaacgtccaacgtcgtacnccgtaaggacggtcacgacctaaccgtaacgtaacttacctttagctagtacgtaagtacggaacgntaacgtcctacgacgacgtcgtnttcgtactagtacggcggtacggtaccggtacgtaaggaccgggtacggtacggggtcccggacccgtaggtaccgacggttcggccggtccgggtaccggg

SEQ ID NO: 79804 - DNA, 931 bp, Homo sapiens
  misc_feature: GYAE6OF01D0AKX.25.35.D02.1.454.CMB.1.raw
  modified_base (190)..(190): a, c, t, g, unknown or other
  misc_feature (190)..(190): n is a, c, g, or t
  modified_base (675)..(675): a, c, t, g, unknown or other
  misc_feature (675)..(675): n is a, c, g, or t
tcagactgtacagtcacgaccggtgctcgatttagcacacgatagttggggtttggggggggagaggagcccagcactagaagtcggcggtgtttccatccggtgatcagcactgaacacagaggactcagcagtggtagtttgggctggcgtcgttgggtttttcctcgttgtccttacgttttaaagnggttcgtccagtgtcagtatgacaacgtgggacgggagggtcgggggggacgtcggtacggtaccgacgggacccgggggtaactcccgtaggacgtcctccgtccgtgtcgcgtaggtccgtccgtccgttacccgttaccgtttccggtttacggttttcggaccttacttccgacggttccgggtcccgaccgacggtcctaccggaacgggtacgaacggggtcggtcggggtagggttggggttcggtacggttacgtaaggttagggttgggggtacgggtaagttaaccggggtaaattaacggttcgttaacctttaggttttacgacgggaccgttaacgggtacccggtttaccggggaaacgggacccggggtacccttaaccctaaccgtaaccttacgtacccggtaaccgagggtaaccggtacgacccgtaaacccgttaaccgaaacgtttacctttaacccgtttttnaaccgttaacgtaacgtaaacgttaaccggtaaacgtggaaaccgtaccgtaaccggtaaccggtaccgtaacggttccgttaacgtttaacgttacggtaccggtccgggttaccggggtagggtaaaccggtaacgggtaaacgggtaacccggggttcggggtaaccccgggttccggtaaccggacggttaccgggtacgggttaccccgggacccgggttaaccgggtacggggaacccggtaacccgggg

SEQ ID NO: 79805 - DNA, 821 bp, Homo sapiens
  misc_feature: GYAE6OF01C63BF.25.35.D02.1.454.CMB.1.raw
tcagactgtacagtcacgaccggtgctcgatttagcacacgatagttgggtttgggggggagaggagcccagcactagaagtcggcggtgttccatccggtgatcagcactgaacacagaggactcagcatggagtttgggctgcgtctggttttccttgttgcttcttaggtaaaaggtgtcctattgtcaggtgctagttggtgctaggtcggtggggggagtccgttcgtacaacggtcccgttgggaacgggtccctaggacgtacctcctccgtggtcgtaacgtctcgtggtacttaccacctactactaatacgacttactttagcggacccttggacctccggacgtaacggtcctaccggaaggggacgggtcgtgggtaaggttggtaacttttactattttaacgcgtaaagttagtagggtaaggttacgtaggtacttaagttttaacaacgtccgtaagtcccgtacggtacccgggcggggtacccttaccgtactacccgtacttacccgtacctacggttaccgacgaaacccggaacctaaccgtaacttacgtaaaccgtttccgtttacgtacggttacgtaacggtaaccgtaaccggtaacccgggttaccgaaccggtaccgggaaccggtaccgtaacccggtaccgttaccgttacgtttccgtacgggtacggtacggtacgggtttaaggggtttagggggttttaacctaaggtttcgtaacggttaccggtaaccgtttacgggtttaccggtttaaaccccttaccccggttaaacccctttaaaacccgg

SEQ ID NO: 79806 - DNA, 924 bp, Homo sapiens
  misc_feature: GYAE6OF01C1TJR.25.35.D02.1.454.CMB.1.raw
tcagactgtacagtcacgaccggtgctcgatttagcacacgatagttgggtttgggggggagaggagcccagcactagaagtcggcggtgtttccatccggtgatcagcactgaacacagaggactcagcagtggtaggtttgggctgcgtcgttcgggttttcctcgttgcttacgttttaagaggtgtccgagtgtcagatcgacgaacgtcgggacggtagggtcgggggagcgttggtaccgacgggccggggtaacgtcccgtaggacgtacctcgtccgttggagccgtacggtccggtccgtcccgttacccgttaccgtttcccgggtttcggttttacggaccttacggttaccgtaacccggttccggggtacccgccgtaccggtccgtaccccggaacggacggtaaacggggtaccgtgggggtacggttcgggggtccggtcggttaaccgtaagttacgggttggggtagggaacgttaaggttaaaaggttacgttacgggttactttaaagtttttacgcggtaaccggttacgggtaccgtttaccggggacgggtaaaccggggtacccctaacgtacccgaaccgttaccgtacccgtaaccggaacgggttaaccgggtaccgaacgttaccccgttaaaccggtaaaaccgtttaaccccgttttacgttttaccgtaccgttaacggtaacctaaacggtttaacccggtaaaccgtcgggtaacccgtaacggttaccggaaccgttaaccgtacggttcttaccgtactttaggtcccgacggggtccggtaacgggttcggaacggaacggtacccggggtacgggtcccgggtaccaccggttaaagcccggtacgggtaacccgggaccgtccggggtaccgggtaacgaaccggg

SEQ ID NO: 79807 - DNA, 840 bp, Homo sapiens
  misc_feature: GYAE6OF01EB0EQ.25.35.D02.1.454.CMB.1.raw
  modified_base (333)..(333): a, c, t, g, unknown or other
  misc_feature (333)..(333): n is a, c, g, or t
tcagactgtacagtcacgaccggtgctcgatttagcacacgatagttgggtttggggctctgggagaggagcccagcactagaagtcggcggtgtttccatccggtgatcagcactgaacacagaggactcagcatggagtttggctgcgtcttgggttttcctcgttgcttcttttaagaggtgtccagtgtcagatgcaacgtgggcgggaggtcggggggagtcgttacgggtccgaagggtcccgggggaaacttccccgtggacgtacctcctccgtgtacgcgtagtcgtcccgtccgtccctacccgttccttcggggggggtttnctacttccgacgtcggtccgccgacggtcctaccggacggacgaagggacgtagggtagggtggggtacggtcggtactagtaacggttgggtagggtagtaggtaaacgtaagttacgtacgtttaagtttgtacgtaccgtacgtaccgtaccggtaacgggtaacgggtacccgtaccgttacccaacccgtaccgttaccgtaccgaacgggaccgtacgtaacggtacccttaaacccggtaaaccgttaaaccctttaaccgttttaacgtaccgttacgtaaacccgttaacgttaaacccggtaaaccgttaggtaacccgtaaccggtaaccgtaaccggaacccgttaccgggtacctttacgttaaccgtttaaccgttaccgggtaccgggtacccgggtacgggttacgtaacgggaaaccggtaccgggtacggggttacccgggtcccgtaacggccgggtaatacgggtccggtacccggtaccccggggg

SEQ ID NO: 79808 - DNA, 895 bp, Homo sapiens
  misc_feature: GYAE6OF01AD5QT.25.35.D02.1.454.CMB.1.raw
tcagactgtacagtcacgaccggtgctcgatttagcacacgatagttgggtttggggctctgggagaggagcccagcactagaagtcggcggtgtttccatccggtgatcagcacctgaacacagaggactcagcagtggtaggtttgggctggacgtcgttgggttttcccgtcgttggtacctttacgtttaaggtacggttgtccgagtggtctagtattcgaccgtaaggtcggggaccggtaaggggttcgggggggagtccgggttaacggtacccggagggtacccgggggaacttcccggtaggaccgtacgttccgtccggttgtacggccgtaggttcggtccccggtaccgtcccgttacccggttccgtttacggtttcggaccgttacgttacggtacccggtacggggtccccgtaccggaccggtacctccggtacggaccggaacgggtcgtcgggtaagggtgggtaccggtcgtaccgtaggtcggtaggtgggtaacgtagggtaaattacgcggtacgtttagtttaggccgtacgtaacggtaccgttacggtacggaaccgggttacctacccggtaacgacccgtacgtaccgtacgtacgggacgtaccgacgtacccgtaacgtaaccgttaaccgttacgttttaccgacttaacggtaaaccggttaacgttaaaccggtaacgggttacgtaaccgttaccgtaacggtaacccggtacgtaccggttacgttacgtacccgttagtaaccggttaccgggtcgggttacggttacccggttaaagggaccggtaccggggtaaccggtcggggttaacccctacgggtaccggacgtcggggtaaccgtccccgggtaaccggggg

SEQ ID NO: 79809 - DNA, 868 bp, Homo sapiens
  misc_feature: GYAE6OF01B48MQ.25.35.D02.1.454.CMB.1.raw
  modified_base (189)..(189): a, c, t, g, unknown or other
  misc_feature (189)..(189): n is a, c, g, or t
tcagactgtacagtcacgaccggtgctcgatttagcacacgatagttgggtttggggggggagaggagcccagcactagaagtcggcggtgtttccatccggtgatcagcactgaacacagaggtactcagcatgggagtttgggctggcgtcgttcgggttttcctcggttgacttcgttttaaaggnggttcgtacctagtgtaccgagatcgactaaccgtgggacggagggtcgggggagtcggtcgccgagggccgggaacgtccgtagacgaccttccgtccgtgtcggacgtaggtccgtcccggacgttccctacccgtttcgtacgtttcccggttttaggacttacgttaccgtaccggttccgggggtaccccaccccgtaagggttcccgaccggaagggtaccgtaaagggggtccgtggggtacgggttcggggtaagggtacccgacgttaggtttaacggtcggggtaagggacttaggggaaattaacggtgtacgttacgtttagcgtacgtaacggtcttaccgggacggtaacggcccgtaaacgtcccgtaacccgtacttccggtaccggaaggtaccgggtaccgtacgttacccggtaaaccttaacgggttaaacccttaccccgttttaatacccggttagaaccgttaaggttaacgtaaccggtacggtaacgtaccgtaacggaaccggtaacgtaccggtacttacggttataaccgtcggttaccggtacggtacgggtaaccaacggtacggaaccggggttaccgggtcggggtccctaaccgggacggtacccggtaggtaccccgggtacggtaccggggacggtaaccgggg

SEQ ID NO: 79810 - DNA, 158 bp, Homo sapiens
  misc_feature: GYAE6OF02HI4OH.25.35.D02.1.454.CMB.1.raw
  modified_base (158)..(158): a, c, t, g, unknown or other
  misc_feature (158)..(158): n is a, c, g, or t
tcagactgtacagtcacgaccggtgctcgatttagcacacgatagttgggtttgggggacccggttgaccgtcctaggtcagcccaaggctgcccctcggtcactctgttcccgccctcctcactgtacagtctgagcgggctggcaaggcgcatagn

SEQ ID NO: 79811 - DNA, 158 bp, Homo sapiens
  misc_feature: GYAE6OF02IF69X.25.35.D02.1.454.CMB.1.raw
  modified_base (158)..(158): a, c, t, g, unknown or other
  misc_feature (158)..(158): n is a, c, g, or t
tcagactgtacagtcacgaccggtgctcgatttagcacacgatagttgggtttgggggacccggttgaccgtcctaggtcagcccaaggctgcccctcggtcactctgttcccaccctcctcactgtacagtctgagcgggctggcaaggcgcatagn

SEQ ID NO: 79812 - DNA, 215 bp, Homo sapiens; identical to SEQ ID NO: 79729
  misc_feature: GYAE6OF02GKOYH.25.35.D02.1.454.CMB.1.raw
  modified_base (215)..(215): a, c, t, g, unknown or other
  misc_feature (215)..(215): n is a, c, g, or t

SEQ ID NO: 79813 - DNA, 553 bp, Homo sapiens
  misc_feature: GYAE6OF02GLUZE.25.35.D02.1.454.CMB.1.raw
  modified_base (366)..(366): a, c, t, g, unknown or other
  misc_feature (366)..(366): n is a, c, g, or t
  modified_base (428)..(428): a, c, t, g, unknown or other
  misc_feature (428)..(428): n is a, c, g, or t
  modified_base (477)..(477): a, c, t, g, unknown or other
  misc_feature (477)..(477): n is a, c, g, or t
tcagactgtacagtcacgaccggtgctcgatttagcacacgatagttgggtttgggggggagaggagcccagcactagaagtcggcggtgtttccatccggtgatcagcactgaacacagaggactcagcatggagtttgggctgcgctgggttttcctcgttgctcttttaagaggtgtccagtgtcagatgcaactggcggagtcgggggaggcgtggtccagccggggaagtccctgagactctcctgtgcagtgtccgcgtccaccttccgtcgtttggcattcactgggtccgccaggctccaggcaagggactggagtgggtggcggtcatatgggtgggatggaagtaatgctatttangcagactcgtgaagggccgactcaccatctccagagcagcctaccaagaacctaccttttancttgactaattagaaaccgtgacgactcgacgacacgctgtctattacngcgtcgggtctaggaacgaacgagggtccggggccttacgtacggcagtacgggaccgccgtggggacccaacggg

SEQ ID NO: 79814 - DNA, 218 bp, Homo sapiens
  misc_feature: GYAE6OF02HN9JI.25.35.D02.1.454.CMB.1.raw
  modified_base (215)..(218): a, c, t, g, unknown or other
  misc_feature (215)..(218): n is a, c, g, or t
tcagactgtacagtcacgaccggtgctcgatttagcacacgatagttgggtttgggctcggtactactgctcagcatgggactctgagctcgctgctcaggtcttcggcgggggacccggttgaccgtcctaggtcagcccaaggctgccccctcggtcactctgttcccaccctcctcactgtacagtctgagcgggctggcaaggcgcatagnnnn

SEQ ID NO: 79815 - DNA, 579 bp, Homo sapiens
  misc_feature: GYAE6OF02GIMV0.25.35.D02.1.454.CMB.1.raw
  modified_base (301)..(301): a, c, t, g, unknown or other
  misc_feature (301)..(301): n is a, c, g, or t
  modified_base (371)..(371): a, c, t, g, unknown or other
  misc_feature (371)..(371): n is a, c, g, or t
  modified_base (499)..(499): a, c, t, g, unknown or other
  misc_feature (499)..(499): n is a, c, g, or t
tcagactgtacagtcacgaccggtgctcgatttagcacacgatagttgggtttgggggggagaggagcccagcactagaagtcggcggtgtttccatccggtgatcagcactgaacacagaggactcagcatggagtttgggctgcgctgggttttcctcgttgctcttttaagaggtgtccagtgtcagatgcaactggcggagtcggggggaggcgtggtccagccggggaagtccctgagactctcctgtgcagtgtccgcgtccaccttccgtcgttttggctattcactgggtccnccaggctccaggcaagggactggagtgggtggcggtcatagtgggtgggatggaagtaatgctattttangcagactccggtagaacgggccgactccaccatcctccaggacggcagcctaccaaacgaacctaccttttatctgactaaattacgaaaaccgtgaacgacctcgacgacacggctgtactattacngcgtcgggtactaggaacgaacgagggtccggggccgtacgtacggcaggtcgggaccgccggtacggggacccaacggg

SEQ ID NO: 79816 - DNA, 539 bp, Homo sapiens
  misc_feature: GYAE6OF02FYABH.25.35.D02.1.454.CMB.1.raw
  modified_base (364)..(364): a, c, t, g, unknown or other
  misc_feature (364)..(364): n is a, c, g, or t
  modified_base (398)..(398): a, c, t, g, unknown or other
  misc_feature (398)..(398): n is a, c, g, or t
  modified_base (419)..(419): a, c, t, g, unknown or other
  misc_feature (419)..(419): n is a, c, g, or t
  modified_base (466)..(466): a, c, t, g, unknown or other
  misc_feature (466)..(466): n is a, c, g, or t
tcagactgtacagtcacgaccggtgctcgatttagcacacgatagttgggtttgggggggagaggagcccagcactagaagtcggcggtgtttccatccggtgatcagcactgaacacagaggactcagcatggagtttgggctgcgctgggttttcctcgttgctcttttaagaggtgtccagtgtcagatgcaactggcggagtcggggggaggcgtggtccagccggggaagtccctgagactctcctgtgcagtgtccgcgcccaccttccgtcgttttggcattcactgggtccgccaggctccaggcaagggctggagtgggtggcggtcatatggtggatggaagtatgcattttangcagactcgtgaagggccgatcaccatctccagnggcagctcaagacacctttanctgctaattcgaaaaccgtgagactcgagacacggctgtctattacngcgcgggtctagaacgaacgaggtccggggccgttcgacggtcagtcgggaccgccggtaggggccaacgggg

SEQ ID NO: 79817 - DNA, 550 bp, Homo sapiens
  misc_feature: GYAE6OF02FYCJH.25.35.D02.1.454.CMB.1.raw
  modified_base (367)..(367): a, c, t, g, unknown or other
  misc_feature (367)..(367): n is a, c, g, or t
  modified_base (397)..(397): a, c, t, g, unknown or other
  misc_feature (397)..(397): n is a, c, g, or t
  modified_base (425)..(425): a, c, t, g, unknown or other
  misc_feature (425)..(425): n is a, c, g, or t
tcagactgtacagtcacgaccggtgctcgatttagcacacgatagttgggtttgggggggagaggagcccagcactagaagtcggcggtgtttccatccggtgatcagcactgaacacagaggactcagcatggaatttgggctgcgctgggttttcctcgttgctcttttaagaggtgtccagtgtcagatgcaactggcggagtcggggggagcgtggtccagccggggaagtccctgagacctctcctgtgcagtgtccgcgtccaccttccgtcgttttggcattcactgggtccgccaggctccaggcaagggactggagtgggtggcggtcatatggtgggatggaagtaatgctatttangcagactccgtgaagggccgactcacatcnccagagcagctccaagaactacctttanctgactaattagaaaaccgtgacgactcgacacgacgctgtactattactgcgtcgggtctggaacgtaacgacgggtcgggaccgtcgtaccggcacgtcggaccgccggtgggacctaacggg

SEQ ID NO: 79818 - DNA, 589 bp, Homo sapiens
  misc_feature: GYAE6OF02IOLCP.25.35.D02.1.454.CMB.1.raw
  modified_base (306)..(306): a, c, t, g, unknown or other
  misc_feature (306)..(306): n is a, c, g, or t
  modified_base (380)..(380): a, c, t, g, unknown or other
  misc_feature (380)..(380): n is a, c, g, or t
  modified_base (513)..(513): a, c, t, g, unknown or other
  misc_feature (513)..(513): n is a, c, g, or t
tcagactgtacagtcacgaccggtgctcgatttagcacacgatagttgggtttggggctctgggagaggagcccagcactagaagtcggcggtgtttccatccggtgatcagcactgaacacagaggactcagcatggagtttgggctgcgctgggttttcctcgttgctcttttaagaggtgtccagtgtcagatgcaactggcggagtcggggggagcgtggtccaggccggggaagtccctgagactctcctgtgcagtgtccgcgtccaccttccgtcgttttggctattcactcgggtccnccaggctccaggcaagggctggaggtgggtggcggtcagtagtgggtgggatgggaaagtaatgctattttagngcagtactccggtgaagggcccgactcgaccatctccagaggcagcctaccaaagtaaccttaccttttatctagactaagttacgaaaccgtgagacctacgaacgacgacggtctacgtaccttagttacnggaccggtcggggtctaggaacggtaacgacggggtccgggtcccgtacgtacgggctagtcgggaccgtcccggg

SEQ ID NO: 79819 - DNA, 601 bp, Homo sapiens
  misc_feature: GYAE6OF02H7N6W.25.35.D02.1.454.CMB.1.raw
  modified_base (385)..(385): a, c, t, g, unknown or other
  misc_feature (385)..(385): n is a, c, g, or t
  modified_base (450)..(450): a, c, t, g, unknown or other
  misc_feature (450)..(450): n is a, c, g, or t
tcagactgtacagtcacgaccggtgctcgatttagcacacgatagttgggtttggggggggagaggagcccagcactagaagtcggcggtgtttccatccggtgatcagcactgaacacagaggactcagcatggagtttgggctgcgctgggttttcctcgttgctcttttaagaggtgtccagtgtcagatgcaactggcggaggtcggggggaggcgtggtccagccggggaagtccctgagactctcctgtgcagtgtccgcgtccaccttccgtcgttttggctattccacgtgggtccgccaggcctcccgaggcgaaggggactgggaggtggggtggcggtcatagtgggtggggatgggaagtaatgctattttangacagactcgtgaacgggccgactcaccatctaccagaggcagctacaaacgaactaccttttanctgacaattacgaaacgtgacgactcgaacgacacggtctgtacttatacgtggcggtcgggtctaggaacggtaacgaggggttccgggggaccgttaccgacgggctaacggtcgggaccggtacccggtcgggggacccgaaacgggg

SEQ ID NO: 79820 - DNA, 593 bp, Homo sapiens
  misc_feature: GYAE6OF02GFKXH.25.35.D02.1.454.CMB.1.raw
  modified_base (383)..(383): a, c, t, g, unknown or other
  misc_feature (383)..(383): n is a, c, g, or t
  modified_base (448)..(448): a, c, t, g, unknown or other
  misc_feature (448)..(448): n is a, c, g, or t
tcagactgtacagtcacgaccggtgctcgatttagcacacgatagttgggtttggggctctgggagaggagcccagcactagaagtcggcggtgtttccatccggtgatcagcactgaacacagaggactcagcatggagtttgggctgcgctgggttttcctcgttgctcttttaagaggtgtccagtgtcagatgcaactggcggagtcggggggaggcgtggtccaggccggggaagtccctgagactctcctgtgcagtgtccgcgtccaccttccgtcgtttggctattcacgtgggtcccgccaggctccgaggcaagggctgggagtggggtggcggtcatagtgggtgggatagggaagtaatgactattttagngcagactccggtaggaacgggccactcaccatcctccagagcagcctaccaagacttacttttanctgactaattacgaaaccgtgacgtactacgacgacgacggtctagtactagttacgtgaccggtcggggtctaggaaacggtaaccggtacggggtccggggtacccgtacggtaccgggactaggtccgggaccgtacccggg

SEQ ID NO: 79821 - DNA, 631 bp, Homo sapiens
  misc_feature: GYAE6OF02JDM0Q.25.35.D02.1.454.CMB.1.raw
  modified_base (375)..(375): a, c, t, g, unknown or other
  misc_feature (375)..(375): n is a, c, g, or t
tcagactgtacagtcacgaccggtgctcgatttagcacacgatagttgggtttgggggggagaggagcccagcactagaagtcggcggtgtttccatccggtgatcagcactgaacacagaggactcagcatggagtttgggctgcgctgggttttcctcgttgctcttttaagaggtgtccagtgtcagatgcaactggcggagtcgggggggagcgtgggtccaggccggggaagtccctgagactctcctgtgcagtgtccgcgtccaccttccgtcgttttggcattcactgggtccgccaggcctccgaggcaagggctgggagtggggtggcggtcagtagtgggtgggatgggaagtatgctatttangcagactcgtaggaacgggccactccaacctatcctccagacggccagcctaccaacgtaacctaccttttatcctgactaaacgtttacgaaaacccgttgaacgtaccgtcgaaccgaccgacggtcctagtacttaagttaccgtggccggtcggggtaccttaggaaccggtaacggtaccggggtacggggtcccgtacgtaccggggactacggtccgggaccggtaccggttcgggggacctaacgggg

SEQ ID NO: 79822 - DNA, 562 bp, Homo sapiens
  misc_feature: GYAE6OF02I0SW1.25.35.D02.1.454.CMB.1.raw
  modified_base (366)..(366): a, c, t, g, unknown or other
  misc_feature (366)..(366): n is a, c, g, or t
  modified_base (394)..(394): a, c, t, g, unknown or other
  misc_feature (394)..(394): n is a, c, g, or t
  modified_base (430)..(430): a, c, t, g, unknown or other
  misc_feature (430)..(430): n is a, c, g, or t
tcagactgtacagtcacgaccggtgctcgatttagcacacgatagttgggtttgggggggagaggagcccagcactagaagtcggcggtgtttccatccggtgatcagcactgaacacagaggactcagcatggagtttgggctgcgctgggttttcctcgttgctcttttaagaggtgtccagtgtcagatgcaactggcggagtcggggggagcgtggtccaggccggggaagtccctgagactctcctgtgcagtcgtccgcgtccaccttccgtcgttttggctattcactggtccgcaggctcaggcaagggctgggagtgggtggcggtcagtagtggtggatggaagtatgctatttangcacgtactcgtgaacgggccactcacnctctaccagacgcagcaccaaagaacctacttttanctgactaagttacgaaaccgtgactacgtcgacgacacggctgtactatcgtgcgtcggtctaggaacgaacggtacgggtcgggtacctacgtacggctagtcgggaccgtcggtacggggaccgaacggg

SEQ ID NO: 79823 - DNA, 561 bp, Homo sapiens
  misc_feature: GYAE6OF02GJ12K.25.35.D02.1.454.CMB.1.raw
  modified_base (379)..(379): a, c, t, g, unknown or other
  misc_feature (379)..(379): n is a, c, g, or t
  modified_base (408)..(408): a, c, t, g, unknown or other
  misc_feature (408)..(408): n is a, c, g, or t
  modified_base (442)..(442): a, c, t, g, unknown or other
  misc_feature (442)..(442): n is a, c, g, or t
  modified_base (489)..(489): a, c, t, g, unknown or other
  misc_feature (489)..(489): n is a, c, g, or t
  modified_base (494)..(494): a, c, t, g, unknown or other
  misc_feature (494)..(494): n is a, c, g, or t
  modified_base (510)..(510): a, c, t, g, unknown or other
  misc_feature (510)..(510): n is a, c, g, or t
tcagactgtacagtcacgaccggtgctcgatttagcacacgatagttgggtttggggggggagaggagcccagcactagaagtcggcggtgtttccatccggtgatcagcactgaacacagaggactcagcatggagtttgggctgcgctgggttttcctcgttgctcttttaagaggtgtccagtgtcagatgcaactggcggagtcggggggaggcgtggtccaggccggggaagtccctgacgactctcctgtgcagtcgtccgcgtccaccttccgtcgttttggctattcactgggtccgcaggcctccgaggcaacgggctgggagtggggtggcggtcagtagtgggtgggatggaagttatgctattttangcagctcgtagaacgggccactcacatcnccgagcggcagcctaccaagtaacctacctttanctgactaatacgaaacgtgatctacgacacgacgcttgtctatacgngcggnggtctagaagtacggnggtccgggcctacggacgcgacggtcggaccggtcgacggggaccaacggg

SEQ ID NO: 79824 - DNA, 585 bp, Homo sapiens
  misc_feature: GYAE6OF02GCCCH.25.35.D02.1.454.CMB.1.raw
  modified_base (298)..(298): a, c, t, g, unknown or other
  misc_feature (298)..(298): n is a, c, g, or t
  modified_base (334)..(334): a, c, t, g, unknown or other
  misc_feature (334)..(334): n is a, c, g, or t
  modified_base (369)..(369): a, c, t, g, unknown or other
  misc_feature (369)..(369): n is a, c, g, or t
  modified_base (437)..(437): a, c, t, g, unknown or other
  misc_feature (437)..(437): n is a, c, g, or t
tcagactgtacagtcacgaccggtgctcgatttagcacacgatagttgggtttggggggagaggagcccagcactagaagtcggcggtgtttccatccggtgatcagcactgaacacagaggactcagcatggagtttgggctgcgctgggttttcctcgttgctcttttaagaggtgtccagtgtcagatgcaactggcggagtcggggggagcgtggtccagccggggaagtccctgagactctcctgtgcagtgtccgcgtccaccttccgtcgttttggcattcactgggtccnccaggctccaggcaagggctggagtgggtggcggtnatagtgggtgggatgggaagtaatgactattttangacagactccgtgaacgggccactcaccatctaccagaggcagcctaccaaagaacctaccgttttanccttagaaactttcgaaaacccgttgaacgtacctcgaacgacgacggtctgtcttaattacgcggtacgcggggtactaggaacgaacgtgggtccgggacctcgtacggctaggtcgggaccgtccgtaggggacccaggggaccc

SEQ ID NO: 79825 - DNA, 753 bp, Homo sapiens
  misc_feature: GYAE6OF02JL9O0.25.35.D02.1.454.CMB.1.raw
  modified_base (301)..(301): a, c, t, g, unknown or other
  misc_feature (301)..(301): n is a, c, g, or t
  modified_base (390)..(390): a, c, t, g, unknown or other
  misc_feature (390)..(390): n is a, c, g, or t
tcagactgtacagtcacgaccggtgctcgatttagcacacgatagttgggtttgggggggagaggagcccagcactagaagtcggcggtgtttccatccggtgatcagcactgaacacagaggactcagcatggagtttgggctgcgctgggttttcctcgttgctcttttaagaggtgtccagtgtcagatgcactggcggaggtcgggggagcgtggtccaggccggggaagtccctgagactctcctgtgcagtcgtccgcgtccaccgttcgtcgtttgctattcacgtcgggtccnccaggcctaccgaggccgaagggactgggagtcgggtggcggtacagtagtgggtacggggatgggaagtactggtacttaagttttanggcaaggtaccgtccggtaggaaccggggtcccgtacttccaacccgtagttcccgtaccgaagggtaacggccgtaacggtcccttaccgaaaacggtaacctttaacccgtttttactacgtagtaacccgttaaagttaaccggaaaacccgttgaaaccggttaccttaaccggaaccgaaccggtaccggtacttcgggttaaccttaacgttaccgacgggtccgggtaccgggttacgtaggtaaaaccgggtaccggttaacgggggtcccggggttccctaaccgggtttaacggggacctaacgggttcccgggaacccggtcccgggttagggggacccccgtaaacggggg

SEQ ID NO: 79826 - DNA, 718 bp, Homo sapiens
  misc_feature: GYAE6OF02JU36C.25.35.D02.1.454.CMB.1.raw
  modified_base (327)..(327): a, c, t, g, unknown or other
  misc_feature (327)..(327): n is a, c, g, or t
  modified_base (391)..(391): a, c, t, g, unknown or other
  misc_feature (391)..(391): n is a, c, g, or t
  modified_base (403)..(403): a, c, t, g, unknown or other
  misc_feature (403)..(403): n is a, c, g, or t
  modified_base (646)..(646): a, c, t, g, unknown or other
  misc_feature (646)..(646): n is a, c, g, or t
tcagactgtacagtcacgaccggtgctcgatttagcacacgatagttgggtttgggggggaggaggaggcccgagcactagaagtcggcggtgtttccatccggtgatcagcactgaacacagaggactcagcatggagtttgggctgcgctgggtttcctcgttgcttctttaagaggtgtccagtgtcagatgcaactggcagaggtcggggggagcgtggtccaaggccgggggaacgtcccgtggacggactccgtccgtggtcgactaggtcggtcccgcgttacccaccgtttcccggtcgtttttcgggcctagtttccnccggttggggtacccgccctagggccttcccgaggccgaacgggtacgtgggacggttcggggngggtccgggtanacgttagggtgggtgggaacgttgggaaattaggtgcgttaagtttttagcggtaagtaccgttccggtagggtaaacggggtcccacgttaccgacccgtacgttcctaccgaacggacggtccgtaacggaccgtaccgaaacgtaccgttaaccgttttatccggttataccgtaaattaaccggtaaaccgtagtaccgtactaccggaccgtaaccgacgtcgtacgtactagttacncgtcgacgggttcacgacggtaacgcggtccggggactcgtcgagcgtaggtccgcggtcgggaccgaacgg

SEQ ID NO: 79827 - DNA, 576 bp, Homo sapiens
  misc_feature: GYAE6OF02FWBCG.25.35.D02.1.454.CMB.1.raw
  modified_base (375)..(375): a, c, t, g, unknown or other
  misc_feature (375)..(375): n is a, c, g, or t
  modified_base (432)..(432): a, c, t, g, unknown or other
  misc_feature (432)..(432): n is a, c, g, or t
tcagactgtacagtcacgaccggtgctcgatttagcacacgatagttgggtttgggggggagaggagcccagcactagaagtcggcggtgtttccatccggtgatcagcactgaacacagaggactcagcatggagtttgggctgcgctgggttttcctcgttgctcttttaagaggtgtccagtgtcagatgcaactggcggagtcggggggagcgtggtccaggccggggaagtccctgagactctcctgtgcagtgtccgcgtccaccttccgtcgttttggcattcactgggtccgccaggctccaggcaagggactggagtggggtggcggtcagtagtgggtggggatgggaagtaagtgctattttangcagactcgtgaagggccgactcacatctcagagcagcctacaagaacctactttanctgctaattacgaaaccgtgaacgtactcgacgaccgacggctgttacctattacgtgcgcggggttctaggaagaacgacgggtccggggccgtacgtaccggcaggttcgggaccgtcccggtacggggacccgtaacgggg

SEQ ID NO: 79828 - DNA, 596 bp, Homo sapiens
  misc_feature: GYAE6OF02GQX7A.25.35.D02.1.454.CMB.1.raw
  modified_base (344)..(344): a, c, t, g, unknown or other
  misc_feature (344)..(344): n is a, c, g, or t
  modified_base (378)..(378): a, c, t, g, unknown or other
  misc_feature (378)..(378): n is a, c, g, or t
  modified_base (457)..(457): a, c, t, g, unknown or other
  misc_feature (457)..(457): n is a, c, g, or t
  modified_base (503)..(503): a, c, t, g, unknown or other
  misc_feature (503)..(503): n is a, c, g, or t
tcagactgtacagtcacgaccggtgctcgatttagcacacgatagttgggtttggggggagaggagcccagcactagaagtcggcggtgtttccatccggtgatcagcactgaacacagaggactcagcatggagtttgggctgcgctgggttttcctcgttgctcttttaagaggtgtccagtgtcagatgcaactggcggagtcgggggaggcgtggtccaggccggggaagtccctgagactctcctgtgcagtgtccgcgtccaccttccgtcgttttggctattcacgtgggtccgccaggcctccgaggcgaagggactgggaggtggggtggcggtnagtagtgggtgggatgggaagtaatgctatttangcagtactccggtgaaacgggccgactccaccactccgtccaaggacggcacgcctaccgaaacgaacctaccttttancttagactaagttacgaaaaccgtgaacgtactacgacgacacggnttacgtcttatactgcggtcgggtctaggaagtaacgacgggtccgggtcctacgtacggcacggtcggaccgccggtacgggaccgaacggg

SEQ ID NO: 79829 - DNA, 650 bp, Homo sapiens
  misc_feature: GYAE6OF02INR5K.25.35.D02.1.454.CMB.1.raw
  modified_base (305)..(305): a, c, t, g, unknown or other
  misc_feature (305)..(305): n is a, c, g, or t
  modified_base (389)..(389): a, c, t, g, unknown or other
  misc_feature (389)..(389): n is a, c, g, or t
  modified_base (492)..(492): a, c, t, g, unknown or other
  misc_feature (492)..(492): n is a, c, g, or t
  modified_base (523)..(523): a, c, t, g, unknown or other
  misc_feature (523)..(523): n is a, c, g, or t
tcagactgtacagtcacgaccggtgctcgatttagcacacgatagttgggtttgggggggagaggagcccagcactagaagtcggcggtgtttccatccggtgatcagcactgaacacagaggactcagcatggagtttgggctgcgctgggttttcctcgttgctcttttaagaggtgtccagtgtcagatgcaactggcggaggtcgggggaggcgtggtccaggccgggaagtccctgagactctcctgtgcagtcgtccgcgtccaccttccgttcgttttggctattcactcgggtcccnccgaggtcctccgaggcgaagggcgtgggaggtgggtggcggtcagtagtgggtggggatagggaagtaatcgactattttagngacgagtacgtccggtaggaacgggtccgtaccgtccaacccgtactccgtaccgaggtaacggcaacggtccctaaccgaaacgtaaccttaccgttttacncgttcgtaacttaacgttaacgaaaaccgtnaaacgtacgtaccgaacgaccgacggtctacgttacttagttacgcggcgtcggtactaggaacgtaacggcgggtccgggccgtacgtacggctacggcggacccgtcggtcgggaccgtaacggg

SEQ ID NO: 79830 - DNA, 706 bp, Homo sapiens
  misc_feature: GYAE6OF02FTQEL.25.35.D02.1.454.CMB.1.raw
  modified_base (416)..(416): a, c, t, g, unknown or other
  misc_feature (416)..(416): n is a, c, g, or t
  modified_base (514)..(514): a, c, t, g, unknown or other
  misc_feature (514)..(514): n is a, c, g, or t
tcagactgtacagtcacgaccggtgctcgatttagcacacgatagttgggtttggggctctgggagaggagcccagcactagaagtcggcggtgtttccatccggtgatcagcactgaacacagaggactcagcatggagttttgggctgcgctgggttttcctcgttgcttcttttaagaggtgtccagtgtcagatgcaacgtgggcggaggtcggggggaggcggtggtccgaggcccgggggaacgtccccgtggacgacttcctccgtgtggcaggtgtcccgccgtcctaccgttccgttcgtttggctattcaccgtgggtcccgccgaggcctccgaggcgaacggggctgggaggtgggtggccggtcagtagtgggtgggataggaagtaatgacttagttttagngcaagtacgttccggtaggaacgggcccgtacttaccaaccgtactcccgtaccgaggacggcacgcctaaccgaaacgtaacccttaccgtttttanccttagacttaaagttacggaaaaccgtgaacgtaccgtaccggaaccgaaccgtacggtacttacgtacttacgttaccgtcggaccgggtacgggttaccgaagggtaaaccggtaaccgggtcggggttacccgggggtaccttaccgggtaaccgggccgtagggtaccggggtacccgtacccgggg

SEQ ID NO: 79831 - DNA, 639 bp, Homo sapiens
  misc_feature: GYAE6OF02IWVCC.25.35.D02.1.454.CMB.1.raw
  modified_base (372)..(372): a, c, t, g, unknown or other
  misc_feature (372)..(372): n is a, c, g, or t
  modified_base (444)..(444): a, c, t, g, unknown or other
  misc_feature (444)..(444): n is a, c, g, or t
tcagactgtacagtcacgaccggtgctcgatttagcacacgatagttgggtttgggggggagaggagcccagcactagaagtcggcggtgtttccatccggtgatcagcactgaacacagaggactcagcatggagtttgggctgcgctgggttttcctcgttgctcttttaagaggtgtccagtgtcagatgcaactggcggagtcggggggagcgtggtccaggccggggaatccctgagactctcctgtgcagtcgtccgcgtccacctttccgtcgttttggcattcacgtgggtccgccaggctccgaggcaagggctgggagtgggtggcggtcatagtgggtgggatggaagtaatgctatttangcagtctccggtagacgggccactccaccatcctacccgagacggcagcctccaaagaaccttaccttttanctgactaacgttacgaaaacccgttgaagacctacggaacgaccgacggtcttacgttaccttaagttacgtcggtaccgggtccggggttactaggaaacggtaaccggtacggggtccgggggtacccttaccggtaccgggacgtaacggttccgggaaccggcccgggttagggggaccccgtaaacgggg

SEQ ID NO: 79832 - DNA, 734 bp, Homo sapiens
  misc_feature: GYAE6OF02GGRLW.25.35.D02.1.454.CMB.1.raw
  modified_base (410)..(410): a, c, t, g, unknown or other
  misc_feature (410)..(410): n is a, c, g, or t
tcagactgtacagtcacgaccggtgctcgatttagcacacgatagttgggtttggggctctgggagaggagcccagcactagaagtcggcggtgtttccatccggtgatcagcactgaacacagaggactcagcatggagtttgggctgcgctgggtttcctcgttgctcttttaagaggtgtccagtgtcagatgcaacgtggcggaggtcggggggaggcggtggtccaggcccggggaagtccctgagactctcctgtgcagtcgtccgcgtccctaccttccgttcgtttggctacttcgacgtcgggtcccgccgaggcctccgacggccgaagggacgtgggaggtggggtcggcggtactagtagtgggtgggagtagggaagtaatggacttaagttttagngactagtaccgttccggtaggaaccgggccctacgtacccaaccgtactcccgtaccgaaggtacggaccaacggtacctaacccgaaacgtaaacccttaacccgttttttaacgccgttacgaaccttaaaacgttaaccggtaaaacccgtgaaccgtacccgtaccggaaccgtaaccgaccggtaccttacggttaaccttacgttaccgtcggtccgggttaccggggttacgtaacggaaaccggtaaccgggttacggggtcccgggtaccgttaccggtaacgggaccgtacgggtaccggaccggtacccgggg

SEQ ID NO: 79833 - DNA, 216 bp, Homo sapiens; identical to SEQ ID NO: 79726
  misc_feature: GYAE6OF02F3WJA.25.35.D02.1.454.CMB.1.raw
  modified_base (215)..(216): a, c, t, g, unknown or other
  misc_feature (215)..(216): n is a, c, g, or t

SEQ ID NO: 79834 - DNA, 651 bp, Homo sapiens
  misc_feature: GYAE6OF02GS3K0.25.35.D02.1.454.CMB.1.raw
  modified_base (370)..(370): a, c, t, g, unknown or other
  misc_feature (370)..(370): n is a, c, g, or t
  modified_base (435)..(435): a, c, t, g, unknown or other
  misc_feature (435)..(435): n is a, c, g, or t
tcagactgtacagtcacgaccggtgctcgatttagcacacgatagttgggtttgggggggagaggagcccagcactagaagtcggcggtgtttccatccggtgatcagcactgaacacagaggactcagcatggagtttgggctgcgctgggttttcctcgttgctcttttaagaggtgtccagtgtcagatgcaactggcggagtcggggggagcgtggtccaggccggggaagtccctgagactctcctgtgcagtgtccgcgtccaccttccgtcgttttggcattcactgggtccgccaggctccaggcaagggctggaggtgggtggcggtcatagtgggtgggatggaagtaatgctattttangcagactcgtagaggccgactccaccatcctaccaggagcagcctaccaagaacctaccttttancttagctaattacgaaaaccgtgaacgtactcggaacgaccgaacggtctacgttacttaacgtttacgtcggaccgggtccggggttactacgggaaacggtaacccggtagggggttaccccggggggtacccgttaccggttaacccggggacgttacggtaccggggtaacccggccccggggttaccgggggacccggtaaacccgggggg

SEQ ID NO: 79835 - DNA, 688 bp, Homo sapiens
  misc_feature: GYAE6OF02FW4ER.25.35.D02.1.454.CMB.1.raw
  modified_base (391)..(391): a, c, t, g, unknown or other
  misc_feature (391)..(391): n is a, c, g, or t
tcagactgtacagtcacgaccggtgctcgatttagcacacgatagttgggtttgggggggagaggagcccagcactagaagtcggcggtgtttccatccggtgatcagcactgaacacagaggactcagcatggagtttgggctgcgctgggttttcctcgttgctcttttaagaggtgtccagtgtcagatgcaactggcggaggtcggggggagcgtggtccaggccggggaagtccctgagactctcctgtgcagtcgtccgcgtccacccttccgtcgttttggctattcacgtgggtcccgccgaggcctcccgaggccaacggggactggaggtggggtggcggtcattagtgggtaggggatggaagtaatgtatattttacgngacagaccgtccggtagaacgggccgactccaccactctaccgagagcagtctaccaaagtacctactttatctgactaagttacgaaaccgtgacgtaaccgtacgtaacgaccgtaccgggcttacggtaccttaacgtttacgtcgggacgggtacccgggttctaacggtaaacggtaaaccggtaaccgggggttcccgggggtaaccccgggttaccgtaaccgggtaccgaacggttacccgggtaacccgggtcccggtacccggggggtaaccggtaaaacccggggg

SEQ ID NO: 79836 - DNA, 598 bp, Homo sapiens
  misc_feature: GYAE6OF02HKHJW.25.35.D02.1.454.CMB.1.raw
  modified_base (377)..(377): a, c, t, g, unknown or other
  misc_feature (377)..(377): n is a, c, g, or t
  modified_base (446)..(446): a, c, t, g, unknown or other
  misc_feature (446)..(446): n is a, c, g, or t
tcagactgtacagtcacgaccggtgctcgatttagcacacgatagttgggtttgggggggagaggagcccagcactagaagtcggcggtgtttccatccggtgatcagcactgaacacagaggactcagcatggagtttgggctgcgctgggttttcctcgttgctcttttaagaggtgtccagtgtcagatgcaactggcggaggtcggggggaggcgtggtccaggccggggaagtccctgagactctcctgtgcagtgtccgcgtccaccttccgtcgttttggcattcactgggtccgccgaggctccgaggcgaagggctggaggtggggtggcggtcagtagtggtagggagtggaagtaatgctatttangacagtactccgtagaacgggccgactccactactctcaggacgacagctacgaagaacctacctttanctcgactaattacgaaacgtgaacgacgtccgacgacgacgtcttgtactaactacgcgtccggtcgggtctaggaacgaacggtacgggtccggggtacctcggtaacggctacggtacggaccggtacccggtcggggaccctaacgggg

SEQ ID NO: 79837 - DNA, 681 bp, Homo sapiens
  misc_feature: GYAE6OF02HFW4T.25.35.D02.1.454.CMB.1.raw
  modified_base (409)..(409): a, c, t, g, unknown or other
  misc_feature (409)..(409): n is a, c, g, or t
  modified_base (485)..(485): a, c, t, g, unknown or other
  misc_feature (485)..(485): n is a, c, g, or t
  modified_base (569)..(569): a, c, t, g, unknown or other
  misc_feature (569)..(569): n is a, c, g, or t
tcagactgtacagtcacgaccggtgctcgatttagcacacgatagttgggtttgggggggagaggagcccagcactagaagtcggcggtgtttccatccggtgatcagcactgaacacagaggactcagcatggtagtttgggctgcgcgttgggttttcctcgttgcttcttttaagaggtgtccagtgtcagatgcaacgtggcggaggtcggggggaggcggtgggtccgaggccggggaacgtcccgtgacgactcctccgtgtgcagtcgtccgcgtccctaccgtttccgttcgttttcggctatttccacgttcgggtccgccgacggtcctccgaggcgaagggacgtggaggtgggtggcggtcagtagtgggtgggagtaggaagtatgacttatttangacgagtcgtcgtaggaacggccactcgactatcctcgaggacgtcacgtacctaccaacgtaaccttccttttancgtagtactaaacgttacgaaaccgtgtaacgacctaacggaacgaccgacggtacttcgtacttacgttaccgcgggtaccgnggggtacctaaggaaaccggtacgggtaccggggttcccggggtaccgttacgtaccgggacgttaacgggcgggaccccggtaccgggtacgggggaacccgtaaccgggg

SEQ ID NO: 79838 - DNA, 593 bp, Homo sapiens
  misc_feature: GYAE6OF02IOSPB.25.35.D02.1.454.CMB.1.raw
  modified_base (388)..(388): a, c, t, g, unknown or other
  misc_feature (388)..(388): n is a, c, g, or t
tcagactgtacagtcacgaccggtgctcgatttagcacacgatagttgggtttggggctctgggagaggagcccagcactagaagtcggcggtgtttccatccggtgatcagcactgaacacagaggactcagcatggagtttgggctgcgctgggttttcctcgttgctcttttaagaggtgtccagtgtcagatgcaactggcggaggtcggggggagcgtggtccaggccggggaatccctgagactctcctgtgcagtgtccgcgtccaccttccgtcgtttgctattcactgggtccgccgaggctccgaggcgaaggggactgggacggtggggtcggcggtcagtagtgggtgggatagggaaagtagtgactattttagngcagactccggtaggaacgggccgactccacctatccgtcaggaggcacgcctaccgaaagtaaccttaccttttatctagacctaagttacgaaacgtgaacgtactacgaacgacaccggctcgtactagttactggcggtacggggtctaaggaacgtaacgacgggtccgggtaccgtcgacggcagtcggaccgtccggg

SEQ ID NO: 79839 - DNA, 725 bp, Homo sapiens
  misc_feature: GYAE6OF02H2MUD.25.35.D02.1.454.CMB.1.raw
  modified_base (165)..(165): a, c, t, g, unknown or other
  misc_feature (165)..(165): n is a, c, g, or t
  modified_base (268)..(268): a, c, t, g, unknown or other
  misc_feature (268)..(268): n is a, c, g, or t
  modified_base (438)..(438): a, c, t, g, unknown or other
  misc_feature (438)..(438): n is a, c, g, or t
  modified_base (560)..(560): a, c, t, g, unknown or other
  misc_feature (560)..(560): n is a, c, g, or t
tcagactgtacagtcacgaccggtgctcgatttagcacacgataggttgggtttggggctctgggagaggagccaggcactagaagtcggcggtgtttccatccggtgatcagcactgaacacagaggactcagcatggagtttgggctgcgtctgggttttccncggttcgctacttttaagaggtcgtccagtgtcagatgacagtggcggaggtcgggggagcgtggtccagggaccgggtaactcctagacgtactctccgtgngacagtcgcgtctccgacctttcgtcgtttcgactattcgacgtcggggtcccacgaggtcccgtacgagggtaccaaaggggtctacgggtacgggttggggcggtaccgggttaataagtaggttcgggttggaagttaggaaagtaagtcggactttaagtttacgngactacgtaccacggttaggaacgggtaccccagtacgtaaccacgttccaacgaggtacggacagtccaaacgtacgtaaaccttacgttttacacgtacgtataaagtaccgtaaacggngtaaccgtcgtaccgaacgtacgtaccgtcgtaacttaacgttagtacgaggttacccggtagggtaacctaaggtaaccgggtaaaaggcccgggggttccgggaacccgttacgggtaaccccggttaaggtaccgtttccggggaacccgttaacccggggg

SEQ ID NO: 79840 - DNA, 640 bp, Homo sapiens
  misc_feature: GYAE6OF02G2TS3.25.35.D02.1.454.CMB.1.raw
  modified_base (384)..(384): a, c, t, g, unknown or other
  misc_feature (384)..(384): n is a, c, g, or t
tcagactgtacagtcacgaccggtgctcgatttagcacacgatagttgggtttgggggggagaggagcccagcactagaagtcggcggtgtttccatccggtgatcagcactgaacacagaggactcagcatggagtttgggctgcgcttgggttttcctcgttgcttcttttaagaggtgtccagtgtcagatgcaactggcggaggtcggggggagcgtggtccaggccggggaagtccctgagactctcctgtgcagtcgtccgcgtccaccttccgtcgttttcggctattcacgtgggtcccgccaggcctcccgagggacgaagggctgggaggtgggtcggcggtcagtagtgggtggatggaagtatgctatttangacagtacctcggagtaacgggcccgtactccgacctatcctaccgagacggcgacgcctaaccaaacgtaaccttaccttttatcctagtacttaaagttacgaaaccgtgaacgtacctacggaaccgacgacggtcttacgttactagttaccgtggaccggtcgggtacaggaacgaacgggtcgggtacccggggtccttacggtacggaccgtacggtcggaccgtccgggtacggggaccctaacgggg

SEQ ID NO: 79841 - DNA, 638 bp, Homo sapiens
  misc_feature: GYAE6OF02GVD42.25.35.D02.1.454.CMB.1.raw
  modified_base (301)..(301): a, c, t, g, unknown or other
  misc_feature (301)..(301): n is a, c, g, or t
  modified_base (377)..(377): a, c, t, g, unknown or other
  misc_feature (377)..(377): n is a, c, g, or t
  modified_base (457)..(457): a, c, t, g, unknown or other
  misc_feature (457)..(457): n is a, c, g, or t
tcagactgtacagtcacgaccggtgctcgatttagcacacgatagttgggtttgggggggagaggagcccagcactagaagtcggcggtgtttccatccggtgatcagcactgaacacagaggactcagcatggagtttgggctgcgcttgggttttcctcgttgctcttttaagaggtgtccagtgtcagatgcaactggcggagtcgggggagcgtggtccaggccggggaatccctgagactctcctgtgctagtttccgcgtccaccttccgtcgttttggctattcactgggtccnccgaggcctccaggccaaggggctgggaggttggggtggcggtcatagtgggtgggatggaagtatgctattttangcagactccgtgaacgggccacgtcacctatcctccgaggtacggctacgcctaccgaaagtaacccttaccgttttacncgttagaccttaagttaacgtaaaaccgtgaacgtacctacggaaccgtaacgaccggtcttaggttcttaacgttacgtcggcgtcgggttactaggaacgaacggtcggggtccggggtaccctacggtaaccggcgtagtcggggaccgtccgggtacggggacccgaagggtacccg

SEQ ID NO: 79842 - DNA, 740 bp, Homo sapiens
  misc_feature: GYAE6OF02HHYDG.25.35.D02.1.454.CMB.1.raw
  modified_base (414)..(414): a, c, t, g, unknown or other
  misc_feature (414)..(414): n is a, c, g, or t
  modified_base (529)..(529): a, c, t, g, unknown or other
  misc_feature (529)..(529): n is a, c, g, or t
tcagactgtacagtcacgaccggtgctcgatttagcacacgatagttgggtttgggggggagaggagcccagcactagaagtcggcggtgtttccatccggtgatcagcactgaacacagaggactcagcatggagtttgggctgcgcttgggttttcctcgttgctcttttaagaggtgtccagtgtcagatgcaacgtggcgggaggtcgggggaggcgtggtccgaggccgggaagtcccgtgacgacttcctccgtgtcgcgagtcgtccgtcgtccctacccgtttccgttcgttttcggctacttccacgtcgggtcccgccacggcctccgaggacgaagggacgtgggtaggtgggtcggcggtcagtaggtgggtaggagtagggaagtagtgtactagttttangtacacgtaccgttacggtaggaaaccgggtcccgtaacctaccgtacctacgttcccgtaccgaaggaccggtacacgtacccgtaaccgaaacgtaacctttaccgttttacncttacgtaactaacgttacgaaaaccgtggaacccgaacgtaccgaaccgtaccgtaccggtcgttacgttaccgttacgttacgcgggtaccggtccgggtacctaaggaaccggtaacggtaccggggtccggggtaacccgttaccggtacgggtccgttacggtaccgggtaccggtacccgggtacgggggaaccccgaaccgggg

SEQ ID NO: 79843 - DNA, 602 bp, Homo sapiens
  misc_feature: GYAE6OF02JD7IJ.25.35.D02.1.454.CMB.1.raw
  modified_base (182)..(182): a, c, t, g, unknown or other
  misc_feature (182)..(182): n is a, c, g, or t
  modified_base (265)..(265): a, c, t, g, unknown or other
  misc_feature (265)..(265): n is a, c, g, or t
  modified_base (311)..(311): a, c, t, g, unknown or other
  misc_feature (311)..(311): n is a, c, g, or t
  modified_base (332)..(332): a, c, t, g, unknown or other
  misc_feature (332)..(332): n is a, c, g, or t
  modified_base (338)..(338): a, c, t, g, unknown or other
  misc_feature (338)..(338): n is a, c, g, or t
  modified_base (347)..(347): a, c, t, g, unknown or other
  misc_feature (347)..(347): n is a, c, g, or t
  modified_base (361)..(361): a, c, t, g, unknown or other
  misc_feature (361)..(361): n is a, c, g, or t
  modified_base (363)..(363): a, c, t, g, unknown or other
  misc_feature (363)..(363): n is a, c, g, or t
  modified_base (369)..(369): a, c, t, g, unknown or other
  misc_feature (369)..(369): n is a, c, g, or t
  modified_base (381)..(381): a, c, t, g, unknown or other
  misc_feature (381)..(381): n is a, c, g, or t
  modified_base (399)..(399): a, c, t, g, unknown or other
  misc_feature (399)..(399): n is a, c, g, or t
  modified_base (403)..(403): a, c, t, g, unknown or other
  misc_feature (403)..(403): n is a, c, g, or t
  modified_base (412)..(412): a, c, t, g, unknown or other
  misc_feature (412)..(412): n is a, c, g, or t
  modified_base (435)..(435): a, c, t, g, unknown or other
  misc_feature (435)..(435): n is a, c, g, or t
  modified_base (439)..(439): a, c, t, g, unknown or other
  misc_feature (439)..(439): n is a, c, g, or t
  modified_base (481)..(481): a, c, t, g, unknown or other
  misc_feature (481)..(481): n is a, c, g, or t
tcagactgtacagtcacgaccggtgctcgatttagcacacgatagttgggtttggggctctgggagaggagcccagcactagaagtcggcggtgtttccatccggtgatcagcactgaacacagaggactcagcatggagtttgggctgcgcttgggttttcctcgttgtcttcttttaagnggttgtccagtgtcagtatgcaacgtggcggaggtcggggggagcgtggtccaggccgggaatcccgtgacgctctctgtgcngtcgtccgcgtccaccttccgtgtttgctattcgactcgggtcccncgaggcctcgagcaggctggngtgggngcgtcatgnggtggatggaatangntatttngtcagtactcgnggacggccacgtcacctntccnccgagcgcngccgtacacgtaacttactttanctcntaactagtaaaccgtgaacggtactcggaacgaccgaccgtnttcgtacgttacttaccgtagccggggtccggttacgtaacggaacggtaaccggttcggggtaccggggtaccccgttacgggtacccggacgtacggggtacgggtacccccgtcgggg

SEQ ID NO: 79844 - DNA, 729 bp, Homo sapiens
  misc_feature: GYAE6OF02FVU7F.25.35.D02.1.454.CMB.1.raw
  modified_base (382)..(382): a, c, t, g, unknown or other
  misc_feature (382)..(382): n is a, c, g, or t
tcagactgtacagtcacgaccggtgctcgatttagcacacgatagttgggtttgggggggagaggagcccagcactagaagtcggcggtgtttccatccggtgatcagcactgaacacagaggactcagcatggagtttgggctgcgctgggttttcctcgttgctcttttaagaggtgtccagtgtcagatgcactggcggaggtcgggggagcgtggtccaggccggggatccctgagactctcctgtgcagtcgtccgcgtccaccttcgtcgttttggctattcacgttcgggtccgccagggcctaccgagggccgaaggggctgggaggtggggtggcggtcatagtgggtgggatgggaagtagtgcttattttngtcgagtacgtccggtaggaaacgggccgacgtaccacctacgtcctaccgagggtacggacacgtaccctaccgaaaacgtaacccgttaccttttatccgttacgacttaaacgttaacggaaaacgttcgaaacggaccttaccggaacggtaaccgtaccggtcgttacggttacctttaacgttcgtaccgggccgggttaccgggggttactaacgggaaacggtaaccgggtaccggggggttacccgggggtacccccgttaccggtacccgggtacgtaacgggttacccggggaaccccgggtacccgggtaccgggggtaacccgtaaaccggggg

SEQ ID NO: 79845 - DNA, 713 bp, Homo sapiens
  misc_feature: GYAE6OF02H2ELH.25.35.D02.1.454.CMB.1.raw
  modified_base (308)..(308): a, c, t, g, unknown or other
  misc_feature (308)..(308): n is a, c, g, or t
  modified_base (394)..(394): a, c, t, g, unknown or other
  misc_feature (394)..(394): n is a, c, g, or t
  modified_base (584)..(584): a, c, t, g, unknown or other
  misc_feature (584)..(584): n is a, c, g, or t
  modified_base (622)..(622): a, c, t, g, unknown or other
  misc_feature (622)..(622): n is a, c, g, or t
  modified_base (672)..(672): a, c, t, g, unknown or other
  misc_feature (672)..(672): n is a, c, g, or t
tcagactgtacagtcacgaccggtgctcgatttagcacacgatagttgggtttgggggggagaggagcccagcactagaagtcggcggtgtttccatccggtgatcagcactgaacacagaggactcagcatggagtttgggctgcgctgggttttcctcgttgctcttttaagaggtgtccagtgtcagatgcaacgtggcggaggtcggggggaggcgtgggtccaggccggggaagtccctgagactctcctgtgcagtgtccgcgtcccacctttccggtcgtttggctattcacgtgggtccncaggctccaggcagggactggaggtgggtggcggtacagttagtgggtaggggattagggaacttaagtcgtacttaagtttttancggactaacggtaccgttccgggtaggaaacggggcccgattacccgaccctagtacccgtaccgaaggacggcacggtacctaccgaaaacggaacctttacccgtttttagaccgttacgaaccgtaaacgtttaacggaaaaacccggttggaaacgtaccgtaccggaaccgaccgtaaccgggtnttacggttaccttattacgtcggcggttaccggggtanaacggaaaggtaacccggaggggttcccggggaccttaccggaaccggtntacggtcgggacccggtaccggtacggggaacctaacgggg

SEQ ID NO: 79846 - DNA, 623 bp, Homo sapiens
  misc_feature: GYAE6OF02JKZPB.25.35.D02.1.454.CMB.1.raw
  modified_base (456)..(456): a, c, t, g, unknown or other
  misc_feature (456)..(456): n is a, c, g, or t
tcagactgtacagtcacgaccggtgctcgatttagcacacgatagttgggtttggggctctgggagaggagcccagcactagaagtcggcggtgtttccatccggtgatcagcactgaacacagaggactcagcatggagtttgggctgcgctgggttttcctcgttgctcttttaagaggtgtccagtgtcagatgcaactggcggagtcggggggagcgtggtccaggccggggaagtccctggagacctctcctgtgcagtgtccgcgtccaccttccgtcgtttggcattcacgtgggtccgccaggcctccaggcaagggactgggagtggggtggcggtcagtatgggtgggatgggaagtaatgactatttatgcacgactccgtaggaagggtcccgactcacctactctccagacggcacgcctaccgaaagaacctaccttttacncgtacgactaaattcggaaaccgtgaacacgtacgaccgacgacggtctcgtaccttacttacgtcggaccggtcggggttacgtaggtaaacgaacggtacggggtacccggggtcccggttacggttaacccggcggtacggttaccgggacccggtacccgggg

SEQ ID NO: 79847 - DNA, 734 bp, Homo sapiens
  misc_feature: GYAE6OF02IBQO2.25.35.D02.1.454.CMB.1.raw
tcagactgtacagtcacgaccggtgctcgatttagcacacgatagttgggtttggggggagaggagcccagcactagaagtcggcggtgtttccatccggtgatcagcactgaacacagaggactcagcatggagtttgggctgcgctgggttttcctcgttgctcttttaagaggtgtccagtgtcagatgcaagtggcggagggtcgggggagtcggtggtccgaggccggggtaactccgtggagtacctcctccgtgtcgacgtagtcgtccgtccgtaccctaccgtttccggttcgttttcggacctacgttaccgtacggttccgggtaccccgaccgacgggtccctacccgaacggaccgaaacggggtaccgtagggtagggttcggggtcgggaccggttcaagttacggttggggtagggtaagtagggtaaaagtacgtgtacgtttaagtttagcggtacgtaacgtaccgttccggtaagggaaaccggtcccgactacgtacctagtccgtacgaggtacgactacgcctaaaccgaaacgtaacccttagttttacgacgttacgtacttaaacgttaaaccgaaacgtcgaacgtactaccggactaacgcgtctagttactacgtacgtcggcggtacggtacaggtaacgaacggtacggtccgggtactacggtcgacgacggtcggaccggtcggtacgggaaccgtaacgg

SEQ ID NO: 79848 - DNA, 818 bp, Homo sapiens
  misc_feature: GYAE6OF02ILHVE.25.35.D02.1.454.CMB.1.raw
  modified_base (440)..(440): a, c, t, g, unknown or other
  misc_feature (440)..(440): n is a, c, g, or t
tcagactgtacagtcacgaccggtgctcgatttagcacacgatagttgggtttggggctctgggagaggagcccagcactagaagtcggcggtgtttccatccggtgatcagcactgaacacagaggactcagcatggagtttgggctgcgcttgggttttcctcgttgcttcgttttaagaggtgtccagtgtcagatgctaacgtggcgggaggtcggggggagtcggtggtccgaggccgggggaatcccgtaggacgtacctctccgtggtgacgtggtcgtccgccgtcctacccgttccgtcggtttggctattcctacgtcgggtcccgccgacggtcctccgaggacgaagggtcgtgggtacggtgggtcggcggtacgtagttaggtgggtaggagtagggtaaagtacgtacgtacttagtttttaagnggtacgtaacggtaccgttaccgggtagggtaacgggtccccgtaaccgtacccgtaaccctaacgttcccgtacccgaaagggtccgggtaccgaccggtaccctaaccgtaaaaccgtaacccgttaaccgtttttaacgtccgttacggtaacgttaaacgttaaaccggtaaaccggtacgtaaccggtaccgtaaccggtaacccgaacggtaacccgtcgttaacgttaccgtttaacgttaaccggtggtaccggggtcccgggttaaacggtaacgggtaaacggtaacccgggtaccgggggttacccggtcccggttaaccggtacggtaccggtaacgggttacccgggacccggtaacccgggggg

SEQ ID NO: 79849 - DNA, 724 bp, Homo sapiens
  misc_feature: GYAE6OF02HHO6X.25.35.D02.1.454.CMB.1.raw
  modified_base (268)..(268): a, c, t, g, unknown or other
  misc_feature (268)..(268): n is a, c, g, or t
  modified_base (360)..(360): a, c, t, g, unknown or other
  misc_feature (360)..(360): n is a, c, g, or t
  modified_base (406)..(406): a, c, t, g, unknown or other
  misc_feature (406)..(406): n is a, c, g, or t
tcagactgtacagtcacgaccggtgctcgatttagcacacgatagttgggtttggggctctgggagaggagcccagcactagaagtcggcggtgtttccatccggtgatcagcactgaacacagaggactcagcatggagtttgggctgcgcttgggttttcctcgttgcttcttttaagaggtgtccagtgtcagatgcaacgtggcggaggtcggggggaggcgtggtccgaggccggggaagtccctgacgacctctcctgtgcnggtcgtcgccgtcctaccgttcgtcgtttgctattctagtcgggtccgcgaggcctccgaggcgaagggacgtgggaggtggggtgcggtanaagttggtgggtaggagtagggaagtaattcggatttagttttacngacgtaacgtacgttccggtaggaaccgggtccactaccaccactacctaccgtaacgacggacgacgacctaccgtaaacgtaaccttaaccttttacgttacgttacgtaacgttaaagttaaccgtaaaaccgtacgtaacgtaacctaccggggggggaacctaaccgtaccgttaccgttacgttaccgtttaacgttaccggtacggtaccgggtaccgggttcggtaacggtaacgggtaacggtaaccgggtccggggtacccggtaccggtaccggtacggtaccggtacgggtacccggtacccgggg

SEQ ID NO: 79850 - DNA, 597 bp, Homo sapiens
  misc_feature: GYAE6OF02IDAJ9.25.35.D02.1.454.CMB.1.raw
  modified_base (308)..(308): a, c, t, g, unknown or other
  misc_feature (308)..(308): n is a, c, g, or t
  modified_base (364)..(364): a, c, t, g, unknown or other
  misc_feature (364)..(364): n is a, c, g, or t
  modified_base (376)..(376): a, c, t, g, unknown or other
  misc_feature (376)..(376): n is a, c, g, or t
  modified_base (446)..(446): a, c, t, g, unknown or other
  misc_feature (446)..(446): n is a, c, g, or t
  modified_base (482)..(482): a, c, t, g, unknown or other
  misc_feature (482)..(482): n is a, c, g, or t
  modified_base (487)..(487): a, c, t, g, unknown or other
  misc_feature (487)..(487): n is a, c, g, or t
tcagactgtacagtcacgaccggtgctcgatttagcacacgatagttgggtttggggctctgggagaggagcccagcactagaagtcggcggtgtttccatccggtgatcagcactgaacacagaggactcagcatggagtttgggctgcgctgggttttcctcgttgccctctttttaagaggtgtccagtgtcagatgcaactggcggaggtcggggggagcgtggtccaggccggggaatccctgacgactctcctgtgcagtgtccgcgtccaccttccgtcgtttggctattcacgtggtccnccaggcctccgaggcaagggctggacgtgggtgcggtcatgtggtggatggaatancgactattttancgacagtactcggtagaacgggccactcacatcacgagacgcagtacctcgaaacgtaactaccttttanctgactaatacgaaacgtgacgtacctacgacgacncggtntcgtactagtacgtggacggtcgggtactaggaacgtaaccggtacggggtaccggggtacccgttacggtaaccggtccgtacggttaccgggacccggttacccgggg

SEQ ID NO: 79851 - DNA, 739 bp, Homo sapiens
  misc_feature: GYAE6OF02J0DWB.25.35.D02.1.454.CMB.1.raw
  modified_base (426)..(426): a, c, t, g, unknown or other
  misc_feature (426)..(426): n is a, c, g, or t
tcagactgtacagtcacgaccggtgctcgatttagcacacgatagttgggtttggggctctgggagaggagcccagcactagaagtcggcggtgtttccatccggtgatcagcactgaacacagaggactcagcatggagttgggctgcgcttgggtttcctcgttgctctttaagaggtgtccagtgtcagatgcaacgtggcggaggtgggggagcggtggtccaggccgggaacgtcccgtgacgtactcctccgtgtagcagtcgtccgacgttccaccgttccgtcgtttggctacttcacgtcggtaccgccgaggtcctaccgtaggacgaacggggtactgggacggtgggtcggcggtcgtagtaggtcgggtaggggagttaggggtaaacgtatcggtactttaaggttttaacncgggtactaacggtaccgttaccggtagggtaaaccggggcccgtaccgtacgtacccgtagttaccccgtacgagggtagcccgtaagacccgttaaccaaacggaaccctttacgttttaaccgtctacggtaaccttaaggttaaaccgaaaccggtcggtaaacgtaccggtaccgaaccggtaccgaaccgttctaccgttactttacgtacggttcggaccggtaccgggttaatacggaaacgtaccgggaacggggttccggtaccggttaccgcggtaacgcggttaccggaccggttaccggg

SEQ ID NO: 79852 - DNA, 797 bp, Homo sapiens
  misc_feature: GYAE6OF02F9Q1B.25.35.D02.1.454.CMB.1.raw
  modified_base (388)..(388): a, c, t, g, unknown or other
  misc_feature (388)..(388): n is a, c, g, or t
  modified_base (401)..(401): a, c, t, g, unknown or other
  misc_feature (401)..(401): n is a, c, g, or t
  modified_base (436)..(436): a, c, t, g, unknown or other
  misc_feature (436)..(436): n is a, c, g, or t
tcagactgtacagtcacgaccggtgctcgatttagcacacgatagttgggtttggggctctgggagaggagcccagcactagaagtcggcggtgttccatccggtgatcagcactgaacacagagactcagcagtggagtttgggcttcgcgttgggttttcctcgttgcttcttttaagaggttgtccagtgtcagtatcgctaacgtgggcggaggtcggggggagtcgtcggtaccgacggccggggtaacgtccctgacgactcctcgtgtgcgtagtcgccgtccgtccctaccgttccgtcgttttggctagttccgacgtcgggtcccgcctaggccctaccgaaggacgaagggacgtgggaggttggggtgacggttanaagtggttggggnggagtaggtaaagtaatgtaacgtttattttacgngtactaacggtcgtaccggtaggtaaccgggccctaactacccgtaacgtaccgtacccgtacgaacggtacggaccgacgtacccgtaaacgaaaccgttaaacccttcctttaagtaccggtataaaacgttaacggttaaccggtaaaccgttggaaaccgtaccgttaccgaaaccggtaacccggtaccggttacttacggtttccgtaaacgtttaccgggtcgggtaccgggtttccgggtaacggtaacggtaaaccgggacccggggtaccgggggttacccgggtaaccggttaccgggttacgacccgggttaggacccggggttacccgggtaccgggtaacccggggg

SEQ ID NO: 79853 - DNA, 647 bp, Homo sapiens
  misc_feature: GYAE6OF02GESOR.25.35.D02.1.454.CMB.1.raw
  modified_base (389)..(389): a, c, t, g, unknown or other
  misc_feature (389)..(389): n is a, c, g, or t
  modified_base (467)..(467): a, c, t, g, unknown or other
  misc_feature (467)..(467): n is a, c, g, or t
  modified_base (542)..(542): a, c, t, g, unknown or other
  misc_feature (542)..(542): n is a, c, g, or t
tcagactgtacagtcacgaccggtgctcgatttagcacacgatagttgggtttgggggggagaggagcccagcactagaagtcggcggtgtttccatccggtgatcagcactgaacacagaggactcagcatggagtttgggctgcgctgggttttcctcgttgcttcttttaagaggtgtccagtgtcagatgcaactggcggaggtcggggggagcgtggtccaggccggggaatccctgacgactctcctgtgcagtcgtccgcgtccacccttccgtcgttttggctattcacgtgggtcccgccaggcctccaggcgaagggctgggaggtggggtggcggtcagttagtgggtagggatagggaagtaagtgactagttttangacagtacctcggtaggaacgggcccactccacctatcctcgaggacgcagcctaccgaacgaaccttacccttttancctacgactaagttaaccgaaaccgtgaacgtacctacggaccgtacgaccggtacttagtaccttaagttacgngtccgggtccggggtactaggaacggtaacggtacggggtacccggggtccttacggtaccggcgtacggtccgggaccgtccgggtacggggacccgtaacggg

SEQ ID NO: 79854 - DNA, 885 bp, Homo sapiens
  misc_feature: GYAE6OF02JK5JY.25.35.D02.1.454.CMB.1.raw
tcagactgtacagtcacgaccggtgctcgatttagcacacgatagttgggtttgggggggagaggagcccagcactagaagtcggcggtgtttccatccggtgatcagcactgaacacagaggactcagcatggagtttgggctgcgctgggttttcctcgttgctcttttaagaggttgtccagtgtcagatgcaactggcggaggtcgggggggagcgtggtccaggcggggaactccctgagactctccgtgtgcagtcgtccgccgtcctaccctttccgtcggttttcggcctattccgacgtcgggtccgccgacggtccctcccgagggtacgaaacggggccttggggaacggttgggggtcgggtcccgggttataacggttaggttggggttacgggggaatttagggggaaaaggtttaaatcggggtaccctttaaaggttttttacgacggtaccgtaaagggtaaccccgtttccgggggtaacggtaaacccgggggcccccggtaaaccttttacccgggaacccccttacgtttaccgtacccccgtaaaggggttaaccggaccggtacccgtaccgtaaccccgtaaaaacggtacccgttttaaaccctttttaccttacgttacgtaccttaaaacggtttacggtaaaaaccccgttggtaaaccggtacccgttaacggaccgtaacccgtaaccggtcgtttacgtacgttaaaccttttcggccgtacccggggtaccggggtttactagggaaaccggaaccgggtacgggggttcccggggttacccggtaccgtaccggggtactaaccgggtcggggaccccggtccgggtacccgggtaccgggtaaacccgggg

SEQ ID NO: 79855 - DNA, 640 bp, Homo sapiens
  misc_feature: GYAE6OF02HXV99.25.35.D02.1.454.CMB.1.raw
  modified_base (415)..(415): a, c, t, g, unknown or other
  misc_feature (415)..(415): n is a, c, g, or t
  modified_base (512)..(512): a, c, t, g, unknown or other
  misc_feature (512)..(512): n is a, c, g, or t
  modified_base (586)..(586): a, c, t, g, unknown or other
  misc_feature (586)..(586): n is a, c, g, or t
tcagactgtacagtcacgaccggtgctcgatttagcacacgatagttgggtttggggctctgggagaggagcccagcactagaagtcggcggtgtttccatccggtgatcagcactgaacacagaggactcagcatggagtttgggctgcgctgggttttcctcgttgctcttttaagaggtgtccagtgtcagatgcaactggcggagtcgggggagcgtggtccaggccggggaagtccctgagactctcctgtgcagtgtccgctccaccgtttccgtcgttttggctattcgaccgttggggtcccgccgaggtccgtccgagggccgaaagggtacctgggaacggtggggtgggccggtacagttagtcgggtgggtacgtgggaaagttaagtgtacgttattttagnggtacagtaccgtccggtaggaacgggtcccgacgtacacccgtaatccgtaccgaggacggcaacgacctacccgaaagtaaccttaccgttttancgttacgactaaagtacgaaacgtgacgtacgtacgaacgacgacgcgtatcttactacgtcgtcggccgggtntaggaacgacggtacggtcggggacctcggtacggctacggtcggacgtccggg

SEQ ID NO: 79856 - DNA, 643 bp, Homo sapiens
  misc_feature: GYAE6OF02FKK7H.25.35.D02.1.454.CMB.1.raw
  modified_base (353)..(353): a, c, t, g, unknown or other
  misc_feature (353)..(353): n is a, c, g, or t
  modified_base (382)..(382): a, c, t, g, unknown or other
  misc_feature (382)..(382): n is a, c, g, or t
tcagactgtacagtcacgaccggtgctcgatttagcacacgatagttgggtttggggggggagaggagcccagcactagaagtcggcggtgtttccatccggtgatcagcactgaacacagaggactcagcatggagtttgggctgcgcttgggttttcctcgttgcttcttttaagaggtgtccagtgtcagatgcaacgtggcgggaggtcgggggggaggcgtgggtccagggccgggggaagtcccgtgagacctctcctgtgcagtgtccgcgtccaccttccgtcgttttggctattcacgtcggtccgccaggcctcgagcgaagggctggaggtgggtggcggtnagtagtggtggatggaatatgctatttangcagtactccggtagacgggccactccacctactcacagacggcgacgtcctaaccaaacgtaacttaccttttaactcttacgtactaaagttaaccggaaacgtacgaacgtacgtaccgaaccgacgacgtcgtagtacctattacgtcgtacgggtccgggtactacggaacggtaacggtagggtcccggggtaccgttaccgttacggaccgttaggtaccgggtaccggtccgggtacggggacctaaccgggg

SEQ ID NO: 79857 - DNA, 922 bp, Homo sapiens
  misc_feature: GYAE6OF02IAQLH.25.35.D02.1.454.CMB.1.raw
tcagactgtacagtcacgaccggtgctcgatttagcacacgatagttgggtttggggctctgggagagagcccagcactagaagtcggcggtgtttccatccggtgatcagcactgaacacagaggactcagcatggtagtttgggctgcgcgttgggttttcctcgttgcttcgttttaagaggtctccagtctcgagtatcgactaacgtgggaccggtagggtcggggggacgtcggttcgggtacccgacgggtacccgggggaaacttcccgtaggaaaccgtccttccgttcgttggtcggacgtaggttccggttccggccgttaccctaacccggtttccggtttacggttttcggacttactttaccgtaccggttcgggttcccgacccgtacggtcccttaccggacggtaccggaaacgggtccgttaggggtaacgggttgggggtcgggacccgggttactaaggttaggttacggggttagggggtaacgttaacgggggttaaaagtttaacggtccgtaacgttttaaagtttttaacgcggtacccgtaacggttaacccgttacccgggtaagggtaacccggggtaccccgttaaccgttacccgaacccgtttacgttaccccgtaaccggtacgggaacgggtacacgggttaccctaaccgtaaaacgttaaccctttacttttaacgttacggtaacgtaaccgttaaacgttaacccggaaaacgttacggaacccgtcgtaacccggaaccgtaaccgtaaccgttcgtacgttaaccttaacgttacgcgggtacccgggtagggttctaacggtaacggtaaccggttacggggtaacccggtcggttaacccggtaaccggtaccgtacggttaccgggcccgtacccggggg

SEQ ID NO: 79858 - DNA, 653 bp, Homo sapiens
  misc_feature: GYAE6OF02GM93J.25.35.D02.1.454.CMB.1.raw
  modified_base (320)..(320): a, c, t, g, unknown or other
  misc_feature (320)..(320): n is a, c, g, or t
  modified_base (496)..(496): a, c, t, g, unknown or other
  misc_feature (496)..(496): n is a, c, g, or t
  modified_base (565)..(565): a, c, t, g, unknown or other
  misc_feature (565)..(565): n is a, c, g, or t
tcagactgtacagtcacgaccggtgctcgatttagcacacgatagttgggtttggggctctgggagaggagcccagcactagaagtcggcggtgtttccatccggtgatcagcactgaacacagaggactcagcatggagtttgggctgcgctgggttttcctcgttgcttcttttaagaggtgtccagtgtcagatgtaacgtgggcggaggtcggggggaggcgtggtccgaggccggggaatcccgtgacgacctctccgtgtgcagtgtccgccgtcctaccttccggttcgttttggctattcacgtcgggtccnccgaggcctccgaggcgaagggcgtgggaggtggggtcggcggtacagtagtgggtaggagtaggaagtatgacttattttagcgtcgaagtacctcggtagggaacggcccgaactccacctactcctaccgaggacggccacgtacctaaccaaacgtaaccttaccgttttancgttagaacctaagttaacgaaacgtgaacgtacgaccgaacgtacgcgtcttacgtactacgttacgngggtccggacgggttacacggtaaacgacgggcgggttaccgggaccgtacggtaccggagtacggtcgggaccgccgggtaccgggg

SEQ ID NO: 79859 - DNA, 804 bp, Homo sapiens
  misc_feature: GYAE6OF02IGW6V.25.35.D02.1.454.CMB.1.raw
  modified_base (185)..(185): a, c, t, g, unknown or other
  misc_feature (185)..(185): n is a, c, g, or t
tcagactgtacagtcacgaccggtgctcgatttagcacacgatagttgggtttggggctctgggagaggagcccagcactagaagtcggcggtgtttccatccggtgatcagcactgaacacagaggactcagcatggagtttgggctgcgcttgggttttcctcgttgcttcttttaagaggtntccagtgtcagatgcaacgtggcggagtcggggggagcgtggtccgaggccggggaagtcccgtgacgactccgtccgtgtgcaggtcgtccgccgtaccacctttccgtcgtttaggctattcacgtcgggtcccgcctacggtcctccgaggaccgaagggtacctgggaggttggggtcgggaccggttcctaagttaccggtgggtaggggaagtggggtaaaaggttaagtggactttaagtttttaagcggtaccgtaaggtacccgttacccgggtaagggaaaccgggtacccgtaccgtaccgtaaccctaaacgttccgttaacccgaggtaacggtacgacgtacccgttaaccgaaaacggtaaacccgttttaacccgttttattacccgtgtaaccgttaaagttaacccggtaaaaccgtcggaaacgttaccggtaccgaaccgtaaccgtaccgggtagttaccgttaccgtttaacgttaccgtcggtacccgggtaccggggttactaaacgggtaaacggtaacccgggtacggggttcccgggtacccggttaccgtaaccgggtacgtacggtaccgggtacccggtaacccggggg

SEQ ID NO: 79860 - DNA, 767 bp, Homo sapiens
  misc_feature: GYAE6OF02IYK3U.25.35.D02.1.454.CMB.1.raw
  modified_base (326)..(326): a, c, t, g, unknown or other
  misc_feature (326)..(326): n is a, c, g, or t
  modified_base (353)..(353): a, c, t, g, unknown or other
  misc_feature (353)..(353): n is a, c, g, or t
tcagactgtacagtcacgaccggtgctcgatttagcacacgatagttgggtttggggggagaggagcccagcactagaagtcggcggtgtttccatccggtgatcagcactgaacacagaggactcagcatggagtttgggctgcgctgggttttcctgttgcttcttttaagaggtgtccagtgtcagatgcaacgtgggcggaggtcgggggggaggtcggtggtcccgagggcccggggtaagtcccgtggacgactcctccgtgtgcgagtcgtccgccgtccctaccgttccgttcggtttgcctattccacgtcggtccncgaggtcctccgaggcgaaggcgtggnggtggggtcgcgtacagtaggtgggtaggagtaggtaagtagtcgtactttagtttagcgtactacggtaccgtccgggtaaggaaccggggtaccctaacgtcccaacctacgtaccgtccgaaggaccggtaccacggtccctaaaccgtaaacgttaaccctttaacgttttacgcgtaagtaccttaaacggttaaaccggtaaaccgtgtaaccgaccgtaaccggaaccgtacccgacgggttacgttacgtttaccgttaaccgtttccggaccgggtgggtaccccgggttataaccggtaacgggtaaccggggtccgggttaacccggggtacctttaccgggaaccgggtccgtaacggttcccgggacccgggtaccgggttaccggggaccgtaaccgggg

SEQ ID NO: 79861 - DNA, 642 bp, Homo sapiens
  misc_feature: GYAE6OF02ISSEW.25.35.D02.1.454.CMB.1.raw
  modified_base (422)..(422): a, c, t, g, unknown or other
  misc_feature (422)..(422): n is a, c, g, or t
  modified_base (533)..(533): a, c, t, g, unknown or other
  misc_feature (533)..(533): n is a, c, g, or t
tcagactgtacagtcacgaccggtgctcgatttagcacacgatagttgggtttggggctctgggagaggagcccagcactagaagtcggcggtgtttccatccggtgatcagcactgaacacagaggactcagcatggagtttgggctgcgctgggttttcctcgttgcttcttttaagaggtgtccagtgtcagatgcaactggcggaggtcggggggagcggtggtccgaggccggggaagtcccgtgacgactcgtcctgtcgcagtcgtccgccgtcctaccgtttccgtcgtttcggctattccacgtcgggtccgacccgaggtcctaccgacggcgaacgggacgtcgggaggtggggtcgggacggtcgagtagtagggtgggagtagggaagtaagtgtacttaagttttagngtacagtaccgtccggtaggaacgggccgtacaccacctacgtcaccgaggacggcacgtacctaacaacgtaaccttaccttttatccgtatactaagtacgtaaacgtnaagtacaccgtaacgacgcgtctacgtcttatcgtcggacggtccgggtatacggaacgtacggtacgggtccggtccgacgtacggcgtacggtcggaccgtcccggg

SEQ ID NO: 79862 - DNA, 626 bp, Homo sapiens
  misc_feature: GYAE6OF02HZRSC.25.35.D02.1.454.CMB.1.raw
  modified_base (335)..(335): a, c, t, g, unknown or other
  misc_feature (335)..(335): n is a, c, g, or t
  modified_base (373)..(373): a, c, t, g, unknown or other
  misc_feature (373)..(373): n is a, c, g, or t
  modified_base (516)..(516): a, c, t, g, unknown or other
  misc_feature (516)..(516): n is a, c, g, or t
  modified_base (532)..(532): a, c, t, g, unknown or other
  misc_feature (532)..(532): n is a, c, g, or t
tcagactgtacagtcacgaccggtgctcgatttagcacacgatagttgggtttgggggggagaggagcccagcactagaagtcggcggtgtttccatccggtgatcagcactgaacacagaggactcagcatggagtttgggctgcgctgggttttcctcgttgctcttttaagaggtgtccagtgtcagatgcaactggcggaggtcggggggagcgtggtccaggccggggaagtccctgagactctcctgtgcagtgtccgcgtccaccttcgtcgtttggcattcactgggtccgccaggcctccgaggcaagggctggagtggtggcgtnagtagtgggtggagtggaaagtatcggactattttagngacaagtaccgtccggtagaacgggtcccgaactccgacctattccctaccgaaggacggcaacgtcctaccaaacgaaccttaaccttttagtccttagtactaaacgttacgaaaccgtgacgacgtcgaccgacgaccgntacgtacttacgtacncggcgtccgggttacaggaaccgaaggtcgggtaccgggtccttacgacgggtactacggtcggaacccggtccggtacgggaccgtaaccggg

SEQ ID NO: 79863 - DNA, 663 bp, Homo sapiens
  misc_feature: GYAE6OF02JDYN5.25.35.D02.1.454.CMB.1.raw
  modified_base (300)..(300): a, c, t, g, unknown or other
  misc_feature (300)..(300): n is a, c, g, or t
tcagactgtacagtcacgaccggtgctcgatttagcacacgatagttgggtttgggggggagaggagcccagcactagaagtcggcggtgtttccatccggtgatcagcactgaacacagaggactcagcatggagtttgggctgcgctgggttttcctcgttgctcttttaagaggtgtccagtgtcagatgcaactggcggagtcgggggaggcgtggtccaggccgggaagtccctagagactctcctgtgcagtgtccgcgtccaccttccgtcgttttggcattcactgggtccnccgaggtcctaccgaggcaagggactgggagtgggtggcggtcagtagtggtcgggatggaagtaacgtgactattttagcgcgtacgaccgtccggtaggaacgggtcccactccgacctagtccctaccgaggtacgccgacgtccgtaccgaaacgtaacctacccgttttaatccgttagaccgttaagttacggaaaacccgttgacgtaccgtccggaacgtaccgtaacggcttagtaccgttaattacccggtgaccggtcggggtatacggaacgtaacggtcgggtaccggggtaccttacggtacccggacgtacggttcgggacccgttccgggacgggacccgtaacggg

SEQ ID NO: 79864 - DNA, 617 bp, Homo sapiens
  misc_feature: GYAE6OF02GIWHD.25.35.D02.1.454.CMB.1.raw
  modified_base (261)..(261): a, c, t, g, unknown or other
  misc_feature (261)..(261): n is a, c, g, or t
tcagactgtacagtcacgaccggtgctcgatttagcacacgatagttgggtttggggctctgggagaggagcccagcactagaagtcggcggtgtttccatccggtgatcagcactgaacacagaggactcagcatggagtttgggctgcgctgggttttcctcgttgctcttttaagaggtgtccagtgtcagatgcaacgtggcggaggtcggggggaggcgtggtccaggccgggaagtccctgacgactctccgtgngcagtgtccgcgtccaccttccgtcgtttggctattcacgtgggtcccgccaggctccgaggcgaagggctggagtgggtgcggtcagtgtgggtggatagggaagtaatggacttattttagtggactaagtaccttccggaggaaccgggtcccacgtccaaccctatccgtacccgaggacggcgacgtcctaacccgaacgtaaccttaccgttttatcgtacgactaagtacgaaaccgtgaacgtactaccgaacgacacggtctacgtactactcgcgtccggtcgggttcagaacggtaacgcgggtccgggtacctacggtacgcgacggtccgggaccgtccgggg

SEQ ID NO: 79865 - DNA, 682 bp, Homo sapiens
  misc_feature: GYAE6OF02FXTFW.25.35.D02.1.454.CMB.1.raw
  modified_base (390)..(390): a, c, t, g, unknown or other
  misc_feature (390)..(390): n is a, c, g, or t
  modified_base (446)..(446): a, c, t, g, unknown or other
  misc_feature (446)..(446): n is a, c, g, or t
tcagactgtacagtcacgaccggtgctcgatttagcacacgatagttgggtttgggggggagaggagcccagcactagaagtcggcggtgtttccatccggtgatcagcactgaacacagaggactcagcatggagtttgggctgcgctgggtttttcctcgttgctcttttaagaggtgtccagtgtcagatgcactggcgagtcgggggagcgtggtccagccgggaagtccctgagacctctcctgtgcagtcgtccgccgtcctacccttccgtcgttttggcctattcactggtccgccaggcctccgaggccaagggactggaggtgggtggcggtcgattacgtgggtcggaattgggaaacgttaaagtgactacgttttanggtacgacgtacgtccgtaggaagggtcccgatcccgaacctatccctaccgaagnggacctacggcctaaccgaaagtaaacccttaccgtttacttctacgaacttaaggttaaacctaaaaccgtgaacgtaaccgttacggaaccgtacccgtaaccggtccgtacgtttacttaactttaccggtagtcccggtacggggtactaaggaacggtaacggagggttcccggggaccttacggtacggacgtacggtacggacccggacggtacgggaccgtaaccggg

SEQ ID NO: 79866 - DNA, 839 bp, Homo sapiens
  misc_feature: GYAE6OF02H5COQ.25.35.D02.1.454.CMB.1.raw
  modified_base (183)..(183): a, c, t, g, unknown or other
  misc_feature (183)..(183): n is a, c, g, or t
  modified_base (467)..(467): a, c, t, g, unknown or other
  misc_feature (467)..(467): n is a, c, g, or t
tcagactgtacagtcacgaccggtgctcgatttagcacacgatagttgggtttggggctctgggagaggagcccagcactagaagtcggcggtgtttccattccggtgatcagcactgaacacagaggactcagcatggaggtttgggctgcgcgtgggttttcctcgttgcttcttttaagnggtgtccagtgtcagatgcaacgtggcggaggtcggggggaggcggtggtccgaggccggggaacgtcccgtgacgacctccgtccgtgtgcgtaggtcgtccgccgtcctacccgtttccggttcgtttggctactttccgacgttcgggtcccgcccgtaggtccttacccggagggaccgaaggggtacgtaggggtacggttcgggggtcgggtccggttacgagttaggtggggtacggggtagtagggtaaagttaagttgtactttaagttttacgngtaccgtaacgtacccgttacccgggtaggaaaccggggtccccgtactacccgaacgtaccgtcccgtaacgacgggtaacggcccgaacggtacccctacggaaaacgttaaccccgtttacgtttttacgcccgttaacgaacgttaaacgttaaacccggtaaaacggtcgtaaaccggtaccgtaaccggacccgaaccgtccggttaccgttacgttaaccgtttagtaacccgttcggggcccgggtttacggggtcgtaaaccgggtaaacgggtaccgggttacccgggggttacccggggtaccgttaaccgggtaacccgggtaccggtaagggtccccgggggtaccgtacccccggggg

SEQ ID NO: 79867 - DNA, 738 bp, Homo sapiens
  misc_feature: GYAE6OF02HZ7TU.25.35.D02.1.454.CMB.1.raw
  modified_base (365)..(365): a, c, t, g, unknown or other
  misc_feature (365)..(365): n is a, c, g, or t
  modified_base (580)..(580): a, c, t, g, unknown or other
  misc_feature (580)..(580): n is a, c, g, or t
  modified_base (638)..(638): a, c, t, g, unknown or other
  misc_feature (638)..(638): n is a, c, g, or t
tcagactgtacagtcacgaccggtgctcgatttagcacacgatagttgggtttgggggggagaggagcccagcactagaagtcggcggtgtttccatccggtgatcagcactgaacacagaggactcagcatggagtttgggctgcgcttgggttttcctcgttgcttcttttaagaggtgtccagtgtcagatgcacgtggcggaggtcggggggaggcgtcggtccgaggccggggaacgtcccgtggagactcctccgtgtgcagtcgtccgcgtccctaccgtttccgttcgttttcgctacttccgacgtgggtcccgccaggtcctaccgaggacgaaggggcctggggtaggtggggngggtccggtagtagtaggttgggtagggagtacgggaaagttaagtcggtactttaatttagtcgactaacggtaccgtcggtaggaaacgggcctaccgtacacccgtatcccgtcgaaggtccggacacggtaccctaaccgaaaacgtacctttacccgttttaacgccgttaacgtaaccttaaaaggttaccggaaaaccgtggtaaccnccgttaaccgggacctacggacgtcttaacgtcttacgtcgccggtgggtccggttanaaggtaaccggacggttaccggggtcccgggtaacccgtcggtaccggacgtacgggcccgggtaaccggtccccgggtagggggtaacccaaaccgggg

SEQ ID NO: 79868 - DNA, 689 bp, Homo sapiens
  misc_feature: GYAE6OF02GFIKD.25.35.D02.1.454.CMB.1.raw
  modified_base (304)..(304): a, c, t, g, unknown or other
  misc_feature (304)..(304): n is a, c, g, or t
tcagactgtacagtcacgaccggtgctcgatttagcacacgatagttgggtttgggggggagaggagcccagcactagaagtcggcggtgtttccatccggtgatcagcactgaacacagaggactcagcatggagtttgggctgcgctgggttttcctcgttgctcttttaagaggtgtccagtgtcagatgcaactggcggagtcggggggaggcgtggtccaggccggggaatccctgagactctcctgtgcagtcgtccgcgtccaccttccgtcgttttggctattcacgtcgggtccnccgaggcctcccgaggcaaaggggacctgggaggtggggtcggcggtacattagtgggtagggagtagggaagtaactggacttaagttttagcgtactagaccgttccggtaagggaaacggggtcccgaactaccaaccgtactcctaccgaaggtacggccaacggtcctaaccgaaacgtaaaccttacccttttaatccgttacgactaaacgttacgaaaacccgtgaacgtacgtacggaacgtacgaccgggtcttgtacttaattaccgtgccgggtcggtacgtaaggaacggtaaccggacgggttcccggggtacccgttacgtaccgggcgtacggtcgggaacccggccggtacgggggacccgaaacggg

SEQ ID NO: 79869 - DNA, 709 bp, Homo sapiens
  misc_feature: GYAE6OF02JJ1W7.25.35.D02.1.454.CMB.1.raw
  modified_base (358)..(358): a, c, t, g, unknown or other
  misc_feature (358)..(358): n is a, c, g, or t
tcagactgtacagtcacgaccggtgctcgatttagcacacgatagttgggtttggggctctgggagaggagcccagcactagaagtcggcggtgtttccatccggtgatcagcactgaacacagaggactcagcatggagtttgggctgcgcttgggttttcctcgttgcttcttttaagaggtgtccagtgtcagatgcaacgtgggcggaggtcgggggagcgtggtccgaggcccggggaagtcccgtagacgacctccgtccgtgtgctaggtcgtccgccgtcctaccgttccgttcgtttgctattccgacgtcggtcccgccgacggctccgaggaccgaagggtcgtggnggtgggtcggcgtcagtgtgggtggagtaggtaaagtagtcgtataagttttagcgacgtacgtaccgttcggaacgggtaacgggacccgtataccccaccgtactcccggaccgtaggacgactaccggtacctaaccgaaacgttaacttaccgtttactacgtcgaacttaacgtaacggaaaccgtcggaacgtaccgtccggtaaacgacccggtaggtacttacggttaactacgttaccggtcggtaccgggtccgggttaaccgaaggtaaacggtaccgggtacggggttcccgggtaccgtaccggtaccggtaggacggttccgggacggtacccgggg

SEQ ID NO: 79870 - DNA, 628 bp, Homo sapiens
  misc_feature: GYAE6OF02G44C3.25.35.D02.1.454.CMB.1.raw
  modified_base (178)..(178): a, c, t, g, unknown or other
  misc_feature (178)..(178): n is a, c, g, or t
  modified_base (316)..(316): a, c, t, g, unknown or other
  misc_feature (316)..(316): n is a, c, g, or t
  modified_base (397)..(397): a, c, t, g, unknown or other
  misc_feature (397)..(397): n is a, c, g, or t
  modified_base (488)..(488): a, c, t, g, unknown or other
  misc_feature (488)..(488): n is a, c, g, or t
  modified_base (527)..(527): a, c, t, g, unknown or other
  misc_feature (527)..(527): n is a, c, g, or t
  modified_base (594)..(594): a, c, t, g, unknown or other
  misc_feature (594)..(594): n is a, c, g, or t
tcagactgtacagtcacgaccggtgctcgatttagcacacgatagttgggtttggggctctgggagaggagcccagcactagaagtcggcggtgtttccatccggtgatcagcactgaacacagaggactcagcatggagtttgggctgcgctggttttcctcgttgctcttttaagnggtgtccagtgtcagatgcaactggcggaggtcgggggagcgtggtccaggccggggaagtccctgacgactctccgtgtgcaggtcgtccgccgtcctaccgtttccgtcgtttggctacttcgacgtcgggtcccncgaggcctccgaggacgaagggactggaggtgggtcggcgtcagtagtggtggacgtggaagttatcggtcttatttacgngactagtacctacggtaggaacgggtccctacgtccacctatccgaccgaggacggtcacgtaccaccgaaacgttaaccttacgtttacnctgactaagtacgaaccgtagacgtacgaccgacgaacncgtactgttacctagttccgcgccgggtacggtctaaggaacgtaccggtacgggtccggttacccnggttaccggactaggtacccgggacgtacccggg

SEQ ID NO: 79871 - DNA, 878 bp, Homo sapiens
  misc_feature: GYAE6OF02FVW53.25.35.D02.1.454.CMB.1.raw
tcagactgtacagtcacgaccggtgctcgatttagcacacgatagttgggtttggggctctgggagaggagcccagcactagaagtcggcggtgtttccatccggtgatcagcactgaacacagaggactcagcagtggagtttgggctgcgcttgggttttcctcgttgcttcttttaagaggtgtccaggtgtcagatgcaacgtggcggaggtcggggggagcggtggtccgaggccggggaacgtccctggacgtactcctccgtgtcgactaggtcggtccgccgttacccgtacccgtttcccggttcggttttcggcctacgtttccgacggttcgggtcccgcccgacgggtcctaccgacgggaccggaaacggggtacgtggggaacgggttcgggggtacggtcgggttaccgtagttacggtgggggttaggggtaagtaggggtaaacggttaacgttcggtaacgtttaagtttttacgcggtaccgtaacggtacccgttaccgggtacgggaaccggggtacccctacgttaccaacccgtacgttccccgtaaccggaagggacgggtacccgtaacggtacccgttaaacccgaaaacggttaaacccgttttaacccgttttttaacgaccgtttaacgtaaccgttaaacgtttaaaccggtaaaaccggtcggtaaaccgttacccgtaccgggtaaacccgtaccggtacgggttaccttacggttaacttaaccgttacggtaccgggtccgggtacgggttacgtaacgggaaaccggtaaccgggttaccggggtcccggggtaccgttaccggtacgggtaccgttacgggtacgggacccggtacccgggg

SEQ ID NO: 79872 - DNA, 667 bp, Homo sapiens
  misc_feature: GYAE6OF02HZRNG.25.35.D02.1.454.CMB.1.raw
  modified_base (184)..(184): a, c, t, g, unknown or other
  misc_feature (184)..(184): n is a, c, g, or t
  modified_base (387)..(387): a, c, t, g, unknown or other
  misc_feature (387)..(387): n is a, c, g, or t
  modified_base (401)..(401): a, c, t, g, unknown or other
  misc_feature (401)..(401): n is a, c, g, or t
tcagactgtacagtcacgaccggtgctcgatttagcacacgatagttgggtttggggctctgggagaggagcccagcactagaagtcggcggtgtttccatccggtgatcagcactgaacacagaggactcagcatggagtttgggctgcgctgggttttcctcgttgcttcttttaagaggtntccagtgtcagagtgcaactggcggaggtcggggggaggcggtggtccgaggccggggaagtcccgtagacgactctcctgtgcgtagtcgtccgcgtcccacctttccgtcgtttgctattcgacgtcggccgccaggcctccgaggtcgaaggcgtggagtgggtggtcggtcagtagtgggtaggataggaagtttaagngtactagttttagngacgtacgtaccgtaccggtaggtaacggtcccgaactaccgacccgtatacccgtaccgaggacggactacgctaacccgtaaacgtaacccttaaccgttttataccgtacgtaacctaaagttaacggtaaaaccgtgaaccgtaccgtacgaccgaaccgcgttactagtaccttagttcgtcggacggtaccgggtaatacggaacgtacggtaccgggtcccggtacgtaccggacggtacgtggtaccggacggtccgg

SEQ ID NO: 79873 - DNA, 751 bp, Homo sapiens
  misc_feature: GYAE6OF02J2FMX.25.35.D02.1.454.CMB.1.raw
tcagactgtacagtcacgaccggtgctcgatttagcacacgatagttgggtttggggggagaggagcccagcactagaagtcggcggtgtttccatccggtgatcagcactgaacacagaggactcagcatggagtttgggctgcgctgggttttcctcgttgcttcttttaagaggtgtccagtgtcagatgcaacgtggcggaggtcgggggagcgtggtccgaggccgggacgtccctaggacgtactcgtcctagtgcgagtcgtccgccgtcctaccgttcgtcgtttggcctattccgacgtcgggtccgccgaggccgtaccgaggccgaagggtcgtgggacggttggggtacggtccggtacgaattacggtagggttagggaacgtgggtaaacgtatcggtactttaagtttagcgtaacgtacggtaccgttcggaaggtaacggtaccgactaccgtaaccctagttaccctacccggaagttacgggaccgacccgtacgtaaacccgtaagtaaaccctttacttttaacgccgtttaacgaaccgtttaaagtaaccgaaacgtcgtacgtaccgtaacgtacccggacgtaccgtcgttagttaccgttaacgtacccgtacggttacgggtaccggttacgaacggttaacgggaaccggtcggggtaccggggttccctaaggtaccggtcacgggttaccgaccgggtacggtaccgggaacgtaaccggg

SEQ ID NO: 79874 - DNA, 738 bp, Homo sapiens
  misc_feature: GYAE6OF02HZTON.25.35.D02.1.454.CMB.1.raw
  modified_base (578)..(578): a, c, t, g, unknown or other
  misc_feature (578)..(578): n is a, c, g, or t
  modified_base (602)..(602): a, c, t, g, unknown or other
  misc_feature (602)..(602): n is a, c, g, or t
  modified_base (610)..(610): a, c, t, g, unknown or other
  misc_feature (610)..(610): n is a, c, g, or t
  modified_base (641)..(641): a, c, t, g, unknown or other
  misc_feature (641)..(641): n is a, c, g, or t
tcagactgtacagtcacgaccggtgctcgatttagcacacgatagttgggtttgggggggagaggagcccagcactagaagtcggcggtgttccatccggtgatcagcactgaacacagaggactcagcagtggagtttgggctgcgctgggtttcctcgtgctctttaagaggtgtccagtgtcagatcgctaacgtggacggtaggtcggggggagcgtgggtaccagggccgggggaatcccgtagacggactcgtccgtgtcgctaggtcgtccgtcgtcccaccgtttccgtcgttttggactacttcgacgttcgggtcccgaccgtaggtccttacccgagggtaccgtaaagggggtaacccgtggggaacgggtttcgggtcgggaccggggttacctaagttaaggttggggtaccggggtaagttacgggaaaggttaaacgtcgggtaacctttagttttaagcggtacgaacgttaaccgtccggtaggaaaccgggcccgtactccgaacgtactccgtcgaagcggtccgacgtacctaaccgaacgtaacttaccgtttacncgttacacgtaattaccgaaaccngtacgacncgaacgacgtcggccttagtacctattacgngtaccggacggttaccgaagtaacgtacggtaccgggtcgggtcccttacgaccggtgaccggtgggacccggtcggtccggggaaccctaaagggg

SEQ ID NO: 79875 - DNA, 887 bp, Homo sapiens
  misc_feature: GYAE6OF02INGFW.25.35.D02.1.454.CMB.1.raw
tcagactgtacagtcacgaccggtgctcgatttagcacacgatagttgggtttggggctctgggagaggagcccagcactagaagtcggcggtgtttccatccggtgatcagcactgaacacagaggactcagcagtggtagtttgggctgagtcgttcgggtttttcctcggttgtctttacgtttttaaaggacggttcgtccctaacgttggttcgaggttcgacctaccggttgggtgggtaggttcgggtggggggacggtcggttcgggtccgacggtcccggtaggggaccggttccccgtaggacgtaccttccgtaccgtggtagaaccggtccttacgttgggttactttttacgtttacaggtttcgggttacgtggctaggttcgccgtacggttcggggtaccccgccggtacggtcccgtaccggaacggggacccgggaacgggggtcccgggtaggtttggggttacgggaacgttaaggtttaacgacggacctaacgtaggttacggaacgttaggggttaaacgtttctaaacggttaaagtttacgtttagttacgggaaccgttaacgggtaacccggtttcgggaaacggggtaaccggggttaccccttaaccgttaccccgaacctaacggttacccgtacggtaaacggaacccgtaaaccgttaaaaccccggttcccgggtaaattacggttttacggttaacgttaaccgggttaagtaacggttcggacgtaacggtcgtaacgaggtactcgggaacgtccgtacggtacttcgtaagttcgttaacgtggtacgcggtagtacgggttacgggtacggtttaaggttacgggttaacgtttacggggtaccgtcgg

SEQ ID NO: 79876 - DNA, 582 bp, Homo sapiens
  misc_feature: GYAE6OF02I6JGI.25.35.D02.1.454.CMB.1.raw
  modified_base (313)..(313): a, c, t, g, unknown or other
  misc_feature (313)..(313): n is a, c, g, or t
  modified_base (386)..(386): a, c, t, g, unknown or other
  misc_feature (386)..(386): n is a, c, g, or t
  modified_base (409)..(409): a, c, t, g, unknown or other
  misc_feature (409)..(409): n is a, c, g, or t
  modified_base (413)..(413): a, c, t, g, unknown or other
  misc_feature (413)..(413): n is a, c, g, or t
  modified_base (474)..(474): a, c, t, g, unknown or other
  misc_feature (474)..(474): n is a, c, g, or t
  modified_base (500)..(500): a, c, t, g, unknown or other
  misc_feature (500)..(500): n is a, c, g, or t
tcagactgtacagtcacgaccggtgctcgatttagcacacgatagttgggtttggggggggagaggagcccagcactagaagtcggcggtgtttccatccggtgatcagcactgaacacagaggactcagcatggagtttgggctgcgctgggttttcctcgttgctcttttaagaggtgtccagtgtcagatgcaactggcggaggtcggggggagcgtggtccaggccggggatccctagacgactctcctgtgacagtcgtcccgcgtccctaccgtttccgtcggttttggctagttcacgtgggtccncaggcctccgaggcacgggactgggagtgggtcggcgtcatgtggtcggatggaatatgacgttatttagcgnacgcgtcgtagacggcactcacnctcncaggagccagacctacgaataccttacctttatcgtgactaagtacgaaaccgtgacgacncgacgactacggcttgtacttagtcncggacggtcggtactagacgtaacggcgggttccggctacggtagctacggtcggaaccggccgggtacggccgtaaccggg

SEQ ID NO: 79877 - DNA, 836 bp, Homo sapiens
  misc_feature: GYAE6OF02JRF7H.25.35.D02.1.454.CMB.1.raw
  modified_base (165)..(165): a, c, t, g, unknown or other
  misc_feature (165)..(165): n is a, c, g, or t
tcagactgtacagtcacgaccggtgctcgatttagcacacgatagttgggtttggggggagaggagcccagcactagaagtcggcggtgtttccatccggtgatcagcactgaacacagaggactcagcatggagtttggctgcgctgggttttcctcgttgctntttaagaggtgtccagtgtcagtatgcaacgtggcggtaggtcggggggagcggtcggtccgaggtccggggaacgttcccgtagacgacctccgtccgtggtgctagtcgtcccgtacgtccctaccttccgttcggttttggctatttccagtcgggtaccgccaggtcctccgaggcgtaagggcctgggaggtgggtcggccggtcgtaagttagtgggtacggtaagtagggtaaagtaacgtgactttaagtttacacggtacgtacgtaaccgttccggtaggaaacgggtcccgtaacgttaccgtaacccgtacgttaccgtacccgaagggtaaccgaccgtaacgtccgtaaacccgtaaacgttaaacccgttaaccttttaaccgacgttaaccgtaacgttaaaacgttaaccggtaaaaacccgtgaaacccggttaaccgtaaccgggtaacgtaaacccggtcgggttaaccttaccggtttaaaccttaccgtttaacggacccgggttaccgggtaccggggttaccgttaaggtaaaccgggaaccgggttaccgggtaacccgggggtacccgttaaccggtaccgggtaactaaccgggtaccgggtaaccggttaccccgggttaccgggaacccgttaaaccggggg

SEQ ID NO: 79878 - DNA, 814 bp, Homo sapiens
  misc_feature: GYAE6OF02F83US.25.35.D02.1.454.CMB.1.raw
  modified_base (305)..(305): a, c, t, g, unknown or other
  misc_feature (305)..(305): n is a, c, g, or t
tcagactgtacagtcacgaccggtgctcgatttagcacacgatagttgggtttgggggggagaggagcccagcactagaagtcggcggtgttccatccggtgatcagcactgaacacagaggactcagcatggagtttgggctgcgctgggtttcctcgttgctcctttaagaggtgtccagtgtcagatgcaacctggcggtaggtcggggggaggcgtggtccgagccggggaagtccctgagactctcctgtgcacgtgtccgcgtccaccttccgtcgttttgctattcacgtgggtcccnccgaggcctccgaggtccgaaggggtctcgggaggtcggggtagggtccggtctaagttaagttggggttacggggagttaccgggtaaaggttaaagtcggtacgtaagtttttaacgtgggtaccgtaacggtaccgttcccgttaggggggggaaaacccgggtccccggtaaacccgtttccgaaccctacgttacccttaccccgacggtacgggaccgtacggaccccttaaccgaaaccgtaaacctaacccgtttttagtacccgtgaaccgtaaacgtttaccggaaaaaccccggttgaacccgggacgttacccggtaacggaccgtaccgggttaccgttaggtttacccttattaaacggttcggtaccgggttacggggtccctaagggtaaacgtaacccgggtaaggggttccccgggacccggttaccgtacgggtacctacgggtaccgggtacccggttcccgggtacgggttccccgggaaaacccggg

SEQ ID NO: 79879 - DNA, 745 bp, Homo sapiens
  misc_feature: GYAE6OF02HI99K.25.35.D02.1.454.CMB.1.raw
  modified_base (134)..(134): a, c, t, g, unknown or other
  misc_feature (134)..(134): n is a, c, g, or t
  modified_base (261)..(261): a, c, t, g, unknown or other
  misc_feature (261)..(261): n is a, c, g, or t
  modified_base (300)..(300): a, c, t, g, unknown or other
  misc_feature (300)..(300): n is a, c, g, or t
tcagactgtacagtcacgaccggtgctcgatttagcacacgatagttgggtttgggggggagaggagcccagcactagaagtcggcggtgttccatccggtgatcagcactgaacacagaggactcagcatggngtttgggctgcgctgggttttcctcgttgctcgttttaagaggtgtccagtgtcagatgcaactgggcggaggtcggggggaggcggtgggtccaggccggggaagtccccgtggagactctcctgngcagtgtccgcgtcctaccgttccgtcgtttggcatccncgtggtccgccgacggctaccgacggccgaaggggaccgtgggaggttggggtcgggccgggtcgagtacggtgggtacggggaagtagggaaagtaagttggacgtattttacgtgactacgtaccgtcgggtaacgacggggcccgtacctaccgacctaacgtcctaccgaagtacgggactacggaccttaaccaaagtaacccgtttacccgtttactaccgtagtaaccgtaaacgtaaccggttaaaaccggtacgtaaccggtaccgttacggaaaccgtacgtaaccggtccgtagttaccgttaacgttaccggtcgggtcgggttaccgggttagtaacggaaccgggtaagtaccgggggtacccggggtccgtaaccggtacgggaccgtacgggtaggtaaccccggcgggtaccggggaccgtaacgggg

SEQ ID NO: 79880 - DNA, 865 bp, Homo sapiens
  misc_feature: GYAE6OF02JVRX0.25.35.D02.1.454.CMB.1.raw
  modified_base (331)..(331): a, c, t, g, unknown or other
  misc_feature (331)..(331): n is a, c, g, or t
tcagactgtacagtcacgaccggtgctcgatttagcacacgatagttgggtttggggctctgggagaggagcccagcactagaagtcggcggtgtttccatccggtgatcagcactgaacacagaggactcagcatggagtttgggctgcgctgggttttcctcgttgctcttttaagaggtgtccagtgtcagatgcaactggcggaggtcgggggagcgtggtccaggccggggaatcccgtggagacttctcctagtgcaggtgtcccgccgtaccctacccgtttccgttccgttttggacctactttccacggttcgggttacccnccgtacggtccttaccgaggccgtaaacgggaccgtgggagggttcggggtcggcgggtacagttaggtggggttgggacgttgggaaagttagtcgtactttagttttacgtgactacgtaccgtccggtaagggtaccgggtacccgacctaccgacccgtagttcccgtacccaagggacccggctaaccggtacccttaacccggtaaacgtaaacccggttttacccgtttttatacccgttacggtaccctaaaaaggtttaccggaaaaaccggtttcgggtaaaacctcccgggttaaacccggtaacggtaacccgggtaccgggtttacccacggtttttaacccgttaacgtttaaccgggttccggcccggggggtttcccgggtttaacggtaaaccggggtttaacggaaaccccggggttaaccgggggttacccggggttcccccggggtttaacccgttaaccgggggtaaccccggtacgggttaacccggggggccccgtttaaaccccgggggg

SEQ ID NO: 79881 - DNA, 585 bp, Homo sapiens
  misc_feature: GYAE6OF02IND1R.25.35.D02.1.454.CMB.1.raw
  modified_base (236)..(236): a, c, t, g, unknown or other
  misc_feature (236)..(236): n is a, c, g, or t
  modified_base (389)..(389): a, c, t, g, unknown or other
  misc_feature (389)..(389): n is a, c, g, or t
  modified_base (431)..(431): a, c, t, g, unknown or other
  misc_feature (431)..(431): n is a, c, g, or t
  modified_base (452)..(452): a, c, t, g, unknown or other
  misc_feature (452)..(452): n is a, c, g, or t
  modified_base (495)..(495): a, c, t, g, unknown or other
  misc_feature (495)..(495): n is a, c, g, or t
  modified_base (505)..(505): a, c, t, g, unknown or other
  misc_feature (505)..(505): n is a, c, g, or t
  modified_base (556)..(556): a, c, t, g, unknown or other
  misc_feature (556)..(556): n is a, c, g, or t
tcagactgtacagtcacgaccggtgctcgatttagcacacgatagttgggtttgggggggagaggagcccagcactagaagtcggcggtgtttccatccggtgatcagcactgaacacagaggactcagcatggagttgggctgcgctgggttttcctcgttgctctttaagaggtgtcccagtgtcagatgcaactggcggagtcgggggagcgtggtccagccggggaatcccngagactctcctgtgcagtgtccgcgtccaccttccgtcgttttggcctattcacgtcggggtccgccaggtcctacccgagggtcgaaggggacctgggaggtggggtggccggtacagtagtgggtgggagtggaagtaatgctattttagngcaagaccgtccgagacgggccactccacatcctcgagacgnacgcacaagtacctactttanctgtactaagtacgaaaccgtgacgactcgaccgacgacgctntcttaatcgngtccgaggttcaggtaacgaacggtacgggtccgggtccgtacgtaccggnacggtggaccgcggtcgggaccgtaacgg

SEQ ID NO: 79882 - DNA, 810 bp, Homo sapiens
  misc_feature: GYAE6OF02IT2SW.25.35.D02.1.454.CMB.1.raw
  modified_base (149)..(149): a, c, t, g, unknown or other
  misc_feature (149)..(149): n is a, c, g, or t
  modified_base (164)..(164): a, c, t, g, unknown or other
  misc_feature (164)..(164): n is a, c, g, or t
  modified_base (191)..(191): a, c, t, g, unknown or other
  misc_feature (191)..(191): n is a, c, g, or t
  modified_base (282)..(282): a, c, t, g, unknown or other
  misc_feature (282)..(282): n is a, c, g, or t
tcagactgtacagtcacgaccggtgctcgatttagcacacgatagttgggtttggggctctgggagaggagcccagcactagaagtcggcggtgtttccatccggtgatcagcactgaacacagaggactcagcatggagtttgggctncgtctgggttttccncgttgcttctttaagcgtgtccaggtntcagatcgacaacgtcgggacggtacggtcggggggagtcgtgggtaccgacggtccggggaacgtccccaggacgtacctctccgtggcncgaggtcgtccgtcgtccctacgttccggttagtttcgacttattccgacgttcgggtacccgcgtaacggtcctaccggaggtaccgtaaacggggtaccgtgggtacgggttcggggtcggtacccgggtactaacggtttaagggtcggggttaggggtacgttaacggggtaaacggtttaaggttccggtacgtttaagtttttaaccggacggtaacccgtaaaggttccccggttacccgggtaaccggggtaaacggggtacccctaacgttaacccgacccgttaaccgttcccgttaaccggacggtacggccgtaaccgtaccgtaacccgtaaacgtaacccttaccgtttactccttacgtaactaacgttaccgaaacgttgacgtcctacggactaccggtctacgtagttccgtaacgttccggagttacggccggttaaggaaccgtaaggtaaccggacgggtccgggtacctacggacccggtgaccggttacggacccggtacccggg

SEQ ID NO: 79883 - DNA, 617 bp, Homo sapiens
  misc_feature: GYAE6OF02GI3EB.25.35.D02.1.454.CMB.1.raw
  modified_base (380)..(380): a, c, t, g, unknown or other
  misc_feature (380)..(380): n is a, c, g, or t
  modified_base (456)..(456): a, c, t, g, unknown or other
  misc_feature (456)..(456): n is a, c, g, or t
tcagactgtacagtcacgaccggtgctcgatttagcacacgatagttgggtttgggggggagaggagcccagcactagaagtcggcggtgtttccatccggtgatcagcactgaacacagaggactcagcatggagtttgggctgcgctgggttttcctcgttgctcttttaagaggtgtccagtgtcagatgcaactggcggaggtcggggggaggcgtggtccaggccggggaagtccctgagactctcctgtgcagtcgtccgcgtccaccttccgtcgttttggctattcactgggtccgccaggctccgaggcaagggactggaggtggggtggcggtcatagtgggtggggatgggaagtaatgctattttagngacagactccgtaggaacgggccgtactccaccatcctccgaggcgggcagcctaccaaacgaccttaccttttancgttgactaagttacgaaaaccgtgaacgactacggacgacgacggcttcgtacttattaccgtgccgggtcgggttactaggaacggtacggtacggggttccggggacccgttcgtacgggcctagggtccggaccggccggtacggggaccaacgggg

SEQ ID NO: 79884 - DNA, 825 bp, Homo sapiens
  misc_feature: GYAE6OF02H7NK2.25.35.D02.1.454.CMB.1.raw
tcagactgtacagtcacgaccggtgctcgatttagcacacgatagttgggtttgggggggagaggagcccagcactagaagtcggcggtgtttccatccggtgatcagcactgaacacagaggactcagcatggagttggctgcgctgggtttcctcgttgacttcttttaagaggtgtccagtgtcagatgctaacgtgggacggagggtacgggggggagcggtcgggtccgacggacccgggggtaacgtccccgtggaacggtaccttcctccgtggtacgtcgacggttcggtcccgcgttccctaccgtttccggttgttttcggactattccacgttcggtccctcgacggctacccgaggtcgaacggggctagggtaggtcgggtcggcggtctagtcgttaggggacggtagtacggtaaggtagtaccgtagtttatttacggacgtacgacggtaccgtccgggtacgaaaccgggtccgtaaccttaccgaacccgttcgttacccgtacgaacgggtaccgggtaccgaacggtacccttaacggaaaccgttaaccccgttacttttacgtaacctacggttaacgtaaccgtaaacgttaaaccggtacgtaacgtaaccgttaccggtaaccgacgttacccggtcgttaacgtttaccgtaaccgttacggtaccggtacccggggttacgggttacgtaaccgggtaacggtaaccgggttaccggggtacccggggttaccgtaccggtaaccggcggttaccggtaccggcccggttacggttaccgggggaacctaaccgggg

SEQ ID NO: 79885 - DNA, 811 bp, Homo sapiens
  misc_feature: GYAE6OF02IS4DX.25.35.D02.1.454.CMB.1.raw
  modified_base (184)..(184): a, c, t, g, unknown or other
  misc_feature (184)..(184): n is a, c, g, or t
tcagactgtacagtcacgaccggtgctcgatttagcacacgatagttgggtttgggggagaggagcccagcactagaagtcggcggtgtttccatccggtgatcagcaactgaacacagaggactcagcagtgggtagtttgggctgcgtcttgggttttcctcgttgcttacgttttaaaggnggttcgtcctagttgttacgagatgactaacgtgggacgggtagggcggggggaggtcgtcggtaccggagggaccggggtaacgttcccggtaggaacggtaccttcttccgtggtacgcaggttcgtccgaccgtccctccgtttccggtttcgtttaggctacgtttccgacggttcgggtcccgtaaccggtacggtcccgcccggaaggtacggtaaaaaccggggtcgtaagggtaccgggttggggtacgggtacccggtataaggttggtaccgggttaggaaggttacggaaagttagtcggtactttaagttttacggcgtaacgtaacgtccgttacgggacgaacgggtccctaccgacgtaaacctcgttaccaccgaggacggaccacgaccgtaaactaaccgtaacctttacctttaacgtcgtaacggtaaacttaacgtaaacggtaaaccgttagaaccgttacgaacccggaaacgtaccgtacggtacgttagtacttacgttaccgtcgacgggttcccgtagtacgtaacgggtaacggtccggttcgggaaccgtcggtacgacgttggaacccggagggtcccggtaccgggaacgtaccgg

SEQ ID NO: 79886 - DNA, 779 bp, Homo sapiens
  misc_feature: GYAE6OF02IE1FZ.25.35.D02.1.454.CMB.1.raw
  modified_base (160)..(160): a, c, t, g, unknown or other
  misc_feature (160)..(160): n is a, c, g, or t
  modified_base (251)..(251): a, c, t, g, unknown or other
  misc_feature (251)..(251): n is a, c, g, or t
tcagactgtacagtcacgaccggtgctcgatttagcacacgatagttgggtttgggctctgggagaggagcccagcactagaagtcggcggtgttccatccggtgatcagcactgaacacagaggactcagcatggagttgggctgcgctgggttttccncgttgcttcttttaagaggtgtccagtgcagatgcaacgtgcgagtcggggagcgtggccagccgggaagtccctgagctcctcgtgtgcngtcgtccgcgtcctaccgttccgttcgtttcggactacgttcacgtcggtccgccacggtcgtaccgtacggacgaagggtaccgtggtacggtcgggtcggccggttacgtaagttaacggtgggtagggtaagttacggggaaacgttaagtcgtacgttaacgtttttacgacggttactaacggtaaccttcccgggtagggtaaacccgggtcccgtaacgtacccgtaaccgtaccgttaccgttaccggtaacgacgggtacgaaccgtaaccgtaacccgtaaacggttaaccttaccgtttttacgtacgttacgtaacgtaacgttaacggtaaacccgtagaacgtaaccgtccggtaacgaccgtaccggttacgtacgttaaccgttagttaccgttacggttccgggtaacgggtccggttaacggaaacggttaaccgggtaccggggttaccccggggtaccgttaccggtaccggttaccggtacgggtaccggtacccggtaacccgggg

SEQ ID NO: 79887 - DNA, 825 bp, Homo sapiens
  misc_feature: GYAE6OF02F67BQ.25.35.D02.1.454.CMB.1.raw
  modified_base (160)..(160): a, c, t, g, unknown or other
  misc_feature (160)..(160): n is a, c, g, or t
  modified_base (176)..(176): a, c, t, g, unknown or other
  misc_feature (176)..(176): n is a, c, g, or t
  modified_base (180)..(180): a, c, t, g, unknown or other
  misc_feature (180)..(180): n is a, c, g, or t
  modified_base (202)..(202): a, c, t, g, unknown or other
  misc_feature (202)..(202): n is a, c, g, or t
tcagactgtacagtcacgaccggtgctcgatttagcacacgatagttggggtttgggggggagaggagcccagcactagaagtcggcggtgtttccatccggtgatcagcactgaacacagaggactcagcatggagtttgggctgcgctgggttttccncgtgcttactttaagnggtntccagtgtcagatgcaagtggnggaggtcgggggagtcgtggtacccaggacccggggaatcccgtaggacgaccttcctccgtaggtcgaccgtaggtcgtacccgcgttaccctacccgtttcgtacgttttaggcctagttccgaacgttcggggtacccccacgtaacggtcctaccgacgggtacgaaggggtacctagggaagggttcgggtgggaccggtactaagttaggtcggggtagggtagtagggtaaacgttaagtcgtaacttttagtttacggacgaccgtacgtaacgttccgggaggaacccggggtcctaaccgtaccgaaaccttagtacccgtacgtaacggggaacgaccgtaacgtaccctaaacggtaaaaccgtacctttaaaccgtttacttacgagttaacccttaaacgttaaccggaaaccgtcggtaaacctaacccggtccggtaaagtcccgtaaccggtacttcgtaaccgtttaactacggtcgggtaccggtacggggtactaacggggaacgtacccggggtaacgggttcccggggtaaccttaccgggtaccggaacgtaccgggtttaccggaacccgggtccggttaaccggggcccgttaacggg

SEQ ID NO: 79888 - DNA, 913 bp, Homo sapiens
  misc_feature: GYAE6OF02GGP83.25.35.D02.1.454.CMB.1.raw
tcagactgtacagtcacgaccggtgctcgatttagcacacgatagttgggtttggggctctgggagaggagcccagcactagaagtcggcggtgtttccatccggtgatcagcactgaacacagaggactcagcatggagtttgggctgcgctgggttttcctcgttgctcttttaagaggtcgtccagtgtcagatgcaacgtgggcggaggtcggggggaggcgtcgggtccaggccggggaagtcccgtaggacgtactccgtccgtgtgcagtcgtccgcgtccctaccttccggttcgtttcggctattcacgtcggtcccgccgacggtctaccgaggaccgaacgggtacgtgggacggttggggtcgggtcggtacgtagttaggttcgggtgggtaacgttaggggaaagttaacgttggtacgtttaagttttacgtacggaacgttaacgggtacccgtttaccggggtaaggggtaaccgggggtaccccgtaaccgtaccgaaccccgtaacgtttccgacccggaaacgggtacggacccgtaacggtaccccgtaaaacccgtaaaacgggttaaccccttttaacccgtttttacgtaccgttacgtaaaacctttaacgggttttaaaaacccgaaaacccgggttagaaaccggttacccggtaaaccgggttaaaccccggaaccgggttaacccgggttcctttacggttaaaccggtttaaccgtttaccgggttaccggggtccggggttaacccgggggttacttaaacccgggggtaaaacgggtaaacccggggttccgggggttaaaccccgggggttccctttaaccggggaacccggggttaaccgtaacggtttccccggggggacccggttaaccccgggggg

SEQ ID NO: 79889 - DNA, 807 bp, Homo sapiens
  misc_feature: GYAE6OF02GYF04.25.35.D02.1.454.CMB.1.raw
  modified_base (413)..(413): a, c, t, g, unknown or other
  misc_feature (413)..(413): n is a, c, g, or t
tcagactgtacagtcacgaccggtgctcgatttagcacacgatagttgggtttggggctctgggagagagcccagcactagaagtcggcggtgtttccatccggtgatcagcactgaacacagaggactcagcatggagtttgggctgcgcttgggttttcctcgttgcttctttaagaggtgtccagtgtcagactgacaacgtggcgggagggtcgggggggagtcggtcggtaccgacgggaccgggaacgtccccgtaggacgtaccttacgtccgtggtacgtacgacggttccggttcccgccgttacccgttaccccgtttccggtttccggttttcggaccttacgttccggtaccgtccgggtcccgacccggacggtccctacggacggacggaaggggtcgngggtacgggtgggtcggacggtacgtaacgttggtggggtagggacgttacggaagtagttgtcgtttaatttcgacgactaacggtacctacgggtaagggaccgggtaccctacgtaccgtaaacccgtagttcccgacccgagggaccacgaccgtaccgtaaccgtacttaaccggttactttacctacgactaacgttaacgtaaccgtaaccgtcggtaacgaccgttaaccgacccggtaagtcccggttaataccggttacttaacgttccggtcggggtacccggttagggttaaccaacgggttacggtaaccgggtccgggggttaccggacccgttttacgggaaccgtcggtaccggttacccgggtaccggtaccggggg

SEQ ID NO: 79890 - DNA, 743 bp, Homo sapiens
  misc_feature: GYAE6OF02G4HES.25.35.D02.1.454.CMB.1.raw
  modified_base (423)..(423): a, c, t, g, unknown or other
  misc_feature (423)..(423): n is a, c, g, or t
tcagactgtacagtcacgaccggtgctcgatttagcacacgatagttgggtttggggggagaggagcccagcactagaagtcggcggtgtttccatccggtgatcagcactgaacacagaggactcagcagtggagtttgggctgcgcgttgggttttcctcggttgcttacttttaagaggtgtccagtgtcagatgcaacgtggcggaggtcgggggagcggtcggtccgaggccgggaagtcccgtagacgaccgtctccgttgtacgcgtagtcgtccgaccgtcctaccgtttccggttcgtttcggctagttccgtacgtcggggtccgccgaggcctccgacggcgaagggcgtgggaggtcgggtggcggtcagtagtgggtaggacgtagggtaagtaacgtgacttatttagngacgacgtacgtacgaggtacgaccgtacgtacctactactccgaccgaggacggtacgaacgtacctaacgtaactaaaccgtttacccttttacgacgttaaccgtaacttaaacgttaaccgtaaaccggttacgaaccggtaccgttaaccggaaccgtacgacggtacttacgtactttaccgtacgcgggtaccggtacgggttacgaacggtaaacggtcgggtaaccgggttcgggtacccgtaacggttaccggtcgtaaccgggtaccggtacccgggtacccgggttaccgggaacccgtaaaccgggg

SEQ ID NO: 79891 - DNA, 1089 bp, Homo sapiens
  misc_feature: GYAE6OF02G3YT1.25.35.D02.1.454.CMB.1.raw
  modified_base (107)..(107): a, c, t, g, unknown or other
  misc_feature (107)..(107): n is a, c, g, or t
  modified_base (198)..(198): a, c, t, g, unknown or other
  misc_feature (198)..(198): n is a, c, g, or t
tcagactgtacagtcacgaccggtgctcgatttagcacacgatagttggggtttggggggggagaggagcccagcactagaacgtcggcggtgtttccagtccggtnactcagcactggaacacgagaggactcagctagtggagtttcgggcttgccgtcgttcgggttttccctgttgtcctttacgttttaaggnggttcgtaccgtaggtgtacgagtactcggaccgtaacggtcgggcgggtaagggggtccggggggagtccggggttcggtacccgacggggtacccggggtaaccgtcccgtaggtaaccggtccttccggttcccgtggtccggacgttaccgggtttccggaacccgttcccgttaccccgttacccggtttacgggtttccgttttacgggaacctttcggtttacccgacccgggtttacgggggtccccccgtaaccggtaaggggtccccgtaacccggttaacgggggaaccggaacggggggttaccggtagggggtttaccgggggttaccggggggtttcggggaaccccgttttaaggtaaccggtttacgggggtttggggggttaaacgggttaaggtaaacggggttaaactttacggtaccggtttaacctttttaaagtttacccgggcgtaaaccggtaaccgggtttaaaccgtttaccgggggaacgggggtaccccgtaaacccggttaaccccttttaacgaaccccgtttacgttacccgtaaccgggttaacgggacgtaaccccggtacgggttaccccttaaaaccggggtaaacctttaacccgttttaacccggtttacgtaaccgtaaccgggtttaacccgttaaacggttaccgttaaaccggtaggtaccgttaaccccggaacggtaaccgacgttcccggttaattaccggttacgttaccggtacggtccggttaccggggtcctaaggtaccggttaccgggaaccgggtacgggaccgggttaccctaaacgggtcgtaacgggttccccgtagggaaaccccggttcgggtaaacggggccccttaaacgggg

SEQ ID NO: 79892 - DNA, 693 bp, Homo sapiens
  misc_feature: GYAE6OF02GAWH5.25.35.D02.1.454.CMB.1.raw
  modified_base (258)..(258): a, c, t, g, unknown or other
  misc_feature (258)..(258): n is a, c, g, or t
  modified_base (308)..(308): a, c, t, g, unknown or other
  misc_feature (308)..(308): n is a, c, g, or t
  modified_base (356)..(356): a, c, t, g, unknown or other
  misc_feature (356)..(356): n is a, c, g, or t
  modified_base (584)..(584): a, c, t, g, unknown or other
  misc_feature (584)..(584): n is a, c, g, or t
  modified_base (603)..(603): a, c, t, g, unknown or other
  misc_feature (603)..(603): n is a, c, g, or t
tcagactgtacagtcacgaccggtgctcgatttagcacacgatagttgggtttgggggggagaggagcccagcactagaagtcggcggtgtttccatccggtgatcagcactgaacacagaggactcagcatggagtttgggctgcgcttgggttttcctcgttgcttcttttaagaggtgtccagtgtcagatgcactggcggaggtcggggggaggcgtggtccagggccgggagtcccgtgacgctctctggtcncgagtcgtccgcgtcctaccgttcgtcgtttgctattccacgtcggtccnccgaggtcctccgacggacgaagggtaccgtgggtaggtgggtcgggnggtctagtacgttggggtggtaggtaggtaagtaagtcgtacttagtttatggacgtacggtacgtcggtacgggacgggtcctactccgaccgtatcccgtacgaggtacggtcacgacgtaccaacttaaccgttactttaactccgtaatacgtaacggttaacgaaaaccggtgactaaccgtcgaacgtaccgtacgtacgttacgttaacgttaacgtccgnggtacccgggtcgggttanaacggaaccggtaagggtcccgggtacgggtaacccgtcgtaaccggggctaaggtccgggtaacccggtcggtacgggaccggtaacgg

SEQ ID NO: 79893 - DNA, 234 bp, Homo sapiens
  misc_feature: GYAE6OF02HGO8P.25.35.D02.1.454.CMB.1.raw
  modified_base (205)..(205): a, c, t, g, unknown or other
  misc_feature (205)..(205): n is a, c, g, or t
  modified_base (208)..(208): a, c, t, g, unknown or other
  misc_feature (208)..(208): n is a, c, g, or t
  modified_base (210)..(234): a, c, t, g, unknown or other
  misc_feature (210)..(234): n is a, c, g, or t
tcagactgtacagtcacgaccggtgctcgatttagcacacgatagttgggtttgggctcggtactactgctcagcatgggactctgagctcgctgctcaggtcttcggcgggggacccgttgaccgtcctaggtcagcccaaggctgccccctggtcactctcgttcccaccctcctcactgtacagtctgagcggctggcagcncangnnnnnnnnnnnnnnnnnnnnnnnnn

SEQ ID NO: 79894 - DNA, 736 bp, Homo sapiens
  misc_feature: GYAE6OF02H8C9V.25.35.D02.1.454.CMB.1.raw
  modified_base (434)..(434): a, c, t, g, unknown or other
  misc_feature (434)..(434): n is a, c, g, or t
  modified_base (606)..(606): a, c, t, g, unknown or other
  misc_feature (606)..(606): n is a, c, g, or t
tcagactgtacagtcacgaccggtgctcgatttagcacacgatagttgggtttggggggagagagcccagcactagaagtcgcggtgtttccatccggtgatcagcactgaacacagaggactcagcatggagtttgggctgcgctgggttttcctcgttgcttcttttaagaggtcgtccagtgtcagatcgcaacgtggcggaggtcgggggagcgtggtccaggccgggaatcccgtgagtactactccgtgtgctaggtcgttccggcgttaccctaccgttccggttcgttttggctattccacgttcgggtccctcgacgtccgtacccgaggtaccgaaaggggtcctgggtaacggtgggttcgggccggttcctaagtaggttcgggaggtagtacgggaaagttaacgtcgtacttagttttanggtaccaaggtaccttccgggtagaaacgggcccacctaccgaaccgtacgtcccgtaaccgaggacggcctaacggtaccctacgaaaccggttaacccttaaccgttttagccttacgtactaaacggttacgaaacgtcggtagacccgtagacccgaactcccgggtnttcgttaactacggttactagggtccggttaccgggtacctaaggtaaaccgtacggtaccgggttccgggtaccggttaccgtaccggcgaggtcccggaccggttacgggtaccgggacgtaaccggg

SEQ ID NO: 79895 - DNA, 694 bp, Homo sapiens
  misc_feature: GYAE6OF02JNJDG.25.35.D02.1.454.CMB.1.raw
  modified_base (497)..(497): a, c, t, g, unknown or other
  misc_feature (497)..(497): n is a, c, g, or t
  modified_base (561)..(561): a, c, t, g, unknown or other
  misc_feature (561)..(561): n is a, c, g, or t
tcagactgtacagtcacgaccggtgctcgatttagcacacgatagttgggtttgggggggagaggagcccagcactagaagtcggcggtgtttccatccggtgatcagcactgaacacagaggactcagcatggagtttgggctgcgctgggtttcctcgttgctctttaagaggtgtccagtgtcagtatgcaacgtggcggaggtcgggggaggcgtggtccaggccggggaacgtcctgagtaccgtctccgtgtcgacgagtcgtccgcgttccaccgttccggttcgttttcggctacttcgacgtgggtcccgccgaggtcctccgaggccgaagggtctgggaggtggggtaggtcgggtacagtgtgggtcggtagtaggaagtaagtgactatttagtgtgacgtacgcgtggaacggccgtactacgacctacgtaccgtccgaaggcggtcacgtcccgtaacctaaagacccgttaacttttccncgttactaccgtaagttaacggtaaaccgttcgacggtacttaccggaaccgacgtaaccggtnttccgtaacgttacgttacgcgggtacgggtcccggttcgtaaacggaaggtaccggtacgggtccggggtacccttacggtaaccggcgttaccggcggaacccggtccgggtacgggacccggtaaacggg

SEQ ID NO: 79896 - DNA, 725 bp, Homo sapiens
  misc_feature: GYAE6OF02IGK0U.25.35.D02.1.454.CMB.1.raw
  modified_base (183)..(183): a, c, t, g, unknown or other
  misc_feature (183)..(183): n is a, c, g, or t
  modified_base (198)..(198): a, c, t, g, unknown or other
  misc_feature (198)..(198): n is a, c, g, or t
  modified_base (284)..(285): a, c, t, g, unknown or other
  misc_feature (284)..(285): n is a, c, g, or t
  modified_base (330)..(330): a, c, t, g, unknown or other
  misc_feature (330)..(330): n is a, c, g, or t
  modified_base (364)..(364): a, c, t, g, unknown or other
  misc_feature (364)..(364): n is a, c, g, or t
  modified_base (489)..(489): a, c, t, g, unknown or other
  misc_feature (489)..(489): n is a, c, g, or t
tcagactgtacagtcacgaccggtgctcgatttagcacacgatagttgggtttggggggggagaggagcccagcactagaagtcggcggtgtttccatccggtgatcagcactgaacacagaggactcagcagtggaggtttgggcttgcgcgttgggttttcctcgttgcttctttaaaggnggttcgtcctaggtntcgagtatgactaacgtcggcgggtaggggtggggggaggcggtcggtccgaggcggggtaactcccgtgacacgtctcctgtcgnngtcgcgctcctccttccgttcgtttgctattcgacgtcgggtccncgacggtcctccgacggacgaacgggtacgtggngggttcggtggtcgtcgtaagttggtgggtggtagtacggtaagtagttgtacttacgttttagcgtacgtagaccggtcggtagggaccggctaccgtacaacgtcttacgcggtaagcgtacnccgaaccttaccgaaactaacctttcttttacgtcgtaacgtaaacgtacgttaaacgaacggtagtacgacccgtagaaccaaccggtcgttacgttccgttataccgttacgaccggggttcggaccggttacgaacggtaacgtaaaccgggggtccgggttccgggtaaccgttaccggacgggtcttacgggtacccggcggggttaccccggtacgggacccggaacggg

SEQ ID NO: 79897 - DNA, 760 bp, Homo sapiens
  misc_feature: GYAE6OF02JYXVH.25.35.D02.1.454.CMB.1.raw
  modified_base (171)..(171): a, c, t, g, unknown or other
  misc_feature (171)..(171): n is a, c, g, or t
  modified_base (608)..(608): a, c, t, g, unknown or other
  misc_feature (608)..(608): n is a, c, g, or t
tcagactgtacagtcacgaccggtgctcgatttagcacacgatagttgggtttgggggggagaggagcccagcactagaagtcggcggtgtttccatccggtgatcagcactgaacacagagactcagcatggagttgggctgcgctggttttcctcgttgctctttaagnggtgtccagtgtcagatgcaacgtggcggaggtcgggggagtcggtggtccgaggccggggtaatcccgtgagtaccgtcctccgtgtcgcgtagttcgtccggccgttccctaccgtttccggttcgtttggcctattccgacgttccggggtccaccgaggtcctaacccgagggaccgtaaagggtccgtggggacggttgggggtacggtccggttactaggtttagtacggggttggggaacgttagggtaaacgttaagtcgtactttaagttttagcggaactaagtccgttacgggtaggtaaccggggaccctagtcccaacgtcttaccgtacgaagtacggactacgtaccaccgtaaacgtcttaccgtttactcggacttagtaaacgttaccggaaacgtcgaaccgtaacgtcggtaaaccncggtacccgtagttacgaacgtttaccgtacggtcggtaccgggtcgtacggtaacggaacggttaccggggaacggtttcccggggtaccttaacggtacgggaccttagggttaccggaacccgtcggggtacccgtaacccggtaacgg

SEQ ID NO: 79898 - DNA, 869 bp, Homo sapiens
  misc_feature: GYAE6OF02JN27R.25.35.D02.1.454.CMB.1.raw
  modified_base (183)..(183): a, c, t, g, unknown or other
  misc_feature (183)..(183): n is a, c, g, or t
tcagactgtacagtcacgaccggtgctcgatttagcacacgatagttgggtttggggggagaggagcccagcactagaagtcggcggtgtttccatccggtgatcagcactgaaccacagaggactcagcatggagtttggctgcgtcgttgggttttacctcgttgcttacgttttaaacgnggtgtaccagtgtcagatgcacgtggcggaggtcgggggagcgtggtccaggccgggtaagtccctgacgaccttctccgtgtcgacgtagtcgtccgcgtcctaccgtttccggttcgttttcggctacgttaccgaccgttcggtcccgaccgaggtccctaccggacggacgaacgggtccgttagggtacggttacggggtcggtaccggttacgtaaggttacggttcggggtacgggtaacggttagggtaaaaggtttaacgtcggtacctttaagttttagccgtaacgtaacggtaccgttaccgggtaagggtaacccggggtacccgtaaccgttacccgaacccgttacccgttaccgtaaccccggtaaggtacggaaccctacgggaccccttaaaaccggtaaacgttaacccgtttaacccgtttttaccgtaccggttaacgttacccgttaaaacgtttacccggaaaaccgttggacccggttaaccgtaacccggtaaaccgaacccgttacgggttacttacggttaacctttaaccggtacgtccgggtcgggttaacccggtattaacggaccgggtaaccggttaccggggtcgggtccccttaagggtcgtaccggacggttcccggaaccggttccgggaaccggtaccgggtaaaccgg

SEQ ID NO: 79899 - DNA, 851 bp, Homo sapiens
  misc_feature: GYAE6OF02HECOV.25.35.D02.1.454.CMB.1.raw
  modified_base (110)..(110): a, c, t, g, unknown or other
  misc_feature (110)..(110): n is a, c, g, or t
  modified_base (187)..(187): a, c, t, g, unknown or other
  misc_feature (187)..(187): n is a, c, g, or t
  modified_base (244)..(244): a, c, t, g, unknown or other
  misc_feature (244)..(244): n is a, c, g, or t
  modified_base (773)..(773): a, c, t, g, unknown or other
  misc_feature (773)..(773): n is a, c, g, or t
tcagactgtacagtcacgaccggtgctcgatttagcacacgatagttgggttggggggagaggagccagcactagaagtcgcgtgttccatccgtgatcagcactgaacncagacggtactccaggctagtcggagtttgggctgccgtcgttacgggttttcctcggttgccttacttttaaaggnggttgtacccagttcgtacagattcgcctaacgtgggaccggtagggtccggggggngtcggtacggtcccgagggacccggggagttccccaggtacgaccgttcgtccttgggtacgcgttaaggtccgggtaccgtacccggttccctaccctttccggttcggttttaccggccgttacttaccgttaccgggttacggacccgtcggtaccgttcccgtaacggacggtaacggtaccggtacggttacgggtcggggttcggggtacggttcggtaacgtgtacgggtacgggtaggtacgtaaggtagtacgtgtaacgttttagtagtccaacgtacggtccgtaccggggtacgtaaccgggaccttaccgacgttacccgtaccgtaccgtaacggaccggacgtaccgtaacggtacctaaaccgggtaaccctttaaccgttaaccttttccgaacggtattaaaacccggtacgaaaaccgggttacgtacccggacgttaccgacggtactaccggacccttggtacgttaccttcgtcggtaacgggtccgtaggtacgaaggtacccggnggggtaccggttacgggttccaaccggtcgtaaccggtcggtaaccgggtccggaaccggttcggaacccggtaccgg

SEQ ID NO: 79900 - DNA, 220 bp, Homo sapiens
  misc_feature: GYAE6OF01AMFSQ.44.25.C03.1.454.CMB.1.raw
  modified_base (217)..(220): a, c, t, g, unknown or other
  misc_feature (217)..(220): n is a, c, g, or t
tcagacagtatatacacgaccggtgctcgatttagtagtgtagatttgggtttggggaagaggaagactgacggtcctcccaggagttcaggtgctgggcaccttgggcacggggaggtgtgtcacaagatttgggctctgggcacagcggccctgggctgcctggtcaaggactacttcctatatactgtctgagcgggctggcaaggcgcatagnnnn

SEQ ID NO: 79901 - DNA, 228 bp, Homo sapiens
  misc_feature: GYAE6OF01C68MM.44.25.C03.1.454.CMB.1.raw
  modified_base (209)..(228): a, c, t, g, unknown or other
  misc_feature (209)..(228): n is a, c, g, or t
tcagacagtatatacacgaccggtgctcgattagtagtgtagattgggttgggaagaggaagactgacggtcctccaggagttcaggtgctggcaccttggcacgggaggtgtgtcacaagatttgggctctgggcacagcggccctgggctgcctggtcaaggactacttccacgtctactgctgagcgggctggcaaggcgcatagnnnnnnnnnnnnnnnnnnnn

SEQ ID NO: 79902 - DNA, 218 bp, Homo sapiens
  misc_feature: GYAE6OF01DDUAW.44.25.C03.1.454.CMB.1.raw
  modified_base (215)..(218): a, c, t, g, unknown or other
  misc_feature (215)..(218): n is a, c, g, or t
tcagacagtatatacacgaccggtgctcgatttagtagtgtagattgggtttgggaagaggaagactgacggtcctcccaggagttcaggtgctgggcaccttgggcacggggaggtgtgtcacaagatttgggctctgggcacagcggccctgggctgcctggtcaaggactacttcctcgatcgcgtctgagcgggctggcaaggcgcatagnnnn

SEQ ID NO: 79903 - DNA, 294 bp, Homo sapiens
  misc_feature: GYAE6OF01BUTW7.44.25.C03.1.454.CMB.1.raw
  modified_base (290)..(294): a, c, t, g, unknown or other
  misc_feature (290)..(294): n is a, c, g, or t
tcagacagtatatacacgaccggtgctcgatttagtagtgtagatttgggtttgggtgtggtggtctccactcccgccttgacgggctgctatctgcctccctggccatcactgggctccaggctgaggacgaggctgattattactgcagctcatatacaagtgggaacactttactattcggcgcagggaccaagctgaccgtcctaggtcagcccaaggctgccccctggtcactctgttcccacctcctctatatactgtctgagcgggctggcaaggcgcatagnnnnn

SEQ ID NO: 79904 - DNA, 127 bp, Homo sapiens
  misc_feature: GYAE6OF01COKM4.44.25.C03.1.454.CMB.1.raw
  modified_base (127)..(127): a, c, t, g, unknown or other
  misc_feature (127)..(127): n is a, c, g, or t
tcagacagtatatacacgaccggtgctcgattagtagtgtagattgggttgggcacagcggccctgggctgcctggtcaaggactacttcctatatactgtctgagcgggctggcaaggcgcatagn

SEQ ID NO: 79905 - DNA, 239 bp, Homo sapiens
  misc_feature: GYAE6OF01CT3HE.44.25.C03.1.454.CMB.1.raw
  modified_base (237)..(239): a, c, t, g, unknown or other
  misc_feature (237)..(239): n is a, c, g, or t
tcagacagtatatacacgaccggtgctcgatttagtagtgtagatttgggtttgggtgcccaagctgctggagggcacggtcaccacggtcaccgtctcctcagcttccaccaagggcccatcggtcttcccctggcgccctgctccaggagcacctctggggcacagcggccctgggctgcctggtcaaggactacttcctatatactgtctgagcgggctggcaaggcgcatagnnn

SEQ ID NO: 79906 - DNA, 239 bp, Homo sapiens
  misc_feature: GYAE6OF01BYOTR.44.25.C03.1.454.CMB.1.raw
  modified_base (235)..(239): a, c, t, g, unknown or other
  misc_feature (235)..(239): n is a, c, g, or t
tcagacagtatatacacgaccggtgctcgatttagtagtgtagatttggtttggtgcccaagctgctggagggcacggtcaccacggtcaccgtctcctcagcttccaccaagggcccatcggtcttcccctggcgccctgctccaggagcacctctggggcacagcggccctgggctgcctggtcaaggactacttccacgtctactgctgagcgggctggcaaggcgcatagnnnnn

SEQ ID NO: 79907 - DNA, 128 bp, Homo sapiens
  misc_feature: GYAE6OF01D9Y1S.44.25.C03.1.454.CMB.1.raw
  modified_base (128)..(128): a, c, t, g, unknown or other
  misc_feature (128)..(128): n is a, c, g, or t
tcagacagtatatacacgaccggtgctcgatttagtagtgtagatttgggttggcacagcggccctgggctgcctggtcaaggactacttcctcgatcgcgtctgagcgggctggcaaggcgcatagn

SEQ ID NO: 79908 - DNA, 238 bp, Homo sapiens
  misc_feature: GYAE6OF01A2FJV.44.25.C03.1.454.CMB.1.raw
  modified_base (237)..(238): a, c, t, g, unknown or other
  misc_feature (237)..(238): n is a, c, g, or t
tcagacagtatatacacgaccggtgctcgatttagtagtgtagatttgggtttgggtgcccaagctgctggagggcacggtcaccacggtcaccgtctcctcagcttccaccaagggcccatcggtcttcccctggcgccctgctccaggagcacctctggggcacagcggccctgggctgcctggtcaaggactacttcctatatactgtctgagcgggctggcaaggcgcatagnn

SEQ ID NO: 79909 - DNA, 219 bp, Homo sapiens
  misc_feature: GYAE6OF01EGD9Q.44.25.C03.1.454.CMB.1.raw
  modified_base (218)..(219): a, c, t, g, unknown or other
  misc_feature (218)..(219): n is a, c, g, or t
tcagacagtatatacacgaccggtgctcgatttagtagtgtagatttgggtttgggggaagaggaagactgacggtcctcccaggagttcaggtgctgggcaccttgggcacggggaggtgtgtcacaagatttgggctctgggcacagcggccctgggctgcctggtcaaggactacttcctatatactgtctgagcgggctggcaaggcgcatagnn

SEQ ID NO: 79910 - DNA, 188 bp, Homo sapiens
  misc_feature: GYAE6OF01BTKPN.44.25.C03.1.454.CMB.1.raw
  modified_base (187)..(188): a, c, t, g, unknown or other
  misc_feature (187)..(188): n is a, c, g, or t
tcagacagtatatacacgaccggtgctcgatttagtagtgtagatttgggtttgggaggtgtgtcacaagatttgggctctgggcaccgtgggcacggggaggtgtgtcacaagatttgggccctgggctgcctggtcaaggactacttcctatatactgtctgagcgggctggcaaggcgcatagnn

SEQ ID NO: 79911 - DNA, 131 bp, Homo sapiens
  misc_feature: GYAE6OF01BTR2N.44.25.C03.1.454.CMB.1.raw
  modified_base (130)..(131): a, c, t, g, unknown or other
  misc_feature (130)..(131): n is a, c, g, or t
tcagacagtatatacacgaccggtgctcgatttagtagtgtagatttgggtttgggcacagcggccctgggctgcctggtcaaggactacttccacgtctactgctgagcgggctggcaaggcgcatagnn

SEQ ID NO: 79912 - DNA, 238 bp, Homo sapiens
  misc_feature: GYAE6OF01DPTKW.44.25.C03.1.454.CMB.1.raw
  modified_base (236)..(238): a, c, t, g, unknown or other
  misc_feature (236)..(238): n is a, c, g, or t
tcagacagtatatacacgaccggtgctcgatttagtagtgtagatttgggtttggtgcccaagctgctggagggcacggtcaccacggtcaccgtctcctcagcttccaccaagggcccatcggtcttcccctggcgccctgctccaggagcacctctggggcacagcggccctgggctgcctggtcaaggactacttcctatatactgtctgagcgggctggcaaggcgcatagnnn

SEQ ID NO: 79913 - DNA, 219 bp, Homo sapiens
  misc_feature: GYAE6OF01BPNN3.44.25.C03.1.454.CMB.1.raw
  modified_base (217)..(219): a, c, t, g, unknown or other
  misc_feature (217)..(219): n is a, c, g, or t
tcagacagtatatacacgaccggtgctcgatttagtagtgtagatttgggtttggggaagaggaagactgacggtcctcccaggagttcaggtgctgggcaccttgggcatggggaggtgtgtcacaagatttgggctctgggcacagcggccctgggctgcctggtcaaggactacttccacgtctactgctgagcgggctggcaaggcgcatagnnn

SEQ ID NO: 79914 - DNA, 239 bp, Homo sapiens; identical to SEQ ID NO: 79905
  misc_feature: GYAE6OF01CVOCK.44.25.C03.1.454.CMB.1.raw
  modified_base (237)..(239): a, c, t, g, unknown or other
  misc_feature (237)..(239): n is a, c, g, or t

SEQ ID NO: 79915 - DNA, 249 bp, Homo sapiens
  misc_feature: GYAE6OF01AKSA0.44.25.C03.1.454.CMB.1.raw
  modified_base (238)..(249): a, c, t, g, unknown or other
  misc_feature (238)..(249): n is a, c, g, or t
tcagacagtatatacacgaccggtgctcgatttagtagtgtagatttgggtttgggtgcccaagctgctggagggcacggtcaccacggtcaccgtctcctcagcttccaccaagggcccatcggtcttcccctggcgccctgctccaggagcacctctgggggcacagcggccctgggctgcctggtcaaggactacttccacgtctactgctgagcgggctggcaaggcgcatagnnnnnnnnnnnn

SEQ ID NO: 79916 - DNA, 251 bp, Homo sapiens
  misc_feature: GYAE6OF01EDGJV.44.25.C03.1.454.CMB.1.raw
  modified_base (239)..(251): a, c, t, g, unknown or other
  misc_feature (239)..(251): n is a, c, g, or t
tcagacagtatatacacgaccggtgctcgatttagtagtgtagatttgggtttgggtgcccaagctgctggagggcacggtcaccacggtcaccgtctcctcagcttccaccaagggcccatcggtcttcccctggcgccctgctccaggagcacctctgggggcacagcggccctgggctgcctggtcaaggactacttcctatatactggtctgagcgggctggcaaggcgcatagnnnnnnnnnnnnn

SEQ ID NO: 79917 - DNA, 279 bp, Homo sapiens
  misc_feature: GYAE6OF01AMSO4.44.25.C03.1.454.CMB.1.raw
  modified_base (245)..(279): a, c, t, g, unknown or other
  misc_feature (245)..(279): n is a, c, g, or t
tcagacagtatatacacgaccggtgctcgatttagtagtgtagatttgggtttgggtgcccaagctagctggagggcaacggtcaacacggtcaccgtctcctcagcttccaccaagggtcccgtatcggtcttccccctggcgccctgctccaggaggcacctctgggggcacagcggccctgggctgccttggtcaaggctacttccacgtctactgctgagcgggctggcaaggcgcatagnnnnnnnnnnnnnnnnnnnnnnnnnnnnnnnnnnn

SEQ ID NO: 79918 - DNA, 131 bp, Homo sapiens
  misc_feature: GYAE6OF01A52MD.44.25.C03.1.454.CMB.1.raw
  modified_base (130)..(131): a, c, t, g, unknown or other
  misc_feature (130)..(131): n is a, c, g, or t
tcagacagtatatacacgaccggtgctcgatttagtagtgtagatttgggtttgggcacagcggccctgggctgcctggtcaaggactacttcctatatactgtctgagcgggctggcaaggcgcatagnn

SEQ ID NO: 79919 - DNA, 130 bp, Homo sapiens
  misc_feature: GYAE6OF01DTMST.44.25.C03.1.454.CMB.1.raw
  modified_base (129)..(130): a, c, t, g, unknown or other
  misc_feature (129)..(130): n is a, c, g, or t
tcagacagtatatacacgaccggtgctcgatttagtagtgtagatttgggtttggcacagcggccctgggctgcctggtcaaggactacttcctatatactgtctgagcgggctggcaaggcgcatagnn

SEQ ID NO: 79920 - DNA, 242 bp, Homo sapiens
  misc_feature: GYAE6OF01EPUFY.44.25.C03.1.454.CMB.1.raw
  modified_base (238)..(242): a, c, t, g, unknown or other
  misc_feature (238)..(242): n is a, c, g, or t
tcagacagtatatacacgaccggtgctcgatttagtagtgtagatttgggtttgggtgcccaagctgctggagggcacggtcaccacggtcaccgtctcctcagcttccaccaagggcccatcggtcttcccctggcgccctgctccaggagcacctctgggggcacagcggccctgggctgcctggtcaaggactacttcctatatactgtctgagcgggctggcaaggcgcatagnnnnn

SEQ ID NO: 79921 - DNA, 130 bp, Homo sapiens
  misc_feature: GYAE6OF01DLJB5.44.25.C03.1.454.CMB.1.raw
  modified_base (130)..(130): a, c, t, g, unknown or other
  misc_feature (130)..(130): n is a, c, g, or t
tcagacagtatatacacgaccggtgctcgatttagtagtgtagatttgggtttgggcacagcggccctgggctgcctggtcaaggactacttcctatatactgtctgagcgggctggcaaggcgcatagn

SEQ ID NO: 79922 - DNA, 236 bp, Homo sapiens
  misc_feature: GYAE6OF01DK3YQ.44.25.C03.1.454.CMB.1.raw
  modified_base (218)..(236): a, c, t, g, unknown or other
  misc_feature (218)..(236): n is a, c, g, or t
tcagacagtatatacacgaccggtgctcgatttagtagtgtagatttgggtttgggggaagaggaagactgacggtcctcccaggagttcaggtgctgggcaccttgggcacggggaggtgtgtcacaagatttgggctctgggcacagcggccctgggctgcctggtcaaggactacttcctatatactgtctgagcgggctggcaaggcgcatagnnnnnnnnnnnnnnnnnnn

SEQ ID NO: 79923 - DNA, 250 bp, Homo sapiens
  misc_feature: GYAE6OF01CR9VG.44.25.C03.1.454.CMB.1.raw
  modified_base (236)..(250): a, c, t, g, unknown or other
  misc_feature (236)..(250): n is a, c, g, or t
tcagacagtatatacacgaccggtgctcgatttagtagtgtagatttgggtttgggtgcccaagctgctggagggcacggtcaccacggtcaccgtctcctcagcttccaccaagggcccatcggtcttcccctggcgccctgctccaggagcacctctggggcacagcggccctgggctgcctggtcaaggactacttccacgtctactgctgagcggctggcaaggcgcatagnnnnnnnnnnnnnnn

SEQ ID NO: 79924 - DNA, 243 bp, Homo sapiens
  misc_feature: GYAE6OF01BH6UO.44.25.C03.1.454.CMB.1.raw
  modified_base (238)..(243): a, c, t, g, unknown or other
  misc_feature (238)..(243): n is a, c, g, or t
tcagacagtatatacacgaccggtgctcgatttagtagtgtagatttgggtttgggtgcccaagctgctggagggcacggtcaccacggtcaccgtctcctcagcttccaccaagggcccatcggtcttcccctggcgccctgctccaggagcacctctgggggcacagcggccctgggctgcctggtcaaggactacttcctcgatcgcgtctgagcgggctggcaaggcgcatagnnnnnn

SEQ ID NO: 79925 - DNA, 271 bp, Homo sapiens
  misc_feature: GYAE6OF01ALZ73.44.25.C03.1.454.CMB.1.raw
  modified_base (263)..(271): a, c, t, g, unknown or other
  misc_feature (263)..(271): n is a, c, g, or t
tcagacagtatatacacgaccggtgctcgatttagtagtgtagatttgggtttgggggaagaggaagactgacggtcctcccaggagttcaggtgctgggcaccttgggcacgggggaggtgtgtcacaagatttgggctctgggcaccgtgggcatgggggaggtgtgtcacaagatttgggctctgggcacagcggccctgggctgcctggtcaaggctacttcctatatactgtctgagcgggctggcaaggcgcatagnnnnnnnnn

SEQ ID NO: 79926 - DNA, 240 bp, Homo sapiens
  misc_feature: GYAE6OF01AUOJO.44.25.C03.1.454.CMB.1.raw
  modified_base (238)..(240): a, c, t, g, unknown or other
  misc_feature (238)..(240): n is a, c, g, or t
tcagacagtatatacacgaccggtgctcgatttagtagtgtagatttgggtttgggtgcccaagctgctggagggcacggtcaccacggtcaccgtctcctcagcttccaccaagggcccatcggtcttcccctggcgccctgctccaggagcacctctgggggcacagcggccctgggctgcctggtcaaggactacttcctatatactgtctgagcgggctggcaaggcgcatagnnn

SEQ ID NO: 79927 - DNA, 188 bp, Homo sapiens
  misc_feature: GYAE6OF01DSBE1.44.25.C03.1.454.CMB.1.raw
  modified_base (188)..(188): a, c, t, g, unknown or other
  misc_feature (188)..(188): n is a, c, g, or t
tcagacagtatatacacgaccggtgctcgatttagtagtgtagatttgggtttggggaggtgtgtcacaagatttgggctctgggcaccgtgggcacggggaggtgtgtcacaagatttgggccctgggctgcctggtcaaggactacttcctatatactgtctgagcgggctggcaaggcgcatagn

SEQ ID NO: 79928 - DNA, 272 bp, Homo sapiens
  misc_feature: GYAE6OF01D9SEB.44.25.C03.1.454.CMB.1.raw
  modified_base (225)..(272): a, c, t, g, unknown or other
  misc_feature (225)..(272): n is a, c, g, or t
tcagacagtatatacacgaccggtgctcgatttagtagtgtagatttgggtttgggtaaggaggaagactgacggtcctcccaggagttcacggtgcgtgggcaccttacgggcacggggaggtgtgttcactaagatttgggctctgggcacagcggaccctgggctgcctggtcaaggactacttccacgtctactgctgagtcggctggcaaggcgcatagnnnnnnnnnnnnnnnnnnnnnnnnnnnnnnnnnnnnnnnnnnnnnnnn

SEQ ID NO: 79929 - DNA, 259 bp, Homo sapiens
  misc_feature: GYAE6OF01B5WV4.44.25.C03.1.454.CMB.1.raw
  modified_base (241)..(259): a, c, t, g, unknown or other
  misc_feature (241)..(259): n is a, c, g, or t
tcagacagtatatacacgaccggtgctcgatttagtagtgtagatttgggtttgggtgcccaagctgctggagggcacggtcaccacggtcaccgtctcctcagcttccaccaagggcccatcggtcttccccctggcgccctgctccaggagcacctctgggggcacagcggccctgggctgcctggtcaaggactacttcctatagtactgtctgagcgggctggcaaggcgcgatagnnnnnnnnnnnnnnnnnnn

SEQ ID NO: 79930 - DNA, 240 bp, Homo sapiens; identical to SEQ ID NO: 79926
  misc_feature: GYAE6OF01AY50O.44.25.C03.1.454.CMB.1.raw
  modified_base (238)..(240): a, c, t, g, unknown or other
  misc_feature (238)..(240): n is a, c, g, or t

SEQ ID NO: 79931 - DNA, 130 bp, Homo sapiens
  misc_feature: GYAE6OF01B3QDK.44.25.C03.1.454.CMB.1.raw
  modified_base (130)..(130): a, c, t, g, unknown or other
  misc_feature (130)..(130): n is a, c, g, or t
tcagacagtatatacacgaccggtgctcgatttagtagtgtagatttgggtttgggcacagcggccctgggctgcctggtcaaggactacttcctcgatcgcgtctgagcgggctggcaaggcgcatagn

SEQ ID NO: 79932 - DNA, 242 bp, Homo sapiens
  misc_feature: GYAE6OF01ENMQY.44.25.C03.1.454.CMB.1.raw
  modified_base (238)..(242): a, c, t, g, unknown or other
  misc_feature (238)..(242): n is a, c, g, or t
tcagacagtatatacacgaccggtgctcgatttagtagtgtagatttgggtttgggtgcccaagctgctggagggcacggtcaccacggtcaccgtctcctcagcttccaccaagggcccatcggtcttcccctggcgccctgctccaggagcacctctgggggcacagcggccctgggctgcctggtcaaggactacttcctcgatcgcgtctgagcgggctggcaaggcgcatagnnnnn

SEQ ID NO: 79933 - DNA, 241 bp, Homo sapiens
  misc_feature: GYAE6OF01D7QQJ.44.25.C03.1.454.CMB.1.raw
  modified_base (238)..(241): a, c, t, g, unknown or other
  misc_feature (238)..(241): n is a, c, g, or t
tcagacagtatatacacgaccggtgctcgatttagtagtgtagatttgggtttggttgcccaagctgctggagggcacggtcaccacggtcaccgtctcctcagcttccaccaagggcccatcggtcttcccctggcgccctgctccaggagcacctctgggggcacagcggccctgggctgcctggtcaaggactacttcctatatactgtctgagcgggctggcaaggcgcatagnnnn

SEQ ID NO: 79934 - DNA, 130 bp, Homo sapiens; identical to SEQ ID NO: 79921
  misc_feature: GYAE6OF01DJSI1.44.25.C03.1.454.CMB.1.raw
  modified_base (130)..(130): a, c, t, g, unknown or other
  misc_feature (130)..(130): n is a, c, g, or t

SEQ ID NO: 79935 - DNA, 356 bp, Homo sapiens
  misc_feature: GYAE6OF01BNI11.44.25.C03.1.454.CMB.1.raw
  modified_base (308)..(308): a, c, t, g, unknown or other
  misc_feature (308)..(308): n is a, c, g, or t
  modified_base (310)..(324): a, c, t, g, unknown or other
  misc_feature (310)..(324): n is a, c, g, or t
  modified_base (326)..(356): a, c, t, g, unknown or other
  misc_feature (326)..(356): n is a, c, g, or t
tcagacagtatatacacgaccggtgctcgatttagtagtgtagatttgggtttgggggttggtggtggtctccacgtcccgccttgacggggctgctatctcgcctccctggccatccactgggctccaggctgaaggatgagggtgattattactgccagtcctatgacagcagcctcagtggttcgggtgttcggcggagggaccaagctgaccgtcctgggtcagcccaaggctgccccctgggtcactctgttcccgccctcctctatatactgtctgagcgggctggcaaggccgcataggcngnnnnnnnnnnnnnnngnnnnnnnnnnnnnnnnnnnnnnnnnnnnnnn

SEQ ID NO: 79936 - DNA, 267 bp, Homo sapiens
  misc_feature: GYAE6OF01CY258.44.25.C03.1.454.CMB.1.raw
  modified_base (228)..(267): a, c, t, g, unknown or other
  misc_feature (228)..(267): n is a, c, g, or t
tcagacagtatatacacgaccggtgctcgatttagtagtgtagatttgggtttggggggtaaggaggaagactgacggtcctcccaggagttcaggtgctgggcaccgttgggcacgggggaggtgtgttccacaagactttgggctctgggcacagcggccctgggctgcctggtcaaggactacttcctatatacctgtcctgagcgggctggcaaggcgcatagnnnnnnnnnnnnnnnnnnnnnnnnnnnnnnnnnnnnnnnn

SEQ ID NO: 79937 - DNA, 220 bp, Homo sapiens
  misc_feature: GYAE6OF01CC1XZ.44.25.C03.1.454.CMB.1.raw
  modified_base (218)..(220): a, c, t, g, unknown or other
  misc_feature (218)..(220): n is a, c, g, or t
tcagacagtatatacacgaccggtgctcgatttagtagtgtagatttgggtttgggggaagaggaagactgacggtcctcccaggagttcaggtgctgggcaccttgggcacggggaggtgtgtcacaagatttgggctctgggcacagcggccctgggctgcctggtcaaggactacttcctatatactgtctgagcgggctggcaaggcgcatagnnn

SEQ ID NO: 79938 - DNA, 240 bp, Homo sapiens
  misc_feature: GYAE6OF01DF4C9.44.25.C03.1.454.CMB.1.raw
  modified_base (238)..(240): a, c, t, g, unknown or other
  misc_feature (238)..(240): n is a, c, g, or t
tcagacagtatatacacgaccggtgctcgatttagtagtgtagatttgggtttgggtgcccaagctgctggagggcatggtcaccacggtcaccgtctcctcagcttccaccaagggcccatcggtcttcccctggcgccctgctccaggagcacctctgggggcacagcggccctgggctgcctggtcaaggactacttcctatatactgtctgagcgggctggcaaggcgcatagnnn

SEQ ID NO: 79939 - DNA, 131 bp, Homo sapiens; identical to SEQ ID NO: 79911
  misc_feature: GYAE6OF01C7R21.44.25.C03.1.454.CMB.1.raw
  modified_base (130)..(131): a, c, t, g, unknown or other
  misc_feature (130)..(131): n is a, c, g, or t

SEQ ID NO: 79940 - DNA, 220 bp, Homo sapiens
  misc_feature: GYAE6OF01AVTPK.44.25.C03.1.454.CMB.1.raw
  modified_base (218)..(220): a, c, t, g, unknown or other
  misc_feature (218)..(220): n is a, c, g, or t
tcagacagtatatacacgaccggtgctcgatttagtagtgtagatttgggtttgggggaagaggaagactgacggtcctcccaggagttcaggtgctgggcaccttgggcatggggaggtgtgtcacaagatttgggctctgggcacagcggccctgggctgcctggtcaaggactacttccacgtctactgctgagcgggctggcaaggcgcatagnnn

SEQ ID NO: 79941 - DNA, 160 bp, Homo sapiens
  misc_feature: GYAE6OF01BNFVF.44.25.C03.1.454.CMB.1.raw
  modified_base (157)..(160): a, c, t, g, unknown or other
  misc_feature (157)..(160): n is a, c, g, or t
tcagacagtatatacacgaccggtgctcgatttagtagtgtagatttgggttgggaggtgtgtcacaagatttgggctctgggcacagcggccctgggctgcctggtcaaggactacttcctatatactgtctgagcgggctggcaaggcgcatagnnnn

SEQ ID NO: 79942 - DNA, 130 bp, Homo sapiens; identical to SEQ ID NO: 79921
  misc_feature: GYAE6OF01EPA0N.44.25.C03.1.454.CMB.1.raw
  modified_base (130)..(130): a, c, t, g, unknown or other
  misc_feature (130)..(130): n is a, c, g, or t

SEQ ID NO: 79943 - DNA, 239 bp, Homo sapiens
  misc_feature: GYAE6OF01AHZKO.44.25.C03.1.454.CMB.1.raw
  modified_base (237)..(239): a, c, t, g, unknown or other
  misc_feature (237)..(239): n is a, c, g, or t
tcagacagtatatacacgaccggtgctcgatttagtagtgtagatttgggtttgggtgcccaagctgctggagggcacggtcaccacggtcaccgtctcctcagcttccaccaagggcccatcggtcttcccctggcaccctcctccaagagcacctctggggcacagcggccctgggctgcctggtcaaggactacttcctatatactgtctgagcgggctggcaaggcgcatagnnn

SEQ ID NO: 79944 - DNA, 130 bp, Homo sapiens
  misc_feature: GYAE6OF01DEQB9.44.25.C03.1.454.CMB.1.raw
  modified_base (130)..(130): a, c, t, g, unknown or other
  misc_feature (130)..(130): n is a, c, g, or t
tcagacagtatatacacgaccggtgctcgatttagtagtgtagatttgggtttgggcacagcggccctgggctgcctggtcaaggactacttccacgtctactgctgagcgggctggcaaggcgcatagn

SEQ ID NO: 79945 - DNA, 132 bp, Homo sapiens
  misc_feature: GYAE6OF01D2AHG.44.25.C03.1.454.CMB.1.raw
  modified_base (130)..(132): a, c, t, g, unknown or other
  misc_feature (130)..(132): n is a, c, g, or t
tcagacagtatatacacgaccggtgctcgatttagtagtgtagatttgggtttgggcacagcggccctgggctgcctggtcaaggactacttcctcgatcgcgtctgagcgggctggcaaggcgcatagnnn

SEQ ID NO: 79946 - DNA, 238 bp, Homo sapiens
  misc_feature: GYAE6OF01EGP2S.44.25.C03.1.454.CMB.1.raw
  modified_base (237)..(238): a, c, t, g, unknown or other
  misc_feature (237)..(238): n is a, c, g, or t
tcagacagtatatacacgaccggtgctcgatttagtagtgtagatttgggtttgggtgcccaagctgctggagggcacggtcaccacggtcaccgtctcctcagcttccaccaagggcccatcggtcttcccctggcgccctgctccaggagcacctctggggcacagcggccctgggctgcctggtcaaggactacttccacgtctactgctgagcgggctggcaaggcgcatagnn

SEQ ID NO: 79947 - DNA, 241 bp, Homo sapiens
  misc_feature: GYAE6OF01CECNF.44.25.C03.1.454.CMB.1.raw
  modified_base (239)..(241): a, c, t, g, unknown or other
  misc_feature (239)..(241): n is a, c, g, or t
tcagacagtatatacacgaccggtgctcgatttagtagtgtagatttgggtttgggtgcccaagctgctggagggcacggtcaccacggtcaccgtctcctcagcttccaccaagggcccatcggtcttccccctggcgccctgctccaggagcacctctgggggcacagcggccctgggctgcctggtcaaggactacttcctatatactgtctgagcgggctggcaaggcgcatagnnn

SEQ ID NO: 79948 - DNA, 301 bp, Homo sapiens
  misc_feature: GYAE6OF01BIXL6.44.25.C03.1.454.CMB.1.raw
  modified_base (296)..(301): a, c, t, g, unknown or other
  misc_feature (296)..(301): n is a, c, g, or t
tcagacagtatatacacgaccggtgctcgatttagtagtgtagatttgggtttggggtgtggtggtctccactcccgccttgacgggctgctatctgcctccctggccatcactgggctccaggctgaagatgagggtgattattactgccagtcctatgacagcagcctcagtggttgggtgttcggcggagggaccaagctgaccgtcctgggtcagcccaaggctgccccctcggtcactctgttcccaccctcctctatatactgtctgagcgggctggcaaggcgcatagnnnnnn

SEQ ID NO: 79949 - DNA, 244 bp, Homo sapiens
  misc_feature: GYAE6OF01DQS16.44.25.C03.1.454.CMB.1.raw
  modified_base (238)..(244): a, c, t, g, unknown or other
  misc_feature (238)..(244): n is a, c, g, or t
tcagacagtatatacacgaccggtgctcgatttagtagtgtagatttgggtttgggtgcccaagctgctggagggcacggtcaccacggtcaccgtctcctcagcttccaccaagggcccatcggtcttcccctggcgccctgctccaggagcacctctgggggcacagcggccctgggctgcctggtcaaggactacttcctatatactgtctgagcgggctggcaaggcgcatagnnnnnnn

SEQ ID NO: 79950 - DNA, 131 bp, Homo sapiens; identical to SEQ ID NO: 79918
  misc_feature: GYAE6OF01CF8I3.44.25.C03.1.454.CMB.1.raw
  modified_base (130)..(131): a, c, t, g, unknown or other
  misc_feature (130)..(131): n is a, c, g, or t

SEQ ID NO: 79951 - DNA, 222 bp, Homo sapiens
  misc_feature: GYAE6OF01CN22F.44.25.C03.1.454.CMB.1.raw
  modified_base (218)..(222): a, c, t, g, unknown or other
  misc_feature (218)..(222): n is a, c, g, or t
tcagacagtatatacacgaccggtgctcgatttagtagtgtagatttgggtttgggggaagaggaagactgacggtcctcccaggagttcaggtgctgggcaccttgggcatggggaggtgtgtcacaagatttgggctctgggcacagcggccctgggctgcctggtcaaggactacttcctatatactgtctgagcgggctggcaaggcgcatagnnnnn

SEQ ID NO: 79952 - DNA, 238 bp, Homo sapiens
  misc_feature: GYAE6OF01D270I.44.25.C03.1.454.CMB.1.raw
  modified_base (238)..(238): a, c, t, g, unknown or other
  misc_feature (238)..(238): n is a, c, g, or t
tcagacagtatatacacgaccggtgctcgatttagtagtgtagatttgggtttgggtgcccaagctgctggagggcacggtcaccacggtcaccgtctcctcagcttccaccaagggcccatcggtcttcccctggcgccctgctccaggagcacctctgggggcacagcggccctgggctgcctggtcaaggactacttcctatatactgtctgagcgggctggcaaggcgcatagn

SEQ ID NO: 79953 - DNA, 380 bp, Homo sapiens
  misc_feature: GYAE6OF01DH823.44.25.C03.1.454.CMB.1.raw
  modified_base (307)..(307): a, c, t, g, unknown or other
  misc_feature (307)..(307): n is a, c, g, or t
  modified_base (309)..(309): a, c, t, g, unknown or other
  misc_feature (309)..(309): n is a, c, g, or t
  modified_base (312)..(320): a, c, t, g, unknown or other
  misc_feature (312)..(320): n is a, c, g, or t
  modified_base (322)..(380): a, c, t, g, unknown or other
  misc_feature (322)..(380): n is a, c, g, or t
tcagacagtatatacacgaccggtgctcgatttagtagtgtagatttgggtttgggggggtgtggtggtctccactcccgccttgacggggctgctatctgcctccctggccatcactgggctccaggctgaagatgagggttgtattattacttgccagtcctatgacagcagcctcagtggttgggtgttcggcggagggaccaagctgaccgtcctgggtcagcccaaggcctggccccctcggtcacctctgttcccgccctcctctatatactgtctgagcgggctggcaagggcgcatagnangcnnnnnnnnngnnnnnnnnnnnnnnnnnnnnnnnnnnnnnnnnnnnnnnnnnnnnnnnnnnnnnnnnnnn

SEQ ID NO: 79954 - DNA, 298 bp, Homo sapiens
  misc_feature: GYAE6OF01CDTJG.44.25.C03.1.454.CMB.1.raw
  modified_base (296)..(298): a, c, t, g, unknown or other
  misc_feature (296)..(298): n is a, c, g, or t
tcagacagtatatacacgaccggtgctcgatttagtagtgtagatttgggtttgggggtgtggtggtctccactcccgccttgacggggctgctatctgcctccctggccatcactgggctccaggctgaagatgagggtgattattactgccagtcctatgacagcagcctcagtggttgggtgttcggcggagggaccaagctgaccgtcctgggtcagcccaaggctgcccctcggtcactctgttcccacctcctctatatactgtctgagcgggctggcaaggcgcatagnnn

SEQ ID NO: 79955 - DNA, 239 bp, Homo sapiens
  misc_feature: GYAE6OF01CXS1M.44.25.C03.1.454.CMB.1.raw
  modified_base (238)..(239): a, c, t, g, unknown or other
  misc_feature (238)..(239): n is a, c, g, or t
tcagacagtatatacacgaccggtgctcgatttagtagtgtagatttgggtttgggtgcccaagctgctggagggcacggtcaccacggtcaccgtctcctcagcttccaccaagggcccatcggtcttcccctggcgccctgctccaggagcacctctgggggcacagcggccctgggctgcctggtcaaggactacttcctatatactgtctgagcgggctggcaaggcgcatagnn

SEQ ID NO: 79956 - DNA, 242 bp, Homo sapiens
  misc_feature: GYAE6OF01DPOTT.44.25.C03.1.454.CMB.1.raw
  modified_base (237)..(242): a, c, t, g, unknown or other
  misc_feature (237)..(242): n is a, c, g, or t
tcagacagtatatacacgaccggtgctcgatttagtagtgtagatttgggtttgggtgcccaagctgctggagggcacggtcaccacggtcaccgtctcctcagcttccaccaagggcccatcggtcttcccctggcgccctgctccaggagcacctctgggggcacagcggccctgggctgcctggtcaaggctacttcctatatactgtctgagcgggctggcaaggcgcatagnnnnnn

SEQ ID NO: 79957 - DNA, 218 bp, Homo sapiens
  misc_feature: GYAE6OF01BA1X4.44.25.C03.1.454.CMB.1.raw
  modified_base (218)..(218): a, c, t, g, unknown or other
  misc_feature (218)..(218): n is a, c, g, or t
tcagacagtatatacacgaccggtgctcgatttagtagtgtagatttgggtttgggggaagaggaagactgacggtcctcccaggagttcaggtgctgggcaccttgggcatggggaggtgtgtcacaagatttgggctctgggcacagcggccctgggctgcctggtcaaggactacttcctatatactgtctgagcgggctggcaaggcgcatagn

SEQ ID NO: 79958 - DNA, 220 bp, Homo sapiens
  misc_feature: GYAE6OF01B9VLY.44.25.C03.1.454.CMB.1.raw
  modified_base (219)..(220): a, c, t, g, unknown or other
  misc_feature (219)..(220): n is a, c, g, or t
tcagacagtatatacacgaccggtgctcgatttagtagtgtagatttgggtttgggggaagaggaagactgacggtcctcccaggagttcaggtgctgggcaccttgggcacgggggaggtgtgtcacaagatttgggctctgggcacagcggccctgggctgcctggtcaaggactacttcctcgatcgcgtctgagcgggctggcaaggcgcatagnn

SEQ ID NO: 79959 - DNA, 221 bp, Homo sapiens
  misc_feature: GYAE6OF01DYFCT.44.25.C03.1.454.CMB.1.raw
  modified_base (219)..(221): a, c, t, g, unknown or other
  misc_feature (219)..(221): n is a, c, g, or t
tcagacagtatatacacgaccggtgctcgatttagtagtgtagatttgggtttgggggaagaggaagactgacggtcctcccaggagttcaggtgctgggcaccttgggcacgggggaggtgtgtcacaagatttgggctctgggcacagcggccctgggctgcctggtcaaggactacttcctatatactgtctgagcgggctggcaaggcgcatagnnn

SEQ ID NO: 79960 - DNA, 239 bp, Homo sapiens
  misc_feature: GYAE6OF01DQBG1.44.25.C03.1.454.CMB.1.raw
  modified_base (238)..(239): a, c, t, g, unknown or other
  misc_feature (238)..(239): n is a, c, g, or t
tcagacagtatatacacgaccggtgctcgatttagtagtgtagatttgggtttgggtgcccaagctgctggagggcacggtcaccacggtcaccgtctcctcagcttccaccaagggcccatcggtcttcccctggtgccctgctccaggagcacctctgggggcacagcggccctgggctgcctggtcaaggactacttcctatatactgtctgagcgggctggcaaggcgcatagnn

SEQ ID NO: 79961 - DNA, 130 bp, Homo sapiens; identical to SEQ ID NO: 79921
  misc_feature: GYAE6OF01DHVAN.44.25.C03.1.454.CMB.1.raw
  modified_base (130)..(130): a, c, t, g, unknown or other
  misc_feature (130)..(130): n is a, c, g, or t

SEQ ID NO: 79962 - DNA, 222 bp, Homo sapiens
  misc_feature: GYAE6OF01C2N1M.44.25.C03.1.454.CMB.1.raw
  modified_base (219)..(222): a, c, t, g, unknown or other
  misc_feature (219)..(222): n is a, c, g, or t
tcagacagtatatacacgaccggtgctcgatttagtagtgtagatttgggtttgggggaagaggaagactgacggtcctcccaggagttcaggtgctgggcaccttgggcacgggggaggtgtgtcacaagatttgggctctgggcacagcggccctgggctgcctggtcaaggactacttccacgtctactgctgagcgggctggcaaggcgcatagnnnn

SEQ ID NO: 79963 - DNA, 244 bp, Homo sapiens; identical to SEQ ID NO: 79949
  misc_feature: GYAE6OF01EMBM7.44.25.C03.1.454.CMB.1.raw
  modified_base (238)..(244): a, c, t, g, unknown or other
  misc_feature (238)..(244): n is a, c, g, or t

SEQ ID NO: 79964 - DNA, 240 bp, Homo sapiens; identical to SEQ ID NO: 79926
  misc_feature: GYAE6OF01DH392.44.25.C03.1.454.CMB.1.raw
  modified_base (238)..(240): a, c, t, g, unknown or other
  misc_feature (238)..(240): n is a, c, g, or t

SEQ ID NO: 79965 - DNA, 240 bp, Homo sapiens
  misc_feature: GYAE6OF01A099F.44.25.C03.1.454.CMB.1.raw
  modified_base (239)..(240): a, c, t, g, unknown or other
  misc_feature (239)..(240): n is a, c, g, or t
tcagacagtatatacacgaccggtgctcgatttagtagtgtagatttgggtttgggtgcccaagctgctggagggcacggtcaccacggtcaccgtctcctcagcttccaccaagggcccatcggtcttccccctggcgccctgctccaggagcacctctgggggcacagcggccctgggctgcctggtcaaggactacttcctatatactgtctgagcgggctggcaaggcgcatagnn

SEQ ID NO: 79966 - DNA, 240 bp, Homo sapiens
  misc_feature: GYAE6OF01ERCJZ.44.25.C03.1.454.CMB.1.raw
  modified_base (237)..(240): a, c, t, g, unknown or other
  misc_feature (237)..(240): n is a, c, g, or t
tcagacagtatatacacgaccggtgctcgatttagtagtgtagatttgggtttgggtgcccaagctgctggagggcacggtcaccacggtcaccgtctcctcagcttccaccaagggcccatcggtcttcccctggcgccctgctccaggagcacctctggggcacagcggccctgggctgcctggtcaaggactacttcctatatactgtctgagcgggctggcaaggcgcatagnnnn

SEQ ID NO: 79967 - DNA, 221 bp, Homo sapiens
  misc_feature: GYAE6OF01BBY3H.44.25.C03.1.454.CMB.1.raw
  modified_base (218)..(221): a, c, t, g, unknown or other
  misc_feature (218)..(221): n is a, c, g, or t
tcagacagtatatacacgaccggtgctcgatttagtagtgtagatttgggtttgggggaagaggaagactgacggtcctcccaggagttcaggtgctgggcaccttgggcatggggaggtgtgtcacaagatttgggctctgggcacagcggccctgggctgcctggtcaaggactacttcctcgatcgcgtctgagcgggctggcaaggcgcatagnnnn

SEQ ID NO: 79968 - DNA, 130 bp, Homo sapiens; identical to SEQ ID NO: 79921
  misc_feature: GYAE6OF01DJ74G.44.25.C03.1.454.CMB.1.raw
  modified_base (130)..(130): a, c, t, g, unknown or other
  misc_feature (130)..(130): n is a, c, g, or t

SEQ ID NO: 79969 - DNA, 137 bp, Homo sapiens
  misc_feature: GYAE6OF01BBECZ.44.25.C03.1.454.CMB.1.raw
  modified_base (137)..(137): a, c, t, g, unknown or other
  misc_feature (137)..(137): n is a, c, g, or t
tcagacagtatatacacgaccggtgctcgatttagtagtgtagatttgggtttgggctctgggcacagcggccctgggctgcctggtcaaggactacttcctatatactgtctgagcgggctggcaaggcgcatagn

SEQ ID NO: 79970 - DNA, 220 bp, Homo sapiens
  misc_feature: GYAE6OF01CYJCF.44.25.C03.1.454.CMB.1.raw
  modified_base (219)..(220): a, c, t, g, unknown or other
  misc_feature (219)..(220): n is a, c, g, or t
tcagacagtatatacacgaccggtgctcgatttagtagtgtagatttgggtttgggggaagaggaagactgacggtcctcccaggagttcaggtgctgggcaccttgggcacgggggaggtgtgtcacaagatttgggctctggacacagcggccctgggctgcctggtcaaggactacttcctatatactgtctgagcgggctggcaaggcgcatagnn

SEQ ID NO: 79971 - DNA, 260 bp, Homo sapiens
  misc_feature: GYAE6OF01C1JVC.44.25.C03.1.454.CMB.1.raw
  modified_base (234)..(260): a, c, t, g, unknown or other
  misc_feature (234)..(260): n is a, c, g, or t
tcagacagtatatacacgaccggtgctcgatttagtagtgtagatttgggtttgggtgcccaagctgctggaggcacggtcaccacggtcacgtctcctcagcttccaccaagggcccatcggtcttcccctggcgccctgctccaggagcaccgtctggggcacagcggccctggctgcctggtcaaggctacttccacgtctactgctgagcgggctggcaaggcgcatagnnnnnnnnnnnnnnnnnnnnnnnnnnn

SEQ ID NO: 79972 - DNA, 240 bp, Homo sapiens
  misc_feature: GYAE6OF01BNBNX.44.25.C03.1.454.CMB.1.raw
  modified_base (238)..(240): a, c, t, g, unknown or other
  misc_feature (238)..(240): n is a, c, g, or t
tcagacagtatatacacgaccggtgctcgatttagtagtgtagatttgggtttgggtgcccaagctgctggagggcacggtcaccacggtcaccgtctcctcagcttccaccaagggcccatcggtcttcccctggcgccctgctccaggagcacctctgggggcacagcggccctgggctgcctggtcaaggactacttcctcgatcgcgtctgagcgggctggcaaggcgcatagnnn

SEQ ID NO: 79973 - DNA, 235 bp, Homo sapiens
  misc_feature: GYAE6OF01BENLJ.44.25.C03.1.454.CMB.1.raw
  modified_base (219)..(235): a, c, t, g, unknown or other
  misc_feature (219)..(235): n is a, c, g, or t
tcagacagtatatacacgaccggtgctcgatttagtagtgtagatttgggtttgggggaagaggaagactgacggtcctcccaggagttcaggtgctgggcaccttgggcacggggaggtgtgtcacaagatttgggctctgggcacagcggccctgggctgcctggtcaaggactacttcctcgatcgcgtctgagcgggctggcaaggtcgcatagnnnnnnnnnnnnnnnnn

SEQ ID NO: 79974 - DNA, 219 bp, Homo sapiens; identical to SEQ ID NO: 79909
  misc_feature: GYAE6OF01AGEQB.44.25.C03.1.454.CMB.1.raw
  modified_base (218)..(219): a, c, t, g, unknown or other
  misc_feature (218)..(219): n is a, c, g, or t

SEQ ID NO: 79975 - DNA, 130 bp, Homo sapiens
  misc_feature: GYAE6OF01CXSHF.44.25.C03.1.454.CMB.1.raw
  modified_base (129)..(130): a, c, t, g, unknown or other
  misc_feature (129)..(130): n is a, c, g, or t
tcagacagtatatacacgaccggtgctcgatttagtagtgtagatttgggttgggcacagcggccctgggctgcctggtcaaggactacttcctatatactgtctgagcgggctggcaaggcgcatagnn

SEQ ID NO: 79976 - DNA, 279 bp, Homo sapiens
  misc_feature: GYAE6OF01DX7KJ.44.25.C03.1.454.CMB.1.raw
  modified_base (237)..(279): a, c, t, g, unknown or other
  misc_feature (237)..(279): n is a, c, g, or t
tcagacagtatatacacgaccggtgctcgatttagtagtgtagatttgggtttgggtgcccaagctgcgttggagggcacggtctaccgtctcctcagcttccaccaagggcccatcggtcttccccctggcgcccgtgctccaggagcaccgtctggggcacagcggccctgggctgcctggtcaaggacctacttcctatatactgtctgagcggggctggcaaggcgcataggnnnnnnnnnnnnnnnnnnnnnnnnnnnnnnnnnnnnnnnnnnn

SEQ ID NO: 79977 - DNA, 220 bp, Homo sapiens
  misc_feature: GYAE6OF01B7WH1.44.25.C03.1.454.CMB.1.raw
  modified_base (219)..(220): a, c, t, g, unknown or other
  misc_feature (219)..(220): n is a, c, g, or t
tcagacagtatatacacgaccggtgctcgatttagtagtgtagatttgggtttgggggaagaggaagactgacggtcctcccaggagttcaggtgctgggcaccttgggcacgggggaggtgtgtcacaagatttgggctctgggcacagcggccctgggctgcctggtcaaggactacttcctatatactgtctgagcgggctggcaaggcgcatagnn

SEQ ID NO: 79978 - DNA, 204 bp, Homo sapiens
  misc_feature: GYAE6OF01BD1KE.44.25.C03.1.454.CMB.1.raw
  modified_base (203)..(204): a, c, t, g, unknown or other
  misc_feature (203)..(204): n is a, c, g, or t
tcagacagtatatacacgaccggtgctcgatttagtagtgtagatttgggtttgggggaagaggaagattgacggtcctcccaggagttcaggtgctgggcaccttgggcacggggaggtgtgtcacaagatttgggctctgggctgcctggtcaaggactacttcctatatactgtctgagcgggctggcaaggcgcatagnn

SEQ ID NO: 79979 - DNA, 220 bp, Homo sapiens
  misc_feature: GYAE6OF01D3QNB.44.25.C03.1.454.CMB.1.raw
  modified_base (219)..(220): a, c, t, g, unknown or other
  misc_feature (219)..(220): n is a, c, g, or t
tcagacagtatatacacgaccggtgctcgatttagtagtgtagatttgggtttgggggaagaggaagactgacggtcctcccaggagttcaggtgctgggcaccttgggcatgggggaggtgtgtcacaagatttgggctctgggcacagcggccctgggctgcctggtcaaggactacttcctatatactgtctgagcgggctggcaaggcgcatagnn

SEQ ID NO: 79980 - DNA, 129 bp, Homo sapiens
  misc_feature: GYAE6OF01EFU3J.44.25.C03.1.454.CMB.1.raw
tcagacagtatatacacgaccggtgctcgatttagtagtgtagatttgggtttgggcacagcggccctgggctgcctggtcaaggactacttcctatatactgtctgagcgggctggcaaggcgcatag

SEQ ID NO: 79981 - DNA, 129 bp, Homo sapiens
  misc_feature: GYAE6OF01AMKDY.44.25.C03.1.454.CMB.1.raw
tcagacagtatatacacgaccggtgctcgatttagtagtgtagatttgggtttgggcacagcggccctgggctgcctggtcaaggactacttcctcgatcgcgtctgagcgggctggcaaggcgcatag

SEQ ID NO: 79982 - DNA, 234 bp, Homo sapiens
  misc_feature: GYAE6OF01BA7IX.44.25.C03.1.454.CMB.1.raw
  modified_base (219)..(234): a, c, t, g, unknown or other
  misc_feature (219)..(234): n is a, c, g, or t
tcagacagtatatacacgaccggtgctcgatttagtagtgtagatttgggtttgggggaagaggaagactgacggtcctcccaggagttcaggtgctgggcaccttgggcatgggggaggtgtgtcacgaagatttgggctctgggcacagcggcctgggctgcctggtcaaggactacttcctatatactgtctgagcgggctggcaaggcgcatagnnnnnnnnnnnnnnnn

SEQ ID NO: 79983 - DNA, 249 bp, Homo sapiens
  misc_feature: GYAE6OF01B5BDJ.44.25.C03.1.454.CMB.1.raw
  modified_base (240)..(249): a, c, t, g, unknown or other
  misc_feature (240)..(249): n is a, c, g, or t
tcagacagtatatacacgaccggtgctcgatttagtagtgtagatttgggtttgggtgcccaagcgtgctggagggcacggtcaccacggtcaccgtctcctcagcttccaccaagggcccatcggtcttccccctggcgccctgctccaggagcacctctgggggcacagcggccctgggctgcctggtcaaggactacttcctatatactgtctgagcgggctggcaaggcgcatagnnnnnnnnnn

SEQ ID NO: 79984 - DNA, 131 bp, Homo sapiens
  misc_feature: GYAE6OF01DALQL.44.25.C03.1.454.CMB.1.raw
  modified_base (130)..(131): a, c, t, g, unknown or other
  misc_feature (130)..(131): n is a, c, g, or t
tcagacagtatatacacgaccggtgctcgatttagtagtgtagatttgggtttgggcacagcggccctgggctgcctggtcaaggactacttcctcgatcgcgtctgagcgggctggcaaggcgcatagnn

SEQ ID NO: 79985 - DNA, 221 bp, Homo sapiens
  misc_feature: GYAE6OF01BLRDW.44.25.C03.1.454.CMB.1.raw
  modified_base (219)..(221): a, c, t, g, unknown or other
  misc_feature (219)..(221): n is a, c, g, or t
tcagacagtatatacacgaccggtgctcgatttagtagtgtagatttgggtttgggggaagaggaagactgacggtcctcccaggagttcaggtgctgggcaccttgggcacgggggaggtgtgtcacaagatttgggctctgggcacagcggccctgggctgcctggtcaaggactacttccacgtctactgctgagcgggctggcaaggcgcatagnnn

SEQ ID NO: 79986 - DNA, 258 bp, Homo sapiens
  misc_feature: GYAE6OF01DRBTM.44.25.C03.1.454.CMB.1.raw
  modified_base (241)..(258): a, c, t, g, unknown or other
  misc_feature (241)..(258): n is a, c, g, or t
tcagacagtatatacacgaccggtgctcgatttagtagtgtagatttgggtttgggtggcccaagctgctggagggcacggtcaccacggtcaccgtctcctcacgcttccaccaagggcccagtcggtcttcccctggcgccctgctccaggagcactctgggggcacagcggccctgggctgcctggtcaaggactacttcctatatactgtctggagcgggctggcaaggcgcatagnnnnnnnnnnnnnnnnnn

SEQ ID NO: 79987 - DNA, 240 bp, Homo sapiens; identical to SEQ ID NO: 79926
  misc_feature: GYAE6OF01AMV4X.44.25.C03.1.454.CMB.1.raw
  modified_base (238)..(240): a, c, t, g, unknown or other
  misc_feature (238)..(240): n is a, c, g, or t

SEQ ID NO: 79988 - DNA, 220 bp, Homo sapiens
  misc_feature: GYAE6OF01C2MUP.44.25.C03.1.454.CMB.1.raw
  modified_base (218)..(220): a, c, t, g, unknown or other
  misc_feature (218)..(220): n is a, c, g, or t
tcagacagtatatacacgaccggtgctcgatttagtagtgtagatttgggtttgggggaagaggaagactgacggtcctcccaggagttcaggtgctgggcaccttgggcatggggaggtgtgtcacaagatttgggctctgggcacagcggccctgggctgcctggtcaaggactacttcctatatactgtctgagcgggctggcaaggcgcatagnnn

SEQ ID NO: 79989 - DNA, 241 bp, Homo sapiens
  misc_feature: GYAE6OF01D7OOJ.44.25.C03.1.454.CMB.1.raw
  modified_base (238)..(241): a, c, t, g, unknown or other
  misc_feature (238)..(241): n is a, c, g, or t
tcagacagtatatacacgaccggtgctcgatttagtagtgtagatttgggtttgggtgcccaagctgctggagggcacggtcaccacggtcaccgtctcctcagcttccaccaagggcccatcggtcttcccctggcgccctgctccaggagcacctctgggggcacagcggccctgggctgcctggtcaaggactacttccacgtctactgctgagcgggctggcaaggcgcatagnnnn

SEQ ID NO: 79990 - DNA, 130 bp, Homo sapiens; identical to SEQ ID NO: 79944
  misc_feature: GYAE6OF01D2VBV.44.25.C03.1.454.CMB.1.raw
  modified_base (130)..(130): a, c, t, g, unknown or other
  misc_feature (130)..(130): n is a, c, g, or t

SEQ ID NO: 79991 - DNA, 221 bp, Homo sapiens; identical to SEQ ID NO: 79959
  misc_feature: GYAE6OF01EGY36.44.25.C03.1.454.CMB.1.raw
  modified_base (219)..(221): a, c, t, g, unknown or other
  misc_feature (219)..(221): n is a, c, g, or t

SEQ ID NO: 79992 - DNA, 242 bp, Homo sapiens
  misc_feature: GYAE6OF01DBDKE.44.25.C03.1.454.CMB.1.raw
  modified_base (238)..(242): a, c, t, g, unknown or other
  misc_feature (238)..(242): n is a, c, g, or t
tcagacagtatatacacgaccggtgctcgatttagtagtgtagatttgggtttgggtgcccaagctgctggagggcacggtcaccacggtcaccgtctcctcagcttccaccaagggcccatcggtcttcccctggcgccctgctccaggagcacctctgggggcacagcggccctgggctgcctggtcaaggactacttccacgtctactgctgagcgggctggcaaggcgcatagnnnnn

SEQ ID NO: 79993 - DNA, 298 bp, Homo sapiens
  misc_feature: GYAE6OF01BAFXM.44.25.C03.1.454.CMB.1.raw
  modified_base (297)..(298): a, c, t, g, unknown or other
  misc_feature (297)..(298): n is a, c, g, or t
tcagacagtatatacacgaccggtgctcgatttagtagtgtagatttgggtttgggggtgtggtggtctccactcccgccttgacggggctgctatctgcctccctggccatcactgggctccaggctgaagatgagggtgattattactgccagtcctatgacagcagcctcagtggttgggtgttcggcggagggaccaagctgaccgtcctgggtcagcccaaggctgccccctggtcactctgttcccaccctcctctatatactgtctgagcgggctggcaaggcgcatagnn

SEQ ID NO: 79994 - DNA, 472 bp, Homo sapiens
  misc_feature: GYAE6OF01EVP9R.44.25.C03.1.454.CMB.1.raw
  modified_base (463)..(463): a, c, t, g, unknown or other
  misc_feature (463)..(463): n is a, c, g, or t
  modified_base (468)..(472): a, c, t, g, unknown or other
  misc_feature (468)..(472): n is a, c, g, or t
tcagacagtatatacacgaccggtgctcgatttagtagtgtagatttgggtttgggctggatccgtcagcccccagggaaggccctggagtggcttgcacacatcttctcgaatgacgaaaaatcctaaagtacatctctgaagagcagtttaaccatctccaaggacacctccaaaaggcaggtggtctttagtatgaccaacatggaccctgcggacacaggcacatattactgtgcacgggtaatgcgggaaagaaacagctggtttctgtattataagtcttaccatctggacgtctggggcaaagggaccacggtcaccgtctcctcagcttccaccaagggcccatcggtcttcccctggcgccctgctccaggagcacctctgggggcacagcggccctggggctgcctggtcaaggactacttccatatactgtctgagcgggctggcaaggcgnatagnnnnn

SEQ ID NO: 79995 - DNA, 241 bp, Homo sapiens
  misc_feature: GYAE6OF01DYL2O.44.25.C03.1.454.CMB.1.raw
  modified_base (238)..(241): a, c, t, g, unknown or other
  misc_feature (238)..(241): n is a, c, g, or t
tcagacagtatatacacgaccggtgctcgatttagtagtgtagatttggttttgggtgcccaagctgctggagggcacggtcaccacggtcaccgtctcctcagcttccaccaagggcccatcggtcttcccctggcgccctgctccaggagcacctctgggggcacagcggccctgggctgcctggtcaaggactacttcctatatactgtctgagcgggctggcaaggcgcatagnnnn

SEQ ID NO: 79996 - DNA, 152 bp, Homo sapiens
  misc_feature: GYAE6OF01A3EP4.44.25.C03.1.454.CMB.1.raw
  modified_base (130)..(152): a, c, t, g, unknown or other
  misc_feature (130)..(152): n is a, c, g, or t
tcagacagtatatacacgaccggtgctcgatttagtagtgtagatttgggtttgggcacagcggccctgggctgcctggtcaaggactacttcctatatactgtctgagcgggctggcaaggcgcatagnnnnnnnnnnnnnnnnnnnnnnn

SEQ ID NO: 79997 - DNA, 221 bp, Homo sapiens
  misc_feature: GYAE6OF01BUMML.44.25.C03.1.454.CMB.1.raw
  modified_base (219)..(221): a, c, t, g, unknown or other
  misc_feature (219)..(221): n is a, c, g, or t
tcagacagtatatacacgaccggtgctcgatttagtagtgtagatttgggtttgggggaagaggaagactgacggtcctcccaggagttcaggtgctgggcaccttgggcatgggggaggtgtgtcacaagatttgggctctgggcacagcggccctgggctgcctggtcaaggactacttcctatatactgtctgagcgggctggcaaggcgcatagnnn

SEQ ID NO: 79998 - DNA, 241 bp, Homo sapiens
  misc_feature: GYAE6OF01ACSXR.44.25.C03.1.454.CMB.1.raw
  modified_base (238)..(241): a, c, t, g, unknown or other
  misc_feature (238)..(241): n is a, c, g, or t
tcagacagtatatacacgaccggtgctcgatttagtagtgtagatttgggtttgggtgcccaagctgctggagggcacggtcaccacggtcaccgtctcctcagcttccaccaagggcccatcggtcttcccctggcgccctgctccaggagcacctctgggggcacagtggccctgggctgcctggtcaaggactacttcctatatactgtctgagcgggctggcaaggcgcatagnnnn

SEQ ID NO: 79999 - DNA, 187 bp, Homo sapiens
  misc_feature: GYAE6OF01C2I7D.44.25.C03.1.454.CMB.1.raw
  modified_base (160)..(187): a, c, t, g, unknown or other
  misc_feature (160)..(187): n is a, c, g, or t
tcagacagtatatacacgaccggtgctcgatttagtagtgtagatttgggtttgggggaggtgtgtcacaagatttgggctctgggcacagcggccctgggctgcctggtcaaggactacttccacgtctactgctgagcgggctggcaaggcgcatagnnnnnnnnnnnnnnnnnnnnnnnnnnnn

SEQ ID NO: 80000 - DNA, 299 bp, Homo sapiens
  misc_feature: GYAE6OF01B79XD.44.25.C03.1.454.CMB.1.raw
  modified_base (296)..(299): a, c, t, g, unknown or other
  misc_feature (296)..(299): n is a, c, g, or t
tcagacagtatatacacgaccggtgctcgatttagtagtgtagatttgggtttgggggtgtggtggtctccactcccgccttgacggggctgctatctgcctccctggccatcactgggctccaggctgaagatgagggtgattattactgccagtcctatgacagcagcctcagtggttgggtgttcggcggagggaccaagctgaccgtcctgggtcagcccaaggctgcccctcggtcactctgttcccaccctctctatatactgtctgagcgggctggcaaggcgcatagnnnn

SEQ ID NO: 80001 - DNA, 221 bp, Homo sapiens; identical to SEQ ID NO: 79997
  misc_feature: GYAE6OF01B9GCP.44.25.C03.1.454.CMB.1.raw
  modified_base (219)..(221): a, c, t, g, unknown or other
  misc_feature (219)..(221): n is a, c, g, or t

SEQ ID NO: 80002 - DNA, 192 bp, Homo sapiens
  misc_feature: GYAE6OF01DE5QO.44.25.C03.1.454.CMB.1.raw
  modified_base (190)..(192): a, c, t, g, unknown or other
  misc_feature (190)..(192): n is a, c, g, or t
tcagacagtatatacacgaccggtgctcgatttagtagtgtagatttgggtttgggggaggtgtgtcacaagatttgggctctgggcaccgtgggcacgggggaggtgtgtcacaagatttgggccctgggctgcctggtcaaggactacttcctatatactgtctgagcgggctggcaaggcgcatagnnn

SEQ ID NO: 80003 - DNA, 666 bp, Homo sapiens
  misc_feature: GYAE6OF01D83J1.44.25.C03.1.454.CMB.1.raw
  modified_base (225)..(225): a, c, t, g, unknown or other
  misc_feature (225)..(225): n is a, c, g, or t
  modified_base (283)..(283): a, c, t, g, unknown or other
  misc_feature (283)..(283): n is a, c, g, or t
tcagacagtatatacacgaccggtgctcgatttagtagtgtagatttgggtttgggggggcacaagaggcagcactcaggacaatctccagcatggcctggtctcctctcctcctcactctcctcgctcactgcacagggtcctgggcccactctgtgctgacgcagccgccctcagtgtcgtgggggccccggggcagagggtcaccatctcctgcactgggancagatccaacatcgggacagattctgatgtccactggtaccaacaccttccaggaacnccacccaactccactacttcgttacgaactactcgtccgtcctacggtaccggtcctacgaccgtacttctcgtcgtcctacgtaacgtcgtcgacctacctacgacccgtccccttccggtcggaccctactaccgtacggtcggtccctaccggacggtcgtaacggaagtacgtagggtacgggttagttaagtttaacttacgtcgtaccgtacgttaccttagtacgaacgacgtacgaccgtcctacgttagggtttggggttcgggttcgggttaccgggacggggtaccggaaccgtacggtcggtaccggtacccggttcggtacgggtacacccggtaccgacggtcccgtccccggtccccgtcggtacccg

SEQ ID NO: 80004 - DNA, 251 bp, Homo sapiens
  misc_feature: GYAE6OF01BDXW3.44.25.C03.1.454.CMB.1.raw
  modified_base (218)..(251): a, c, t, g, unknown or other
  misc_feature (218)..(251): n is a, c, g, or t
tcagacagtatatacacgaccggtgctcgatttagtagtgtagatttgggtttgggggtacgaatggtcaccgtctcttcagcttccaccaagggcccatcggtcttccccctggcgccctgctccaggagcacctctgggggcacagcggccctgggctgcctggtcaaggactacttcctatatactgtctgagcgggctgggcaaggcgcatagnnnnnnnnnnnnnnnnnnnnnnnnnnnnnnnnnn

SEQ ID NO: 80005 - DNA, 239 bp, Homo sapiens; identical to SEQ ID NO: 79955
  misc_feature: GYAE6OF01EUUSR.44.25.C03.1.454.CMB.1.raw
  modified_base (238)..(239): a, c, t, g, unknown or other
  misc_feature (238)..(239): n is a, c, g, or t

SEQ ID NO: 80006 - DNA, 243 bp, Homo sapiens
  misc_feature: GYAE6OF01A8XSH.44.25.C03.1.454.CMB.1.raw
  modified_base (239)..(243): a, c, t, g, unknown or other
  misc_feature (239)..(243): n is a, c, g, or t
tcagacagtatatacacgaccggtgctcgatttagtagtgtagatttgggtttgggtgcccaagctgctggagggcacggtcaccacggtcaccgtctcctcagcttccaccaagggcccatcggtcttccccctggcgccctgctccaggagcacctctgggggcacagcggccctgggctgcctggtcaaggactacttcctatatactgtctgagcgggctggcaaggcgcatagnnnnn

SEQ ID NO: 80007 - DNA, 239 bp, Homo sapiens; identical to SEQ ID NO: 79955
  misc_feature: GYAE6OF01EBVBC.44.25.C03.1.454.CMB.1.raw
  modified_base (238)..(239): a, c, t, g, unknown or other
  misc_feature (238)..(239): n is a, c, g, or t

SEQ ID NO: 80008 - DNA, 130 bp, Homo sapiens; identical to SEQ ID NO: 79921
  misc_feature: GYAE6OF01A4AZ9.44.25.C03.1.454.CMB.1.raw
  modified_base (130)..(130): a, c, t, g, unknown or other
  misc_feature (130)..(130): n is a, c, g, or t

SEQ ID NO: 80009 - DNA, 193 bp, Homo sapiens
  misc_feature: GYAE6OF01BXM7R.44.25.C03.1.454.CMB.1.raw
  modified_base (188)..(193): a, c, t, g, unknown or other
  misc_feature (188)..(193): n is a, c, g, or t
tcagacagtatatacacgaccggtgctcgatttagtagtgtagatttgggtttggggatgtgtgtcacaagatttgggctctgggcaccgtgggcacggggaggtgtgtcacaagatttgggccctgggctgcctggtcaaggactacttcctatatactgtctgagcgggctggcaaggcgcatagnnnnnn

SEQ ID NO: 80010 - DNA, 240 bp, Homo sapiens; identical to SEQ ID NO: 79926
  misc_feature: GYAE6OF01CZY4Q.44.25.C03.1.454.CMB.1.raw
  modified_base (238)..(240): a, c, t, g, unknown or other
  misc_feature (238)..(240): n is a, c, g, or t

SEQ ID NO: 80011 - DNA, 140 bp, Homo sapiens
  misc_feature: GYAE6OF01BVGA2.44.25.C03.1.454.CMB.1.raw
  modified_base (136)..(140): a, c, t, g, unknown or other
  misc_feature (136)..(140): n is a, c, g, or t
tcagacagtatatacacgaccggtgctcgatttagtagtgtagatttgggtttgggctctgggcacagcggccctgggctgcctggtcaaggactacttcctatatactgtctgagcggctggcaaggcgcatagnnnnn

SEQ ID NO: 80012 - DNA, 270 bp, Homo sapiens
  misc_feature: GYAE6OF01BLFY6.44.25.C03.1.454.CMB.1.raw
  modified_base (223)..(270): a, c, t, g, unknown or other
  misc_feature (223)..(270): n is a, c, g, or t
tcagacagtatatacacgaccggtgctcgatttagtagtgtagatttgggtttgggggaagaggaagactgacggtcctccaggagttcaggtgctgggcaccttgggcagtgggggaggtgtgtcacaagatttgggctctagggcacaggcggccctgggctgcctggtcaaggactacttcctatatactgtctgagcgggctggcaaggcgacagtagnnnnnnnnnnnnnnnnnnnnnnnnnnnnnnnnnnnnnnnnnnnnnnnn

SEQ ID NO: 80013 - DNA, 139 bp, Homo sapiens
  misc_feature: GYAE6OF01EKLEL.44.25.C03.1.454.CMB.1.raw
  modified_base (129)..(139): a, c, t, g, unknown or other
  misc_feature (129)..(139): n is a, c, g, or t
tcagacagtatatacacgaccggtgctcgatttagtagtgtagatttgggttgggcacagcggccctggctgcctggtcaaggactacgttccacgtctactgctgagcgggctggcaaggcgcatagnnnnnnnnnnn

SEQ ID NO: 80014 - DNA, 239 bp, Homo sapiens
  misc_feature: GYAE6OF01C683O.44.25.C03.1.454.CMB.1.raw
  modified_base (238)..(239): a, c, t, g, unknown or other
  misc_feature (238)..(239): n is a, c, g, or t
tcagacagtatatacacgaccggtgctcgatttagtagtgtagatttgggtttgggtgcccaagctgctggagggcacggtcaccacggtcaccgtctcctcagcttccaccaagggcccatcggtcttcccctggcgccctgctccaggagcacctctggggacacagcggccctgggctgcctggtcaaggactacttcctcgatcgcgtctgagcgggctggcaaggcgcatagnn

SEQ ID NO: 80015 - DNA, 219 bp, Homo sapiens
  misc_feature: GYAE6OF01C5D35.44.25.C03.1.454.CMB.1.raw
  modified_base (218)..(219): a, c, t, g, unknown or other
  misc_feature (218)..(219): n is a, c, g, or t
tcagacagtatatacacgaccggtgctcgatttagtagtgtagatttgggtttggggaagaggaagactgacggtcctcccaggagttcaggtgctgggcaccttgggcacgggggaggtgtgtcacaagatttgggctctgggcacagcggccctgggctgcctggtcaaggactacttcctatatactgtctgagcgggctggcaaggcgcatagnn

SEQ ID NO: 80016 - DNA, 160 bp, Homo sapiens
  misc_feature: GYAE6OF01B4CFO.44.25.C03.1.454.CMB.1.raw
  modified_base (160)..(160): a, c, t, g, unknown or other
  misc_feature (160)..(160): n is a, c, g, or t
tcagacagtatatacacgaccggtgctcgatttagtagtgtagatttgggtttgggggaggtgtgtcacaagatttgggctctgggcacagcggccctgggctgcctggtcaaggactacttcctatatactgtctgagcgggctggcaaggcgcatagn

SEQ ID NO: 80017 - DNA, 242 bp, Homo sapiens
  misc_feature: GYAE6OF01BNHC7.44.25.C03.1.454.CMB.1.raw
  modified_base (239)..(242): a, c, t, g, unknown or other
  misc_feature (239)..(242): n is a, c, g, or t
tcagacagtatatacacgaccggtgctcgatttagtagtgtagatttgggtttgggtgcccaagctgctggagggcacggtcaccacggtcaccgtctcctcagcttccaccaagggcccatcggtcttccccctggcgccctgctccaggagcacctctgggggcacagcggccctgggctgcctggtcaaggactacttcctatatactgtctgagcgggctggcaaggcgcatagnnnn

SEQ ID NO: 80018 - DNA, 155 bp, Homo sapiens
  misc_feature: GYAE6OF01EGJ26.44.25.C03.1.454.CMB.1.raw
  modified_base (155)..(155): a, c, t, g, unknown or other
  misc_feature (155)..(155): n is a, c, g, or t
tcagacagtatatacacgaccggtgctcgatttagtagtgtagatttgggtttgggggaagaggaagactgacggtcctgccacagcggccctgggctgcctggtcaaggactacttccacgtctactgctgagcgggctggcaaggcgcatagn

SEQ ID NO: 80019 - DNA, 521 bp, Homo sapiens
  misc_feature: GYAE6OF01CDOYA.44.25.C03.1.454.CMB.1.raw
  modified_base (415)..(415): a, c, t, g, unknown or other
  misc_feature (415)..(415): n is a, c, g, or t
tcagacagtatatacacgaccggtgctcgatttagtagtgtagatttgggtttggggggcacaagaggcagcactcaggacaatctccagcatggcctggtctcctctcctcctcactctcctcgctcactgcacagggtcctgggcccactctgtgctgacgcagccgccctcagtgtctggggccccgggcagagggtcaccatctcctgcactgggagcagatccaacatcgggacagattctgatgtccactggtaccaacaccttccaggaacacgcccccaaactcctcatctttaggtaacaactatccggccctcgacggggtcccctgacccgattctctggctccaagtctggcacctcacgccctccctggccatcactggctccgaggctgaagatgagggtnattatactgccagtcctatgacagcagtcctgagttggttggtgttcggcggagggaccaggctgaccgtcgtgggtcacgcccgaaggcctcgcccccgtggtcc

SEQ ID NO: 80020 - DNA, 289 bp, Homo sapiens
  misc_feature: GYAE6OF01EPFS1.44.25.C03.1.454.CMB.1.raw
  modified_base (234)..(234): a, c, t, g, unknown or other
  misc_feature (234)..(234): n is a, c, g, or t
  modified_base (236)..(289): a, c, t, g, unknown or other
  misc_feature (236)..(289): n is a, c, g, or t
tcagacagtatatacacgaccggtgctcgattttagtagtgtagatttgggtttggggtggcccaagctgctggagggcacggtcaccgtctcctcagcttccaccaagggcccatcggtcttccccctggcgccctgctccaggagcacctctgggggcacagcggccctgggctgcctggtcaaggactacttccacgtctactgctgagcgggctggcaaggcgcgatagnannnnnnnnnnnnnnnnnnnnnnnnnnnnnnnnnnnnnnnnnnnnnnnnnnnnnn

SEQ ID NO: 80021 - DNA, 241 bp, Homo sapiens; identical to SEQ ID NO: 79947
  misc_feature: GYAE6OF01CY2LT.44.25.C03.1.454.CMB.1.raw
  modified_base (239)..(241): a, c, t, g, unknown or other
  misc_feature (239)..(241): n is a, c, g, or t

SEQ ID NO: 80022 - DNA, 241 bp, Homo sapiens; identical to SEQ ID NO: 79947
  misc_feature: GYAE6OF01CMC4P.44.25.C03.1.454.CMB.1.raw
  modified_base (239)..(241): a, c, t, g, unknown or other
  misc_feature (239)..(241): n is a, c, g, or t

SEQ ID NO: 80023 - DNA, 189 bp, Homo sapiens
  misc_feature: GYAE6OF01E2AJU.44.25.C03.1.454.CMB.1.raw
  modified_base (188)..(189): a, c, t, g, unknown or other
  misc_feature (188)..(189): n is a, c, g, or t
tcagacagtatatacacgaccggtgctcgatttagtagtgtagatttgggtttggggaggtgtgtcacaagatttgggctctgggcaccgtgggcacggggaggtgtgtcacaagatttgggccctgggctgcctggtcaaggactacttccacgtctactgctgagcgggctggcaaggcgcatagnn

SEQ ID NO: 80024 - DNA, 241 bp, Homo sapiens
  misc_feature: GYAE6OF01B5JAX.44.25.C03.1.454.CMB.1.raw
  modified_base (238)..(241): a, c, t, g, unknown or other
  misc_feature (238)..(241): n is a, c, g, or t
tcagacagtatatacacgaccggtgctcgatttagtagtgtagatttgggtttgggtgcccaagctgctggagggcacggtcaccacggtcaccgtctcctcagcttccaccaagggcccatcggtcttcccctggcgccctgctccaggagcacctctgggggcacagcggccctgggctgcctggtcaaggactacttcctatatactgtctgagcgggctggcaaggcgcatagnnnn

SEQ ID NO: 80025 - DNA, 130 bp, Homo sapiens; identical to SEQ ID NO: 79944
  misc_feature: GYAE6OF01C8JDU.44.25.C03.1.454.CMB.1.raw
  modified_base (130)..(130): a, c, t, g, unknown or other
  misc_feature (130)..(130): n is a, c, g, or t

SEQ ID NO: 80026 - DNA, 260 bp, Homo sapiens
  misc_feature: GYAE6OF01A8NU2.44.25.C03.1.454.CMB.1.raw
  modified_base (243)..(260): a, c, t, g, unknown or other
  misc_feature (243)..(260): n is a, c, g, or t
tcagacagtatatacacgaccggtgctcgatttagtagtgtagatttgggtttgggtggcccaagctgctggagggcacggtcaccacggtcaccgtctcctcacgcttccaccaagggcccagtcggtcttccccctggcgccctgctccaggagcacctctgggggcacagcggccctgggcctgcctggtcaaggactacttcctatatactgtctgagcgggctggcaaggcgcatagnnnnnnnnnnnnnnnnnn

SEQ ID NO: 80027 - DNA, 219 bp, Homo sapiens
  misc_feature: GYAE6OF01BU4JN.44.25.C03.1.454.CMB.1.raw
  modified_base (219)..(219): a, c, t, g, unknown or other
  misc_feature (219)..(219): n is a, c, g, or t
tcagacagtatatacacgaccggtgctcgatttagtagtgtagatttgggtttgggggaagaggaagactgacggtcctcccaggagttcaggtgctgggcaccttgggcacgggggaggtgtgtcacaagatttgggctctgggcacagcggccctgggctgcctggtcaaggactacttcctatatactgtctgagcgggctggcaaggcgcatagn

SEQ ID NO: 80028 - DNA, 239 bp, Homo sapiens; identical to SEQ ID NO: 79955
  misc_feature: GYAE6OF01DWMJL.44.25.C03.1.454.CMB.1.raw
  modified_base (238)..(239): a, c, t, g, unknown or other
  misc_feature (238)..(239): n is a, c, g, or t

SEQ ID NO: 80029 - DNA, 311 bp, Homo sapiens
  misc_feature: GYAE6OF01A6QPI.44.25.C03.1.454.CMB.1.raw
  modified_base (230)..(231): a, c, t, g, unknown or other
  misc_feature (230)..(231): n is a, c, g, or t
  modified_base (233)..(235): a, c, t, g, unknown or other
  misc_feature (233)..(235): n is a, c, g, or t
  modified_base (237)..(237): a, c, t, g, unknown or other
  misc_feature (237)..(237): n is a, c, g, or t
  modified_base (240)..(240): a, c, t, g, unknown or other
  misc_feature (240)..(240): n is a, c, g, or t
  modified_base (242)..(311): a, c, t, g, unknown or other
  misc_feature (242)..(311): n is a, c, g, or t
tcagacagtatatacacgaccggtgctcgatttagtagtgtagatttgggtttgggggaagtagggaagactgacggtcctccctaggagttcaggtgtactgggcaccttgggcacgggggaggtgtgtcactaaggatttgggcgtctgggcacagcggccctggggctgcctggtcaaggactacttcctatatactgtctgagcgggtctggacaaggcgcatagnngnnngnagngnnnnnnnnnnnnnnnnnnnnnnnnnnnnnnnnnnnnnnnnnnnnnnnnnnnnnnnnnnnnnnnnnnnnnn

SEQ ID NO: 80030 - DNA, 240 bp, Homo sapiens; identical to SEQ ID NO: 79965
  misc_feature: GYAE6OF01A9KDO.44.25.C03.1.454.CMB.1.raw
  modified_base (239)..(240): a, c, t, g, unknown or other
  misc_feature (239)..(240): n is a, c, g, or t

SEQ ID NO: 80031 - DNA, 239 bp, Homo sapiens
  misc_feature: GYAE6OF01BAOJL.44.25.C03.1.454.CMB.1.raw
  modified_base (239)..(239): a, c, t, g, unknown or other
  misc_feature (239)..(239): n is a, c, g, or t
tcagacagtatatacacgaccggtgctcgatttagtagtgtagatttgggtttgggtgcccaagctgctggagggcacggtcaccacggtcaccgtctcctcagcttccaccaagggcccatcggtcttccccctggcgccctgctccaggagcacctctgggggcacagcggccctgggctgcctggtcaaggactacttcctatatactgtctgagcgggctggcaaggcgcatagn

SEQ ID NO: 80032 - DNA, 238 bp, Homo sapiens
  misc_feature: GYAE6OF01DB4CN.44.25.C03.1.454.CMB.1.raw
  modified_base (237)..(238): a, c, t, g, unknown or other
  misc_feature (237)..(238): n is a, c, g, or t
tcagacagtatatacacgaccggtgctcgatttagtagtgtagatttgggtttgggtgcccaagctgctggagggcacggtcaccacggtcaccgtctcctcagcttccaccagggcccatcggtcttcccctggcgccctgctccaggagcacctctgggggcacagcggccctgggctgcctggtcaaggactacttcctatatactgtctgagcgggctggcaaggcgcatagnn

SEQ ID NO: 80033 - DNA, 243 bp, Homo sapiens
  misc_feature: GYAE6OF01ATZ02.44.25.C03.1.454.CMB.1.raw
  modified_base (239)..(243): a, c, t, g, unknown or other
  misc_feature (239)..(243): n is a, c, g, or t
tcagacagtatatacacgaccggtgctcgatttagtagtgtagatttgggtttgggtgcccaagctgctggagggcacggtcaccacggtcaccgtctcctcagcttccaccaagggcccatcggtcttccccctggcgccctgctccaggagcacctctgggggcacagcggccctgggctgcctggtcaaggactacttcctcgatcgcgtctgagcgggctggcaaggcgcatagnnnnn

SEQ ID NO: 80034 - DNA, 130 bp, Homo sapiens; identical to SEQ ID NO: 79921
  misc_feature: GYAE6OF01B86V6.44.25.C03.1.454.CMB.1.raw
  modified_base (130)..(130): a, c, t, g, unknown or other
  misc_feature (130)..(130): n is a, c, g, or t

SEQ ID NO: 80035 - DNA, 242 bp, Homo sapiens; identical to SEQ ID NO: 80017
  misc_feature: GYAE6OF01BSAWL.44.25.C03.1.454.CMB.1.raw
  modified_base (239)..(242): a, c, t, g, unknown or other
  misc_feature (239)..(242): n is a, c, g, or t

SEQ ID NO: 80036 - DNA, 327 bp, Homo sapiens
  misc_feature: GYAE6OF01EM71Y.44.25.C03.1.454.CMB.1.raw
  modified_base (299)..(327): a, c, t, g, unknown or other
  misc_feature (299)..(327): n is a, c, g, or t
tcagacagtatatacacgaccggtgctcgatttagtagtgtagatttgggtttggggggtgtggtaggtctccactcccgccttgacggggctgctatctgcctccctggccatcactgggctccaggctgaagatgagggtgattattactgccagtcctatgacagcagcctcagtggttgggtgttcggcggagggaccaagctgaccgtcctgggtcagcccaaggcctgccccctggtcactctgttcccgcctcctctatatactgtctgagcggctggcaaggcgcatacgnnnnnnnnnnnnnnnnnnnnnnnnnnnnn

SEQ ID NO: 80037 - DNA, 296 bp, Homo sapiens
  misc_feature: GYAE6OF01CEH4C.44.25.C03.1.454.CMB.1.raw
  modified_base (295)..(296): a, c, t, g, unknown or other
  misc_feature (295)..(296): n is a, c, g, or t
tcagacagtatatacacgaccggtgctcgatttagtagtgtagatttgggtttgggggtgtggtggtctccactcccgccttgacggggctgctatctgcctccctggccatcactgggctccaggctgaagatgagggtgattattactgccagtcctatgacagcagcctcagtggttgggtgttcggcggagggaccaagctgaccgtcctgggtcagcccaaggctgcccctggtcactctgttcccaccctctctatatactgtctgagcgggctggcaaggcgcatagnn

SEQ ID NO: 80038 - DNA, 298 bp, Homo sapiens
  misc_feature: GYAE6OF01BZQ5A.44.25.C03.1.454.CMB.1.raw
  modified_base (295)..(298): a, c, t, g, unknown or other
  misc_feature (295)..(298): n is a, c, g, or t
tcagacagtatatacacgaccggtgctcgatttagtagtgtagatttgggtttgggggtgtggtggtctccactcccgccttgacgggctgctatctgcctccctggccatcactgggctccaggctgaagatgagggtgattattactgccagtcctatgacagcagcctcagtggttgggtgttcggcggagggaccaagctgaccgtcctgggtcagcccaaggctcgcccctcggtcactctgttcccgcctctctatatactgtctgagcgggctggcaaggcgcatagnnnn

SEQ ID NO: 80039 - DNA, 246 bp, Homo sapiens
  misc_feature: GYAE6OF01CJGF5.44.25.C03.1.454.CMB.1.raw
  modified_base (219)..(246): a, c, t, g, unknown or other
  misc_feature (219)..(246): n is a, c, g, or t
tcagacagtatatacacgaccggtgctcgatttagtagtgtagatttgggtttgggggaagaggtaaggactgacggtcctcccaggagttcaggtgctgggcaccttgggcacggggagtgtgtcacaagatttgggctctgggcacagcggccctgggctgcctggtcaaggactacttcctatatactgtctgagcgggctggcaaggcgcatagnnnnnnnnnnnnnnnnnnnnnnnnnnnn

SEQ ID NO: 80040 - DNA, 217 bp, Homo sapiens
  misc_feature: GYAE6OF01BCFTF.44.25.C03.1.454.CMB.1.raw
  modified_base (217)..(217): a, c, t, g, unknown or other
  misc_feature (217)..(217): n is a, c, g, or t
tcagacagtatatacacgaccggtgctcgatttagtagtgtagatttgggtttggggaagaggaagactgacggtcctcccaggagttcaggtgctgggcaccttgggcatggggaggtgtgtcacaagatttgggctctgggcacagcggccctgggctgcctggtcaaggactacttcctatatactgtctgagcgggctggcaaggcgcatagn

SEQ ID NO: 80041 - DNA, 247 bp, Homo sapiens
  misc_feature: GYAE6OF01E2IBD.44.25.C03.1.454.CMB.1.raw
  modified_base (240)..(247): a, c, t, g, unknown or other
  misc_feature (240)..(247): n is a, c, g, or t
tcagacagtatatacacgaccggtgctcgatttagtagtgtagatttgggtttgggtgcccgaagctgctggagggcacggtcaccacggtcaccgtctcctcagcttccaccaagggcccatcggtcttccccctggcgccctgctccaggagcacctctgggggcacagcggccctgggctgcctggtcaaggactacttcctatatactgtctgagcgggctggcaaggcgcatagnnnnnnnn

SEQ ID NO: 80042 - DNA, 241 bp, Homo sapiens
  misc_feature: GYAE6OF01AZDLW.44.25.C03.1.454.CMB.1.raw
  modified_base (238)..(241): a, c, t, g, unknown or other
  misc_feature (238)..(241): n is a, c, g, or t
tcagacagtatatacacgaccggtgctcgatttagtagtgtagatttgggtttgggtgcccaagctgctggagggcacggtcaccacggtcaccgtctcctcagcttccaccaagggcccatcggtcttcccctggcgccctgctccaggagcacctctgggggcacagcggccctgggctgcctggtcaaggactacttcctcgatcgcgtctgagcgggctggcaaggcgcatagnnnn

SEQ ID NO: 80043 - DNA, 240 bp, Homo sapiens; identical to SEQ ID NO: 79926
  misc_feature: GYAE6OF01DS0A6.44.25.C03.1.454.CMB.1.raw
  modified_base (238)..(240): a, c, t, g, unknown or other
  misc_feature (238)..(240): n is a, c, g, or t

SEQ ID NO: 80044 - DNA, 306 bp, Homo sapiens
  misc_feature: GYAE6OF01CPPYO.44.25.C03.1.454.CMB.1.raw
  modified_base (299)..(306): a, c, t, g, unknown or other
  misc_feature (299)..(306): n is a, c, g, or t
tcagacagtatatacacgaccggtgctcgatttagtagtgtagatttgggtttgggggtgtggtggtctccactcccgccttgacggggctgctatctgcctccctggccatcactgggctccaggctgaagatgagggtgattattactgccagtcctatgacagcagcctcagtggttgggtgttcggcggagggaccaagctgaccgtcctgggtcagcccaaggctgccccctcggtcactctgttcccgccctcctctatatacctgtctgagcgggctggcaaggcgcatagnnnnnnnn

SEQ ID NO: 80045 - DNA, 239 bp, Homo sapiens
  misc_feature: GYAE6OF01EGTNO.44.25.C03.1.454.CMB.1.raw
  modified_base (238)..(239): a, c, t, g, unknown or other
  misc_feature (238)..(239): n is a, c, g, or t
tcagacagtatatacacgaccggtgctcgatttagtagtgtagatttgggtttgggtgcccaagctgctggagggcacggtcaccacggtcaccgtctcctcagcttccaccaagggcccatcggtcttcccctggcgccctgctccaggagcacctctgggggcacagcggccctgggctgcctggtcaaggactacttcctcgatcgcgtctgagcgggctggcaaggcgcatagnn

SEQ ID NO: 80046 - DNA, 571 bp, Homo sapiens
  misc_feature: GYAE6OF01DEAHM.44.25.C03.1.454.CMB.1.raw
  modified_base (174)..(174): a, c, t, g, unknown or other
  misc_feature (174)..(174): n is a, c, g, or t
  modified_base (221)..(221): a, c, t, g, unknown or other
  misc_feature (221)..(221): n is a, c, g, or t
tcagacagtatatacacgaccggtgctcgatttagtagtgtagatttgggtttggggggcacaagaggcagcactcaggacaatctccagcatggcctggtctcctctcctcctcactctcctcgctcactgcacagggtcctgggcccactctgtgctgacgcagccgccctnagtgtctggggccccgggcagagggtcaccatctcctgcactgggancagatccaacatcgggacagattctgatgtccactggtaccaacaccttccaggaacacgcccccaaaactcctcatctttggaacaactatcggccctcgacgggtccctagacccgtattcctcgtggcctaccaagtctggcacctcacgtccctcccgtggcccatcacgtcgggcctccaggctagaagagtggagggtgatttattactgcctagtcctatcgaacagcgacgtcctcgtagttggttgggtgttcgggcgggacgggaccaagtcgtggtacccggtccgtcgggtccgacggtaccccgaagggtcctacccggcccccgttcgggtacccg

SEQ ID NO: 80047 - DNA, 130 bp, Homo sapiens; identical to SEQ ID NO: 79944
  misc_feature: GYAE6OF01AQA8Z.44.25.C03.1.454.CMB.1.raw
  modified_base (130)..(130): a, c, t, g, unknown or other
  misc_feature (130)..(130): n is a, c, g, or t

SEQ ID NO: 80048 - DNA, 261 bp, Homo sapiens
  misc_feature: GYAE6OF01CESIS.44.25.C03.1.454.CMB.1.raw
  modified_base (241)..(261): a, c, t, g, unknown or other
  misc_feature (241)..(261): n is a, c, g, or t
tcagacagtatatacacgaccggtgctcgatttagtagtgtagatttgggtttgggtgcccaagctgctggagggcacggtcaccacggtcaccgtctcctcagcttccaccaagggcccatcggtcttccccctggcgccctgctccaggagcacctctgggggcacagcggccctgggctgcctggtcaaggactacgttcctatagtactgtctgagcgggctggcaaggcgcatagnnnnnnnnnnnnnnnnnnnnn

SEQ ID NO: 80049 - DNA, 174 bp, Homo sapiens
  misc_feature: GYAE6OF01BLE0P.44.25.C03.1.454.CMB.1.raw
  modified_base (159)..(174): a, c, t, g, unknown or other
  misc_feature (159)..(174): n is a, c, g, or t
tcagacagtatatacacgaccggtgctcgatttagtagtgtagatttgggtttggggaggtgtgtcacaagatttgggctctgggcacagcggccctgggctgcctggtcaaggactacttccacgtctactgctgagcgggctggcaaggcgcatagnnnnnnnnnnnnnnnn

SEQ ID NO: 80050 - DNA, 241 bp, Homo sapiens; identical to SEQ ID NO: 79989
  misc_feature: GYAE6OF01AHYKZ.44.25.C03.1.454.CMB.1.raw
  modified_base (238)..(241): a, c, t, g, unknown or other
  misc_feature (238)..(241): n is a, c, g, or t

SEQ ID NO: 80051 - DNA, 519 bp, Homo sapiens
  misc_feature: GYAE6OF01EBGMD.44.25.C03.1.454.CMB.1.raw
  modified_base (427)..(427): a, c, t, g, unknown or other
  misc_feature (427)..(427): n is a, c, g, or t
  modified_base (435)..(435): a, c, t, g, unknown or other
  misc_feature (435)..(435): n is a, c, g, or t
  modified_base (513)..(513): a, c, t, g, unknown or other
  misc_feature (513)..(513): n is a, c, g, or t
tcagacagtatatacacgaccggtgctcgatttagtagtgtagatttgggtttgggggggaagctcagcttcagctgtgggtagagaagacaggactcaggacgatctccagcatggccagcttccctctcctcctcaccctcctcactcactgtgcagggtcctgggcccagtctgtgatgtctcagccaccctcagcgtctgggacccccgggcagggggtcaccatctcctgcactgggagcagatccaacatcgggacagattctgatgtccactggtaccaacaccttccaggaacacgcccccaaactcctcatctttaggtaacaactatcggccctcgacgggtccctgaccgattctctggctccaagtctggcacctcacgcctccctggccatcactgggcctccgaggctgaagntgagggtnattatactgccagtcctatgacagcagcctgaggtggttggtgttcggcggaggaccaagcgtcgaccgtcgtggtcngacccg

SEQ ID NO: 80052 - DNA, 240 bp, Homo sapiens; identical to SEQ ID NO: 79972
  misc_feature: GYAE6OF01DXHTS.44.25.C03.1.454.CMB.1.raw
  modified_base (238)..(240): a, c, t, g, unknown or other
  misc_feature (238)..(240): n is a, c, g, or t

SEQ ID NO: 80053 - DNA, 136 bp, Homo sapiens
  misc_feature: GYAE6OF01CRKDP.44.25.C03.1.454.CMB.1.raw
tcagacagtatatacacgaccggtgctcgatttagtagtgtagatttgggtttgggctctgggcacagcggccctgggctgcctggtcaaggactacttccacgtctactgctgagcgggctggcaaggcgcatag

SEQ ID NO: 80054 - DNA, 241 bp, Homo sapiens; identical to SEQ ID NO: 79989
  misc_feature: GYAE6OF01B2NOF.44.25.C03.1.454.CMB.1.raw
  modified_base (238)..(241): a, c, t, g, unknown or other
  misc_feature (238)..(241): n is a, c, g, or t

SEQ ID NO: 80055 - DNA, 269 bp, Homo sapiens
  misc_feature: GYAE6OF01CLMUI.44.25.C03.1.454.CMB.1.raw
  modified_base (230)..(230): a, c, t, g, unknown or other
  misc_feature (230)..(230): n is a, c, g, or t
  modified_base (236)..(238): a, c, t, g, unknown or other
  misc_feature (236)..(238): n is a, c, g, or t
  modified_base (240)..(269): a, c, t, g, unknown or other
  misc_feature (240)..(269): n is a, c, g, or t
tcagacagtatatacacgaccggtgctcgatttagtagtgtagatttgggtttggggtggcccaagctgctggagggcacggtcaccacggtcaccgtctcctcagcttccaccaaggcccatcggtcttcccctggcgccctgctccaggagcacctctgggggcacagcggccctgggctgcctggtcaaggctacttccagtctactgctgagcggctggcaaggcncatagnnnannnnnnnnnnnnnnnnnnnnnnnnnnnnnn

SEQ ID NO: 80056 - DNA, 308 bp, Homo sapiens
  misc_feature: GYAE6OF01ELF5Q.44.25.C03.1.454.CMB.1.raw
  modified_base (121)..(121): a, c, t, g, unknown or other
  misc_feature (121)..(121): n is a, c, g, or t
  modified_base (149)..(149): a, c, t, g, unknown or other
  misc_feature (149)..(149): n is a, c, g, or t
  modified_base (264)..(308): a, c, t, g, unknown or other
  misc_feature (264)..(308): n is a, c, g, or t
tcagacagtatatacacgaccggtgctcgatttagtagtgtagatttgggtttgggggggaagaggaagactgacggtcctcccaggagttcaggtgctgggcaccttgggcaggtggggngtgtgtcacaagtgttggctgtggcacnggcccgtccgtggctcgccgttggtacgaacggtacctttacctttaccaacgttaccttacgttcgtcgtaggacgggccgggtcgtcggaacggaacgggccgactaagtagnnnnnnnnnnnnnnnnnnnnnnnnnnnnnnnnnnnnnnnnnnnnn

SEQ ID NO: 80057 - DNA, 240 bp, Homo sapiens; identical to SEQ ID NO: 79926
  misc_feature: GYAE6OF01ELNBC.44.25.C03.1.454.CMB.1.raw
  modified_base (238)..(240): a, c, t, g, unknown or other
  misc_feature (238)..(240): n is a, c, g, or t

SEQ ID NO: 80058 - DNA, 301 bp, Homo sapiens
  misc_feature: GYAE6OF01BVSRG.44.25.C03.1.454.CMB.1.raw
  modified_base (297)..(301): a, c, t, g, unknown or other
  misc_feature (297)..(301): n is a, c, g, or t
tcagacagtatatacacgaccggtgctcgatttagtagtgtagatttgggtttgggggtgtggtggtctccactcccgccttgacggggctgctatctgcctccctggccatcactgggctccaggctgaagatgagggtgattattactgccagtcctatgacagcagcctcagtggttgggtgttcggcggagggaccaagctgaccgtctgggtcagcccaaggctcgcccctcggtcactctcgttcccgccctcctctatatactgtctgagcggctggcaaggcgcatagnnnnn

SEQ ID NO: 80059 - DNA, 610 bp, Homo sapiens
  misc_feature: GYAE6OF01BX5X0.44.25.C03.1.454.CMB.1.raw
  modified_base (460)..(460): a, c, t, g, unknown or other
  misc_feature (460)..(460): n is a, c, g, or t
tcagacagtatatacacgaccggtgctcgatttagtagtgtagatttgggtttgggggactcctgtgccccaccatggacactctttgctacacactcctgctgctgaccacccttcctgggtcttgtcccaggtcaccttgaaggagtctggtcctgtgctggtgaaacccacagagaccctcacgctgacctgcaccatctctgggttctctctcaacgatattagaatgggtgtgagctggatccgtcacgcccccaggggaacggcccgtggaggtggcttgcacacatcttctcgaatgaacgaaaatcctacagtacatctctagaagagacaagtttaaccatctaccaacggacaacctaccaaaaggcaggtgtactttagtatgaccaacatggaccctgcgacacagcacatattactgtgcgacgggtatggaacgggtaaagaacgngacgttggtttactagttaatttaataacgttacttaaccctattacgtacgggtacgtcggtagggggtaaccaaacggggtacccgtacgggtaccctaacccggttcccttacccgtcctaacgtcccgttaccccgaaaccccggg

SEQ ID NO: 80060 - DNA, 138 bp, Homo sapiens
  misc_feature: GYAE6OF01BCRU1.44.25.C03.1.454.CMB.1.raw
  modified_base (137)..(138): a, c, t, g, unknown or other
  misc_feature (137)..(138): n is a, c, g, or t
tcagacagtatatacacgaccggtgctcgatttagtagtgtagatttgggtttgggctctgggcacagcggccctgggctgcctggtcaaggactacttcctatatactgtctgagcgggctggcaaggcgcatagnn

SEQ ID NO: 80061 - DNA, 137 bp, Homo sapiens
  misc_feature: GYAE6OF01COL6J.44.25.C03.1.454.CMB.1.raw
  modified_base (137)..(137): a, c, t, g, unknown or other
  misc_feature (137)..(137): n is a, c, g, or t
tcagacagtatatacacgaccggtgctcgatttagtagtgtagatttgggtttgggctctgggcacagcggcactgggctgcctggtcaaggactacttcctatatactgtctgagcgggctggcaaggcgcatagn

SEQ ID NO: 80062 - DNA, 221 bp, Homo sapiens; identical to SEQ ID NO: 79959
  misc_feature: GYAE6OF01AC2K0.44.25.C03.1.454.CMB.1.raw
  modified_base (219)..(221): a, c, t, g, unknown or other
  misc_feature (219)..(221): n is a, c, g, or t

SEQ ID NO: 80063 - DNA, 240 bp, Homo sapiens; identical to SEQ ID NO: 79965
  misc_feature: GYAE6OF01ECKYN.44.25.C03.1.454.CMB.1.raw
  modified_base (239)..(240): a, c, t, g, unknown or other
  misc_feature (239)..(240): n is a, c, g, or t

SEQ ID NO: 80064 - DNA, 130 bp, Homo sapiens; identical to SEQ ID NO: 79921
  misc_feature: GYAE6OF01B7W1I.44.25.C03.1.454.CMB.1.raw
  modified_base (130)..(130): a, c, t, g, unknown or other
  misc_feature (130)..(130): n is a, c, g, or t

SEQ ID NO: 80065 - DNA, 144 bp, Homo sapiens
  misc_feature: GYAE6OF01CWH83.44.25.C03.1.454.CMB.1.raw
  modified_base (130)..(144): a, c, t, g, unknown or other
  misc_feature (130)..(144): n is a, c, g, or t
tcagacagtatatacacgaccggtgctcgatttagtagtgtagatttgggtttgggcacagcggccctgggctgcctggtcaaggactacttcctatatactgtctgagcgggctggcaaggcgcatagnnnnnnnnnnnnnnn

SEQ ID NO: 80066 - DNA, 242 bp, Homo sapiens; identical to SEQ ID NO: 80017
  misc_feature: GYAE6OF01BGKJC.44.25.C03.1.454.CMB.1.raw
  modified_base (239)..(242): a, c, t, g, unknown or other
  misc_feature (239)..(242): n is a, c, g, or t

SEQ ID NO: 80067 - DNA, 655 bp, Homo sapiens
  misc_feature: GYAE6OF01EB7BX.44.25.C03.1.454.CMB.1.raw
  modified_base (225)..(225): a, c, t, g, unknown or other
  misc_feature (225)..(225): n is a, c, g, or t
tcagacagtatatacacgaccggtgctcgatttagtagtgtagatttgggtttggggggcacaagaggcagcactcaggacaatctccagcatggcctggtctcctctcctcctcactctcctcgctcactgcacagggtcctgggcccactctgtgctgacgcagccgccctcagtgtcgtggggccccggggcaggagggtcaccatctcctgcacgtgggancagactccaacatcgggacagattctgatgtccactggtaccaacaccttccaggaacacgacccccaaactcctacattctttaggtaaccaactactccggccctcgacggggtccctgaccgattctctggctacaagtctgccactcacgccctccctggcctatccgacgtcgggcctccgacggtctagaaagtacgtaggaagggttgtaagtttacttacgtggaccctaaggttcccttaagtcgaaccaggacctacgtcccttagtagggttcggggtttaggggttcggtttcggggaccgggtaacggggtaaccctaacggtccgttacgggaaccccggtttccggtacgggggttaccaaccgggtaccccggtaacgggcccgtttcccggtccccccccggtgggttacccc

SEQ ID NO: 80068 - DNA, 221 bp, Homo sapiens; identical to SEQ ID NO: 79959
  misc_feature: GYAE6OF01B6RYJ.44.25.C03.1.454.CMB.1.raw
  modified_base (219)..(221): a, c, t, g, unknown or other
  misc_feature (219)..(221): n is a, c, g, or t

SEQ ID NO: 80069 - DNA, 299 bp, Homo sapiens
  misc_feature: GYAE6OF01DQFH8.44.25.C03.1.454.CMB.1.raw
  modified_base (297)..(299): a, c, t, g, unknown or other
  misc_feature (297)..(299): n is a, c, g, or t
tcagacagtatatacacgaccggtgctcgatttagtagtgtagatttgggtttgggggtgtggtggtctccactcccgccttgacggggctgctatctgcctccctggccatcactgggctccaggctgaagatgagggtgattattactgccagtcctatgacagcagcctcagtggttgggtgttcggcggagggaccaagctgaccgtcctaggtcagcccaaggctgcccctcggtcactctgttcccgccctcctctatatactgtctgagcgggctggcaaggcgcatagnnn

SEQ ID NO: 80070 - DNA, 243 bp, Homo sapiens
  misc_feature: GYAE6OF01BO7ZO.44.25.C03.1.454.CMB.1.raw
  modified_base (239)..(243): a, c, t, g, unknown or other
  misc_feature (239)..(243): n is a, c, g, or t
tcagacagtatatacacgaccggtgctcgatttagtagtgtagatttgggtttgggtgcccaagctgctggagggcacggtcaccacggtcaccgtctcctcagcttccaccaagggcccatcggtcttccccctggcgccctgctccaggagcacctctgggggcacagcggccctgggctgcctggtcaaggactacttccacgtctactgctgagcgggctggcaaggcgcatagnnnnn

SEQ ID NO: 80071 - DNA, 239 bp, Homo sapiens; identical to SEQ ID NO: 80031
  misc_feature: GYAE6OF01BDDM7.44.25.C03.1.454.CMB.1.raw
  modified_base (239)..(239): a, c, t, g, unknown or other
  misc_feature (239)..(239): n is a, c, g, or t

SEQ ID NO: 80072 - DNA, 138 bp, Homo sapiens; identical to SEQ ID NO: 80060
  misc_feature: GYAE6OF01A2ZIY.44.25.C03.1.454.CMB.1.raw
  modified_base (137)..(138): a, c, t, g, unknown or other
  misc_feature (137)..(138): n is a, c, g, or t

SEQ ID NO: 80073 - DNA, 349 bp, Homo sapiens
  misc_feature: GYAE6OF01EOV28.44.25.C03.1.454.CMB.1.raw
  modified_base (301)..(349): a, c, t, g, unknown or other
  misc_feature (301)..(349): n is a, c, g, or t
tcagacagtatatacacgaccggtgctcgatttagtagtgtagatttgggtttggggggtgtggtggtctccactcccgccttgacggggctgctatctgcctcccctggccatcactggggctccaggctgaagatgagggtgattattactgccagtcctatgacagcagcctcagtggttgggtgttcggcggagggaccaagctgaccgtcctgggtcagcccaaggctgccccctcggtcactctgttcccgcctcctctatatactgtctgagcgggctggcaaggccgcatagnnnnnnnnnnnnnnnnnnnnnnnnnnnnnnnnnnnnnnnnnnnnnnnnn

SEQ ID NO: 80074 - DNA, 220 bp, Homo sapiens
  misc_feature: GYAE6OF01B08AY.44.25.C03.1.454.CMB.1.raw
  modified_base (219)..(220): a, c, t, g, unknown or other
  misc_feature (219)..(220): n is a, c, g, or t
tcagacagtatatacacgaccggtgctcgatttagtagtgtagatttgggtttgggggaagaggaagactgacggtcctcccaggagttcaggtgctgggcaccttgggcacgggggaggtgtgtcacaagatttgggctctgggcacagcggccctgggctgcctggtcaaggactacttccacgtctactgctgagcgggctggcaaggcgcatagnn

SEQ ID NO: 80075 - DNA, 243 bp, Homo sapiens; identical to SEQ ID NO: 80033
  misc_feature: GYAE6OF01A0PHC.44.25.C03.1.454.CMB.1.raw
  modified_base (239)..(243): a, c, t, g, unknown or other
  misc_feature (239)..(243): n is a, c, g, or t

SEQ ID NO: 80076 - DNA, 456 bp, Homo sapiens
  misc_feature: GYAE6OF01CO24O.44.25.C03.1.454.CMB.1.raw
  modified_base (449)..(456): a, c, t, g, unknown or other
  misc_feature (449)..(456): n is a, c, g, or t
tcagacagtatatacacgaccggtgctcgatttagtagtgtagatttgggtttgggggctgttcctggaaggtgttggtaccagagggtcaccatctcctgcactgggagcagatccaacatcgggacagattctgatgtccactggtaccaacaccttccaggaacagcccccaaactcctcatctttggtaacaactatcggccctcaggggtccctgaccgattctctggctccaagtctggcacctcagcctccctggccatcactgggctccaggctgaagatgagggtgattattactgccagtcctatgacagcagcctcagtggttgggtgttcggcggaggaccaagctgaccgtctgggtcagcccaaggctgccccctggtcactctcgttccccacctcctctatatactgtctgagcggctggcaaggcgcatagnnnnnnnn

SEQ ID NO: 80077 - DNA, 272 bp, Homo sapiens
  misc_feature: GYAE6OF01BPLN4.44.25.C03.1.454.CMB.1.raw
  modified_base (255)..(255): a, c, t, g, unknown or other
  misc_feature (255)..(255): n is a, c, g, or t
  modified_base (261)..(272): a, c, t, g, unknown or other
  misc_feature (261)..(272): n is a, c, g, or t
tcagacagtatatacacgaccggtgctcgatttagtagtgtagatttgggtttgggggaagaggaagactgacggtcctcccaggagttcaggtgctgggcaccttgggcacgggggaggtgtgtcacaagatttggctctgggcaccgtgggcatgggggagtgtgtcacaagatttgggctctgggcacagcggcctgggctgcctggtcaaggactacttcctatatactgtctgagcgggctggcaaggcncatagnnnnnnnnnnnn

SEQ ID NO: 80078 - DNA, 218 bp, Homo sapiens
  misc_feature: GYAE6OF01AZ78R.44.25.C03.1.454.CMB.1.raw
  modified_base (217)..(218): a, c, t, g, unknown or other
  misc_feature (217)..(218): n is a, c, g, or t
tcagacagtatatacacgaccggtgctcgatttagtagtgtagatttgggtttggggaagaggaagactgacggtcctcccaggagttcaggtgctgggcaccttgggcacggggaggtgtgtcacaagatttgggctctgggcacagcggccctgggctgcctggtcaaggactacttcctatatactgtctgagcgggctggcaaggcgcatagnn

SEQ ID NO: 80079 - DNA, 222 bp, Homo sapiens
  misc_feature: GYAE6OF01ALQ6P.44.25.C03.1.454.CMB.1.raw
  modified_base (218)..(222): a, c, t, g, unknown or other
  misc_feature (218)..(222): n is a, c, g, or t
tcagacagtatatacacgaccggtgctcgatttagtagtgtagatttgggtttgggggaagaggaagactgacggtcctcccaggagttcaggtgctgggcaccttgggcacggggaggtgtgtcacaagatttgggctctgggcacagcggccctgggctgcctggtcaaggactacttcctatatactgtctgagcgggctggcaaggcgcatagnnnnn

SEQ ID NO: 80080 - DNA, 305 bp, Homo sapiens
  misc_feature: GYAE6OF01DMCV5.44.25.C03.1.454.CMB.1.raw
  modified_base (294)..(305): a, c, t, g, unknown or other
  misc_feature (294)..(305): n is a, c, g, or t
tcagacagtatatacacgaccggtgctcgatttagtagtgtagatttgggtttgggggtgtggtggtctccactcccgccttgacgggctgctatctgcctccctggccatcactgggctccaggctgaagatgagggtgattattactgccagtcctatgacagcagcctcagtggttgggtgttcggcggagggaccaagctgaccgtcctgggtcagcccaaggctgcccctggtcactctgttcccgccctctctatatactgtctgagcgggctggcaaggcgcatagnnnnnnnnnnnn

SEQ ID NO: 80081 - DNA, 265 bp, Homo sapiens
  misc_feature: GYAE6OF01E584Q.44.25.C03.1.454.CMB.1.raw
  modified_base (263)..(265): a, c, t, g, unknown or other
  misc_feature (263)..(265): n is a, c, g, or t
tcagacagtatatacacgaccggtgctcgatttagtagtgtagatttgggtttgggggaagaggaagactgacggtcctcccaggagttcaggtgctgggcaccttgggcacgggggaggtgtgtcacaagatttgggctctgggcaccgtgggcatgggggaggtgtgtcacaagatttgggctctgggcacagcggccctgggctgcctggtcaaggctacttcctatatactgtctgagcgggctggcaaggcgcatagnnn

SEQ ID NO: 80082 - DNA, 129 bp, Homo sapiens
  misc_feature: GYAE6OF01ECLKP.44.25.C03.1.454.CMB.1.raw
tcagacagtatatacacgaccggtgctcgatttagtagtgtagatttgggtttgggcacagcggccctgggctgcctggtcaaggactacttccacgtctactgctgagcgggctggcaaggcgcatag

SEQ ID NO: 80083 - DNA, 240 bp, Homo sapiens
  misc_feature: GYAE6OF01BCOWU.44.25.C03.1.454.CMB.1.raw
  modified_base (239)..(240): a, c, t, g, unknown or other
  misc_feature (239)..(240): n is a, c, g, or t
tcagacagtatatacacgaccggtgctcgatttagtagtgtagatttgggtttgggtgcccaagctgctggagggcacggtcaccacggtcaccgtctcctcagcttccaccaagggcccatcggtcttccccctggcgccctgctccaggagcacctctgggggcacagcggccctgggctgcctggtcaaggactacttccacgtctactgctgagcgggctggcaaggcgcatagnn

SEQ ID NO: 80084 - DNA, 131 bp, Homo sapiens; identical to SEQ ID NO: 79911
  misc_feature: GYAE6OF01BZBTX.44.25.C03.1.454.CMB.1.raw
  modified_base (130)..(131): a, c, t, g, unknown or other
  misc_feature (130)..(131): n is a, c, g, or t

SEQ ID NO: 80085 - DNA, 242 bp, Homo sapiens
  misc_feature: GYAE6OF01A4W8K.44.25.C03.1.454.CMB.1.raw
  modified_base (239)..(242): a, c, t, g, unknown or other
  misc_feature (239)..(242): n is a, c, g, or t
tcagacagtatatacacgaccggtgctcgatttagtagtgtagatttgggtttgggtgcccaagctgctggagggcacggtcaccacggtcaccgtctcctcagcttccaccaagggcccatcggtcttccccctggcgccctgctccaggagcacctctgggggcacagcggccctgggctgcctggtcaaggactacttcctcgatcgcgtctgagcgggctggcaaggcgcatagnnnn

SEQ ID NO: 80086 - DNA, 220 bp, Homo sapiens; identical to SEQ ID NO: 79979
  misc_feature: GYAE6OF01EWMDT.44.25.C03.1.454.CMB.1.raw
  modified_base (219)..(220): a, c, t, g, unknown or other
  misc_feature (219)..(220): n is a, c, g, or t

SEQ ID NO: 80087 - DNA, 139 bp, Homo sapiens
  misc_feature: GYAE6OF01C5UA1.44.25.C03.1.454.CMB.1.raw
  modified_base (129)..(139): a, c, t, g, unknown or other
  misc_feature (129)..(139): n is a, c, g, or t
tcagacagtatatacacgaccggtgctcgatttagtagtgtagatttgggttggcacagcggaccctgggctgcctggtcaaggactacttccacgtctactgctgagcgggctggcaaggcgcatagnnnnnnnnnnn

SEQ ID NO: 80088 - DNA, 133 bp, Homo sapiens
  misc_feature: GYAE6OF01CMIZL.44.25.C03.1.454.CMB.1.raw
  modified_base (130)..(133): a, c, t, g, unknown or other
  misc_feature (130)..(133): n is a, c, g, or t
tcagacagtatatacacgaccggtgctcgatttagtagtgtagatttgggtttgggcacagcggccctgggctgcctggtcaaggactacttcctatatactgtctgagcgggctggcaaggcgcatagnnnn

SEQ ID NO: 80089 - DNA, 130 bp, Homo sapiens; identical to SEQ ID NO: 79944
  misc_feature: GYAE6OF01ATV9F.44.25.C03.1.454.CMB.1.raw
  modified_base (130)..(130): a, c, t, g, unknown or other
  misc_feature (130)..(130): n is a, c, g, or t

SEQ ID NO: 80090 - DNA, 239 bp, Homo sapiens
  misc_feature: GYAE6OF01C6PZ8.44.25.C03.1.454.CMB.1.raw
  modified_base (237)..(239): a, c, t, g, unknown or other
  misc_feature (237)..(239): n is a, c, g, or t
tcagacagtatatacacgaccggtgctcgatttagtagtgtagatttgggtttgggtgcccaagctgctggagggcacggtcaccacggtcaccgtctcctcagcttccaccaagggcccatcggtcttcccctggcgccctgctccaggagcacctctgggggcacagcggccctgggctgcctggtcaaggctacttcctatatactgtctgagcgggctggcaaggcgcatagnnn

SEQ ID NO: 80091 - DNA, 242 bp, Homo sapiens; identical to SEQ ID NO: 80017
  misc_feature: GYAE6OF01DWKX0.44.25.C03.1.454.CMB.1.raw
  modified_base (239)..(242): a, c, t, g, unknown or other
  misc_feature (239)..(242): n is a, c, g, or t

SEQ ID NO: 80092 - DNA, 458 bp, Homo sapiens
  misc_feature: GYAE6OF01BG0UM.44.25.C03.1.454.CMB.1.raw
  modified_base (453)..(458): a, c, t, g, unknown or other
  misc_feature (453)..(458): n is a, c, g, or t
tcagacagtatatacacgaccggtgctcgatttagtagtgtagatttgggtttgggggctgttcctggaaggtgttggtaccagagggtcaccatctcctgcactgggagcagatccaacatcgggacagattctgatgtccactggtaccaacaccttccaggaacagcccccaaactcctcatctttggtaacaactatcggccctcaggggtccctgaccgattctctggctccaagtctggcacctcagcctccctggccatcactgggctccaggctgaagatgagggtgattattactgccagtcctatgacagcagcctcagtggttgggtgttcggcggagggaccaagctgaccgtcctgggtcagcccaaggctgccccctcggtcactctgttccccgccctcctctatatactgtctgagcgggctggcaaggcgcatagnnnnnn

SEQ ID NO: 80093 - DNA, 220 bp, Homo sapiens; identical to SEQ ID NO: 79977
  misc_feature: GYAE6OF01D79KG.44.25.C03.1.454.CMB.1.raw
  modified_base (219)..(220): a, c, t, g, unknown or other
  misc_feature (219)..(220): n is a, c, g, or t

SEQ ID NO: 80094 - DNA, 257 bp, Homo sapiens
  misc_feature: GYAE6OF01A15SG.44.25.C03.1.454.CMB.1.raw
  modified_base (217)..(217): a, c, t, g, unknown or other
  misc_feature (217)..(217): n is a, c, g, or t
  modified_base (223)..(257): a, c, t, g, unknown or other
  misc_feature (223)..(257): n is a, c, g, or t
tcagacagtatatacacgaccggtgctcgatttagtagtgtagatttgggtttggggggaagaggaagactgacggtcctcccaggagttcaagtgctcgggcaccttgggcacgggggaggtgtgtcacaagatttgggctctgggcaacagcggccctgggctgcctggtcaaggactacttcctcgatcgcgtctgaggcgggctggcaaggcncatagnnnnnnnnnnnnnnnnnnnnnnnnnnnnnnnnnnn

SEQ ID NO: 80095 - DNA, 238 bp, Homo sapiens
  misc_feature: GYAE6OF01A9TBR.44.25.C03.1.454.CMB.1.raw
  modified_base (236)..(238): a, c, t, g, unknown or other
  misc_feature (236)..(238): n is a, c, g, or t
tcagacagtatatacacgaccggtgctcgatttagtagtgtagatttgggtttgggtgcccaagctgctggagggcacggtcaccacggtcaccgtctcctcagcttccaccaagggccatcggtcttcccctggcgccctgctccaggagcacctctgggggcacagcggcctgggctgcctggtcaaggactacttcctatatactgtctgagcgggctggcaaggcgcatagnnn

SEQ ID NO: 80096 - DNA, 220 bp, Homo sapiens; identical to SEQ ID NO: 79958
  misc_feature: GYAE6OF01E0FJ0.44.25.C03.1.454.CMB.1.raw
  modified_base (219)..(220): a, c, t, g, unknown or other
  misc_feature (219)..(220): n is a, c, g, or t

SEQ ID NO: 80097 - DNA, 270 bp, Homo sapiens
  misc_feature: GYAE6OF01BWCNI.44.25.C03.1.454.CMB.1.raw
  modified_base (265)..(270): a, c, t, g, unknown or other
  misc_feature (265)..(270): n is a, c, g, or t
tcagacagtatatacacgaccggtgctcgatttagtagtgtagatttgggtttgggggaagaggaagactgacggtcctcccaggagttcaggtgctgggcaccttgggcacgggggaggtgtgtcacaagatttgggctctgggcaccgtgggcagtgggggaggtgtgtcacaagatttgggctctgggcacagcggccctgggctgcctggtcaaggactacttcctatatactgtctgagcgggctggcaaggcgcatagnnnnnn

SEQ ID NO: 80098 - DNA, 215 bp, Homo sapiens
  misc_feature: GYAE6OF01EGKMH.44.25.C03.1.454.CMB.1.raw
  modified_base (215)..(215): a, c, t, g, unknown or other
  misc_feature (215)..(215): n is a, c, g, or t
tcagacagtatatacacgaccggtgctcgatttagtagtgtagatttgggtttgggggacaatggtcaccgtctcttcagcttccaccaagggcccatcggtcttccccctggcgccctgctccaggagcacctctgggggcacagcggccctgggctgcctggtcaaggactacttcctatatactgtctgagcgggctggcaaggcgcatagn

SEQ ID NO: 80099 - DNA, 248 bp, Homo sapiens
  misc_feature: GYAE6OF01CBMJA.44.25.C03.1.454.CMB.1.raw
  modified_base (238)..(248): a, c, t, g, unknown or other
  misc_feature (238)..(248): n is a, c, g, or t
tcagacagtatatacacgaccggtgctcgatttagtagtgtagatttgggtttgggtgcccaagctgctggagggcacggtcaccacggtcaccgtctcctcagcttccaccaagggcccatcggtcttcccctggcgccctgctccaggagcacctctgggggcacagcggccctgggctgcctggtcaaggactacttcctatatactgtctgagcgggctggcaaggcgcatagnnnnnnnnnnn

SEQ ID NO: 80100 - DNA, 242 bp, Homo sapiens
  misc_feature: GYAE6OF01EIH44.44.25.C03.1.454.CMB.1.raw
  modified_base (239)..(242): a, c, t, g, unknown or other
  misc_feature (239)..(242): n is a, c, g, or t
tcagacagtatatacacgaccggtgctcgatttagtagtgtagatttgggtttgggtgcccaagctgctggagggcacggtcaccacggtcaccgtctcctcagcttccaccaagggcccatcggtcttccccctggcgccctgctccgggagcacctctgggggcacagcggccctgggctgcctggtcaaggactacttcctatatactgtctgagcgggctggcaaggcgcatagnnnn

SEQ ID NO: 80101 - DNA, 480 bp, Homo sapiens
  misc_feature: GYAE6OF01AJ9CS.44.25.C03.1.454.CMB.1.raw
  modified_base (403)..(403): a, c, t, g, unknown or other
  misc_feature (403)..(403): n is a, c, g, or t
  modified_base (472)..(480): a, c, t, g, unknown or other
  misc_feature (472)..(480): n is a, c, g, or t
tcagacagtatatacacgaccggtgctcgatttagtagtgtagatttgggtttgggctggatccgtcagcccccagggaaggccctggagtggcttgcacacatcttctcgaatgacgaaaaatcctacagtacatctctgaagagcagtttaaccatctccaaggacacctccaaaaggcaggtggtctttagtatgaccaacatggaccctgcggacacaggcacatattactgtgcacgggtaatgcgggaaagaacagctggtttctgtattataagtcttaccatctggacgtctggggcaaaggggaccacggtcaccgtctcctcagcttccaccaagggcccatcggtcttccccctggccgccctgcctccaggacgcacctctgggggcacgngcggccctgggctgcctggtcaaggctacttcctatatactgtctgagcgggctggcaaggcgcatagnnnnnnnnn

SEQ ID NO: 80102 - DNA, 239 bp, Homo sapiens; identical to SEQ ID NO: 79955
  misc_feature: GYAE6OF01C6DC0.44.25.C03.1.454.CMB.1.raw
  modified_base (238)..(239): a, c, t, g, unknown or other
  misc_feature (238)..(239): n is a, c, g, or t

SEQ ID NO: 80103 - DNA, 241 bp, Homo sapiens
  misc_feature: GYAE6OF01AT034.44.25.C03.1.454.CMB.1.raw
  modified_base (239)..(241): a, c, t, g, unknown or other
  misc_feature (239)..(241): n is a, c, g, or t
tcagacagtatatacacgaccggtgctcgatttagtagtgtagatttgggtttgggtgcccaagctgctggagggcacggtcaccacggtcaccgtctcctcagcttccaccaagggcccatcggtcttccccctggcgccctgctccaggagcacctctgggggcacagcggccctgggctgcctggtcaaggactacttccacgtctactgctgagcgggctggcaaggcgcatagnnn

SEQ ID NO: 80104 - DNA, 232 bp, Homo sapiens
  misc_feature: GYAE6OF01DYT4P.44.25.C03.1.454.CMB.1.raw
  modified_base (230)..(232): a, c, t, g, unknown or other
  misc_feature (230)..(232): n is a, c, g, or t
tcagacagtatatacacgaccggtgctcgatttagtagtgtagatttgggtttgggtgcccaagctgctggagggcacggtcaccacggtcaccgtctcctcagcttccaccaagggcccatcggtcttcccctggcgccctgctccaggagcacctctgggggcacagcggccctgggctgcctggtcaaggactgtctactgctgagcgggctggcaaggcgcatagnnn

SEQ ID NO: 80105 - DNA, 136 bp, Homo sapiens
  misc_feature: GYAE6OF01CCTD3.44.25.C03.1.454.CMB.1.raw
  modified_base (130)..(136): a, c, t, g, unknown or other
  misc_feature (130)..(136): n is a, c, g, or t
tcagacagtatatacacgaccggtgctcgatttagtagtgtagatttgggtttgggcacagcggccctgggctgcctggtcaaggactacttcctatatactgtctgagcgggctggcaaggcgcatagnnnnnnn

SEQ ID NO: 80106 - DNA, 132 bp, Homo sapiens
  misc_feature: GYAE6OF01C4N94.44.25.C03.1.454.CMB.1.raw
  modified_base (130)..(132): a, c, t, g, unknown or other
  misc_feature (130)..(132): n is a, c, g, or t
tcagacagtatatacacgaccggtgctcgatttagtagtgtagatttgggtttgggcacagcggccctgggctgcctggtcaaggactacttccacgtctactgctgagcgggctggcaaggcgcatagnnn

SEQ ID NO: 80107 - DNA, 263 bp, Homo sapiens
  misc_feature: GYAE6OF01D5DWG.44.25.C03.1.454.CMB.1.raw
  modified_base (241)..(263): a, c, t, g, unknown or other
  misc_feature (241)..(263): n is a, c, g, or t
tcagacagtatatacacgaccggtgctcgatttagtagtgtagatttgggtttgggtgcccaagctgctgggagggcgacggtcaccacggtcaccgtctcctcagcttccaccaagggcccatcggtcttcccctggcgccctgctccagggagcacctctgggggcacagcggccctgggctgcctggtcaaggactacttcctatatactgtctgagcgggctggcaaggcgcatagnnnnnnnnnnnnnnnnnnnnnnn

SEQ ID NO: 80108 - DNA, 130 bp, Homo sapiens; identical to SEQ ID NO: 79921
  misc_feature: GYAE6OF01DSAE5.44.25.C03.1.454.CMB.1.raw
  modified_base (130)..(130): a, c, t, g, unknown or other
  misc_feature (130)..(130): n is a, c, g, or t

SEQ ID NO: 80109 - DNA, 131 bp, Homo sapiens
  misc_feature: GYAE6OF01DS5RE.44.25.C03.1.454.CMB.1.raw
  modified_base (124)..(124): a, c, t, g, unknown or other
  misc_feature (124)..(124): n is a, c, g, or t
  modified_base (130)..(131): a, c, t, g, unknown or other
  misc_feature (130)..(131): n is a, c, g, or t
tcagacagtatatacacgaccggtgctcgatttagtagtgtagatttgggtttgggcacagcggccctgggctgcctggtcaaggactacttcctatatactgtctgagcgggctggcaaggcncatagnn

SEQ ID NO: 80110 - DNA, 242 bp, Homo sapiens; identical to SEQ ID NO: 79932
  misc_feature: GYAE6OF01DKHBJ.44.25.C03.1.454.CMB.1.raw
  modified_base (238)..(242): a, c, t, g, unknown or other
  misc_feature (238)..(242): n is a, c, g, or t

SEQ ID NO: 80111 - DNA, 241 bp, Homo sapiens; identical to SEQ ID NO: 80024
  misc_feature: GYAE6OF01CKVII.44.25.C03.1.454.CMB.1.raw
  modified_base (238)..(241): a, c, t, g, unknown or other
  misc_feature (238)..(241): n is a, c, g, or t

SEQ ID NO: 80112 - DNA, 295 bp, Homo sapiens
  misc_feature: GYAE6OF01AET6U.44.25.C03.1.454.CMB.1.raw
  modified_base (295)..(295): a, c, t, g, unknown or other
  misc_feature (295)..(295): n is a, c, g, or t
tcagacagtatatacacgaccggtgctcgatttagtagtgtagatttgggtttgggggtgtggtggtctccactcccgccttgacggggctgctatctgcctccctggccatcactgggctccaggctgaagatgagggtgattattactgccagtcctatgacagcagcctcagtggttgggtgttcggcggagggaccaagctgaccgtctgggtcagcccaaggctgcccctggtcactctcgttcccgcctcctctatatactgtctgagcgggctggcaaggcgcatagn

SEQ ID NO: 80113 - DNA, 244 bp, Homo sapiens
  misc_feature: GYAE6OF01CPITV.44.25.C03.1.454.CMB.1.raw
  modified_base (239)..(244): a, c, t, g, unknown or other
  misc_feature (239)..(244): n is a, c, g, or t
tcagacagtatatacacgaccggtgctcgatttagtagtgtagatttgggtttgggtgcccaagctgctggagggcacggtcaccacggtcaccgtctcctcagcttccaccaagggcccatcggtcttccccctggcgccctgctccaggagcacctctgggggcacagcggccctgggctgcctggtcaaggactacttccacgtctactgctgagcgggctggcaaggcgcatagnnnnnn

SEQ ID NO: 80114 - DNA, 240 bp, Homo sapiens
  misc_feature: GYAE6OF01BIIUN.44.25.C03.1.454.CMB.1.raw
  modified_base (238)..(240): a, c, t, g, unknown or other
  misc_feature (238)..(240): n is a, c, g, or t
tcagacagtatatacacgaccggtgctcgatttagtagtgtagatttgggtttgggtgcccaagctgctggagggcacggtcaccacggtcaccgtctcctcagcttccaccaagggcccatcggtcttccccctggcaccctcctccaagagcacctctggggcacagcggccctgggctgcctggtcaaggactacttccacgtctactgctgagcgggctggcaaggcgcatagnnn

SEQ ID NO: 80115 - DNA, 222 bp, Homo sapiens
  misc_feature: GYAE6OF01DRF4R.44.25.C03.1.454.CMB.1.raw
  modified_base (219)..(222): a, c, t, g, unknown or other
  misc_feature (219)..(222): n is a, c, g, or t
tcagacagtatatacacgaccggtgctcgatttagtagtgtagatttgggtttgggggaagaggaagactgacggtcctcccaggagttcaggtgctgggcaccttgggcatgggggaggtgtgtcacaagatttgggctctgggcacagcggccctgggctgcctggtcaaggactacttccacgtctactgctgagcgggctggcaaggcgcatagnnnn

SEQ ID NO: 80116 - DNA, 300 bp, Homo sapiens
  misc_feature: GYAE6OF01BETNA.44.25.C03.1.454.CMB.1.raw
  modified_base (298)..(300): a, c, t, g, unknown or other
  misc_feature (298)..(300): n is a, c, g, or t
tcagacagtatatacacgaccggtgctcgatttagtagtgtagatttgggtttgggggtgtggtggtctccactcccgccttgacggggctgctatctgcctccctggccatcactgggctccaggctgaagatgagggtgattattactgccagtcctatgacagcagcctcagtggttgggtgttcggcggagggaccaagctgaccgtcctgggtcagcccaaggctgccccctcggtcactctgttcccgccctcctctatatactgtctgagcgggctggcaaggcgcatagnnn

SEQ ID NO: 80117 - DNA, 247 bp, Homo sapiens
  misc_feature: GYAE6OF01A5GQF.44.25.C03.1.454.CMB.1.raw
  modified_base (203)..(203): a, c, t, g, unknown or other
  misc_feature (203)..(203): n is a, c, g, or t
  modified_base (225)..(247): a, c, t, g, unknown or other
  misc_feature (225)..(247): n is a, c, g, or t
tcagacagtatatacacgaccggtgctcgatttagtagtgtagatttgggtttgggggtaaggaggaagactgacggtcctcccaggagttcaggtgcgtgggcaccttcgggcacgggggaggtgtgtcacaagatttgggctctgggcacagcggccctgggctgcctggtcaaggactacttcctatatactgtcctgancgggctggcaaggcgcatacgnnnnnnnnnnnnnnnnnnnnnnn

SEQ ID NO: 80118 - DNA, 243 bp, Homo sapiens
  misc_feature: GYAE6OF01EFC1C.44.25.C03.1.454.CMB.1.raw
  modified_base (238)..(243): a, c, t, g, unknown or other
  misc_feature (238)..(243): n is a, c, g, or t
tcagacagtatatacacgaccggtgctcgatttagtagtgtagatttgggtttgggtgcccaagctgctggagggcacggtcaccacggtcaccgtctcctcagcttccaccaagggcccatcggtcttcccctggcgccctgctccaggagcacctctgggggcacagcggccctgggctgcctggtcaaggactacttcctatatactgtctgagcgggctggcaaggcgcatagnnnnnn

SEQ ID NO: 80119 - DNA, 241 bp, Homo sapiens; identical to SEQ ID NO: 80103
  misc_feature: GYAE6OF01A6XFZ.44.25.C03.1.454.CMB.1.raw
  modified_base (239)..(241): a, c, t, g, unknown or other
  misc_feature (239)..(241): n is a, c, g, or t

SEQ ID NO: 80120 - DNA, 537 bp, Homo sapiens
  misc_feature: GYAE6OF01A1MVX.44.25.C03.1.454.CMB.1.raw
  modified_base (523)..(523): a, c, t, g, unknown or other
  misc_feature (523)..(523): n is a, c, g, or t
tcagacagtatatacacgaccggtgctcgatttagtagtgtagatttgggtttgggggactcctgtgccccaccatggacactctttgctacacactcctgctgctgaccacccttcctgggtcttgtcccaggtcaccttgaaggagtctggtcctgtgctggtgaaacccacagagaccctcacgctgacctgcaccatctctgggttctctctcaacgatattagaatgggtgtgagctggatccgtcagcccccagggaaggccctggagtggcttgcacacatcttctcgaatgacgaaaaatcctacagtacatctctgaagagcagtttaaccatctccaaggacacctccaaaaggcaggtggtctttagtatgaccaacatggaccctgcggacacaggcacatattactgtgcacgggtaatggacgggaaagaacagctggtttctgtattataagtcttaccatctggacgtcgtggggacaaaggggcccacgggtcaccggtctcctancgcttcccaaccgg

SEQ ID NO: 80121 - DNA, 223 bp, Homo sapiens
  misc_feature: GYAE6OF01C77SG.44.25.C03.1.454.CMB.1.raw
  modified_base (218)..(223): a, c, t, g, unknown or other
  misc_feature (218)..(223): n is a, c, g, or t
tcagacagtatatacacgaccggtgctcgatttagtagtgtagatttgggtttgggggaagaggaagactgacggtcctcccaggagttcaggtgctgggcaccttgggcatggggaggtgtgtcacaagatttgggctctgggcacagcggccctgggctgcctggtcaaggactacttccacgtctactgctgagcgggctggcaaggcgcatagnnnnnn

SEQ ID NO: 80122 - DNA, 245 bp, Homo sapiens
  misc_feature: GYAE6OF01DYGXA.44.25.C03.1.454.CMB.1.raw
  modified_base (238)..(245): a, c, t, g, unknown or other
  misc_feature (238)..(245): n is a, c, g, or t
tcagacagtatatacacgaccggtgctcgatttagtagtgtagatttgggtttgggtgcccaagctgctggagggcacggtcaccacggtcaccgtctcctcagcttccaccaagggcccatcggtcttcccctggcgccctgctccaggagcacctctgggggcacagcggccctgggctgcctggtcaaggactacttcctatatactgtctgagcgggctggcaaggcgcatagnnnnnnnn

SEQ ID NO: 80123 - DNA, 195 bp, Homo sapiens
  misc_feature: GYAE6OF01C2REF.44.25.C03.1.454.CMB.1.raw
  modified_base (191)..(195): a, c, t, g, unknown or other
  misc_feature (191)..(195): n is a, c, g, or t
tcagacagtatatacacgaccggtgctcgatttagtagtgtagatttgggtttgggggaggtgtgtcacaagatttgggctctgggcaccgtgggcacgggggaggtgtgtcacaagatttgggccctgggctgcctggtcaaggactacttccacgtctactgtctgagcgggctggcaaggcgcatagnnnnn

SEQ ID NO: 80124 - DNA, 191 bp, Homo sapiens
  misc_feature: GYAE6OF01DEWM3.44.25.C03.1.454.CMB.1.raw
  modified_base (189)..(191): a, c, t, g, unknown or other
  misc_feature (189)..(191): n is a, c, g, or t
tcagacagtatatacacgaccggtgctcgatttagtagtgtagatttgggtttggggaggtgtgtcacaagatttgggctctgggcaccgtgggcacgggggaggtgtgtcacaagatttgggccctgggctgcctggtcaaggactacttccacgtctactgctgagcgggctggcaaggcgcatagnnn

SEQ ID NO: 80125 - DNA, 219 bp, Homo sapiens; identical to SEQ ID NO: 80027
  misc_feature: GYAE6OF01CJQSH.44.25.C03.1.454.CMB.1.raw
  modified_base (219)..(219): a, c, t, g, unknown or other
  misc_feature (219)..(219): n is a, c, g, or t

SEQ ID NO: 80126 - DNA, 299 bp, Homo sapiens
  misc_feature: GYAE6OF01ACHK7.44.25.C03.1.454.CMB.1.raw
  modified_base (294)..(299): a, c, t, g, unknown or other
  misc_feature (294)..(299): n is a, c, g, or t
tcagacagtatatacacgaccggtgctcgatttagtagtgtagatttgggtttgggggtgtggtggtctccactcccgccttgacgggctgctatctgcctccctggccatcactgggctccaggctgaagatgagggtgattattactgccagtcctatgacagcagcctcagtggttgggtgttcggcggagggaccaagctgaccgtcctgggtcagcccaaggctgcccctggtcactctgttcccgcctcctctatatactgtctgagcgggctggcaaggcgcatagnnnnnn

SEQ ID NO: 80127 - DNA, 239 bp, Homo sapiens; identical to SEQ ID NO: 79943
  misc_feature: GYAE6OF01DV2C8.44.25.C03.1.454.CMB.1.raw
  modified_base (237)..(239): a, c, t, g, unknown or other
  misc_feature (237)..(239): n is a, c, g, or t

SEQ ID NO: 80128 - DNA, 240 bp, Homo sapiens; identical to SEQ ID NO: 79926
  misc_feature: GYAE6OF01B986C.44.25.C03.1.454.CMB.1.raw
  modified_base (238)..(240): a, c, t, g, unknown or other
  misc_feature (238)..(240): n is a, c, g, or t

SEQ ID NO: 80129 - DNA, 319 bp, Homo sapiens
  misc_feature: GYAE6OF01AF8PM.44.25.C03.1.454.CMB.1.raw
  modified_base (311)..(319): a, c, t, g, unknown or other
  misc_feature (311)..(319): n is a, c, g, or t
tcagacagtatatacacgaccggtgctcgatttagtagtgtagatttgggtttgggggggtcacaagaggcagcgctctcgggacgtctctaccatggcctgggctctgctgctcctcactctcctcacccaggacacagggtcctgggcccagtctgccctgactcagcctgcctccgtgtctgggtcgcctggacagtcggtcaccatctcctgcactggagccagcggtcagcccaaggccaaccccactgtcactctgttcccgccctctctatatactgtctgagcgggctggcaaggcgcatagnnnnnnnnn

SEQ ID NO: 80130 - DNA, 240 bp, Homo sapiens
  misc_feature: GYAE6OF01B63VS.44.25.C03.1.454.CMB.1.raw
  modified_base (238)..(240): a, c, t, g, unknown or other
  misc_feature (238)..(240): n is a, c, g, or t
tcagacagtatatacacgaccggtgctcgatttagtagtgtagatttgggtttgggtgcccaagctgctggagggcacggtcaccacggtcaccgtctcctcagcttccaccaagggcccatcggtcttcccctggcgccctgctccaggagcacctctgggggcacagcggccctgggctgcctggtcaaggactacttccacgtctactgctgagcgggctggcaaggcgcatagnnn

SEQ ID NO: 80131 - DNA, 240 bp, Homo sapiens; identical to SEQ ID NO: 80083
  misc_feature: GYAE6OF01BVN8I.44.25.C03.1.454.CMB.1.raw
  modified_base (239)..(240): a, c, t, g, unknown or other
  misc_feature (239)..(240): n is a, c, g, or t

SEQ ID NO: 80132 - DNA, 130 bp, Homo sapiens; identical to SEQ ID NO: 79921
  misc_feature: GYAE6OF01AR2QS.44.25.C03.1.454.CMB.1.raw
  modified_base (130)..(130): a, c, t, g, unknown or other
  misc_feature (130)..(130): n is a, c, g, or t

SEQ ID NO: 80133 - DNA, 237 bp, Homo sapiens
  misc_feature: GYAE6OF01DGCLO.44.25.C03.1.454.CMB.1.raw
  modified_base (234)..(237): a, c, t, g, unknown or other
  misc_feature (234)..(237): n is a, c, g, or t
tcagacagtatatacacgaccggtgctcgatttagtagtgtagatttgggttgggtgcccaagctgctggaggcacggtcaccacggtcaccgtctcctcagcttccaccaagggcccatcggtcttcccctggcgccctgctccaggagcacctctgggggcacagcggccctgggctgcctggtcaaggctacttccagtctactgctgagcgggctggcaaggcgcaatgnnnn

SEQ ID NO: 80134 - DNA, 243 bp, Homo sapiens; identical to SEQ ID NO: 80006
  misc_feature: GYAE6OF01EDEA4.44.25.C03.1.454.CMB.1.raw
  modified_base (239)..(243): a, c, t, g, unknown or other
  misc_feature (239)..(243): n is a, c, g, or t

SEQ ID NO: 80135 - DNA, 282 bp, Homo sapiens
  misc_feature: GYAE6OF01CWKT2.44.25.C03.1.454.CMB.1.raw
  modified_base (141)..(141): a, c, t, g, unknown or other
  misc_feature (141)..(141): n is a, c, g, or t
  modified_base (159)..(159): a, c, t, g, unknown or other
  misc_feature (159)..(159): n is a, c, g, or t
  modified_base (246)..(246): a, c, t, g, unknown or other
  misc_feature (246)..(246): n is a, c, g, or t
  modified_base (252)..(282): a, c, t, g, unknown or other
  misc_feature (252)..(282): n is a, c, g, or t
tcagacagtatatacacgaccggtgctcgatttagtagtgtagatttgggtttgggttggccctaagctgctggagggcacggtcaccacggtcaccgtctcctacagcttcccaccaagggcccattcggtcttcccccnggcgccctgctccaggancacctcgtgggggcacagcggcccgtgggctgccgtggtcaaggtactacttacctagtactactgtctgagcgggctggcaaggcncatagnnnnnnnnnnnnnnnnnnnnnnnnnnnnnnn

SEQ ID NO: 80136 - DNA, 828 bp, Homo sapiens
  misc_feature: GYAE6OF01BT589.44.25.C03.1.454.CMB.1.raw
tcagacagtatatacacgaccggtgctcgatttagtagtgtagatttgggtttggggggcacaagaggcagcactcaggacaatctccagcatggcctggtctcctctcctcctcactctcctcgctcactgcacagggtcctgggcccactctgtgctgacgcagccgccctcagtgtcgtcgggggccccgggcaggagggtccaccatctcctgcacgtgggagcagactccaacagtcgggacagacttctgatcgtccactcggtaaccaaccaccttccaaggaacacgacccccaaactccctacacttcgtttacggtaactaactacgtccggcccttcgacggggttccctacggaccgtacttcctcgtcggcctacccgaagttccgtcggcctacctcacgtccctcccgtggccctactccgacgtcggggtccctaccgacgggtccttaggaaacgtacgttgggtaacggggttacgtaacgttttaacgttaaccgtcgtaccccgtaacggtttaccctaagttacggaaaccgtaacgggtacccgtaaccggtccccgttaccggttaacggggttttcggggggttttacgggggtttacggggttttacccggggggaaccggggggtaaaccggggggtaaaaccccgtaaaggggttccccggtttaacccggggttaaaccccccgggtttcccgggttaacggggggttacccccgtaaacccggggtaccccccgggtaaaacgggggtcccccgtttaccccggggtccccccccccgggtttccggggttaccccccg

SEQ ID NO: 80137 - DNA, 499 bp, Homo sapiens
  misc_feature: GYAE6OF01E1SVB.44.25.C03.1.454.CMB.1.raw
  modified_base (483)..(499): a, c, t, g, unknown or other
  misc_feature (483)..(499): n is a, c, g, or t
tcagacagtatatacacgaccggtgctcgattttagtagtgtagatttgggtttggggacggtgggaatccgtcagcccccagggaaggccctggagtggcttgcacacatcttctcgaatgaccgaaaaatcctacagtacatctctgaagagcagttttaaccatctccaaggacacctccaaaaggcaggtgttctttagtatgaccaacatggacccctgcggacacagggcacatattactgtgcacgggtaatggcgggaaagaaacagctaggttctgtattataagtcttaccatctgacgtctggggcaaagggaccacggtcaccgtctcctcaggcttccaccagggcccatcggtcttcccctggcgccctgctcaggagcacctctgggggcacagcggccctgggcctgcctggtccaaggactaacttcctccgatcgtcgtctgagcgggctggcaaggcgcatagnnnnnnnnnnnnnnnnn

SEQ ID NO: 80138 - DNA, 222 bp, Homo sapiens
  misc_feature: GYAE6OF01D7BGC.44.25.C03.1.454.CMB.1.raw
  modified_base (219)..(222): a, c, t, g, unknown or other
  misc_feature (219)..(222): n is a, c, g, or t
tcagacagtatatacacgaccggtgctcgatttagtagtgtagatttgggtttgggggaagaggaagactgacggtcctcccaggagttcaggtgctgggcaccttgggcacgggggaggtgtgtcacaagatttgggctctgggcacagcggccctgggctgcctggtcaaggactacttcctatatactgtctgagcgggctggcaaggcgcatagnnnn

SEQ ID NO: 80139 - DNA, 273 bp, Homo sapiens
  misc_feature: GYAE6OF01DBGWO.44.25.C03.1.454.CMB.1.raw
  modified_base (262)..(273): a, c, t, g, unknown or other
  misc_feature (262)..(273): n is a, c, g, or t
tcagacagtatatacacgaccggtgctcgatttagtagtgtagatttgggtttgggggaagaggaagactgacggtcctcccaggagttcaggtgctgggcaccttgggcacgggggaggtgtgtcacaagatttgggctctgggcaccgtgggcatgggggaggtgtgtcacaagatttgggctctggcacagcggccctgggctgcctggtcaaggctacttcctatatactgtctgagcgggctggcaaggcacatagnnnnnnnnnnnn

SEQ ID NO: 80140 - DNA, 541 bp, Homo sapiens
  misc_feature: GYAE6OF01E0T37.44.25.C03.1.454.CMB.1.raw
tcagacagtatatacacgaccggtgctcgatttagtagtgtagatttgggtttggggggaagctcagcttcagctgtgggtagagaagacaggactcaggacgatctccagcatggccagcttccctctcctcctcaccctcctcactcactgtgcagggtcctgggcccagtctgtgatgtctcagccaccctcagcgtctgggacccccgggcagggggtcaccatctcttgttctggaaggagtccaatatcggatcttatcctgtcaactggtatcggggactcccaggcacggccccccgactccttatctatgctactaatcagcggccctcaggggtccctgcccgattctctggctccaagtctggcactacaggctacctggccatccttgatctccagtctgaggatgaggctgattactactgtgcagcagtgggatgacaggccggaacgggcgtggggtcgttcgggcgggtagggaccgtaaggttcgacccgttccgtaagggtcaggccccgaaggccgtcccgg

SEQ ID NO: 80141 - DNA, 138 bp, Homo sapiens
  misc_feature: GYAE6OF01CEYF2.44.25.C03.1.454.CMB.1.raw
  modified_base (130)..(138): a, c, t, g, unknown or other
  misc_feature (130)..(138): n is a, c, g, or t
tcagacagtatatacacgaccggtgctcgatttagtagtgtagatttgggtttgggcacagcggccctgggctgcctggtcaaggactacttcctatatactgtctgagcgggctggcaaggcgcatagnnnnnnnnn

SEQ ID NO: 80142 - DNA, 240 bp, Homo sapiens; identical to SEQ ID NO: 79926
  misc_feature: GYAE6OF01C57LX.44.25.C03.1.454.CMB.1.raw
  modified_base (238)..(240): a, c, t, g, unknown or other
  misc_feature (238)..(240): n is a, c, g, or t

SEQ ID NO: 80143 - DNA, 341 bp, Homo sapiens
  misc_feature: GYAE6OF01A8I9X.44.25.C03.1.454.CMB.1.raw
  modified_base (303)..(341): a, c, t, g, unknown or other
  misc_feature (303)..(341): n is a, c, g, or t
tcagacagtatatacacgaccggtgctcgatttagtagtgtagatttgggtttggggggtggtggtggtctccactcccgccttgacggggctgctatctgcctccctggccatcactgggctccaggctgaagatgagggtgattattactgccagtcctattgacagcagcctcagtggttgggtgttcggcggagggaccaaggctgaccgtccgtgggtcagcccaaggctgcccctggtcactctgttcccgccctcctctatatactgtctgagcgggctggcaaggcgcagtacgnnnnnnnnnnnnnnnnnnnnnnnnnnnnnnnnnnnnnnn

SEQ ID NO: 80144 - DNA, 220 bp, Homo sapiens; identical to SEQ ID NO: 79940
  misc_feature: GYAE6OF01DWS1Q.44.25.C03.1.454.CMB.1.raw
  modified_base (218)..(220): a, c, t, g, unknown or other
  misc_feature (218)..(220): n is a, c, g, or t

SEQ ID NO: 80145 - DNA, 245 bp, Homo sapiens
  misc_feature: GYAE6OF01ATEBN.44.25.C03.1.454.CMB.1.raw
  modified_base (239)..(245): a, c, t, g, unknown or other
  misc_feature (239)..(245): n is a, c, g, or t
tcagacagtatatacacgaccggtgctcgatttagtagtgtagatttgggtttgggtgcccaagctgctggagggcacggtcaccacggtcaccgtctcctcagcttccaccaagggcccatcggtcttccccctggcgccctgctccaggagcacctctgggggcacagcggccctgggctgcctggtcaaggactacttcctcgatcgcgtctgagcgggctggcaaggcgcatagnnnnnnn

SEQ ID NO: 80146 - DNA, 198 bp, Homo sapiens
  misc_feature: GYAE6OF01BLZBS.44.25.C03.1.454.CMB.1.raw
  modified_base (197)..(198): a, c, t, g, unknown or other
  misc_feature (197)..(198): n is a, c, g, or t
tcagacagtatatacacgaccggtgctcgatttagtagtgtagatttgggtttgggggctgttcctggaaggtgttggtaccagagggtcaccatctcctgcactggagccagcggtcagcccaaggccaaccccactgtcactctgttcccgccctcctctatatactgtctgagcgggctggcaaggcgcatagnn

SEQ ID NO: 80147 - DNA, 248 bp, Homo sapiens
  misc_feature: GYAE6OF01DVV3B.44.25.C03.1.454.CMB.1.raw
  modified_base (237)..(248): a, c, t, g, unknown or other
  misc_feature (237)..(248): n is a, c, g, or t
tcagacagtatatacacgaccggtgctcgatttagtagtgtagatttgggtttgggtgcccaagctgctggagggcacggtcaccacggtcaccgtctcctcagcttccaccaagggcccatcggtcttcccctggcgccctgctccaggagcacctctgggggcacagcggccctgggctgcctggtcaaggctacttccacgtctactgctgagcgggctggcaaggcgcatagnnnnnnnnnnnn

SEQ ID NO: 80148 - DNA, 242 bp, Homo sapiens; identical to SEQ ID NO: 79920
  misc_feature: GYAE6OF01AI38J.44.25.C03.1.454.CMB.1.raw
  modified_base (238)..(242): a, c, t, g, unknown or other
  misc_feature (238)..(242): n is a, c, g, or t

SEQ ID NO: 80149 - DNA, 513 bp, Homo sapiens
  misc_feature: GYAE6OF01AHPZJ.44.25.C03.1.454.CMB.1.raw
  modified_base (302)..(302): a, c, t, g, unknown or other
  misc_feature (302)..(302): n is a, c, g, or t
  modified_base (461)..(461): a, c, t, g, unknown or other
  misc_feature (461)..(461): n is a, c, g, or t
  modified_base (474)..(474): a, c, t, g, unknown or other
  misc_feature (474)..(474): n is a, c, g, or t
  modified_base (479)..(480): a, c, t, g, unknown or other
  misc_feature (479)..(480): n is a, c, g, or t
  modified_base (482)..(485): a, c, t, g, unknown or other
  misc_feature (482)..(485): n is a, c, g, or t
  modified_base (490)..(490): a, c, t, g, unknown or other
  misc_feature (490)..(490): n is a, c, g, or t
  modified_base (493)..(493): a, c, t, g, unknown or other
  misc_feature (493)..(493): n is a, c, g, or t
  modified_base (497)..(499): a, c, t, g, unknown or other
  misc_feature (497)..(499): n is a, c, g, or t
  modified_base (501)..(502): a, c, t, g, unknown or other
  misc_feature (501)..(502): n is a, c, g, or t
  modified_base (504)..(511): a, c, t, g, unknown or other
  misc_feature (504)..(511): n is a, c, g, or t
  modified_base (513)..(513): a, c, t, g, unknown or other
  misc_feature (513)..(513): n is a, c, g, or t
tcagacagtatatacacgaccggtgctcgatttagtagtgtagatttggggtttgggggctggttcctgggaaggtcgttggtaccagagggtcaccatcttcctgcactgggagcagatccaacatcgggacagattctgatgttccgactggtaccaacaccgtttccagggaacagccccctaaaatcctcatctttggtaacaactatcggccctcgagggggtccctgaccggattctctggctccaaggtctggcacctcagccctcctggccatccactgggctccagctgaagntgaggtgtattattacgtcgccagtcctatgacaggcagcctcgagtggttgggtgttcggcggaggaccaaggctgaccgtctgggtcagccaaggctcgcccccgtggtccactctcgttccccaccctcctatatactacttgctagacgcgggtntggcaaggccganatagnntnnnngatgntanctgnnngnngnnnnnnnngn

SEQ ID NO: 80150 - DNA, 335 bp, Homo sapiens
  misc_feature: GYAE6OF01EOJWJ.44.25.C03.1.454.CMB.1.raw
  modified_base (181)..(181): a, c, t, g, unknown or other
  misc_feature (181)..(181): n is a, c, g, or t
  modified_base (294)..(294): a, c, t, g, unknown or other
  misc_feature (294)..(294): n is a, c, g, or t
  modified_base (304)..(304): a, c, t, g, unknown or other
  misc_feature (304)..(304): n is a, c, g, or t
  modified_base (310)..(310): a, c, t, g, unknown or other
  misc_feature (310)..(310): n is a, c, g, or t
  modified_base (312)..(335): a, c, t, g, unknown or other
  misc_feature (312)..(335): n is a, c, g, or t
tcagacagtatatacacgaccggtgctcgattttagtagtgtagatttgggtttgggggggtgtggtggtctccactcccgccttgacggggctgctatctgcctccctggccatcactgggctccaggctcgaagactgagggtcattattactgccagtcctatggacaggccagcctnagtggttgggtgttcggcggacgggacccaagctgaccgtccgtcgggtcagcccaaggcctgccccctggtcactctgttcccacctcctactatatactgtctgagcgggntggcaaggcncatagncnnnnnnnnnnnnnnnnnnnnnnnn

SEQ ID NO: 80151 - DNA, 243 bp, Homo sapiens
  misc_feature: GYAE6OF01BGOL3.44.25.C03.1.454.CMB.1.raw
  modified_base (239)..(243): a, c, t, g, unknown or other
  misc_feature (239)..(243): n is a, c, g, or t
tcagacagtatatacacgaccggtgctcgatttagtagtgtagatttgggtttgggtgcccaagctgctggagggcacggtcaccacggtcaccgtctcctcagcttccaccaagggcccatcggtcttccccctggcaccctcctccaagagcacctctgggggcacagcggccctgggctgcctggtcaaggactacttcctatatactgtctgagcgggctggcaaggcgcatagnnnnn

SEQ ID NO: 80152 - DNA, 457 bp, Homo sapiens
  misc_feature: GYAE6OF01BGE7K.44.25.C03.1.454.CMB.1.raw
  modified_base (452)..(457): a, c, t, g, unknown or other
  misc_feature (452)..(457): n is a, c, g, or t
tcagacagtatatacacgaccggtgctcgatttagtagtgtagatttgggtttgggggctgttcctggaaggtgttggtaccagagggtcaccatctcctgcactgggagcagatccaacatcgggacagattctgatgtccactggtaccaacaccttccaggaacagcccccaaactcctcatctttggtaacaactatcggccctcaggggtccctgaccgattctctggctccaagtctggcacctcagcctccctggccatcactgggctccaggctgaagatgagggtgattattactgccagtcctatgacagcagcctcagtggttgggtgttcggcggaggaccaagctgaccgtcctgggtcagcccaaggctgccccctcggtcactcctgttccccaccctcctctatatactgtctgagcgggctggcaggcgcatagnnnnnn

SEQ ID NO: 80153 - DNA, 222 bp, Homo sapiens; identical to SEQ ID NO: 80138
  misc_feature: GYAE6OF01C1JWR.44.25.C03.1.454.CMB.1.raw
  modified_base (219)..(222): a, c, t, g, unknown or other
  misc_feature (219)..(222): n is a, c, g, or t

SEQ ID NO: 80154 - DNA, 469 bp, Homo sapiens
  misc_feature: GYAE6OF01B8JHL.44.25.C03.1.454.CMB.1.raw
  modified_base (455)..(456): a, c, t, g, unknown or other
  misc_feature (455)..(456): n is a, c, g, or t
  modified_base (458)..(469): a, c, t, g, unknown or other
  misc_feature (458)..(469): n is a, c, g, or t
tcagacagtatatacacgaccggtgctcgatttagtagtgtagatttgggtttgggggctgttcctggaaggtgttggtaccagagggtcaccatctcctgcactgggagcagatccaacatcgggacagattctgatgtccactggtaccaacaccttccaggaacagcccccaaactcctcatctttggtaacaactatcggccctcaggggtccctgaccgattctctggctccaagtctggcacctcagcctccctggccatcactgggctccaggctgaagatgaggtgattattactgccagtcctatgacagcagcctcagtggttgggtgttcggcggaggaccaagctgaccgtctggtcagcccaaggcctgccccctggtccactctcgttccccgccccttctctatatactgtcctgacgcgggctggcaaggcacagtagnngnnnnnnnnnnnn

SEQ ID NO: 80155 - DNA, 242 bp, Homo sapiens
  misc_feature: GYAE6OF01B64EB.44.25.C03.1.454.CMB.1.raw
  modified_base (237)..(242): a, c, t, g, unknown or other
  misc_feature (237)..(242): n is a, c, g, or t
tcagacagtatatacacgaccggtgctcgatttagtagtgtagatttgggtttgggtgcccaagctgctggagggcacggtcaccacggtcaccgtctcctcagcttccaccaagggccatcggtcttcccctggcgccctgctccaggagcacctctgggggcacagcggccctgggctgcctggtcaaggactacttcctatatactgtctgagcgggctggcaaggcgcatagnnnnnn

SEQ ID NO: 80156 - DNA, 243 bp, Homo sapiens; identical to SEQ ID NO: 79924
  misc_feature: GYAE6OF01EMOHT.44.25.C03.1.454.CMB.1.raw
  modified_base (238)..(243): a, c, t, g, unknown or other
  misc_feature (238)..(243): n is a, c, g, or t

SEQ ID NO: 80157 - DNA, 242 bp, Homo sapiens; identical to SEQ ID NO: 80017
  misc_feature: GYAE6OF01ETIAJ.44.25.C03.1.454.CMB.1.raw
  modified_base (239)..(242): a, c, t, g, unknown or other
  misc_feature (239)..(242): n is a, c, g, or t

SEQ ID NO: 80158 - DNA, 242 bp, Homo sapiens
  misc_feature: GYAE6OF01BHN0O.44.25.C03.1.454.CMB.1.raw
  modified_base (237)..(242): a, c, t, g, unknown or other
  misc_feature (237)..(242): n is a, c, g, or t
tcagacagtatatacacgaccggtgctcgatttagtagtgtagatttgggtttgggtgcccaagctgctggagggcacggtcaccacggtcaccgtctcctcagcttccaccaagggcccatcggtcttcccctggcgccctgctccaggagcacctctggggcacagcggccctgggctgcctggtcaaggactacttccacgtctactgctgagcgggctggcaaggcgcatagnnnnnn

SEQ ID NO: 80159 - DNA, 264 bp, Homo sapiens
  misc_feature: GYAE6OF01BAX3L.44.25.C03.1.454.CMB.1.raw
  modified_base (239)..(264): a, c, t, g, unknown or other
  misc_feature (239)..(264): n is a, c, g, or t
tcagacagtatatacacgaccggtgctcgatttagtagtgtagatttgggtttggggtgcccaagctgctggagggcacggtcaccacggtcaccgtctcctcagcttccacaagggcccatcggtcttccccctggcgccctgctccaggagcacctctgggggcacagcggccctgggctgcctggtcaaggactacttcctatatactgtctgagcgggctggcaaggcgcatagnnnnnnnnnnnnnnnnnnnnnnnnnn

SEQ ID NO: 80160 - DNA, 301 bp, Homo sapiens
  misc_feature: GYAE6OF01A1V6P.44.25.C03.1.454.CMB.1.raw
  modified_base (296)..(301): a, c, t, g, unknown or other
  misc_feature (296)..(301): n is a, c, g, or t
tcagacagtatatacacgaccggtgctcgatttagtagtgtagatttgggtttgggggtgtggtggtctccactcccgccttgacggggctgctatctgcctccctggccatcactgggctccaggctgaagatgagggtgattattactgccagtcctatgacagcagcctcagtggttgggtgttcggcggagggaccaagctgaccgtcctgggtcagcccaaggctgccccctggtcactctgttcccacctcctctatatactgtctgagcgggctggcaaggcgcatagnnnnnn

SEQ ID NO: 80161 - DNA, 245 bp, Homo sapiens
  misc_feature: GYAE6OF01DBC3R.44.25.C03.1.454.CMB.1.raw
  modified_base (239)..(245): a, c, t, g, unknown or other
  misc_feature (239)..(245): n is a, c, g, or t
tcagacagtatatacacgaccggtgctcgatttagtagtgtagatttgggtttgggtgcccaagctgctggagggcacggtcaccacggtcaccgtctcctcagcttccaccaagggcccatcggtcttccccctggcgccctgctccaggagcacctctgggggcacagcggccctgggctgcctggtcaaggactacttccacgtctactgctgagcgggctggcaaggcgcatagnnnnnnn

SEQ ID NO: 80162 - DNA, 240 bp, Homo sapiens
  misc_feature: GYAE6OF01DAPOR.44.25.C03.1.454.CMB.1.raw
  modified_base (236)..(240): a, c, t, g, unknown or other
  misc_feature (236)..(240): n is a, c, g, or t
tcagacagtatatacacgaccggtgctcgatttagtagtgtagatttgggtttgggtgcccaagctgctggagggcacggtcaccacggtcaccgtctcctcagcttccaccaagggccatcggtcttcccctggcgccctgctccaggagcacctctggggcacagcggccctgggctgcctggtcaaggactacttcctatatactgtctgagcgggctggcaaggcgcatagnnnnn

SEQ ID NO: 80163 - DNA, 239 bp, Homo sapiens
  misc_feature: GYAE6OF01E238N.44.25.C03.1.454.CMB.1.raw
  modified_base (239)..(239): a, c, t, g, unknown or other
  misc_feature (239)..(239): n is a, c, g, or t
tcagacagtatatacacgaccggtgctcgatttagtagtgtagatttgggtttgggtgcccaagctgctggagggcacggtcaccacggtcacccgtctcctcagcttccaccaagggcccatcggtcttccccctggcgccctgctccaggagcacctctggggcacagcggccctgggctgcctggtcaaggactacttcctatatactgtctgagcgggctggcaaggcgcatagn

SEQ ID NO: 80164 - DNA, 300 bp, Homo sapiens
  misc_feature: GYAE6OF01BYGTL.44.25.C03.1.454.CMB.1.raw
  modified_base (296)..(300): a, c, t, g, unknown or other
  misc_feature (296)..(300): n is a, c, g, or t
tcagacagtatatacacgaccggtgctcgatttagtagtgtagatttgggtttgggggtgtggtggtctccactcccgccttgacggggctgctatctgcctccctggccatcactgggctccaggctgaagatgagggtgattattactgccagtcctatgacagcagcctcagtggttgggtgttcggcggagggaccaagctgaccgtcctgggtcagcccaaggctgccccctggtcactctgttcccgcctcctctatatactgtctgagcgggctggcaaggcgcatagnnnnn

SEQ ID NO: 80165 - DNA, 190 bp, Homo sapiens
  misc_feature: GYAE6OF01CKFUO.44.25.C03.1.454.CMB.1.raw
  modified_base (162)..(190): a, c, t, g, unknown or other
  misc_feature (162)..(190): n is a, c, g, or t
tcagacagtatatacacgaccggtgctcgatttagtagtgtagatttgggtttgggggtagggtgtgtcacaagatttgggctctgggcacagcggccctgggctcgcctggtcaaggactacttccacgtctactgctgagcgggctggcaggcgcatagnnnnnnnnnnnnnnnnnnnnnnnnnnnnn

SEQ ID NO: 80166 - DNA, 551 bp, Homo sapiens
  misc_feature: GYAE6OF01C2Q20.44.25.C03.1.454.CMB.1.raw
  modified_base (274)..(274): a, c, t, g, unknown or other
  misc_feature (274)..(274): n is a, c, g, or t
  modified_base (452)..(452): a, c, t, g, unknown or other
  misc_feature (452)..(452): n is a, c, g, or t
tcagacagtatatacacgaccggtgctcgatttagtagtgtagatttgggtttgggggggaagaggaagactgacggtcctcccaggagttcaggtgctgggcaccttgggcacggggggaggtgtgtcacaagatttgggctctgggcaccgtgggcagtgggggagtgtgtcacaagatttggactcctgtgccccacatggacactcttgctacacactcctgctgctgaccctaccccttctgggtcttgtcccaggtcaccttgaaggngtctggtcctgtgctggtgaaaccacagagacctcacgctgacctgcaccatctctgggttctctctcaacgatattagaatgggtgtgagctggactccgtcacgtcccccgaaggggaacggcccgtgggagtggcttcggcacacatcttctcgaatagaacgaaaactcctaanacgtacatctctagaagagtctaagttaaccatctaccaagacaccacgaaagcagggtgttacttagtactgactaacagtacggacctggcgaaccg

SEQ ID NO: 80167 - DNA, 242 bp, Homo sapiens
  misc_feature: GYAE6OF01ESM69.44.25.C03.1.454.CMB.1.raw
  modified_base (238)..(242): a, c, t, g, unknown or other
  misc_feature (238)..(242): n is a, c, g, or t
tcagacagtatatacacgaccggtgctcgatttagtagtgtagatttgggtttgggtgcccaagctgctggagggcacggtcaccacggtcaccgtctcctcagcttccaccaagggcccatcggtcttccccctggcgccctgctccaggagcacctctgggggcacagcggccctgggctgcctggtcaaggactactcctcgatcgcgtctgagcgggctggcaaggcgcatagnnnnn

SEQ ID NO: 80168 - DNA, 505 bp, Homo sapiens
  misc_feature: GYAE6OF01EALT8.44.25.C03.1.454.CMB.1.raw
  modified_base (197)..(197): a, c, t, g, unknown or other
  misc_feature (197)..(197): n is a, c, g, or t
  modified_base (231)..(231): a, c, t, g, unknown or other
  misc_feature (231)..(231): n is a, c, g, or t
  modified_base (242)..(242): a, c, t, g, unknown or other
  misc_feature (242)..(242): n is a, c, g, or t
  modified_base (326)..(326): a, c, t, g, unknown or other
  misc_feature (326)..(326): n is a, c, g, or t
  modified_base (361)..(361): a, c, t, g, unknown or other
  misc_feature (361)..(361): n is a, c, g, or t
  modified_base (429)..(429): a, c, t, g, unknown or other
  misc_feature (429)..(429): n is a, c, g, or t
  modified_base (488)..(488): a, c, t, g, unknown or other
  misc_feature (488)..(488): n is a, c, g, or t
tcagacagtatatacacgaccggtgctcgatttagtagtgtagatttgggtttggggcttcagctgtggcacaagacggcagcactcaggacaatctccagcatggcctggtctcctctcctcctcactctcctcacccaggacacagggtcctggcccagtctgccctgactcagcctgcctccgtgtctgggtcncctggacagtcggtcaccatctcctgcactgganccagcgtaatnttcttagtcttaactttgtctcctgtatcaacatcatccagtaaacgcccccaaaatcatcatctatgagcctatagagccctnagggtttcaatcgcttcactgcctcaaagtccggnaacacggcctcctgacaatctctgggctccaggctgaggacgaggctgatttattatgttgctcagtntgttctcgcatcagttactgtcttcggaattgggaaccaggtcaacgttccaggtcaancccaaagccctaaaccc

SEQ ID NO: 80169 - DNA, 221 bp, Homo sapiens
  misc_feature: GYAE6OF01CRGGO.44.25.C03.1.454.CMB.1.raw
  modified_base (220)..(221): a, c, t, g, unknown or other
  misc_feature (220)..(221): n is a, c, g, or t
tcagacagtatatacacgaccggtgctcgatttagtagtgtagatttgggtttgggggaagaggaagactgacggtcctcccaggagttcaggtgctgggcaccttgggcacgggggaggtgtgtcacaaagatttgggctctgggcacagcggccctgggctgcctggtcaaggactacttcctcgatcgcgtctgagcgggctggcaaggcgcatagnn

SEQ ID NO: 80170 - DNA, 297 bp, Homo sapiens
  misc_feature: GYAE6OF01B3IKZ.44.25.C03.1.454.CMB.1.raw
  modified_base (295)..(297): a, c, t, g, unknown or other
  misc_feature (295)..(297): n is a, c, g, or t
tcagacagtatatacacgaccggtgctcgatttagtagtgtagatttgggtttgggggtgtggtggtctccactcccgccttgacggggctgctatctgcctccctggccatcactgggctccaggctgaagatgagggtgattattactgccagtcctatgacagcagcctcagtggttgggtgttcggcggagggaccaagctgaccgtcctgggtcagcccaaggctgcccctggtcactctgttcccaccctctctatatactgtctgagcgggctggcaaggcgcatagnnn

SEQ ID NO: 80171 - DNA, 236 bp, Homo sapiens
  misc_feature: GYAE6OF01DCFMY.44.25.C03.1.454.CMB.1.raw
  modified_base (230)..(236): a, c, t, g, unknown or other
  misc_feature (230)..(236): n is a, c, g, or t
tcagacagtatatacacgaccggtgctcgatttagtagtgtagatttgggtttgggtgcccaagctgctggagggcacggtcaccgtctcctcagcttccaccaagggcccatcggtcttccccctggcgccctgctccaggagcacctctgggggcacagcggccctgggctgcctggtcaaggactacttccacgtctactgctgagcgggctggcaaggcgcatagnnnnnnn

SEQ ID NO: 80172 - DNA, 240 bp, Homo sapiens; identical to SEQ ID NO: 80130
  misc_feature: GYAE6OF01B3OIP.44.25.C03.1.454.CMB.1.raw
  modified_base (238)..(240): a, c, t, g, unknown or other
  misc_feature (238)..(240): n is a, c, g, or t

SEQ ID NO: 80173 - DNA, 816 bp, Homo sapiens
  misc_feature: GYAE6OF01EVI0P.44.25.C03.1.454.CMB.1.raw
  modified_base (205)..(205): a, c, t, g, unknown or other
  misc_feature (205)..(205): n is a, c, g, or t
  modified_base (239)..(239): a, c, t, g, unknown or other
  misc_feature (239)..(239): n is a, c, g, or t
  modified_base (251)..(251): a, c, t, g, unknown or other
  misc_feature (251)..(251): n is a, c, g, or t
  modified_base (268)..(268): a, c, t, g, unknown or other
  misc_feature (268)..(268): n is a, c, g, or t
tcagacagtatatacacgaccggtgctcgatttagtagtgtagatttgggtttgggggggctacgaagaggcagcactcaggacaatctccagcatggcctggtactcctctcctcctcactctcctcgctcactgcacacgggtcctgggcccactctgtgctgacgcagccgccctcgaggtcgtccgtcgggggccccgggnaggacgggtcaccgatcctctcgcacgtgggacncagactccaacngtcggaacagtacttcngatcgtaccactcggtaaccaactacccttaccgaacggaaccaccggaccccccaaaacgtccgtactacgttcgtttacggtaaaccaacgttagtcccggtacccctacgacggggttccctaggacccgtatttccgtacgtcggacctaccgtaaacgtcgtcggaccctaacctcgaccgtccccttacccgtacggaccctaacgttaccgaaccgttccgggtacccttaccggaacgggtccttaagggtaaacgtacggtacggggtaacgggttacttaaacgttttacgttaccgtaccggtacctaacggttaccccgttaagtaccggtaacgtaacggtaccgtaacgttcccgttacggttacggggttaccggggtttcggggtacgggtttaccggggaaccggggttacggggaacccttaaacggggtccgttaccgggtaccccggttcgggttacgggtaccgtaaccgggtaccccgggtaaacggccccggttaccccgggtcccccggttcgggttaaccccg

SEQ ID NO: 80174 - DNA, 244 bp, Homo sapiens; identical to SEQ ID NO: 79949
  misc_feature: GYAE6OF01DHSXP.44.25.C03.1.454.CMB.1.raw
  modified_base (238)..(244): a, c, t, g, unknown or other
  misc_feature (238)..(244): n is a, c, g, or t

SEQ ID NO: 80175 - DNA, 457 bp, Homo sapiens
  misc_feature: GYAE6OF01CGDPV.44.25.C03.1.454.CMB.1.raw
  modified_base (444)..(444): a, c, t, g, unknown or other
  misc_feature (444)..(444): n is a, c, g, or t
  modified_base (449)..(457): a, c, t, g, unknown or other
  misc_feature (449)..(457): n is a, c, g, or t
tcagacagtatatacacgaccggtgctcgatttagtagtgtagatttgggtttgggggctgttcctggaaggtgttggtaccagagggtcaccatctcctgcactgggagcagatccaacatcgggacagattctgatgtccactggtaccaacaccttccaggaacagcccccaaactcctcatctttggtaacaactatcggccctcaggggtccctgaccgattctctggctccaagtctggcacctcagcctcctggccatcactgggctccaggctgaagatgagggtgattatactgccagtcctatgacagcagcctcaggtggttgggtgtcggcggaggaccaagctaaccgtctgggtcagcccaaggctcgccccctggtcactctcgtcccgccctcctctatactactgtctgagcgggctggcaaggcgnatagnnnnnnnnn

SEQ ID NO: 80176 - DNA, 297 bp, Homo sapiens
  misc_feature: GYAE6OF01EPCOP.44.25.C03.1.454.CMB.1.raw
  modified_base (296)..(297): a, c, t, g, unknown or other
  misc_feature (296)..(297): n is a, c, g, or t
tcagacagtatatacacgaccggtgctcgatttagtagtgtagatttgggtttgggggtgtggtggtctccactcccgccttgacggggctgctatctgcctccctggccatcactgggctccaggctgaagatgagggtgattattactgccagtcctatgacagcagcctcagtggttgggtgttcggcggagggaccaagctgaccgtcctgggtcagcccaaggctgccccctcggtcactctgtcccgcctcctctatatactgtctgagcgggctggcaaggcgcatagnn

SEQ ID NO: 80177 - DNA, 547 bp, Homo sapiens
  misc_feature: GYAE6OF01EM8TG.44.25.C03.1.454.CMB.1.raw
  modified_base (396)..(396): a, c, t, g, unknown or other
  misc_feature (396)..(396): n is a, c, g, or t
  modified_base (534)..(534): a, c, t, g, unknown or other
  misc_feature (534)..(534): n is a, c, g, or t
tcagacagtatatacacgaccggtgctcgatttagtagtgtagatttgggtttgggggactcctgtcgccccaccatggacactctttgctacacgactcctgctgctgaccaccccttcctgggtcttgtcccaggtcaccttgaaggagtctggtcctgtgctggtgaaacccacagagaccctcacgctgacctgcaccatctctgggttctctctcaacgatattagaatgggtgtgagctggatccgtcagcccccagggaaggccctggagtggcttgcacacatcttctcgaatgacgaaaaatcctacagtacatctctgaagagcagtttaaccatctccaagacacctacaaaagcaggtgtcttagtatgacaacatggaccctncgggggacacaggcacatattactgtgacgacggtaagtagacgggaaagaaacgagacgtggttactagttattaataagtacttaccatctggtacgtcgtgggacgaacgggacacggtcaccgtctacctcacncgtccgtaacccg

SEQ ID NO: 80178 - DNA, 160 bp, Homo sapiens
  misc_feature: GYAE6OF01EYD2O.44.25.C03.1.454.CMB.1.raw
  modified_base (131)..(160): a, c, t, g, unknown or other
  misc_feature (131)..(160): n is a, c, g, or t
tcagacagtatatacacgaccggtgctcgatttagtagtgtagatttgggtttgggcgacagcggccctgggctgcctggtcaaggactacttccacgtctactgctgagcgggctggcaaggcgcatagnnnnnnnnnnnnnnnnnnnnnnnnnnnnnn

SEQ ID NO: 80179 - DNA, 244 bp, Homo sapiens
  misc_feature: GYAE6OF01CDMWK.44.25.C03.1.454.CMB.1.raw
  modified_base (238)..(244): a, c, t, g, unknown or other
  misc_feature (238)..(244): n is a, c, g, or t
tcagacagtatatacacgaccggtgctcgatttagtagtgtagatttgggtttgggtgcccaagctgctggagggcacggtcaccacggtcaccgtctcctcagcttccaccaagggcccatcggtcttcccctggcgccctgctccaggagcacctctgggggaacagcggccctgggctgcctggtcaaggactacttcctatatactgtctgagcgggctggcaaggcgcatagnnnnnnn

SEQ ID NO: 80180 - DNA, 241 bp, Homo sapiens
  misc_feature: GYAE6OF01CPRV5.44.25.C03.1.454.CMB.1.raw
  modified_base (236)..(241): a, c, t, g, unknown or other
  misc_feature (236)..(241): n is a, c, g, or t
tcagacagtatatacacgaccggtgctcgatttagtagtgtagatttgggtttgggtgcccaagctgctggagggcacggtcaccacggtcaccgtctcctcagcttccaccaaggcccatcggtcttcccctggcgccctgctccaggagcacctctggggcacagcggccctgggctgcctggtcaaggactacttccacgtctactgctgagcgggctggcaaggcgcatagnnnnnn

SEQ ID NO: 80181 - DNA, 243 bp, Homo sapiens
  misc_feature: GYAE6OF01DTILZ.44.25.C03.1.454.CMB.1.raw
  modified_base (239)..(243): a, c, t, g, unknown or other
  misc_feature (239)..(243): n is a, c, g, or t
tcagacagtatatacacgaccggtgctcgatttagtagtgtagatttgggtttgggtgcccaagctgctggagggcacggtcaccacggtcaccgtctcctcagcttccaccaagggcccatcggtcttccccctggcaccctcctccaagagcacctctgggggcacagcggccctgggctgcctggtcaaggactacttccacgtctactgctgagcgggctggcaaggcgcatagnnnnn

SEQ ID NO: 80182 - DNA, 277 bp, Homo sapiens
  misc_feature: GYAE6OF01ENH7L.44.25.C03.1.454.CMB.1.raw
  modified_base (243)..(244): a, c, t, g, unknown or other
  misc_feature (243)..(244): n is a, c, g, or t
  modified_base (246)..(277): a, c, t, g, unknown or other
  misc_feature (246)..(277): n is a, c, g, or t
tcagacagtatatacacgaccggtgctcgatttagtagtgtagatttgggtttgggtgcccaaaggctgctggagggcacggtcaccacggtcaccgtctcctcagcttccaccaagggcccatcggtcttcccctggcgccctgctccaggacgcacctctgggggcacagcggccctgggctgcctggttcaaggactacttcctatatactgtctgagcgggctggcaagggcgcatagnngnnnnnnnnnnnnnnnnnnnnnnnnnnnnnnnn

SEQ ID NO: 80183 - DNA, 277 bp, Homo sapiens
  misc_feature: GYAE6OF01BL02X.44.25.C03.1.454.CMB.1.raw
  modified_base (246)..(277): a, c, t, g, unknown or other
  misc_feature (246)..(277): n is a, c, g, or t
tcagacagtatatacacgaccggtgctcgatttagtagtgtagatttgggtttggggtgcccaagctgctggagggcacggtcacctacggtcaccgtctcctcagcttccaccaagggcccatcggtcttccccctggcgccctgtctccaggagcacctcttgggggcacagcggtaccctgggctgcctggtcaaggactacttcctatatactgtctgagcgggctggcaagggcgcatagnnnnnnnnnnnnnnnnnnnnnnnnnnnnnnnn

SEQ ID NO: 80184 - DNA, 301 bp, Homo sapiens
  misc_feature: GYAE6OF01BS111.44.25.C03.1.454.CMB.1.raw
  modified_base (297)..(301): a, c, t, g, unknown or other
  misc_feature (297)..(301): n is a, c, g, or t
tcagacagtatatacacgaccggtgctcgatttagtagtgtagatttgggtttgggggtgtggtggtctccactcccgccttgacggggctgctatctgcctccctggccatcactgggctccaggctgaagatgagggtgattattactgccagtcctatgacagcagcctcagtggttgggtgttcggcggagggaccaagctgaccgtcctgggtcagcccaaggctgccccctggtcactctgttcccgccctcctctatatactgtctgagcgggctggcaaggcgcatagnnnnn

SEQ ID NO: 80185 - DNA, 302 bp, Homo sapiens
  misc_feature: GYAE6OF01AZGVW.44.25.C03.1.454.CMB.1.raw
  modified_base (298)..(302): a, c, t, g, unknown or other
  misc_feature (298)..(302): n is a, c, g, or t
tcagacagtatatacacgaccggtgctcgatttagtagtgtagatttgggtttgggggtgtggtggtctccactcccgccttgacggggctgctatctgcctccctggccatcactgggctccaggctgaagatgagggtgattattactgccagtcctatgacagcagcctcagtggttgggtgttcggcggagggaccaagctgaccgtcctgggtcagcccaaggctgccccctcggtcactctgttcccaccctcctctatatactgtctgagcgggctggcaaggcgcatagnnnnn

SEQ ID NO: 80186 - DNA, 784 bp, Homo sapiens
  misc_feature: GYAE6OF01CQT4D.44.25.C03.1.454.CMB.1.raw
tcagacagtatatacacgaccggtgctcgatttagtagtgtagatttgggtttgggggggcacaagaggcagcactcaggacaatctccagcatggcctggtctcctctcctcctcactctcctcgctcactgcacagggtcctgggcccactctgtgctgacgcagccgccctcagtgtcgtcgggggccccgggcaggagggtcaccatctcctgcacgtgggagcagatccaacagtcgggacagattctgatcgtccactcggtaaccaacaccttccgaaggaaccacgacccccaaactcctactactctttacggtaacaacctactaccggcccctcgaacggggtcccctacggaccgtattcctctcggcctccgaagtccgtggcctaccctccacgtccccttcccgtcggcccacgttcctaccgtcgggtacccttacccgacgggtcgtacggaaaggtacgttaggggtaacggggttagttaacgttttaacgtttaccgtcggtacccttaacggttccccttaagttcggaaccgtaacggtacccgtaaccgggttcccttacgtaacggggttttcgggggtttcgggggttacgggtttaccgggggtaccggggtaaacgggggtaccccgtaaacgggtcccggttaaccgggttacccccgggttcccggttaccgggggttacccaaccggggtaacccccgtaaacgggggttccccgttaccccggggtccccccccggttcgggtttaacccccg

SEQ ID NO: 80187 - DNA, 646 bp, Homo sapiens
  misc_feature: GYAE6OF01BT0WU.44.25.C03.1.454.CMB.1.raw
  modified_base (578)..(578): a, c, t, g, unknown or other
  misc_feature (578)..(578): n is a, c, g, or t
  modified_base (580)..(581): a, c, t, g, unknown or other
  misc_feature (580)..(581): n is a, c, g, or t
  modified_base (583)..(583): a, c, t, g, unknown or other
  misc_feature (583)..(583): n is a, c, g, or t
  modified_base (588)..(588): a, c, t, g, unknown or other
  misc_feature (588)..(588): n is a, c, g, or t
  modified_base (590)..(590): a, c, t, g, unknown or other
  misc_feature (590)..(590): n is a, c, g, or t
  modified_base (604)..(604): a, c, t, g, unknown or other
  misc_feature (604)..(604): n is a, c, g, or t
  modified_base (613)..(613): a, c, t, g, unknown or other
  misc_feature (613)..(613): n is a, c, g, or t
  modified_base (618)..(618): a, c, t, g, unknown or other
  misc_feature (618)..(618): n is a, c, g, or t
  modified_base (621)..(621): a, c, t, g, unknown or other
  misc_feature (621)..(621): n is a, c, g, or t
  modified_base (625)..(625): a, c, t, g, unknown or other
  misc_feature (625)..(625): n is a, c, g, or t
  modified_base (635)..(635): a, c, t, g, unknown or other
  misc_feature (635)..(635): n is a, c, g, or t
  modified_base (637)..(637): a, c, t, g, unknown or other
  misc_feature (637)..(637): n is a, c, g, or t
  modified_base (645)..(645): a, c, t, g, unknown or other
  misc_feature (645)..(645): n is a, c, g, or t
tcagacagtatatacacgaccggtgctcgatttagtagtgtagatttgggtttgggggggtcgggagagggtcgaccgatctcctgcacgtgggagccacgatccgaacagtcgggacaggattctcgatcgtccactggtaccaacgaccttccagggaaccaggcccccaaaactcctcactctttggtaacaactatcggccctcgaggggtccctggaccgacttcgtctggctccaagtcctggcctacctcgacgccctcccgtacggcccaattccgaacgttggggcctttaccgaagggtcctaggaacgtacgttgggaacggggttagaatttaaccgttaacctacggccccaaagttccctaattggaactaggtcgaaggtccctacgtaggttgggtttcggggtcggttccgggacgggttacgggaccaagtcgtacgtacccgtccgtcggtccaaggtcccagggctacgcccctcggtcctaccgtctcgttccccgcccttcctcgtactacgtacgtgtcgtggacgtcgggctggactaacggcgcgtacgtagntnntnactananactcgtgctggcgngtacagtcncgcgngcncgcncgcgcgctcncntctctccnc

SEQ ID NO: 80188 - DNA, 226 bp, Homo sapiens
  misc_feature: GYAE6OF01A10RK.44.25.C03.1.454.CMB.1.raw
  modified_base (219)..(226): a, c, t, g, unknown or other
  misc_feature (219)..(226): n is a, c, g, or t
tcagacagtatatacacgaccggtgctcgatttagtagtgtagatttgggtttgggggaagaggaagactgacggtcctcccaggagttcaggtgctgggcaccttgggcacgggggaggtgtgtcacaagatttgggctctgggcacatcggccctgggctgcctggtcaaggactacttcctatatactgtctgagcgggctggcaaggcgcatagnnnnnnnn

SEQ ID NO: 80189 - DNA, 246 bp, Homo sapiens
  misc_feature: GYAE6OF01CMT92.44.25.C03.1.454.CMB.1.raw
  modified_base (238)..(246): a, c, t, g, unknown or other
  misc_feature (238)..(246): n is a, c, g, or t
tcagacagtatatacacgaccggtgctcgatttagtagtgtagatttgggtttgggtgcccaagctgctggagggcacggtcaccacggtcaccgtctcctcagcttccaccaagggccatcggtcttcccctggcgccctgctccaggagcacctcgtgggggcacagcggccctgggctgcctggtcaaggactacttccacgtctactgctgagcgggctggcaaggcgcatagnnnnnnnnn

SEQ ID NO: 80190 - DNA, 241 bp, Homo sapiens; identical to SEQ ID NO: 79989
  misc_feature: GYAE6OF01DTGSO.44.25.C03.1.454.CMB.1.raw
  modified_base (238)..(241): a, c, t, g, unknown or other
  misc_feature (238)..(241): n is a, c, g, or t

SEQ ID NO: 80191 - DNA, 244 bp, Homo sapiens
  misc_feature: GYAE6OF01EF9F0.44.25.C03.1.454.CMB.1.raw
  modified_base (222)..(244): a, c, t, g, unknown or other
  misc_feature (222)..(244): n is a, c, g, or t
tcagacagtatatacacgaccggtgctcgatttagtagtgtagatttgggtttggggggaaggaggaagactgacggtcctcccaggagttcaggtgctgggccaccttgggcacgggggagtgtgtcacaagatttgggctctgggcacagcggccctgggctgcctggtcaaggactacttcctatatactgtctgagcgggctggcaaggccgcatagnnnnnnnnnnnnnnnnnnnnnnn

SEQ ID NO: 80192 - DNA, 251 bp, Homo sapiens
  misc_feature: GYAE6OF01A63NA.44.25.C03.1.454.CMB.1.raw
  modified_base (239)..(251): a, c, t, g, unknown or other
  misc_feature (239)..(251): n is a, c, g, or t
tcagacagtatatacacgaccggtgctcgatttagtagtgtagatttgggtttgggtgcccaagctgctggagggcacggtcaccacggtcaccgtctcctcagcttccaccaagggcccatcggtcttccccctggcgccctgctccaggagcacctctgggggcacagcggccctgggctgcctggtcaaggactacttcctatatactgtctgagcgggctggcaaggcgcatagnnnnnnnnnnnnn

SEQ ID NO: 80193 - DNA, 552 bp, Homo sapiens
  misc_feature: GYAE6OF01BE0NZ.44.25.C03.1.454.CMB.1.raw
  modified_base (396)..(396): a, c, t, g, unknown or other
  misc_feature (396)..(396): n is a, c, g, or t
  modified_base (433)..(433): a, c, t, g, unknown or other
  misc_feature (433)..(433): n is a, c, g, or t
  modified_base (442)..(442): a, c, t, g, unknown or other
  misc_feature (442)..(442): n is a, c, g, or t
tcagacagtatatacacgaccggtgctcgatttagtagtgtagatttgggtttgggggcttcagctgtgggcacaagaggcagcactcaggacaatctccagcatggcctggtctcctctcctcctcactctcctcgctcactgcacagggtcctgggcccactctgtgctgacgcagccgccctcagtgtctggggccccggggcagagggtcaccatctcctgcactgggagcagatccaacatcgggacagattctgatgtccactggtaccaacacctttccaggaaccacgcccccaaactccctcattcctttaggtaacaactactccggcccctcgacggggtcccctggacccgattctcgtggctccaaagtcctggcacctcacnccctccctggcccatcactgggctccgaggctgaagntggagggtnattatactgccagtccctatcgacagcacgcctcgaggttgggttggggtgttccgggcggacggggtacccaaggtcgtacggaccggttcctgggtccacggccccgg

SEQ ID NO: 80194 - DNA, 192 bp, Homo sapiens; identical to SEQ ID NO: 80002
  misc_feature: GYAE6OF01A60TT.44.25.C03.1.454.CMB.1.raw
  modified_base (190)..(192): a, c, t, g, unknown or other
  misc_feature (190)..(192): n is a, c, g, or t

SEQ ID NO: 80195 - DNA, 555 bp, Homo sapiens
  misc_feature: GYAE6OF01CAX2Q.44.25.C03.1.454.CMB.1.raw
  modified_base (551)..(552): a, c, t, g, unknown or other
  misc_feature (551)..(552): n is a, c, g, or t
  modified_base (554)..(555): a, c, t, g, unknown or other
  misc_feature (554)..(555): n is a, c, g, or t
tcagacagtatatacacgaccggtgctcgatttagtagtgtagatttgggtttgggggacgcctagttcggccgggggggcccctaagactctcctgtctcgtctctgaacccacctttaggagctactggatgcactgggtccgccaagctccaggaaagggcctgatgtgggtatcacgtattaacaccgatgggactatcactggttactcagacgccgtgaagggccgattcatcatctccagagacaatgtcgaaaacacggtgtatttacaaatgaacagtctaagagtcgaggacacggctgtctactattgtgtgagaccttatgatttcacttgggggagttatcgtttgggcccacactgggccagggaaccttggtcgtcgtctcctcagcttccaccaagggcccatcggtccttcccccgtggccgccctgcctccaggacgcacctcgtgggggcacgacgcggccctgggctgcctggtcaaggactacttcctatactactgtctggacgcgggctcgggcaagggcgacatagnngnn

SEQ ID NO: 80196 - DNA, 488 bp, Homo sapiens
  misc_feature: GYAE6OF01C5S8Q.44.25.C03.1.454.CMB.1.raw
  modified_base (148)..(148): a, c, t, g, unknown or other
  misc_feature (148)..(148): n is a, c, g, or t
  modified_base (157)..(157): a, c, t, g, unknown or other
  misc_feature (157)..(157): n is a, c, g, or t
  modified_base (259)..(259): a, c, t, g, unknown or other
  misc_feature (259)..(259): n is a, c, g, or t
  modified_base (263)..(264): a, c, t, g, unknown or other
  misc_feature (263)..(264): n is a, c, g, or t
  modified_base (266)..(266): a, c, t, g, unknown or other
  misc_feature (266)..(266): n is a, c, g, or t
  modified_base (268)..(268): a, c, t, g, unknown or other
  misc_feature (268)..(268): n is a, c, g, or t
  modified_base (270)..(272): a, c, t, g, unknown or other
  misc_feature (270)..(272): n is a, c, g, or t
  modified_base (274)..(274): a, c, t, g, unknown or other
  misc_feature (274)..(274): n is a, c, g, or t
  modified_base (276)..(277): a, c, t, g, unknown or other
  misc_feature (276)..(277): n is a, c, g, or t
  modified_base (279)..(279): a, c, t, g, unknown or other
  misc_feature (279)..(279): n is a, c, g, or t
  modified_base (281)..(281): a, c, t, g, unknown or other
  misc_feature (281)..(281): n is a, c, g, or t
  modified_base (283)..(284): a, c, t, g, unknown or other
  misc_feature (283)..(284): n is a, c, g, or t
  modified_base (286)..(286): a, c, t, g, unknown or other
  misc_feature (286)..(286): n is a, c, g, or t
  modified_base (303)..(303): a, c, t, g, unknown or other
  misc_feature (303)..(303): n is a, c, g, or t
  modified_base (305)..(305): a, c, t, g, unknown or other
  misc_feature (305)..(305): n is a, c, g, or t
  modified_base (308)..(308): a, c, t, g, unknown or other
  misc_feature (308)..(308): n is a, c, g, or t
  modified_base (310)..(310): a, c, t, g, unknown or other
  misc_feature (310)..(310): n is a, c, g, or t
  modified_base (315)..(316): a, c, t, g, unknown or other
  misc_feature (315)..(316): n is a, c, g, or t
  modified_base (318)..(318): a, c, t, g, unknown or other
  misc_feature (318)..(318): n is a, c, g, or t
  modified_base (327)..(327): a, c, t, g, unknown or other
  misc_feature (327)..(327): n is a, c, g, or t
  modified_base (329)..(333): a, c, t, g, unknown or other
  misc_feature (329)..(333): n is a, c, g, or t
  modified_base (335)..(335): a, c, t, g, unknown or other
  misc_feature (335)..(335): n is a, c, g, or t
  modified_base (353)..(353): a, c, t, g, unknown or other
  misc_feature (353)..(353): n is a, c, g, or t
  modified_base (355)..(355): a, c, t, g, unknown or other
  misc_feature (355)..(355): n is a, c, g, or t
  modified_base (357)..(357): a, c, t, g, unknown or other
  misc_feature (357)..(357): n is a, c, g, or t
  modified_base (359)..(359): a, c, t, g, unknown or other
  misc_feature (359)..(359): n is a, c, g, or t
  modified_base (361)..(361): a, c, t, g, unknown or other
  misc_feature (361)..(361): n is a, c, g, or t
  modified_base (363)..(363): a, c, t, g, unknown or other
  misc_feature (363)..(363): n is a, c, g, or t
  modified_base (385)..(385): a, c, t, g, unknown or other
  misc_feature (385)..(385): n is a, c, g, or t
  modified_base (387)..(387): a, c, t, g, unknown or other
  misc_feature (387)..(387): n is a, c, g, or t
  modified_base (390)..(390): a, c, t, g, unknown or other
  misc_feature (390)..(390): n is a, c, g, or t
  modified_base (395)..(395): a, c, t, g, unknown or other
  misc_feature (395)..(395): n is a, c, g, or t
  modified_base (399)..(399): a, c, t, g, unknown or other
  misc_feature (399)..(399): n is a, c, g, or t
  modified_base (401)..(401): a, c, t, g, unknown or other
  misc_feature (401)..(401): n is a, c, g, or t
  modified_base (403)..(403): a, c, t, g, unknown or other
  misc_feature (403)..(403): n is a, c, g, or t
  modified_base (408)..(408): a, c, t, g, unknown or other
  misc_feature (408)..(408): n is a, c, g, or t
  modified_base (456)..(456): a, c, t, g, unknown or other
  misc_feature (456)..(456): n is a, c, g, or t
  modified_base (458)..(458): a, c, t, g, unknown or other
  misc_feature (458)..(458): n is a, c, g, or t
  modified_base (461)..(461): a, c, t, g, unknown or other
  misc_feature (461)..(461): n is a, c, g, or t
  modified_base (483)..(483): a, c, t, g, unknown or other
  misc_feature (483)..(483): n is a, c, g, or t
  modified_base (485)..(485): a, c, t, g, unknown or other
  misc_feature (485)..(485): n is a, c, g, or t
  modified_base (487)..(487): a, c, t, g, unknown or other
  misc_feature (487)..(487): n is a, c, g, or t
tcagacagtatatacacgaccggtgctcgatttagtagtgtagatttgggtttggggtgccctaagctgcctggggacggcacggtcaccgtctctcagcttccaccaagggtcccatcggttcttcccctaggcgccctgctcaggngcacctcgnggggcacgaggcggccgtgggcgtcgcctgggtactaaggactacttcacgtactactgcctggacgcgggctcggacgaacgggccgacaacgtcgcaganatannanangnnnanannanancnngngacgacgacacgctctntntgngngagannanagagagtangnnnnncngagcgcgcgacgctctcncncncncncncacgcgacgctctcgtcctccncnccncctcncacncncncgcgngcgcgcgcgcgcgtcgcgcgtcgtacgacgactactcctactacgtcncncgngcgacgacggcgacgacgacgngngng

SEQ ID NO: 80197 - DNA, 300 bp, Homo sapiens
  misc_feature: GYAE6OF01EOMIA.44.25.C03.1.454.CMB.1.raw
  modified_base (297)..(300): a, c, t, g, unknown or other
  misc_feature (297)..(300): n is a, c, g, or t
tcagacagtatatacacgaccggtgctcgatttagtagtgtagatttgggtttgggggtgtggtggtctccactcccgccttgacggggctgctatctgcctccctggccatcactgggctccaggctgaagatgagggtgattattactgccagtcctatgacagcagcctcagtggttgggtgttcggcggagggaccaagctgaccgtcctgggtcagcccaaggctgccccctggtcactctgttcccgccctcctctatatactgtctgagcgggctggcaaggcgcatagnnnn

SEQ ID NO: 80198 - DNA, 735 bp, Homo sapiens
  misc_feature: GYAE6OF01EJH5B.44.25.C03.1.454.CMB.1.raw
  modified_base (286)..(286): a, c, t, g, unknown or other
  misc_feature (286)..(286): n is a, c, g, or t
tcagacagtatatacacgaccggtgctcgatttagtagtgtagatttgggtttggggggggtcacaagaggcagcgctctcgggacgtctccaccatggcctgggctctgctgctcctcactctcctcactcaggacacagggtcctgggcccagtctgccctgactcagcctgcctccgtgtctgggtcgcctggacagtcggtcaccatcctcctgcactggagccagcgtaatattcttagtcttaacttgtctctggtatcaactatcatccaaggtaaacnccccaaatcatcatctatgacggcctaagtaacgacgccctacgtagggtttctggtcgtcttcgtcgtcggtccttaccgaagttccgtacggaccaaaccgtaccggccccttaccccgtagacccgtaacttcccgtacggtccgggtaccctaccgtacgggtccgttacgggaacgggtaaccggaacgggttccgttacgtaactttaacgttaccgtacggtacgtacggtacctacgtaaagttaaaacgtaaaaaggaacgtaaccctaaacttaccgtttaagtttaacggtacgttaccggggtaacggggaacgggtaacccgaaaggtacccgttaccggtaacccccgggttacggttaacgggtaccgaaccggtaacccccgtaagggtccccgttacccggtcccccccggttcggtacccttaacccccgg

SEQ ID NO: 80199 - DNA, 241 bp, Homo sapiens; identical to SEQ ID NO: 80024
  misc_feature: GYAE6OF01CXB8G.44.25.C03.1.454.CMB.1.raw
  modified_base (238)..(241): a, c, t, g, unknown or other
  misc_feature (238)..(241): n is a, c, g, or t

SEQ ID NO: 80200 - DNA, 221 bp, Homo sapiens; identical to SEQ ID NO: 79959
  misc_feature: GYAE6OF01BBDQD.44.25.C03.1.454.CMB.1.raw
  modified_base (219)..(221): a, c, t, g, unknown or other
  misc_feature (219)..(221): n is a, c, g, or t

SEQ ID NO: 80201 - DNA, 294 bp, Homo sapiens
  misc_feature: GYAE6OF01BF9EN.44.25.C03.1.454.CMB.1.raw
  modified_base (245)..(246): a, c, t, g, unknown or other
  misc_feature (245)..(246): n is a, c, g, or t
  modified_base (250)..(294): a, c, t, g, unknown or other
  misc_feature (250)..(294): n is a, c, g, or t
tcagacagtatatacacgaccggtgctcgatttagtagtgtagatttgggtttgggtggcccaagctgctggagggcacggtcaccacggtcaccgtctcctcagcttccaccaagggcccatcggtcttccccctggcgccctgctccaggagcacctcgtgggggcacgagcggccctgggctgcctggtcaaggctacttcctatagtactgtctgagcgggctggcaaggcgcaataggcnncatnnnnnnnnnnnnnnnnnnnnnnnnnnnnnnnnnnnnnnnnnnnnn

SEQ ID NO: 80202 - DNA, 239 bp, Homo sapiens
  misc_feature: GYAE6OF01C2IAU.44.25.C03.1.454.CMB.1.raw
  modified_base (237)..(239): a, c, t, g, unknown or other
  misc_feature (237)..(239): n is a, c, g, or t
tcagacagtatatacacgaccggtgctcgatttagtagtgtagatttgggtttgggtgcccaagctgctggagggcacggtcaccacggtcaccgtctcctcagcttccaccaagggcccatcggtcttcccctggcgcctgctccaggagcacctctgggggcacagcggccctgggctgcctggtcaaggactacttcctatatactgtctgagcgggctggcaaggcgcatagnnn

SEQ ID NO: 80203 - DNA, 242 bp, Homo sapiens
  misc_feature: GYAE6OF01DKZW4.44.25.C03.1.454.CMB.1.raw
  modified_base (237)..(242): a, c, t, g, unknown or other
  misc_feature (237)..(242): n is a, c, g, or t
tcagacagtatatacacgaccggtgctcgatttagtagtgtagatttgggtttgggtgcccaagctgctggagggcacggtcaccacggtcaccgtctcctcagcttccaccaaggccatcggtcttcccctggcgccctgctccaggagcacctcgtggggcacagcggccctgggctgcctggtcaaggactacttcctatatactgtctgagcgggctggacaaggcgcatagnnnnnn

SEQ ID NO: 80204 - DNA, 220 bp, Homo sapiens; identical to SEQ ID NO: 79937
  misc_feature: GYAE6OF01ACPV8.44.25.C03.1.454.CMB.1.raw
  modified_base (218)..(220): a, c, t, g, unknown or other
  misc_feature (218)..(220): n is a, c, g, or t

SEQ ID NO: 80205 - DNA, 245 bp, Homo sapiens
  misc_feature: GYAE6OF01CROBC.44.25.C03.1.454.CMB.1.raw
  modified_base (238)..(245): a, c, t, g, unknown or other
  misc_feature (238)..(245): n is a, c, g, or t
tcagacagtatatacacgaccggtgctcgatttagtagtgtagatttgggtttgggtgcccaagctgctggagggcacggtcaccacggtcaccgtctcctcagcttccaccaagggcccatcggtcttccccctggcgccctgctccaggagcacctctgggggcacagcggccctgggctgcctggtcaaggctacttcctatatactgtctgagcgggctggcaaggcgcatagnnnnnnnn

SEQ ID NO: 80206 - DNA, 841 bp, Homo sapiens
  misc_feature: GYAE6OF01BMM38.44.25.C03.1.454.CMB.1.raw
tcagacagtatatacacgaccggtgctcgatttagtagtgtagatttgggtttgggggcttcagctgtgggcacaagaggcagcactcaggacaatctccagcatggcatggtctcctctcctcctcactctcctcgctcactgcacagggtcctgggcccacgtctgtgctgacgcagccgccctcagtgtcgtcggggccccggggcacggagggtccaccgatcctcctgccacgtgggacgcagactaccaaacgagtccggggaacaggtatttccgtagattcgtccacgtcggtaacccaaccgtacccttacccgaacggtaaccaccggtaccccccaaaacttcctactagttaccgttttaggtaaacctaactaacgttcccggaccccttacggtaccgggggttcccctacggtaacccgtatttcccgtccgttacggtaccttacccgtaaacgttcgtacggtaccctaacccgtccgaaccgtccccgttcccgtccgggtacccctaaccgttacccgtaacccggtcggggtaccccttaccccggaagggtacccgttaaggaaacggtacgttagggtaacgggttacgttaaacgtttaacgttaaccggtcgtaaccgtaacggtttaccccgttaagtaccggtaaccgtacggtaccgtaccggttaccccgttacggttaagggttttccggggggtttaggggtttacccggggtttaccggggaccgggggtaaaccgggtaacccgaaacgggttcccggtaccgggttaccccgggtttacccggttcggggtacccgtaacccccgggg

SEQ ID NO: 80207 - DNA, 244 bp, Homo sapiens
  misc_feature: GYAE6OF01DNKS5.44.25.C03.1.454.CMB.1.raw
  modified_base (239)..(244): a, c, t, g, unknown or other
  misc_feature (239)..(244): n is a, c, g, or t
tcagacagtatatacacgaccggtgctcgatttagtagtgtagatttgggtttgggtgcccaagctgctggagggcacggtcaccacggtcaccgtctcctcagcttccaccaagggcccatcggtcttccccctggcgccctgctccaggagcacctctgggggcacagcggccctgggctgcctggtcaaggactacttcctatatactgtctgagcgggctggcaaggcgcatagnnnnnn

SEQ ID NO: 80208 - DNA, 241 bp, Homo sapiens
  misc_feature: GYAE6OF01A0RMH.44.25.C03.1.454.CMB.1.raw
  modified_base (238)..(241): a, c, t, g, unknown or other
  misc_feature (238)..(241): n is a, c, g, or t
tcagacagtatatacacgaccggtgctcgatttagtagtgtagatttgggtttgggtgcccaagctgctggagggcacggtcaccacggtcaccgtctcctcagcttccaccaagggcccatcggtcttccccctggcgccctgctccaggagcacctctgggggcacagcggccctgggctgcctggtcaaggctacttccacgtctactgctgagcgggctggcaaggcgcatagnnnn

SEQ ID NO: 80209 - DNA, 241 bp, Homo sapiens; identical to SEQ ID NO: 80042
  misc_feature: GYAE6OF01D8BFP.44.25.C03.1.454.CMB.1.raw
  modified_base (238)..(241): a, c, t, g, unknown or other
  misc_feature (238)..(241): n is a, c, g, or t

SEQ ID NO: 80210 - DNA, 435 bp, Homo sapiens
  misc_feature: GYAE6OF01BAYGP.44.25.C03.1.454.CMB.1.raw
  modified_base (426)..(435): a, c, t, g, unknown or other
  misc_feature (426)..(435): n is a, c, g, or t
tcagacagtatatacacgaccggtgctcgatttagtagtgtagatttgggtttggggggcagagggtcaccatctcctgcactgggagcagatccaacatcgggacagattctgatgtccactggtaccaacaccttccaggaacagcccccaaactcctcatctttggtaacaactatcggccctcaggggtccctgaccgattctctggctccaagtctggcacctcagcctcctggccatcactgggctccaggctgaagatgaggtgattattactgccagtcctatgacagcagcctcaggtggttgggtgttcggcggaggaccaagctgaccgtctggtcagcccaaggctcgcccctggtcactctcgttcccaccctctctatactactgtctgagcgggctggcaaggcgcatagnnnnnnnnnn

SEQ ID NO: 80211 - DNA, 138 bp, Homo sapiens; identical to SEQ ID NO: 80060
  misc_feature: GYAE6OF01BFQ45.44.25.C03.1.454.CMB.1.raw
  modified_base (137)..(138): a, c, t, g, unknown or other
  misc_feature (137)..(138): n is a, c, g, or t

SEQ ID NO: 80212 - DNA, 289 bp, Homo sapiens
  misc_feature: GYAE6OF01DGN80.44.25.C03.1.454.CMB.1.raw
  modified_base (251)..(289): a, c, t, g, unknown or other
  misc_feature (251)..(289): n is a, c, g, or t
tcagacagtatatacacgaccggtgctcgatttagtagtgtagatttgggtttgggtgcccaagcgtgctggacgggcacggtcaccacggtcaccgtctcctcagcttccaccaagggcccatcggtcttcccctggcgccctgcctccaggagtcacctcgtgggggcacgtacgcggccctgggcttgccgtggtccaaggtactacttcctatatactgtctgagcgggcgtggcaaggcgcatagnnnnnnnnnnnnnnnnnnnnnnnnnnnnnnnnnnnnnnn

SEQ ID NO: 80213 - DNA, 574 bp, Homo sapiens
  misc_feature: GYAE6OF01EHH2B.44.25.C03.1.454.CMB.1.raw
  modified_base (466)..(466): a, c, t, g, unknown or other
  misc_feature (466)..(466): n is a, c, g, or t
  modified_base (527)..(527): a, c, t, g, unknown or other
  misc_feature (527)..(527): n is a, c, g, or t
  modified_base (558)..(558): a, c, t, g, unknown or other
  misc_feature (558)..(558): n is a, c, g, or t
tcagacagtatatacacgaccggtgctcgatttagtagtgtagatttgggtttgggggactcctgtgccccaccatggacactctttgctacacactcctgctgctgaccaccccttcctgggtcttgtcccaggtcaccttgaaggagtctggtcctgtgctggtgaaacccacagagaccctcacgctgacctgcaccatctctgggttctctctcaacgatattagaagtgggtgtgagctggatccgtcacgccccgagggaacggccctggagtggcttgcacacatcttctcgaatgaacgaaaatcctacagtacatctctagaagagactagtttaaccatcctacaacggacacctacgaaaaggcgtaggtggttactttagtatgaaccaacagtcggaccctggcgacacgaggacacatacttactgtagcgacgggtaatggaacgggaaanaacgagtacgttggtttactagttatttaagtaacgttacctactatcgtggacgttcggngggacaacgggcaccggtcacccgtctccancgtcctccgaacccgg

SEQ ID NO: 80214 - DNA, 243 bp, Homo sapiens
  misc_feature: GYAE6OF01CNI8Q.44.25.C03.1.454.CMB.1.raw
  modified_base (238)..(243): a, c, t, g, unknown or other
  misc_feature (238)..(243): n is a, c, g, or t
tcagacagtatatacacgaccggtgctcgatttagtagtgtagatttgggtttgggtgcccaagctgctggagggcacggtcaccacggtcaccgtctcctcagcttccaccaagggcccatcggtcttcccctggcgccctgctccaggagcacctctgggggcacagcggccctgggctgcctggtcaaggactacttccacgtctactgctgagcgggctggcaaggcgcatagnnnnnn

SEQ ID NO: 80215 - DNA, 247 bp, Homo sapiens
  misc_feature: GYAE6OF01CCNF5.44.25.C03.1.454.CMB.1.raw
  modified_base (240)..(247): a, c, t, g, unknown or other
  misc_feature (240)..(247): n is a, c, g, or t
tcagacagtatatacacgaccggtgctcgatttagtagtgtagatttgggtttgggtgcccaagctgctggagggcacggtcaccacggtcaccgtctcctcagcttccaccaagggcccatcggtcttcccctggcgccctgctccaggagcacctcgtgggggcacagcggccctgggctgcctggtcaaggactacttcctatatactgtctgagcgggctggcaaggcgcaagtgnnnnnnnn

SEQ ID NO: 80216 - DNA, 240 bp, Homo sapiens; identical to SEQ ID NO: 79965
  misc_feature: GYAE6OF01A8N4D.44.25.C03.1.454.CMB.1.raw
  modified_base (239)..(240): a, c, t, g, unknown or other
  misc_feature (239)..(240): n is a, c, g, or t

SEQ ID NO: 80217 - DNA, 642 bp, Homo sapiens
  misc_feature: GYAE6OF01BB67Q.44.25.C03.1.454.CMB.1.raw
  modified_base (626)..(642): a, c, t, g, unknown or other
  misc_feature (626)..(642): n is a, c, g, or t
tcagacagtatatacacgaccggtgctcgatttagtagtgtagatttgggtttgggggggcagagggtcaccatctcctgcactgggagcagatccaacatcgggacagattctgatgtcccacgtggtaacccaactacccttccgaaggaaccaccgaccccccaaaactccctctacttcgttttaggtaaaccaaactagtcccggtcccctcggacggggtccctcgaccgtattcctcgtcggtcctaccgaagtcgtcggcctaccctcacgtcccctcccgtcggccactcctacggtcgggtcctccgaggtctagaagagtggaggggtgtaatttattactcgcctaggtccctagtacgacagtccacgtcccgtcgtagggtttggggtttggggttcggtttcggggaccggggtacggggaaccgaaacggtccgtacggtaccccggttccggtacgggtccgaacgacccccggaaacgggcccgtcccggcccccccgttccggtcctacccgttccgttcccggttcccccgtccccttcccgtaccttacttacttaccgtgtcgtgtacgggccgggtcgtcgggacgacgggccgcgagtagcnnnnnnnnnnnnnnnnn

SEQ ID NO: 80218 - DNA, 245 bp, Homo sapiens
  misc_feature: GYAE6OF01AJKOZ.44.25.C03.1.454.CMB.1.raw
  modified_base (239)..(245): a, c, t, g, unknown or other
  misc_feature (239)..(245): n is a, c, g, or t
tcagacagtatatacacgaccggtgctcgatttagtagtgtagatttgggtttgggtgcccaagctgctggagggcacggtcaccatggtcaccgtctcctcagcttccaccaagggcccatcggtcttccccctggcgccctgctccaggagcacctccgagagcacagcggccctgggctgcctggtcaaggactacttcctcgatcgcgtctgagcgggctggcaaggcgcatagnnnnnnn

SEQ ID NO: 80219 - DNA, 563 bp, Homo sapiens
  misc_feature: GYAE6OF01A71JR.44.25.C03.1.454.CMB.1.raw
  modified_base (197)..(197): a, c, t, g, unknown or other
  misc_feature (197)..(197): n is a, c, g, or t
  modified_base (226)..(226): a, c, t, g, unknown or other
  misc_feature (226)..(226): n is a, c, g, or t
  modified_base (411)..(411): a, c, t, g, unknown or other
  misc_feature (411)..(411): n is a, c, g, or t
tcagacagtatatacacgaccggtgctcgatttagtagtgtagatttgggtttgggggggcacaagaggcagcactcaggacaatctccagcatggcctggtctcctctcctcctcactctcctcgctcactgcacagggtcctgggcccactctgtgctgacgcagccgccctcagtgtcgtgggggccccggggnagagggtcaccatctcctgcacgtgggancagatccaacagtcgggacagattctgatgtccactggtaccaacaccttcaggacacgcccccaaactcctcatctttaggaacactatcgcctcagggtcctgaccgattctctggctccaagtctggcacctcacgcctccctggccatcactgggcctccgaggctagaagatggagggtntatttatacgtgcctagtcctatcgacagcagtcctgtaggtggttagggtcggttcggacggggtaggaacccgtaaggccgttaggaccccggttcgtaggggtaccacggtccccgaaggtcccgtacccgccccccggttggtccccg

SEQ ID NO: 80220 - DNA, 152 bp, Homo sapiens
  misc_feature: GYAE6OF01ARQI0.44.25.C03.1.454.CMB.1.raw
  modified_base (137)..(152): a, c, t, g, unknown or other
  misc_feature (137)..(152): n is a, c, g, or t
tcagacagtatatacacgaccggtgctcgatttagtagtgtagatttgggtttgggctcgtgggcacagcggccctgggctgcctggtcaaggactacttccacgtctactgctgagcggctggcaaggcgcatagnnnnnnnnnnnnnnnn

SEQ ID NO: 80221 - DNA, 273 bp, Homo sapiens
  misc_feature: GYAE6OF01D8AXO.44.25.C03.1.454.CMB.1.raw
  modified_base (267)..(273): a, c, t, g, unknown or other
  misc_feature (267)..(273): n is a, c, g, or t
tcagacagtatatacacgaccggtgctcgatttagtagtgtagatttgggtttgggaggaagaggaagactgacggtcctcccaggagttcaggtgctgggcaccttgggcgacgggggaggtgtgtcacaagatttgggctctgggcaccgtgggcagtgggggaggtgtgtcacaagatttgggctctgggcacagcggccctgggctgcctggtcaaggactacttcctatatactgtctgagcgggctggcaaggcgcatagnnnnnnn

SEQ ID NO: 80222 - DNA, 158 bp, Homo sapiens
  misc_feature: GYAE6OF01E2BHV.44.25.C03.1.454.CMB.1.raw
  modified_base (120)..(120): a, c, t, g, unknown or other
  misc_feature (120)..(120): n is a, c, g, or t
  modified_base (125)..(158): a, c, t, g, unknown or other
  misc_feature (125)..(158): n is a, c, g, or t
tcagacagtatatacacgaccggtgctcgatttagtagtgtagatttgggtttgggcacagcgccctggctgcctggtcaaggactacttccacgtctactgctgagcggctggcaggcnatagnnnnnnnnnnnnnnnnnnnnnnnnnnnnnnnnnn

SEQ ID NO: 80223 - DNA, 243 bp, Homo sapiens
  misc_feature: GYAE6OF01AT0OR.44.25.C03.1.454.CMB.1.raw
  modified_base (221)..(243): a, c, t, g, unknown or other
  misc_feature (221)..(243): n is a, c, g, or t
tcagacagtatatacacgaccggtgctcgatttagtagtgtagatttgggtttggggggaagaggaagactgacggtcctcccaggagttcaggtgctgggcaccgttgggcacgggggaggtgtgtcacaagatttgggctctgggcacagcggccctgggctgcctggtcaaggactacttccacgtctactgctgagcgggctggcaaggcgcatagnnnnnnnnnnnnnnnnnnnnnnn

SEQ ID NO: 80224 - DNA, 801 bp, Homo sapiens
  misc_feature: GYAE6OF01DI3CP.44.25.C03.1.454.CMB.1.raw
  modified_base (778)..(778): a, c, t, g, unknown or other
  misc_feature (778)..(778): n is a, c, g, or t
  modified_base (780)..(782): a, c, t, g, unknown or other
  misc_feature (780)..(782): n is a, c, g, or t
  modified_base (784)..(801): a, c, t, g, unknown or other
  misc_feature (784)..(801): n is a, c, g, or t
tcagacagtatatacacgaccggtgctcgatttagtagtgtagatttgggtttgggctggatccgtcacgccccgagggaacggccctggagtggcttgcacacattcttctacgaatgaaacgaaaaactcctacagtacatctctagaagagctaacgtttaaaccattcctaccgaaacggaccaccctaaccgaaaaaggcgtagggttggttactttaagtatacgaaccaaacagtcggaccctcggaccggacacgacggacaacaattattacgtggtcgacgtaacgggtaatcgggaacgggaaaaagaacagtcgttgggtttctagttattaagttaaacgttccttaaccattcgtacgggtacgttcggtcgggggaacgaaaacggggacccgtacgggtcccgtaacccggttcctccctcgacggtcccttacccgaacccggaaaccggggcccctaacggttccccggttccctttccccccggtcgggtccccgtcccccgtcgcccgttacccggaaacgggtcgacccctacccgttcggggtccggggggacccaacccggaccgggtccccgggtccccgggttcggggtcccgttccgggtccccggttacgggttaaccgaaaccgggttaccctttaaccgttttacccgtaaacttacgtttaaccgtttcggttacccggtagggtaccggggtcccggggtgttaccgggggaaccgaaacggggtcccgaacgttaacggaacggtncnnngnnnnnnnnnnnnnnnnnn

SEQ ID NO: 80225 - DNA, 240 bp, Homo sapiens; identical to SEQ ID NO: 79926
  misc_feature: GYAE6OF01ED2EU.44.25.C03.1.454.CMB.1.raw
  modified_base (238)..(240): a, c, t, g, unknown or other
  misc_feature (238)..(240): n is a, c, g, or t

SEQ ID NO: 80226 - DNA, 228 bp, Homo sapiens
  misc_feature: GYAE6OF01DEDXJ.44.25.C03.1.454.CMB.1.raw
  modified_base (219)..(228): a, c, t, g, unknown or other
  misc_feature (219)..(228): n is a, c, g, or t
tcagacagtatatacacgaccggtgctcgatttagtagtgtagatttgggtttgggggaagaggaagactgacggtcctcccaggagttcaggtgctgggcaccttgggcacgggggaggtgtgtcacaagatttgggctctgggcacagcggccctgggctgcctggtcaaggactacttcctatatactgtctgagcgggctggcaaggcgcatagnnnnnnnnnn

SEQ ID NO: 80227 - DNA, 268 bp, Homo sapiens
  misc_feature: GYAE6OF01EM1P5.44.25.C03.1.454.CMB.1.raw
  modified_base (263)..(268): a, c, t, g, unknown or other
  misc_feature (263)..(268): n is a, c, g, or t
tcagacagtatatacacgaccggtgctcgatttagtagtgtagatttgggtttgggggaagaggaagactgacggtcctcccaggagttcaggtgctgggcaccttgggcacgggggaggtgtgtcacaagatttgggctctgggcaccgtgggcagtgggggagtgtgtcacaagatttgggctctgggcacagcggccctgggctgcctggtcaaggctacttcctatatactgtctgagcgggctggcaaggcgcatagnnnnnn

SEQ ID NO: 80228 - DNA, 226 bp, Homo sapiens
  misc_feature: GYAE6OF01BP1Y2.44.25.C03.1.454.CMB.1.raw
  modified_base (219)..(226): a, c, t, g, unknown or other
  misc_feature (219)..(226): n is a, c, g, or t
tcagacagtatatacacgaccggtgctcgatttagtagtgtagatttgggtttgggggaagaggaagactgacggtcctcccaggagttcaggtgctgggcaccttgggcacgggggaggtgtgtcacaagatttgggctctgggcacagcggccctgggctgcctggtcaaggactacttcctatatactgtctgagcgggctggcaaggcgcatagnnnnnnnn

SEQ ID NO: 80229 - DNA, 812 bp, Homo sapiens
  misc_feature: GYAE6OF01C29X0.44.25.C03.1.454.CMB.1.raw
tcagacagtatatacacgaccggtgctcgatttagtagtgtagatttgggtttgggggactcctgtgccccaccatggacactctttgctacacactcctgctgctgaccacccttcctgggtcttgtcccaggtcaccttgaaggagtctggtcctgtgctggtgaaacccacagagaccctcacgctgacctgcaccatctctgggttctctctcaacgatattagaatgggtgtgagctgggactccgtcacgcccccgagggaacggccctggagtggcttgcacacatctctcgaatgaacgaaaactcctacagtacatctctagaagagactaacgttaaccatcctaccgaaacggacctaacccgtaaccgaaaaacggcgtaagggttcgtttacttttaagtacgtacgaaaccctaacgtacggtacgggtcccctagggacccggaacaacggaggaccaacgtaatttaacgtttacgtacgggtacgtaaccggtaacggggttaacggttacgggaaaccggggtaaaacgtaaacggtaacgggttaaccggttttacgggtttttaacgttaaggtttaaagtttaaacgtttaaaccggtttaaccttttaaacccgttaacggttaccggttaccggggttaaccgggttacggggttaaccggggggtaaacccgggtaaaaccggggtaccccgggttaaaccgggttacccccggttaaaccccggtttccccgttaccccgttaccggaaccccggttcccgtttaaccccccggaaaaccccggggg

SEQ ID NO: 80230 - DNA, 654 bp, Homo sapiens
  misc_feature: GYAE6OF01AXKJY.44.25.C03.1.454.CMB.1.raw
  modified_base (520)..(520): a, c, t, g, unknown or other
  misc_feature (520)..(520): n is a, c, g, or t
tcagacagtatatacacgaccggtgctcgatttagtagtgtagatttgggtttgggggactcctgtgccccaccatggacactctttgctacacactcctgctgctgaccacccttcctgggtcttgtcccaggtcaccttgaaggagtctggtcctgtgctggtgaaacccacagagaccctcacgctgacctgcaccatctctgggttctctctcaacgatattagaatgggtgtgagctggatccgtcacgccccagggaacgccgtggagtggcttgcacacatcttctacgaatcgaaacgaaaaactccgtaactacgtacactactctagaaagacgtactaagtttaaccactacctaccgaaacggtaccaacctaccgaaaaggcgtaaggttggttacctttaagtactagaacccaaacgtagtacggtaccctacggacggaacaacgacggcaactaatacttacgtgttcgacgtaacggtaagtcggaaacggaaacgtaaacncgtcggtttacggtttcgtaggttaatttaacgttaagttaccttaacctagtcgtaggtaccggtcgtacggggtaacaaacgggtccaacgggttccaccggttctaccgtacacgtcttacccgaacccgg

SEQ ID NO: 80231 - DNA, 244 bp, Homo sapiens
  misc_feature: GYAE6OF01DJ0MZ.44.25.C03.1.454.CMB.1.raw
  modified_base (240)..(244): a, c, t, g, unknown or other
  misc_feature (240)..(244): n is a, c, g, or t
tcagacagtatatacacgaccggtgctcgatttagtagtgtagatttgggtttgggtgcccaagctgctggagggcacggtcaccacggtcaccgtctcctcagcttccaccaagggccatcggtcttcccctggcgccctgctccaggagcacctcgtgggggcacaggcggccctgggctgcctggtcaaggactacttcctatatactgtctgagcgggctggcaagggcgcatagnnnnn

SEQ ID NO: 80232 - DNA, 555 bp, Homo sapiens
  misc_feature: GYAE6OF01BBEQK.44.25.C03.1.454.CMB.1.raw
  modified_base (274)..(274): a, c, t, g, unknown or other
  misc_feature (274)..(274): n is a, c, g, or t
tcagacagtatatacacgaccggtgctcgatttagtagtgtagatttgggtttggggggaagaggaagactgacggtcctcccaggagttcaggtgctgggcaccttgggcacgggggaggtgtgtcacaagatttgggctctgggcaccgtgggcatggggggaggtgtgtcacaagatttggactcctgtgccccaccatggacactctttgctacacactcctgctgctgacccaccccttcctgggtcttgtcccaggtcaccttgaagngtctggtcctgtgctggtgaaacccacagagaccctcacgctgacctgcaccatctctgggttctctctcaacgatattagaatgggtgtgagctggactccgtcacgcccccgagggaacggcccgtggacgtggcttgcacacatctctcgaatgaacgaaaactcctaacagtacatactctagaagagactagtttaaccatactaccaacgaccacctaccgaaaggcgaggtggtactttagtatgaaccaacactaggaccctggccgtaaccg

SEQ ID NO: 80233 - DNA, 240 bp, Homo sapiens; identical to SEQ ID NO: 79972
  misc_feature: GYAE6OF01B8DO3.44.25.C03.1.454.CMB.1.raw
  modified_base (238)..(240): a, c, t, g, unknown or other
  misc_feature (238)..(240): n is a, c, g, or t

SEQ ID NO: 80234 - DNA, 249 bp, Homo sapiens; identical to SEQ ID NO: 79915
  misc_feature: GYAE6OF01BC92Z.44.25.C03.1.454.CMB.1.raw
  modified_base (238)..(249): a, c, t, g, unknown or other
  misc_feature (238)..(249): n is a, c, g, or t

SEQ ID NO: 80235 - DNA, 244 bp, Homo sapiens
  misc_feature: GYAE6OF01AYZXU.44.25.C03.1.454.CMB.1.raw
  modified_base (239)..(244): a, c, t, g, unknown or other
  misc_feature (239)..(244): n is a, c, g, or t
tcagacagtatatacacgaccggtgctcgatttagtagtgtagatttgggtttgggtgcccaagctgctggagggcacggtcaccacggtcaccgtctcctcagcttccaccaagggcccatcggtcttccccctggcgccctgctccaggagcacctctgggggcacagcggccctgggctgcctggtcaaggactacttcctcgatcgcgtctgagcgggctggcaaggcgcatagnnnnnn

SEQ ID NO: 80236 - DNA, 326 bp, Homo sapiens
  misc_feature: GYAE6OF01D90OI.44.25.C03.1.454.CMB.1.raw
  modified_base (174)..(174): a, c, t, g, unknown or other
  misc_feature (174)..(174): n is a, c, g, or t
  modified_base (288)..(288): a, c, t, g, unknown or other
  misc_feature (288)..(288): n is a, c, g, or t
  modified_base (295)..(295): a, c, t, g, unknown or other
  misc_feature (295)..(295): n is a, c, g, or t
  modified_base (302)..(326): a, c, t, g, unknown or other
  misc_feature (302)..(326): n is a, c, g, or t
tcagacagtatatacacgaccggtgctcgatttagtagtgtagatttggggtttggggggtgtggtggtctccactcccgccttgacgggctgctatctgcctccctggccatcactgggctccaggctgaagatggaggtgattattactgccagtcctatgacagcagcctnagtggttgggtgttcggcggagggaccaaagcgtgaccgtcctgggtcagcccaaggctcgcccctggcactctgtcccacctctctatatactgtctggagcgggactcgganaaggcgntagtagnnnnnnnnnnnnnnnnnnnnnnnnn

SEQ ID NO: 80237 - DNA, 243 bp, Homo sapiens; identical to SEQ ID NO: 80006
  misc_feature: GYAE6OF01B6Z8E.44.25.C03.1.454.CMB.1.raw
  modified_base (239)..(243): a, c, t, g, unknown or other
  misc_feature (239)..(243): n is a, c, g, or t

SEQ ID NO: 80238 - DNA, 303 bp, Homo sapiens
  misc_feature: GYAE6OF01BZC59.44.25.C03.1.454.CMB.1.raw
  modified_base (300)..(303): a, c, t, g, unknown or other
  misc_feature (300)..(303): n is a, c, g, or t
tcagacagtatatacacgaccggtgctcgatttagtagtgtagatttgggtttgggggtgtggtggtctccactcccgccttgacggggctgctatctgcctccctggccatcactgggctccaggctgaagatgagggtgattattactgccagtcctatgacagcagcctcagtggttgggtgttcggcggagggaccaagctgaccgtcctgggtcagcccaaggctcgccccctcggtcactctcgttcccgccctcctctatatactgtctgagcgggctggcaaggcgcatagnnnn

SEQ ID NO: 80239 - DNA, 245 bp, Homo sapiens
  misc_feature: GYAE6OF01CLW21.44.25.C03.1.454.CMB.1.raw
  modified_base (239)..(245): a, c, t, g, unknown or other
  misc_feature (239)..(245): n is a, c, g, or t
tcagacagtatatacacgaccggtgctcgatttagtagtgtagatttgggtttgggtgcccaagctgctggagggcacggtcaccacggtcaccgtctcctcagcttccaccaagggcccatcggtcttccccctggcgccctgctccaggagcacctctgggggcacagcggccctgggctgcctggtcaaggactacttcctatatactgtctgagcgggctggcaaggcgcatagnnnnnnn

SEQ ID NO: 80240 - DNA, 611 bp, Homo sapiens
  misc_feature: GYAE6OF01AD7CN.44.25.C03.1.454.CMB.1.raw
tcagacagtatatacacgaccggtgctcgatttagtagtgtagatttgggtttgggggactcctgtgccccaccatggacactctttgctacacactcctgctgctgaccacccttcctgggtcttgtcccaggtcaccttgaaggagtctggtcctgtgctggtgaaacccacagagaccctcacgctgacctgcaccatctctgggttctctctcaacgatattagaatgggtgtgagctggatccggtcacgcccccagggaaggccctggagtggcttgcacacatctctcgaatgacgaaaatcctacagtacatctctgaagagcagtttaaccatctaccaaggacacctacaaaaggcaggtggtctttagtatgaccaacatcggacctgcggacacaggcacattatactgtcgcgacgggtaatcggacgggaaaagaacgagtacgttggttttacgttagttaatttaagtaacgttaccttaacctagttccgttagggtaccggttcggtacggggggaaccgtaaagggggtaccctaaccgggtacctacccgggttcctacccttaccgaacgtcccttcccgaaaccccggg

SEQ ID NO: 80241 - DNA, 744 bp, Homo sapiens
  misc_feature: GYAE6OF01EG1B9.44.25.C03.1.454.CMB.1.raw
tcagacagtatatacacgaccggtgctcgatttagtagtgtagatttgggtttggggggaagaggaagactgacggtcctcccaggagttcaggtgctgggcaccttgggcacgggggaggtgtgtcacaagatttgggctctgggcaccgtgggcagtgggggagtgtgtcacaagatttggactcctgtcgccccacatggactactctttgctacacactcctgctgctcgaccctacccctttcgtgggtcttcgcccaggtcaccgttgaaggtgtctggtcctgtcgctggtacgaaaccacagacgacccctcacgctgacctgccacctactctcgtggttctctctacaacgtattaatagtaagtgggtgtgagtcgtggactccgtcaccggaccccgaaggggaaccggtcccgtagggacggttcggtacgttcggacctaaccgtacgtacgttaccgtttaccgtacgtaaacgttaacggtaaaaccgtaaaaaaccgttcccttaaacgacgtttaacctaacttaccgttacgtaaacggtaaacggtaaccggtaaccgttaaaccggttttaaacccacttaacccgtaaccgtaaaccggtaaccctaacccgtaaaccgaaaacgggtaccgtaacgggtttacgttacggtttaacgttaaccgtaccggaaacctaaccgtaacgtacccgggtaacccgttcgggaacccggtaacccg

SEQ ID NO: 80242 - DNA, 340 bp, Homo sapiens
  misc_feature: GYAE6OF01AZ1OY.44.25.C03.1.454.CMB.1.raw
  modified_base (263)..(263): a, c, t, g, unknown or other
  misc_feature (263)..(263): n is a, c, g, or t
  modified_base (265)..(267): a, c, t, g, unknown or other
  misc_feature (265)..(267): n is a, c, g, or t
  modified_base (269)..(271): a, c, t, g, unknown or other
  misc_feature (269)..(271): n is a, c, g, or t
  modified_base (273)..(340): a, c, t, g, unknown or other
  misc_feature (273)..(340): n is a, c, g, or t
tcagacagtatatacacgaccggtgctcgatttagtagtgtagattttggggtttggggtgcccaagctgctggagggcacggtcaccaaccggtcaccgtctcctcagcttcccaccaagggcccatcgtcttccccctggcgccctgctccaggagcacctcgtgggggcacagccggcccctgggcctgcctggtcaaggtactacttcctatagtacgtgtcgtggaggtaccgggctgggcgaaggcgcgtaataggntnnngnnntnnnnnnnnnnnnnnnnnnnnnnnnnnnnnnnnnnnnnnnnnnnnnnnnnnnnnnnnnnnnnnnnnnnn

SEQ ID NO: 80243 - DNA, 300 bp, Homo sapiens
  misc_feature: GYAE6OF01DLN3U.44.25.C03.1.454.CMB.1.raw
  modified_base (294)..(300): a, c, t, g, unknown or other
  misc_feature (294)..(300): n is a, c, g, or t
tcagacagtatatacacgaccggtgctcgatttagtagtgtagatttgggtttgggggtgtggtggtctccactcccgccttgacggggctgctatctgcctccctggccatcactgggctccaggctgaagatgaggtgattattactgccagtcctatgacagcagcctcagtggttgggtgttcggcggagggaccaagctgaccgtcctgggtcagcccaaggctcgcccctcggtcactctgttcccacctctcatatactgtctgagcgggctggcaaggcgcatagnnnnnnn

SEQ ID NO: 80244 - DNA, 262 bp, Homo sapiens
  misc_feature: GYAE6OF01C4RJ0.44.25.C03.1.454.CMB.1.raw
  modified_base (166)..(166): a, c, t, g, unknown or other
  misc_feature (166)..(166): n is a, c, g, or t
  modified_base (235)..(235): a, c, t, g, unknown or other
  misc_feature (235)..(235): n is a, c, g, or t
  modified_base (242)..(262): a, c, t, g, unknown or other
  misc_feature (242)..(262): n is a, c, g, or t
tcagacagtatatacacgaccggtgctcgatttagtagtgtagatttgggtttgggtgcccaagctgctggaggcacggtcaccacggtcaccgtctcctcagcttccaccaagggcccatcggtcttcccctggcgccctgctccaggcgcacctctggggcacngcggccctgggctgcctggtcaaggactacttccgtatatactgtcgtgagcgggctggacgaagggcncaatagnnnnnnnnnnnnnnnnnnnnn

SEQ ID NO: 80245 - DNA, 596 bp, Homo sapiens
  misc_feature: GYAE6OF01AJ3MK.44.25.C03.1.454.CMB.1.raw
  modified_base (467)..(467): a, c, t, g, unknown or other
  misc_feature (467)..(467): n is a, c, g, or t
  modified_base (509)..(509): a, c, t, g, unknown or other
  misc_feature (509)..(509): n is a, c, g, or t
tcagacagtatatacacgaccggtgctcgatttagtagtgtagatttgggtttgggggactcctgtgccccaccatggacactctttgctacacactcctgctgctgaccacccttcctgggtcttgtcccaggtcaccttgaaggagtctggtcctgtgctggtgaaacccacagagaccctcacgctgacctgcaccatctctgggttctctctcaacgatattagaatgggtgtgagctggatccgtcacgcccccgagggaacggccctggagtggcttgcacacatcttctcgaatgaacgaaaatcctacagtacatctctagaagagctaagtttaaccatctaccaaggacacctaccaaaggcaggttgtactttagtatacgaccaacgatcggaccctggaccgacacgaggacacattatactgtgacgtacgggtaatcgggacggaaagaacnggtcttaggtttctagttaatttaagtaacgttccttaaccngttacgtcgggtaccgttcggtggggaccaaacggggtcccaccgggtccaccggttcctccgtacacgtccgttacccgaacccgg

SEQ ID NO: 80246 - DNA, 739 bp, Homo sapiens
  misc_feature: GYAE6OF01ED37K.44.25.C03.1.454.CMB.1.raw
  modified_base (255)..(255): a, c, t, g, unknown or other
  misc_feature (255)..(255): n is a, c, g, or t
tcagacagtatatacacgaccggtgctcgatttagtagtgtagatttgggtttgggggggcacaagaggcagcactcaggacaatctccagcatggcctggtctcctctcctcctcactctcctcgctcactgcacagggtcctgggcccactctgtgctgacgcagcccgccctcagtgtcgtcgggggccccgggcaggagggtcaccatctcctgcacgtgggagcagactccaacagtcgggacagattcngatcgtccacgtcggtaaccaactacccttccgaaggaaccaccgacccccaaactcctacacttcgtttaggtaaaccaactacgtccggccctcgacggggtccctgaccgtattcctcgtcggctaccgaagtccgtcggcctacccgtcgaccgtcccttcccgtacggccctatcccgacggtcgggtcctacccggaggtctaggaacgagtacgggtagggttacgttaactttaacgttacgtcgtaccctacgttacccttaacgtcggtaaccgacgaccgtacggtccccttacggttaacggggtttcggggtttcgggggtttacgggttaccggggaccggggtaaaccggggtaaaccgtaaccggttccggtaccggggtaaccccggttcccgggttacggggtacccaacccggtaccccggaaacgggtccccgttccccggtaccccccggttcgggtaccccg

SEQ ID NO: 80247 - DNA, 276 bp, Homo sapiens
  misc_feature: GYAE6OF01B0992.44.25.C03.1.454.CMB.1.raw
  modified_base (241)..(276): a, c, t, g, unknown or other
  misc_feature (241)..(276): n is a, c, g, or t
tcagacagtatatacacgaccggtgctcgatttagtagtgtagatttgggtttgggtgcccaagcgtgctggagggcacggtcaccacggtcaccgtctcctcagcttccaccaagggcccatcggtcttccccctggcgccctgctccaggagcacctctgggggcacagcggccctgggctgcctggtcaaggactacttcctatatactgtctgagcgggctggcaaaggcgcatagnnnnnnnnnnnnnnnnnnnnnnnnnnnnnnnnnnnn

SEQ ID NO: 80248 - DNA, 240 bp, Homo sapiens; identical to SEQ ID NO: 79965
  misc_feature: GYAE6OF01AZPV6.44.25.C03.1.454.CMB.1.raw
  modified_base (239)..(240): a, c, t, g, unknown or other
  misc_feature (239)..(240): n is a, c, g, or t

SEQ ID NO: 80249 - DNA, 541 bp, Homo sapiens
  misc_feature: GYAE6OF01B98R6.44.25.C03.1.454.CMB.1.raw
  modified_base (444)..(444): a, c, t, g, unknown or other
  misc_feature (444)..(444): n is a, c, g, or t
  modified_base (494)..(494): a, c, t, g, unknown or other
  misc_feature (494)..(494): n is a, c, g, or t
tcagacagtatatacacgaccggtgctcgatttagtagtgtagatttgggtttgggggactcctgtgccccaccatggacactctttgctacacactcctgctgctgaccaccccttcctgggtcttgtcccaggtcaccttgaaggagtctggtcctgtgctggtgaaacccacagagaccctcacgctgacctgcaccatctctgggttctctctcaacgatattagaatgggtgtgagctggatccgtcagccccagggaaggccctggagtggcttgcacacatcttctcgaatgaacgaaaatcctacagtacatctctagaagagcaagtttaaccatctaccaaggacacctacaaaagcaggtgtcttagtatgacaacagtacgacctgcgacacgaggcacatatactgtgcgaggtaatgacggaaagaacgngtacgttggttactagttattatagtcttacatcgtggagtcgtcggganaaacgggccacggtctaccgtctccctagacgtccgtccgtaacccg

SEQ ID NO: 80250 - DNA, 259 bp, Homo sapiens
  misc_feature: GYAE6OF01BOBW1.44.25.C03.1.454.CMB.1.raw
  modified_base (251)..(252): a, c, t, g, unknown or other
  misc_feature (251)..(252): n is a, c, g, or t
  modified_base (254)..(259): a, c, t, g, unknown or other
  misc_feature (254)..(259): n is a, c, g, or t
tcagacagtatatacacgaccggtgctcgatttagtagtgtagatttgggtttgggtcgcccaagctgctggagggcgacggtcaccgacggtcaccgtctcctcagcttccaccgaagggcccatcggtcttcccctggcgccctgctcaggagcacgtcgtcggggcacgagcggccctgggcctcgcctggtcaaggtactacttcctactatactgtctgacgtcgggctggcaaggcgacagtagnnannnnnn

SEQ ID NO: 80251 - DNA, 753 bp, Homo sapiens
  misc_feature: GYAE6OF01DSMVO.44.25.C03.1.454.CMB.1.raw
  modified_base (214)..(214): a, c, t, g, unknown or other
  misc_feature (214)..(214): n is a, c, g, or t
  modified_base (249)..(249): a, c, t, g, unknown or other
  misc_feature (249)..(249): n is a, c, g, or t
  modified_base (568)..(568): a, c, t, g, unknown or other
  misc_feature (568)..(568): n is a, c, g, or t
tcagacagtatatacacgaccggtgctcgatttagtagtgtagatttgggtttgggggcttcagctgtgggcacaagaggcagcactcaggacaatctccagcatggcctggtctcctctcctcctcactctcctcgctcactgcacgagggtcctgggcccactctgtgctgacgcacgccgcctcaggtcgtccggtcggggccccgggganaggacgggtccaccatcctcctgcacgtggggacncgaagactaccaaactagtcgggacaggtacttactgatcgtaccacgtcggtaacccaactaccttaccgaacggaacctaccgaccccctaaactcctactaacttcgtttacggaaactacgtacgtcccggcctacggtacgggttccctacgggtacctactttccgtacgtcggtacccttacgtaagtccgtttacggccctaccgtaccgtacgtccccgttcccgtaccggacctacgtcccgtaacgtcgggtcctaccgaggtacctaggaacgtagttacgggtacgggtattaacgtttagttcgnggttactacggtacctacgtaaatttacgtaaaccggtaaggttaaaccggtaaaaccctttacgtttaacccgtaaggtttacccggaccgtaacgggtaaccgggaacccgttaaggtcccgttaacccgggtaacccgttacccggtaaccggtacccgtaacccggtccccggtaacccgg

SEQ ID NO: 80252 - DNA, 232 bp, Homo sapiens
  misc_feature: GYAE6OF01EQY4G.44.25.C03.1.454.CMB.1.raw
  modified_base (211)..(211): a, c, t, g, unknown or other
  misc_feature (211)..(211): n is a, c, g, or t
  modified_base (217)..(232): a, c, t, g, unknown or other
  misc_feature (217)..(232): n is a, c, g, or t
tcagacagtatatacacgaccggtgctcgatttagtagtgtagatttgggtttggggggaagaggaagactgacggtcctccaggagttcaggtgctgggcaccttgggcagtgggggaggtgtgtcacaagatttgggctctgggcacagcggccctgggctgcctggtcaaggctacttccagtctactgctgagcggctggcaaggcncatagnnnnnnnnnnnnnnnn

SEQ ID NO: 80253 - DNA, 751 bp, Homo sapiens
  misc_feature: GYAE6OF01DEVJE.44.25.C03.1.454.CMB.1.raw
  modified_base (230)..(230): a, c, t, g, unknown or other
  misc_feature (230)..(230): n is a, c, g, or t
tcagacagtatatacacgaccggtgctcgatttagtagtgtagatttgggtttgggggggcacaagaggcagcactcaggacaatctccagcatggcctggtctcctctcctcctcactctcctcgctcactgcacagggtcctgggcccactctgtgctgacgcagcccgccctcagtgtcgtcgggggccccggggcaggagggtccaccatctcctgcacgtgggancagactccaacagtcggggacagattctgatcgtccacgtcggtaacccaacctacccttaccgaaggaaccaccgtacccccccaaaacttccctactaacgtttccttttaacggtaaacctaaccttaacgtcccgggtacccccttcgtaacgggggttccccctacggaacccgttatttcctcgtcggtccctaccgaacgttccttcggacctacccgttccgacgtccccctcccgttcggcccctaacgttcctacggttccgggcccttaccgacgggtccttaacggaaggtaacgtagggtacgggttagtaacgtttaactttaccgtcggtaccctacgttacctaagtcggtaaccaggtaccctacgtcccgtaggtagggtttgggtttcgggtcgggttaccgggtaccggggaccggaaccgtacggtccgtacggtacccggttccggtagggtaccacggcccggtaaggtcccgttacccggcccccgttcggtacccg

SEQ ID NO: 80254 - DNA, 194 bp, Homo sapiens
  misc_feature: GYAE6OF01C7Q6V.44.25.C03.1.454.CMB.1.raw
  modified_base (189)..(194): a, c, t, g, unknown or other
  misc_feature (189)..(194): n is a, c, g, or t
tcagacagtatatacacgaccggtgctcgatttagtagtgtagatttgggtttgggggaggtgtgtcacaagatttgggctctgggcaccgtgggcacggggaggtgtgtcacaagatttgggccctgggctgcctggtcaaggactacttccacgtctactgctgagcgggctggcaaggcgcatagnnnnnn

SEQ ID NO: 80255 - DNA, 479 bp, Homo sapiens
  misc_feature: GYAE6OF01DB7MQ.44.25.C03.1.454.CMB.1.raw
  modified_base (468)..(479): a, c, t, g, unknown or other
  misc_feature (468)..(479): n is a, c, g, or t
tcagacagtatatacacgaccggtgctcgatttagtagtgtagatttgggtttgggggggcagagggtcaccatctcctgcactgggagcagatccaacatcgggacagattctgatgtccactggtaccaacaccttccaggaacacgcccccaaactcctcatctttaggtaacaactatcggccctcgacggggtccctgaccgattctctggcctccaagtctggccacctcacgcctccctggccatcacgtgggcctccgaggctagaagataggagggtgtaattattactgcctagtcctatgacagcacgcctcgaggtggttgggtcgttcggcggagggaccaagctcgacgtcgtggtcacgcccgaagctacgccccgtggtcactcctcgttccccgtcccttcctactactatacttgtctagcggtcggcgtggacaaggcgacaagtagcnnnnnnnnnnnn

SEQ ID NO: 80256 - DNA, 554 bp, Homo sapiens
  misc_feature: GYAE6OF01EKHKK.44.25.C03.1.454.CMB.1.raw
  modified_base (270)..(270): a, c, t, g, unknown or other
  misc_feature (270)..(270): n is a, c, g, or t
tcagacagtatatacacgaccggtgctcgatttagtagtgtagatttgggtttggggggaagaggaagactgacggtcctcccaggagttcaggtgctgggcaccttgggcacgggggaggtgtgtcacaagatttgggctctgggcaccgtgggcagtgggggaggtgtgtcacaagatttggactcctgtgccccacatggacactctttgctacacactcctgctgctgacccacccttctgggtcttgcccaggtcacttgaaggngtctggtcctgtgctggtgaaacccacagagaccctcacgctgacctgcaccatctctgggttctctctcaacgatattagaatgggtgtgagctggatccgtcacgccccgagggaacgcccgtggacgtggcttgcacactatcttctacgaatgaacgaaaatcctaacagtacatctctagaagagactaagttaaccacttactaccgaaggaccaccgtaccgaaagcgaggttgttactttagtatacgaacctaacacgtaggacctgcggaaccg

SEQ ID NO: 80257 - DNA, 617 bp, Homo sapiens
  misc_feature: GYAE6OF01EQ3LT.44.25.C03.1.454.CMB.1.raw
  modified_base (596)..(596): a, c, t, g, unknown or other
  misc_feature (596)..(596): n is a, c, g, or t
tcagacagtatatacacgaccggtgctcgatttagtagtgtagatttgggtttgggggactcctgtgccccaccatggacactctttgctacacactcctgctgctgaccaccccttcctgggtcttgtcccaggtcaccttgaaggagtctggtcctgtgctggtgaaacccacagagaccctcacgctgacctgcaccatctctgggttctctctcaacgatattagaatgggtgtgagctggatccgtcacgcccccgagggaaggccctggagtggcttgcacacatcttctcgaatgaacgaaaaactcctacagtacatctctgaagagctagttaaccatctaccaaggacacctaccaaaaggcaggtggttactttagtagtagaaccaacatcggacccctggaccggaaccagacggacaactataacttacgtgtcgacgtaacgggtaatcggaaccgggtaaagaaacaggtacgttcggttttacgtagtttaattagttaacgttaccttacagtttcgtggtacgttcggtacggggacgaaacgggccgtaaccgggtccgacccggttctaccgtanacgtccctaccgaaacccggg

SEQ ID NO: 80258 - DNA, 607 bp, Homo sapiens
  misc_feature: GYAE6OF01CDRGU.44.25.C03.1.454.CMB.1.raw
tcagacagtatatacacgaccggtgctcgatttagtagtgtagatttgggtttgggggactcctgtgccccaccatggacactctttgctacacactcctgctgctgaccacccttcctgggtcttgtcccaggtcaccttgaaggagtctggtcctgtgctggtgaaacccacagagaccctcacgctgacctgcaccatctctgggttctctctcaacgatattagaatgggtgtgagctggatcccgtcacgcccccagggaacggcctggagtggcttgcacacatctctacgaatgaacgaaaatcctaacagtacatctactagaagagactaagtttaaccatctaccaagacacctacaaaggcaggtgtctttagtatcgaacatagtacggaccctggaccgacacgaggcaactatacttacgtgtacacggtaaggtaagtacgggaacgggaaaacgaacgtaaggtcgttaggtttacttagttaacttaattaacgttctaacctatcgtaggaccgttcggacggggtacgaaaacgggccctaaccgggtactaccccggtctacctacgacgtccttaccccgaaccgg

SEQ ID NO: 80259 - DNA, 243 bp, Homo sapiens; identical to SEQ ID NO: 80070
  misc_feature: GYAE6OF01BI3JF.44.25.C03.1.454.CMB.1.raw
  modified_base (239)..(243): a, c, t, g, unknown or other
  misc_feature (239)..(243): n is a, c, g, or t

SEQ ID NO: 80260 - DNA, 241 bp, Homo sapiens; identical to SEQ ID NO: 79947
  misc_feature: GYAE6OF01CC5MT.44.25.C03.1.454.CMB.1.raw
  modified_base (239)..(241): a, c, t, g, unknown or other
  misc_feature (239)..(241): n is a, c, g, or t

SEQ ID NO: 80261 - DNA, 242 bp, Homo sapiens
  misc_feature: GYAE6OF01A72U3.44.25.C03.1.454.CMB.1.raw
  modified_base (239)..(242): a, c, t, g, unknown or other
  misc_feature (239)..(242): n is a, c, g, or t
tcagacagtatatacacgaccggtgctcgatttagtagtgtagatttgggtttgggtgcccaagctgctggagggcacggtcaccacggtcaccgtctcctcagcttccaccaagggtccatcggtcttccccctggcgccctgctccaggagcacctctgggggcacagcggccctgggctgcctggtcaaggactacttcctatatactgtctgagcgggctggcaaggcgcatagnnnn

SEQ ID NO: 80262 - DNA, 223 bp, Homo sapiens
  misc_feature: GYAE6OF01A78W4.44.25.C03.1.454.CMB.1.raw
  modified_base (219)..(223): a, c, t, g, unknown or other
  misc_feature (219)..(223): n is a, c, g, or t
tcagacagtatatacacgaccggtgctcgatttagtagtgtagatttgggtttgggggaagaggaagactgacggtcctcccaggagttcaggtgctgggcaccttgggcatgggggaggtgtgtcacaagatttgggctctgggcacagcggccctgggctgcctggtcaaggactacttcctcgatcgcgtctgagcgggctggcaaggcgcatagnnnnn

SEQ ID NO: 80263 - DNA, 243 bp, Homo sapiens; identical to SEQ ID NO: 80006
  misc_feature: GYAE6OF01BKU6A.44.25.C03.1.454.CMB.1.raw
  modified_base (239)..(243): a, c, t, g, unknown or other
  misc_feature (239)..(243): n is a, c, g, or t

SEQ ID NO: 80264 - DNA, 131 bp, Homo sapiens; identical to SEQ ID NO: 79984
  misc_feature: GYAE6OF01EWN6B.44.25.C03.1.454.CMB.1.raw
  modified_base (130)..(131): a, c, t, g, unknown or other
  misc_feature (130)..(131): n is a, c, g, or t

SEQ ID NO: 80265 - DNA, 634 bp, Homo sapiens
  misc_feature: GYAE6OF01BO5DS.44.25.C03.1.454.CMB.1.raw
  modified_base (371)..(371): a, c, t, g, unknown or other
  misc_feature (371)..(371): n is a, c, g, or t
  modified_base (489)..(489): a, c, t, g, unknown or other
  misc_feature (489)..(489): n is a, c, g, or t
tcagacagtatatacacgaccggtgctcgatttagtagtgtagatttgggtttgggggggcacaagaggcagcactcaggacaatctccagcatggcctggtctcctctcctcctcactctcctcgctcactgcacagggtcctgggcccactctgtgctgacgcagccgccctcagtgtccgggactcctggtcagtcggtcaccatcttctgttcttccagtcgacaattccactggccctttaaagtctctatcatggtacgcaggtcggtcccgggccgacgacccccgaaagtccctactttacgaccgttcctttcggcggtcttcggctcgtccgtggtccgttttcgcctctagtctcgaccncgcgccctccctcgaccactccaacctaaccgtccggtcctagacggagtgacggtctagtactttacgttttggttgtacgctaatttactttcgtacttactaccttactaaattnttcgttacgttacggtaacggtccggggacccgtcgttccgacgtccgtcctgccgtcgaccgacccaaacggacccctaaacccgtcttcgtacctaccgttcttcccgttaccccctacccttaccttcctacttacgtaccg

SEQ ID NO: 80266 - DNA, 309 bp, Homo sapiens
  misc_feature: GYAE6OF01EKPP3.44.25.C03.1.454.CMB.1.raw
  modified_base (297)..(309): a, c, t, g, unknown or other
  misc_feature (297)..(309): n is a, c, g, or t
tcagacagtatatacacgaccggtgctcgatttagtagtgtagatttgggtttggggggtgtggtggtctccactcccgccttgacggggctgctatctgcctccctggccatcactgggctccaggctgaagatgagggtgattattactgccagtcctatgacagcagcctcagtggttgggtgttcggcggagggaccaagctgaccgtcctgggtcagcccaaggctgcccctcggtcactctgtcccgcctcctctatatactgtctgagcgggctggcaaaggcgcatagnnnnnnnnnnnnn

SEQ ID NO: 80267 - DNA, 706 bp, Homo sapiens
  misc_feature: GYAE6OF01DM1IL.44.25.C03.1.454.CMB.1.raw
  modified_base (294)..(294): a, c, t, g, unknown or other
  misc_feature (294)..(294): n is a, c, g, or t
tcagacagtatatacacgaccggtgctcgatttagtagtgtagatttgggtttgggggctgttcctggaaggtgttggtaccagtggacatcagaatctgtcccgatgttggatctgctcccagtgcaggagatggtgacccctctcggcccccggggccccagacactggagggcggctgcgtcagcacagaggtcgggcccaggaccctgtgcaggtgagcgaggagagtggaggaggagaggacgaccgaggccatggctaggagtattcggtcctggagtgctcgccttnttcgtcgcccagagcgtaggaacgcgaagaccgacctacctaaaccttcctactacttaccgtttaggtaaaactacttacgtcccggccctacggtacggggtccctacggtaccgtattcctacgtcggtcctaccgtaagtcgtacgcctaccctcgacccgtccctcccgtcgacctacgttccgaccggtcgggccctacgacggtctaggaagtagtacgggtagggttattaacgtttacgttaccgtcgtacccgttaacgttcccttaggtaccgaaccgacgtacccgtaccgtaccggttacggttaggggtttacggggtttcgggggttacggttacccgggggacgggttaacgggaacccgtaaggtcccggttaccgggtacccggttacccgggg

SEQ ID NO: 80268 - DNA, 259 bp, Homo sapiens
  misc_feature: GYAE6OF01EX17D.44.25.C03.1.454.CMB.1.raw
  modified_base (223)..(259): a, c, t, g, unknown or other
  misc_feature (223)..(259): n is a, c, g, or t
tcagacagtatatacacgaccggtgctcgatttagtagtgtagatttgggtttgggggggaaggaggaagactgacggtcctcccaggagttcaggtgctgggccaccttgggcacgggggagtgtgtcacaagatttggctctgggcacagcggccctgggctgcctggtcaaggactacttcctatatactgtctgagcgggtctgggcaaggcgcatagnnnnnnnnnnnnnnnnnnnnnnnnnnnnnnnnnnnnn

SEQ ID NO: 80269 - DNA, 776 bp, Homo sapiens
  misc_feature: GYAE6OF01DFAG4.44.25.C03.1.454.CMB.1.raw
  modified_base (152)..(152): a, c, t, g, unknown or other
  misc_feature (152)..(152): n is a, c, g, or t
  modified_base (181)..(181): a, c, t, g, unknown or other
  misc_feature (181)..(181): n is a, c, g, or t
tcagacagtatatacacgaccggtgctcgatttagtagtgtagatttgggtttgggggacgtcctgtcgccccaccactggacactctttcgctacacactcctgctgctgaccacccttcctgggtcttgtcccaggttcacgttgaaggngtctggtcctggtgctggtacgaaacccncgagacgaccctcgacgctgaccgtgcacgatctcgtgggttctctctacgaacgtattaagttagaagtgggtgtgagtctggactccgacgaccgcccgagggacgtcctggagtggcgttcgcacgactacgtcgttcacgtaagtagaaacgtaaaatccgtaacgacgtactactactacgtaggaacgtacgaacgttaacgtttaacacgttactaaccgaaacggtaccaaccgtaacgaaaacggcgtaacgggttacgtttacgtttaagtactaacggaaacctaaagtcgtacccggtaccgacgaccggaaccgaacgacgggtaccaaacgttacgttaacgtttacgtggtaacggtaccggtaaagggttaacgaacgggaaacgggaaaacgaaacgtacgggtaccgtttacgggtttacttaacgttaaatttacggttaaacgttacgtaaccgtaaggttaccggacggttaccggtaacggtaacggggaaacctaaacggggcccgtttaacggcccgttaaacccggttcctacccgtacgtacccgttaccgtaccccggttaaacccgg

SEQ ID NO: 80270 - DNA, 601 bp, Homo sapiens
  misc_feature: GYAE6OF01AO89Y.44.25.C03.1.454.CMB.1.raw
tcagacagtatatacacgaccggtgctcgatttagtagtgtagatttgggtttgggggaagaggaagactgacggtcctcccaggagttcaggtgctgggcaccttgggcacgggggaggtgtgtcacaagatttgggctctgggcaccgtgggcatgggggagtgtgtcacaagatttggactcctgtcgccccaccatggacactctttgctacacactcctgctgctgaccacccttctggtcttgtcccaggtcaccttgaaggagtctggtcctgtgcgtggtacgaaacccacagacgacccctcacgcgtcgacctcgccaccatctcgtggttctctctcaacgtatacttagaacgtgggtgtgagcgtggactccgtcaccgccccgaagggacgtccgtaggagtcggtcttgctacactactcttacgacgtaagtacgaacgtaaaactcctaacacgtacctactactacgtacgaagtacgtacgtaacgtttaaccacttccaccgaacgaccacctaaccgaaagcgtacggttaggttacgttgtacgtacaaccgaactacgtaccgacctggacgtaaccg

SEQ ID NO: 80271 - DNA, 219 bp, Homo sapiens; identical to SEQ ID NO: 80027
  misc_feature: GYAE6OF01BS7LN.44.25.C03.1.454.CMB.1.raw
  modified_base (219)..(219): a, c, t, g, unknown or other
  misc_feature (219)..(219): n is a, c, g, or t

SEQ ID NO: 80272 - DNA, 243 bp, Homo sapiens
  misc_feature: GYAE6OF01DS0LB.44.25.C03.1.454.CMB.1.raw
  modified_base (238)..(243): a, c, t, g, unknown or other
  misc_feature (238)..(243): n is a, c, g, or t
tcagacagtatatacacgaccggtgctcgatttagtagtgtagatttggttttgggtgcccaagctgctggagggcacggtcaccacggtcaccgtctcctcagcttccaccaagggcccatcggtcttcccctggcgccctgctccaggagcacctctgggggcacagcggccctgggctgcctggtcaaggactacttcctatatactgtctgagcgggctggcaaggcgcatagnnnnnn

SEQ ID NO: 80273 - DNA, 244 bp, Homo sapiens; identical to SEQ ID NO: 80207
  misc_feature: GYAE6OF01EF0SY.44.25.C03.1.454.CMB.1.raw
  modified_base (239)..(244): a, c, t, g, unknown or other
  misc_feature (239)..(244): n is a, c, g, or t

SEQ ID NO: 80274 - DNA, 234 bp, Homo sapiens
  misc_feature: GYAE6OF01CS8ZK.44.25.C03.1.454.CMB.1.raw
  modified_base (226)..(234): a, c, t, g, unknown or other
  misc_feature (226)..(234): n is a, c, g, or t
tcagacagtatatacacgaccggtgctcgatttagtagtgtagatttgggtttggggggaagaggaagactgacggtcctcccaggagttcaggtgctgggcaccgttgggcacggggggaggtgtgtcacaagatttgggctcgtgggcacaggcggccctgggctgcctggtcaaggactacttcctcgatcgcgtctggagcgggctggcaagggcgcatagnnnnnnnnn

SEQ ID NO: 80275 - DNA, 636 bp, Homo sapiens
  misc_feature: GYAE6OF01D62SA.44.25.C03.1.454.CMB.1.raw
  modified_base (299)..(299): a, c, t, g, unknown or other
  misc_feature (299)..(299): n is a, c, g, or t
  modified_base (342)..(342): a, c, t, g, unknown or other
  misc_feature (342)..(342): n is a, c, g, or t
tcagacagtatatacacgaccggtgctcgatttagtagtgtagatttgggtttgggggaagaggaagactgacggtcctcccaggagttcaggtgctgggcaccttgggcacgggggaggtgtgtcacaagatttgggctctgggcaccgtgggcatgggggagtgtgtcacaagatttggactcctgtgccccacatggacactctttgctacacactcctgctgctgaccacccttctgggtcttgtcccaggtcaccttgaaggagtctggtcctgtgctggtgaaacccacaganaccctcacgctgacctgcaccatctctggttctctctcaacgntaattagaatgggtgtgagctggactccgtcacgccccagggaacgcccgtaggagtggcttcgcacacgatcttactacgaactagaactaaaaactccttaaacgacgtaacgtatcgttactaggaaagtacggtacttaacgttttaaaccgaacttacctacccgaaacggtaacctaacccgtaacccgaaaaagggaccgtaacgggttaggttacgtttttaaggtaacgttacggaaaccctaaaccgtaaattaccgggtaaacccctgggtcccggaaacccg

SEQ ID NO: 80276 - DNA, 292 bp, Homo sapiens
  misc_feature: GYAE6OF01DCWUQ.44.25.C03.1.454.CMB.1.raw
  modified_base (279)..(292): a, c, t, g, unknown or other
  misc_feature (279)..(292): n is a, c, g, or t
tcagacagtatatacacgaccggtgctcgatttagtagtgtagatttgggtttgggggaagaggaagactgacggtcctcccaggagttcaggtgctgggcaccttgggcagtgggggaggtgtgtcacaagtatttgggctctgggcaccggtgggcacgggggagtgtgtcaacaagtagtttgggctcgtgggcacgaggcggccctgggctggccgtggtcaaggtacttacgttctatatactgtctgagcgggctggacaaggcgacagtagnnnnnnnnnnnnnn

SEQ ID NO: 80277 - DNA, 245 bp, Homo sapiens
  misc_feature: GYAE6OF01ESEF2.44.25.C03.1.454.CMB.1.raw
  modified_base (238)..(245): a, c, t, g, unknown or other
  misc_feature (238)..(245): n is a, c, g, or t
tcagacagtatatacacgaccggtgctcgatttagtagtgtagatttgggtttgggtgcccaagctgctggagggcacggtcaccacggtcaccgtctcctcagcttccaccaagggcccatcggtcttccccctgcgccctgctccaggagcacctctgggggcacagcggccctgggctgcctggtcaaggactacttcctatatactgtctgagcgggctggcaaggcgcatagnnnnnnnn

SEQ ID NO: 80278 - DNA, 667 bp, Homo sapiens
  misc_feature: GYAE6OF01E31KF.44.25.C03.1.454.CMB.1.raw
  modified_base (274)..(274): a, c, t, g, unknown or other
  misc_feature (274)..(274): n is a, c, g, or t
tcagacagtatatacacgaccggtgctcgatttagtagtgtagatttgggtttggggggaagaggaagactgacggtcctcccaggagttcaggtgctgggcaccttgggcacgggggaggtgtgtcacaagatttgggctctgggcaccgtgggcagtgggggagtgtgtcacaagatttggactcctgtgccccacatggacactctttgctacacactcctgctgctcgacccctaccccttctgggtcttcgtcccaggtcacttgaggngtctgtcctgtgctggtacgaacccagacgacgaccctcacgtctgaccctgaccacctactcctcgtcgggttcctcctctactaacgattaagttagaagtggggtgtgagtcgtggtactcccggtacaccggcccccgaaggggacgcccgtgggagtcggtcttcggaccactactacttccttactacgtaatacggtaaaccgtaaaacttaccctaacgtaacgtaccaacttcctacgtaagtaacgagtacctaacgtttaacccacgttaccgtaccgaaacggtaccctaacccgtaaccgaaaacggtccggtacgggttacgttacgtttacgtacgtacgaaaccctaacgacgtacggtacccgtggaccgtaaccg

SEQ ID NO: 80279 - DNA, 579 bp, Homo sapiens
  misc_feature: GYAE6OF01BTOGG.44.25.C03.1.454.CMB.1.raw
  modified_base (459)..(459): a, c, t, g, unknown or other
  misc_feature (459)..(459): n is a, c, g, or t
tcagacagtatatacacgaccggtgctcgatttagtagtgtagatttgggtttggggggggtcacaagaggcagcgctctcgggacgtctccaccatggcctgggctctgctgctcctcactctcctcacccaggacacagggtcctgggcccagtctgccctgactcagcctgcctccgtgtctgggtcgcctggacagtcggtcaccatctcctgcactggacgccagcggtaatattcttagtcttaactttgtctcctggtatcaacatcatccaggtaaacgcccccaaactcatcatctatgagtcctataagcggtccctgtagggtttctaatcgtcttcactgcctccaacgtccggacaaccgaccggccctcccgtagaactaactcctcgtcgggcctccgaggctggacgggtacgaggtctagtatttattacgtgcacgtctanatacgtagtaaggtacggaacttacgtttacttacgttcggacgacgaacggaccaacgcgtacgaccgtcgtaggacacgacccgacggtcctcccggacccctggtctcctcgtcccg

SEQ ID NO: 80280 - DNA, 683 bp, Homo sapiens
  misc_feature: GYAE6OF01DX3IV.44.25.C03.1.454.CMB.1.raw
  modified_base (216)..(216): a, c, t, g, unknown or other
  misc_feature (216)..(216): n is a, c, g, or t
  modified_base (372)..(372): a, c, t, g, unknown or other
  misc_feature (372)..(372): n is a, c, g, or t
  modified_base (660)..(660): a, c, t, g, unknown or other
  misc_feature (660)..(660): n is a, c, g, or t
  modified_base (672)..(672): a, c, t, g, unknown or other
  misc_feature (672)..(672): n is a, c, g, or t
tcagacagtatatacacgaccggtgctcgatttagtagtgtagatttgggtttggggggaagaggaagactgacggtcctcccaggagttcaggtgctgggcaccttgggcacgggggagtgtgtcacaagatttgggctctgggcaccgtgggcatgggagaggtgtgtcacaagatttggactcctgtgccccacatggacactctttgctacncactcctgctgctgaccctaccccttcgtgggtcttacggtcccctaggtccaccgtttaggaaacggtacgttccgttcgggttccctggtcgccgttcggtacgaaaccccacacggtaacgaccccttacaccgctacggaccctgccaaccngtctcgttcggttcctctctacgaacgtattaacgtagaagttgggtgtagtcggtctacggtactccgtacgaccggtacccccgaaggggacccgtcccgtagggtacgtcggtacgttggaccaactacctacgttcgttaccgtaacgtaacgtacgaaaccggtaaaacgttccctaaacgtacgtactacgtacgttaacgtaccgaagtacgtaccttaacgttacctacgtaccgtaccaacggtacctacgtacgaaacgcgtaggtcgtacttaaganacgtaacactancgacgtcgacg

SEQ ID NO: 80281 - DNA, 548 bp, Homo sapiens
  misc_feature: GYAE6OF01C77P6.44.25.C03.1.454.CMB.1.raw
  modified_base (328)..(328): a, c, t, g, unknown or other
  misc_feature (328)..(328): n is a, c, g, or t
  modified_base (366)..(366): a, c, t, g, unknown or other
  misc_feature (366)..(366): n is a, c, g, or t
  modified_base (379)..(379): a, c, t, g, unknown or other
  misc_feature (379)..(379): n is a, c, g, or t
  modified_base (395)..(395): a, c, t, g, unknown or other
  misc_feature (395)..(395): n is a, c, g, or t
  modified_base (409)..(409): a, c, t, g, unknown or other
  misc_feature (409)..(409): n is a, c, g, or t
  modified_base (469)..(469): a, c, t, g, unknown or other
  misc_feature (469)..(469): n is a, c, g, or t
  modified_base (475)..(475): a, c, t, g, unknown or other
  misc_feature (475)..(475): n is a, c, g, or t
tcagacagtatatacacgaccggtgctcgatttagtagtgtagatttgggtttgggggactcctgtgccccaccatggacactctttgctacacactcctgctgctgaccacccttcctgggtcttgtcccaggtcaccttgaaggagtctggtcctgtgctggtgaaacccacagagaccctcacgctgacctgcaccatctctgggttctctctcaacgatattagaatgggtgtgagctggatccgtcacgccccagggaaggcccgtggagtggcttgcacacatctctcgaatgaacgaaaatcctacagtacatctctgaangctagttaccatctacagacacctacaaagcaggtgtntttagatgacaantacgacctgcgacacnggcacatatactgngcgacgggtataggacgggaaagaacagcttaggtttctgtattataagttcttaaccgnttacgnggtacgtcgtggggactaaacgggaccgtcgggtacctaccggtacctcctacacgtcctcccgtaacccggg

SEQ ID NO: 80282 - DNA, 134 bp, Homo sapiens
  misc_feature: GYAE6OF01EKJVS.44.25.C03.1.454.CMB.1.raw
  modified_base (130)..(134): a, c, t, g, unknown or other
  misc_feature (130)..(134): n is a, c, g, or t
tcagacagtatatacacgaccggtgctcgatttagtagtgtagatttgggtttgggcacagcggccctgggctgcctggtcaaggactacttcctcgatcgcgtctgagcgggctggcaaggcgcatagnnnnn

SEQ ID NO: 80283 - DNA, 706 bp, Homo sapiens
  misc_feature: GYAE6OF01ETDXR.44.25.C03.1.454.CMB.1.raw
  modified_base (261)..(261): a, c, t, g, unknown or other
  misc_feature (261)..(261): n is a, c, g, or t
tcagacagtatatacacgaccggtgctcgatttagtagtgtagatttgggtttgggggggcacaagaggcagcactcaggacaatctccagcatggcctggtctcctctcctcctcactctcctcgctcactgcacagggtcctgggcccactctgtgctgacgcagcccgccctcagtgtcgtcgggggccccggggcaggagggtcaccatcctcctgcacgtggggacgcagactaccaacagtcgggacagtattcngatcgtccactggtaccaactaccttcgaggaacaccgacccccaaactcctcacttcgtttacgtaacaactacgtccggcctcgacggggttccctaggtaccgtattccgtcgtcggcctaccgaagtcgtcggcctacctcaccgcccttcccgcggcctactccgacgtcgggtcctaccgaggtacgtagaaacggtagtagggacgggttagtaacttttaacgttaccgtcgacccttacgttacccttaagtacgaaccgacgaccgtacgtacccgttcggtaaggggtttcgggtttacgggggttcggtttccgggggaacggggaaccgggtaaacccgtaaggtcccggtacgggtcccggtccgggttagggtacccgaacggaccccggtaaacggtcccgtacccggtcccccggttcgggttaaccc

SEQ ID NO: 80284 - DNA, 555 bp, Homo sapiens
  misc_feature: GYAE6OF01DU35M.44.25.C03.1.454.CMB.1.raw
  modified_base (443)..(443): a, c, t, g, unknown or other
  misc_feature (443)..(443): n is a, c, g, or t
tcagacagtatatacacgaccggtgctcgatttagtagtgtagatttgggtttgggggaagaggaagactgacggtcctcccaggagttcaggtgctgggcaccttgggcacgggggaggtgtgtcacaagatttgggctctgggcaccgtgggcatgggggagtgtgtcacaagatttggactcccgtgccccaccatggacactctttgctacacactcctgctgctgacccacccttctggtcttgcccaggtcaccttgagatctggtcctgtgctggtgtaaacccacagagacctcacgctgacctgcaccatctctggttctctctcaacgatattacgaatggtgtgagctggatccgtcagcccccagggaacgccctggacgtggcttgcacacatcttctacgaatgacgaaaatcctaacagtacagtctntagaagacgactaacgtttaaccagttactaccaacgtaccaaccttaccaaaacggcaagggtcgttactttaggtactgaccaactactacggaccctcgcggtacaacg

SEQ ID NO: 80285 - DNA, 639 bp, Homo sapiens
  misc_feature: GYAE6OF01AH473.44.25.C03.1.454.CMB.1.raw
  modified_base (310)..(310): a, c, t, g, unknown or other
  misc_feature (310)..(310): n is a, c, g, or t
  modified_base (489)..(489): a, c, t, g, unknown or other
  misc_feature (489)..(489): n is a, c, g, or t
tcagacagtatatacacgaccggtgctcgatttagtagtgtagatttgggtttgggggactcctgtgccccaccatggacactctttgctacacactcctgctgctgaccacccttcctgggtcttgtcccaggtcaccttgaaggagtctggtcctgtgctggtgaaacccacagagaccctcacgctgacctgcaccatctctgggttctctctcaacgatattagaatgggtgtgagctggatccgtcacgccccgagggaacggccctggagtggcttgcacacatcttctcgaatgaacgaaaancctacagtacatctctgaagagactagttaaccatacctacaaacggaccaacctacgaaaacggtcgaggttacggttactttaagtactacgaaccaacgtacgtcggtaccctggaccggaacacgaggcaactagttacttacgtgtacgacgtaagggtactggaacgggaaanaacgagtacgttggtttactgttaattagtaagttccttaacgacgttcgtacgggtacgtacggtagggggtaaccgaaacgggcccgtaccgggttacaacccgtttccgtacccttaccgacggtcccgtttaacccgaacccgggg

SEQ ID NO: 80286 - DNA, 158 bp, Homo sapiens
  misc_feature: GYAE6OF01CLVUU.44.25.C03.1.454.CMB.1.raw
  modified_base (158)..(158): a, c, t, g, unknown or other
  misc_feature (158)..(158): n is a, c, g, or t
tcagacagtatatacacgaccggtgctcgatttagtagtgtagatttgggtttgggggaggtgtgtcacaagatttggctctggcacagcggccctgggctgcctggtcaaggactacttcctatatactgtctgagcgggctggcaaggcgcatagn

SEQ ID NO: 80287 - DNA, 606 bp, Homo sapiens
  misc_feature: GYAE6OF01A0A8M.44.25.C03.1.454.CMB.1.raw
  modified_base (277)..(277): a, c, t, g, unknown or other
  misc_feature (277)..(277): n is a, c, g, or t
  modified_base (303)..(303): a, c, t, g, unknown or other
  misc_feature (303)..(303): n is a, c, g, or t
tcagacagtatatacacgaccggtgctcgatttagtagtgtagatttgggtttggggggaagaggaagactgacggtcctcccaggagttcaggtgctgggcaccttgggcacgggggaggtgtgtcacaagatttgggctctgggcaccgtgggcagtggggggaggtgtgtcacaagatttggactcctgtgccccacatggacacttctttgctacacactcctgctgctgacccaccccttctgggtccttcgtcccaggtcaccttgaaggngtctggtcctgtgctggtcaaacccncagacgaccctcacgctcgacctgccaccatctcgtcggttctctctacaacgtatattagaagtgggtgtgagcgtacggctccgtcaccgcccgaggacgccgtggacgtgctcgcacactactctcgtacgtaatacgaaactaaactcctaacgacgtactactactacgtacgaagtacgacgttaacgttaacactcctaccgaacgtacctaaccgtaaccgaaacggtacgtacgggttagttacgtttaacgtacgtacgtaacctaacgtacgtacggaccctaggcgaaccg

SEQ ID NO: 80288 - DNA, 138 bp, Homo sapiens; identical to SEQ ID NO: 80141
  misc_feature: GYAE6OF01A2HS5.44.25.C03.1.454.CMB.1.raw
  modified_base (130)..(138): a, c, t, g, unknown or other
  misc_feature (130)..(138): n is a, c, g, or t

SEQ ID NO: 80289 - DNA, 494 bp, Homo sapiens
  misc_feature: GYAE6OF01B4UDO.44.25.C03.1.454.CMB.1.raw
  modified_base (338)..(338): a, c, t, g, unknown or other
  misc_feature (338)..(338): n is a, c, g, or t
  modified_base (436)..(436): a, c, t, g, unknown or other
  misc_feature (436)..(436): n is a, c, g, or t
  modified_base (481)..(494): a, c, t, g, unknown or other
  misc_feature (481)..(494): n is a, c, g, or t
tcagacagtatatacacgaccggtgctcgatttagtagtgtagatttgggtttgggggctgttcctggaaggtgttggtaccagagggtcaccatctcctgcactgggagcagatccaaacatcgggacagattctgatgtccactggtaccaacaccttccaggaacagcccccaaaactcctcatctttggtaaacaactatcggccctcgaggggtcccctgaccgtattctctggctccaagtctggcacctcagccctcccgtggccatccactgggctccaggctgaagatggagggtgaattattactgccagtcctatgacagcagcctnaggtggttgggtgttcgggcggagggaccaaagctgaccgtcgtgggtcacgcccgaaaggcctcgccccctgggcactctcgttccccgcccttccncttatatacctgtctggagcggtcgtggacgaaggcgacatagannnnnnnnnnnnnn

SEQ ID NO: 80290 - DNA, 391 bp, Homo sapiens
  misc_feature: GYAE6OF01ABZP4.44.25.C03.1.454.CMB.1.raw
  modified_base (194)..(194): a, c, t, g, unknown or other
  misc_feature (194)..(194): n is a, c, g, or t
  modified_base (228)..(228): a, c, t, g, unknown or other
  misc_feature (228)..(228): n is a, c, g, or t
  modified_base (312)..(312): a, c, t, g, unknown or other
  misc_feature (312)..(312): n is a, c, g, or t
  modified_base (317)..(320): a, c, t, g, unknown or other
  misc_feature (317)..(320): n is a, c, g, or t
  modified_base (322)..(322): a, c, t, g, unknown or other
  misc_feature (322)..(322): n is a, c, g, or t
  modified_base (327)..(327): a, c, t, g, unknown or other
  misc_feature (327)..(327): n is a, c, g, or t
  modified_base (329)..(329): a, c, t, g, unknown or other
  misc_feature (329)..(329): n is a, c, g, or t
  modified_base (333)..(337): a, c, t, g, unknown or other
  misc_feature (333)..(337): n is a, c, g, or t
  modified_base (339)..(342): a, c, t, g, unknown or other
  misc_feature (339)..(342): n is a, c, g, or t
  modified_base (344)..(345): a, c, t, g, unknown or other
  misc_feature (344)..(345): n is a, c, g, or t
  modified_base (349)..(391): a, c, t, g, unknown or other
  misc_feature (349)..(391): n is a, c, g, or t
tcagacagtatatacacgaccggtgctcgatttagtagtgtagatttgggtttggggggggtcacaagaggcagcgctctcgggacgtctccaccatggcctgggctctgctgctcctcactctcctcaccccaggacacagggtccctgggccccagtctgccctgactcagcctgcctccgtgtctgggtcncctggacagtcggtcaccatctcctgcactgganccagcgtcagccccaaggcccaaccccatgtcactctcgttccccacctctcctatactactgtctgagcgggctggcaaggcnatagnnnnangcagntnacgnnnnntnnnntnnatcnnnnnnnnnnnnnnnnnnnnnnnnnnnnnnnnnnnnnnnnnnn

SEQ ID NO: 80291 - DNA, 245 bp, Homo sapiens; identical to SEQ ID NO: 80239
  misc_feature: GYAE6OF01ATN6I.44.25.C03.1.454.CMB.1.raw
  modified_base (239)..(245): a, c, t, g, unknown or other
  misc_feature (239)..(245): n is a, c, g, or t

SEQ ID NO: 80292 - DNA, 244 bp, Homo sapiens
  misc_feature: GYAE6OF01EHYVB.44.25.C03.1.454.CMB.1.raw
  modified_base (237)..(244): a, c, t, g, unknown or other
  misc_feature (237)..(244): n is a, c, g, or t
tcagacagtatatacacgaccggtgctcgatttagtagtgtagatttgggtttgggtgcccaagctgctggagggcacggtcaccacggtcaccgtctcctcagcttccaccaagggcccatcggtcttccccctggcgccctgctccaggagcacctctgggggcacagcggccctgggctgcctggtcaaggactacttctatatactgtctgagcggctggcaaggcgcatagnnnnnnnn

SEQ ID NO: 80293 - DNA, 250 bp, Homo sapiens
  misc_feature: GYAE6OF01CGECO.44.25.C03.1.454.CMB.1.raw
  modified_base (239)..(250): a, c, t, g, unknown or other
  misc_feature (239)..(250): n is a, c, g, or t
tcagacagtatatacacgaccggtgctcgatttagtagtgtagatttgggtttgggtgcccaagctgctggagggcacggtcaccacggtcaccgtctcctcagcttccaccaagggcccatcggtcttccccctggcgccctgctccaggagcacctctgggggcacagcggccctgggctgcctggtcaaggactacttcctcgatcgcgtctgagcgggctggcaaggcgcatagnnnnnnnnnnnn

SEQ ID NO: 80294 - DNA, 307 bp, Homo sapiens
  misc_feature: GYAE6OF01BBI47.44.25.C03.1.454.CMB.1.raw
  modified_base (300)..(307): a, c, t, g, unknown or other
  misc_feature (300)..(307): n is a, c, g, or t
tcagacagtatatacacgaccggtgctcgatttagtagtgtagatttgggtttgggggtgtggtggtctccactcccgccttgacggggctgctatctgcctccctggccatcactgggctccaggctgaagatgagggtgattattactgccagtcctatgacagcagcctcagtggttgggtgttcggcggagggaccaagctgaccgtcctgggtcagcccaaggctcgccccctcggtcactctcgttcccaccctcctctatatactgtctgagcgggctggcaaggcgcatagnnnnnnnn

SEQ ID NO: 80295 - DNA, 599 bp, Homo sapiens
  misc_feature: GYAE6OF01E07CU.44.25.C03.1.454.CMB.1.raw
  modified_base (469)..(469): a, c, t, g, unknown or other
  misc_feature (469)..(469): n is a, c, g, or t
tcagacagtatatacacgaccggtgctcgatttagtagtgtagatttgggtttggggggggaagctcagcttcagctgtgggtagagaagacaggactcaggacgatctccagcatggccagcttccctctcctcctcaccctcctcactcactgtgcagggtcctgggcccagtctgtgatgtctcagccaccctcagcgtctgggacccccgggcagggggtcaccatctcttgttctggaggaagtccaatatcgatcttatctgtcaactggtatcgggactcccaggcccgaccgccccgtacctccatactctactacgtactactaactccgacgcggcccggtccgtacgggtcccgtcgtcccgtacttcgtctcgtacgtccgtacgtcgtacgtacacgtacgtacgtcgtacctcgtcctacgtcttcgtactacgtcctacgtacgtagtagtagngaggtactacgtactacgtacgtcgtagcgagtcgtagtcggacgacgacgacggaccggtacggtcggtcgggtcggtacgggacggtacggtaccgacgtacgtacgtacgtacgtccgcgccgtacg

SEQ ID NO: 80296 - DNA, 576 bp, Homo sapiens
  misc_feature: GYAE6OF01EO5NQ.44.25.C03.1.454.CMB.1.raw
  modified_base (265)..(265): a, c, t, g, unknown or other
  misc_feature (265)..(265): n is a, c, g, or t
  modified_base (340)..(340): a, c, t, g, unknown or other
  misc_feature (340)..(340): n is a, c, g, or t
tcagacagtatatacacgaccggtgctcgatttagtagtgtagatttgggtttggggggaagaggaagactgacggtcctcccaggagttcaggtgctgggcaccttgggcacgggggaggtgtgtcacaagatttgggctctgggcaccgtgggcatgggggagtgtgtcacaagatttggactcctgtgccccacatggacactcttgctacacactcctgctgctgacccacccttctggtcttgcccaggtcacttgaagngtctggtcctgtgctggtgaaaccacagacgaccctcacgctgacctgcaccatctctcggttctctctcaacgntatagaatgggtgtgagctggactcgtcaccgccccgaggacgcccgtggacgtcggcttcgacacacgtacttcttactacgaatacgaacgtaaaactcctaacagtacacttctctagaacgtagactaacgttaaccactctaccgaacgactaccctaaccgaaacggcgtaggttgttacgtttagtactacgaaccctaacgtacgttaggacccgttgccggtaaccg

SEQ ID NO: 80297 - DNA, 557 bp, Homo sapiens
  misc_feature: GYAE6OF01A2R8Z.44.25.C03.1.454.CMB.1.raw
  modified_base (300)..(300): a, c, t, g, unknown or other
  misc_feature (300)..(300): n is a, c, g, or t
  modified_base (392)..(392): a, c, t, g, unknown or other
  misc_feature (392)..(392): n is a, c, g, or t
  modified_base (505)..(505): a, c, t, g, unknown or other
  misc_feature (505)..(505): n is a, c, g, or t
  modified_base (510)..(510): a, c, t, g, unknown or other
  misc_feature (510)..(510): n is a, c, g, or t
  modified_base (522)..(523): a, c, t, g, unknown or other
  misc_feature (522)..(523): n is a, c, g, or t
  modified_base (525)..(525): a, c, t, g, unknown or other
  misc_feature (525)..(525): n is a, c, g, or t
  modified_base (538)..(539): a, c, t, g, unknown or other
  misc_feature (538)..(539): n is a, c, g, or t
  modified_base (541)..(541): a, c, t, g, unknown or other
  misc_feature (541)..(541): n is a, c, g, or t
  modified_base (543)..(544): a, c, t, g, unknown or other
  misc_feature (543)..(544): n is a, c, g, or t
  modified_base (546)..(546): a, c, t, g, unknown or other
  misc_feature (546)..(546): n is a, c, g, or t
  modified_base (548)..(550): a, c, t, g, unknown or other
  misc_feature (548)..(550): n is a, c, g, or t
  modified_base (552)..(552): a, c, t, g, unknown or other
  misc_feature (552)..(552): n is a, c, g, or t
  modified_base (554)..(554): a, c, t, g, unknown or other
  misc_feature (554)..(554): n is a, c, g, or t
tcagacagtatatacacgaccggtgctcgatttagtagtgtagatttgggtttgggggctgttcctggaaggtgttggtaccagagggtcaccatctcctgcactgggagcagatccaacatcgggacaggattctgatgtccactggtaccaacaccttccaggaacacgcccccaaatcctcattctttggtaaacaacgtatccggccctcgacggggtccctggaccgtattctcgtggctccaagtctggcactcacgtcctcctggccatcacgtcggctccgagctgaaacgntgaggtagattactactagcctagtcctaagtcgacagctacgcctcgaggtggttgggtgtcgggacggaggacagctgaccgtcgtggcncgcctaaggctcgccccgttggtaccacgttccgtcgttccccgacccgttcctcgttaatctacgttacgtctggtacgccgggtatcggacgacggcctacgtagttacgnccgtnccgttagccgtnncncgtcgtcgcgatnncncnncncnnncncncgc

SEQ ID NO: 80298 - DNA, 206 bp, Homo sapiens
  misc_feature: GYAE6OF01CA13H.44.25.C03.1.454.CMB.1.raw
  modified_base (191)..(206): a, c, t, g, unknown or other
  misc_feature (191)..(206): n is a, c, g, or t
tcagacagtatatacacgaccggtgctcgatttagtagtgtagatttggggtttgggggaggtgtgtcacaagatttgggctctgggcaccgtgggcacgggggaggtgtgtcacaagatttgggccctgggctgcctggtcaaggactacttcctatatactgtctgagcgggctggcaaggcgcatagnnnnnnnnnnnnnnnn

SEQ ID NO: 80299 - DNA, 810 bp, Homo sapiens
  misc_feature: GYAE6OF01CKD7F.44.25.C03.1.454.CMB.1.raw
  modified_base (199)..(199): a, c, t, g, unknown or other
  misc_feature (199)..(199): n is a, c, g, or t
  modified_base (231)..(231): a, c, t, g, unknown or other
  misc_feature (231)..(231): n is a, c, g, or t
  modified_base (259)..(259): a, c, t, g, unknown or other
  misc_feature (259)..(259): n is a, c, g, or t
tcagacagtatatacacgaccggtgctcgatttagtagtgtagatttgggtttgggggggcacaagaggcagcactcaggacaatctccagcatggcctggtctcctctcctcctcactctcctcgctcactgcacagggtcctgggcccactctgtgctgacgcagcccgccctcagtgtccgtcgggggccccgggnaggacgggtcaccgatctcctgcacgtgggancagactccaacagtcgggacagtattcngatcgtccacgtacgtaaccaacctaccttaccgaacggaacaccgaccccctaaactcctactacttacctttaacggtaaacctaacgttacgtcccggtacccctacggacggggtcccctacgtaacccgtactttccgtccgtcggacccttaccgtaacgttccgtcggaccctaccgttaccgaccgtccccttaccccgtcggaccctacgtccgtaaccggtcgggtaccttacccggtagggtacccttaaggaacggtaagttacggggtaacgggttacgttaaacgttttaactttaccggtacgtacccgttaacgttacccgtttaagacggtaaaccgtaacgtacccgtaaccgtacccgtttacggtaacggggttcggggttttcggggttacgggttaccggggacccggggtaaacgggtaacccgtaacgggttccgttaccgggtaacccgggttccggtacggggttaccaaccggtacccggtaacgggtccccgttaccccggtcccccggttacggttaccccg

SEQ ID NO: 80300 - DNA, 236 bp, Homo sapiens
  misc_feature: GYAE6OF01CS6V9.44.25.C03.1.454.CMB.1.raw
  modified_base (221)..(236): a, c, t, g, unknown or other
  misc_feature (221)..(236): n is a, c, g, or t
tcagacagtatatacacgaccggtgctcgatttagtagtgtagatttgggtttggggggaagaggaagactgacggtcctcccaggagttcaggtgctgggcaccttgggcacgggggagtgtgtcacaagatttgggctctgggcacagcggccctgggctgcctggtcaaggactacttcctatatactgtctgagcgggctaggcaaggcgcaatagnnnnnnnnnnnnnnnn

SEQ ID NO: 80301 - DNA, 314 bp, Homo sapiens
  misc_feature: GYAE6OF01CTCE9.44.25.C03.1.454.CMB.1.raw
  modified_base (294)..(294): a, c, t, g, unknown or other
  misc_feature (294)..(294): n is a, c, g, or t
  modified_base (302)..(314): a, c, t, g, unknown or other
  misc_feature (302)..(314): n is a, c, g, or t
tcagacagtatatacacgaccggtgctcgatttagtagtgtagatttgggtttggggggtgtggtggtctccactcccgccttgacggggctgctatctgcctccctggccatcactgggctccaggctgaagatgagggtgattattactgccagtcctatgacagcagcctcagtggttgggtgttcggcggagggaccaagctgaccgtctgggtcagccaaggctcgcccctgtcactctcgtcccacctctctatactactgtctaggacggcggtctggcgaacggcncgagtagnnnnnnnnnnnnn

SEQ ID NO: 80302 - DNA, 720 bp, Homo sapiens
  misc_feature: GYAE6OF01BNR8S.44.25.C03.1.454.CMB.1.raw
  modified_base (233)..(233): a, c, t, g, unknown or other
  misc_feature (233)..(233): n is a, c, g, or t
  modified_base (255)..(255): a, c, t, g, unknown or other
  misc_feature (255)..(255): n is a, c, g, or t
  modified_base (426)..(426): a, c, t, g, unknown or other
  misc_feature (426)..(426): n is a, c, g, or t
tcagacagtatatacacgaccggtgctcgatttagtagtgtagatttgggtttgggggggcacaagaggcagcactcaggacaatctccagcatggcctggtctcctctcctcctcactctcctcgctcactgcacgagggtcctgggcccactctgtgctgacgcagccgccctcagtgtcgtcgggggcccgggcaggagggtccaccgatcctccgtgcacgtggggacncagactccaacagtcgggaacngtattctgatcgtccactcggtaaccaactacccttacgaacggaaccaccggccccctaaaccttcctactacttaccgtttaacggtaaactaaccgtgtaccggaccctcggtaccggggttccctaggtaccgtattccgtcgtcgtcctaccgtaagtctcggacncccgtcgtaaccgtcccgttaccgtcggacctacttaccgtacgtcgggacccttcgacggtacgtaagaaacggtgttaacgggagggttctaactttacgttaactcggtacctacggttccctaagtcgaacgtagccgtacgtacgtcggttaggttcggggttcggggttacgggtttccgggaaccggggtacggtaaccggacggtaccggttccggtaccggttccggtcgggtaaccgacggtacccgacggttaccccgacccggttccccgtaccgggtcccg

SEQ ID NO: 80303 - DNA, 569 bp, Homo sapiens
  misc_feature: GYAE6OF01A2BQ0.44.25.C03.1.454.CMB.1.raw
  modified_base (549)..(569): a, c, t, g, unknown or other
  misc_feature (549)..(569): n is a, c, g, or t
tcagacagtatatacacgaccggtgctcgatttagtagtgtagatttgggtttgggctggatccgtcagcccccagggaaggccctggagtggcttgcacacatcttctcgaatgacgaaaaatcctacagtacatctctgaagagcagtttaaccatctccaaggacacctccaaaaggcaggtggtctttagtatgaccaacatggaccctgcggacacaggcacatattactgtgcaacgggtaatggacgggaaaagaaacagtctggtttctgtattataagtcttacatctggacgtcgtggggacaacgggaccacggtcaccgtctcctcacgtcttcccaccgaacgggcccaacgtccggtcccttcccccgtcggccgtccctacgcctacccgaggacgccaccgtccgtcgggggccacgacggccgggcccgtgggcctcggccgtcggtaccgaacggtaccttacgttcccgacgttccttacgtcgtccgtggacgggcgggtcgtagggaccgaacggccgacgatacggnnnnnnnnnnnnnnnnnnnnn

SEQ ID NO: 80304 - DNA, 866 bp, Homo sapiens
  misc_feature: GYAE6OF01DR2LM.44.25.C03.1.454.CMB.1.raw
tcagacagtatatacacgaccggtgctcgatttagtagtgtagatttgggtttgggggggcacaaagaggcagcactcaggacaatctccagcatggcctggtctcctctcctcctcactctcctcgctcactgcacagggtcctgggcccactctgtgctgaccgcacgcccgccctcgagtcggtcggtcgggggcccccggggcaggacgggtccaccatcctccgtgccacgtgggagcaagactcccaacgagtaccgggacagtattctgattcgtccacgttacggtaacccaacctacccttaccgaaggaaaccacccggaacccccctaaaacctccctactaacgtttccgttttaacggtaaaaccaaccttaacgtcccggtacccctaccggtaacgggggttcccctacggaccgttacttcctcgtacggtcccttaccgaacgtccgttcggacctacccgttaccgaccgtccccttccccgtacggaccctacgtacccgtaccggttccgggcccgttacccgtagggtaccgttacggaaacggtaacggttacgggtaagggggtttacttaaacgttttaaaccgtttaaccgttacccggtaacccgttaacgggtttacccctttaagttaaccgaaaccgtaccggtaaccgtaaccgttcccgttacggtacgggttttacgggggtttcggggttcggttacccgggggaccgggtaaaccggggtaacccggtaacggtacgtacccgggttaccccgggttaccgggttccgggtaacccgtaccgggtaacccggaacggtcccgtacccccgggtcccccttcgggtacccccg

SEQ ID NO: 80305 - DNA, 245 bp, Homo sapiens
  misc_feature: GYAE6OF01C4GNA.44.25.C03.1.454.CMB.1.raw
  modified_base (239)..(245): a, c, t, g, unknown or other
  misc_feature (239)..(245): n is a, c, g, or t
tcagacagtatatacacgaccggtgctcgatttagtagtgtagatttgggtttgggtgcccaagctgctggagggcacggtcaccacggtcaccgtctcctcagcttccaccaagggcccatcggtcttcccctggcgccctgctccaggagcacctctgggggcacagcggccctgggctgcctggtcaaaggctaacttcctcgatcgcgtctgagcgggctggcaaggcgcatagnnnnnnn

SEQ ID NO: 80306 - DNA, 243 bp, Homo sapiens; identical to SEQ ID NO: 80006
  misc_feature: GYAE6OF01BCFL1.44.25.C03.1.454.CMB.1.raw
  modified_base (239)..(243): a, c, t, g, unknown or other
  misc_feature (239)..(243): n is a, c, g, or t

SEQ ID NO: 80307 - DNA, 791 bp, Homo sapiens
  misc_feature: GYAE6OF01DRP6P.44.25.C03.1.454.CMB.1.raw
tcagacagtatatacacgaccggtgctcgatttagtagtgtagatttgggtttgggggaagaggaagactgacggtcctcccaggagttcaggtgctgggcaccttgggcatgggggaggtgtgtcacaagatttgggctctgggcaccgtgggcatgggggagtgtgtcacaagatttggactcctgtgccccacatggacactctttgctacacactccctgctgctacgacccctacccttcgtggttcttccgacccgtgtcctacttaggaaggtactcgtcggtcctggtcgtcggttggtaaccgaaacccacaaggaaccgtacccctacgaaccgtctacgtacccgtgcccaacctcttccgtcggtttcggttctccgttctaccgaacgtattaagttaacgtaaggtgggttagtaggacgtcggtacgtacgttcccgtacgacccggtaccccggaaaggggtacccgtccggtagggtacggtcggtcgttcgacgtaacacgttacttccgttaccgtacggtaagtaacggaaaaccgtaaactacccgtaacgaagtaacctattaccgtacgtaagaacgtacgtacgtttaaaccgttaacctacttacccgtaaccgtaaaccgtaaccctaaaccccgtaaaaccggtaaacgggtaccggttaaacgggtttaccgggttttaaccgtttaaacggttaaccgtaacccgtaaaacccgttaaacggaccggtttaaccccgggtaacccgttcgggaaaaccccgg

SEQ ID NO: 80308 - DNA, 257 bp, Homo sapiens
  misc_feature: GYAE6OF01B2OX0.44.25.C03.1.454.CMB.1.raw
  modified_base (242)..(257): a, c, t, g, unknown or other
  misc_feature (242)..(257): n is a, c, g, or t
tcagacagtatatacacgaccggtgctcgatttagtagtgtagatttgggtttgggtgcccaagctgctggagggcacggtcaccacggtcaccgtctcctcagcttccaccaagggcccatcggtcttccccctggcgccctgctccaggagcacctctggggggcacggcggcccgtgggcgtgcctggtcgaaggactacttcctcgatcgcgtctgagcgggctggcaggcgcatagnnnnnnnnnnnnnnnn

SEQ ID NO: 80309 - DNA, 323 bp, Homo sapiens
  misc_feature: GYAE6OF01EIF9E.44.25.C03.1.454.CMB.1.raw
  modified_base (313)..(323): a, c, t, g, unknown or other
  misc_feature (313)..(323): n is a, c, g, or t
tcagacagtatatacacgaccggtgctcgatttagtagtgtagatttgggtttggggggtgtggtggtctccactcccgccttgacggggctgctatctgcctccctggccatcactgggctccaggctgaagatggagggtgattattactgccagtcctatgacagcagcctcagtggttgggtgttcggcggagggaccaagctcgacccgtccgtggtcacgcccaaggcctcgccccctcggtccaccttctccgttcccgccctcctctatatactgtactgacgcgggctggacaaggcgcaatgnnnnnnnnnnn

SEQ ID NO: 80310 - DNA, 539 bp, Homo sapiens
  misc_feature: GYAE6OF01CRF42.44.25.C03.1.454.CMB.1.raw
  modified_base (237)..(237): a, c, t, g, unknown or other
  misc_feature (237)..(237): n is a, c, g, or t
  modified_base (261)..(261): a, c, t, g, unknown or other
  misc_feature (261)..(261): n is a, c, g, or t
  modified_base (518)..(539): a, c, t, g, unknown or other
  misc_feature (518)..(539): n is a, c, g, or t
tcagacagtatatacacgaccggtgctcgatttagtagtgtagatttgggtttgggctggatccgtcagcccccagggaaggccctggagtggcttgcacacatcttctcgaatgacgaaaaaatcctacagtacatctctgaagagcagttttaaccatctccaaggacacctaccaaaaggcaggtggtctttagtatgaccaacatggacctgcggacacaggcacatattacngtgcacgggtaatgacgggaaaanaacagctggtttctgtattataagtcttacatctggacgtcgtggggacaaagggaccacggtcaccgtctcctcacgcttccaccaacgggcccacgtccggtccttcccccgtcggccgccctcgcctccgaggacgcacccgtcgtcgggggcacgaggccggcccgtgggcctcgtccgtggtacgaaggtacctacttaccgtatataactcgtcgtgacggcgggcgtggtacgaacggcgcgtaacgtgnnnnnnnnnnnnnnnnnnnnnn

SEQ ID NO: 80311 - DNA, 222 bp, Homo sapiens
  misc_feature: GYAE6OF01CAL9D.44.25.C03.1.454.CMB.1.raw
  modified_base (220)..(222): a, c, t, g, unknown or other
  misc_feature (220)..(222): n is a, c, g, or t
tcagacagtatatacacgaccggtgctcgatttagtagtgtagatttgggtttggggggaagaggaagactgacggtcctcccaggagttcaggtgctgggcaccttgggcacgggggaggtgtgtcacaagatttgggctctgggcacagcggccctgggctgcctggtcaaggactacttcctatatactgtctgagcgggctggcaaggcgcatagnnn

SEQ ID NO: 80312 - DNA, 582 bp, Homo sapiens
  misc_feature: GYAE6OF01BGDNY.44.25.C03.1.454.CMB.1.raw
  modified_base (270)..(270): a, c, t, g, unknown or other
  misc_feature (270)..(270): n is a, c, g, or t
  modified_base (358)..(358): a, c, t, g, unknown or other
  misc_feature (358)..(358): n is a, c, g, or t
tcagacagtatatacacgaccggtgctcgatttagtagtgtagatttgggtttggggggaagaggaagactgacggtcctcccaggagttcaggtgctgggcaccttgggcacggggggaggtgtgtcacaagatttgggctctgggcaccgtgggcagtggggggaggtgtgtcacaagatttggactcctgtgccccacatggacactctttgctacacactcctgctgctgaccacccttctgggtcttgtcccaggtcactgaagngtctgtcctgtgctggtcgaaacccacagagaccctcacgctgacctgcaccatctcgtggtctctctcaacgatattagaatgggtngagcgtggactccgcacgccccgagggacggcccgtggacgtgtctgcacacattcctctacgaatacgaaacgtaaaactcctaacgaactactactacctctgaagtactactaacgtttaaccatctaccaacggaccaaccgtaccaaaaggacgtaggttacgttacgtttaaggttactacgaacctaacgtagtacggacccttcggcggtaaaccg

SEQ ID NO: 80313 - DNA, 246 bp, Homo sapiens
  misc_feature: GYAE6OF01DVW8T.44.25.C03.1.454.CMB.1.raw
  modified_base (240)..(246): a, c, t, g, unknown or other
  misc_feature (240)..(246): n is a, c, g, or t
tcagacagtatatacacgaccggtgctcgatttagtagtgtagatttgggtttgggtgcccaagctgctggagggcacggtcaccacggtcaccgtctcctcagcttccaccaagggcccatcggtcttccccctggcgccctgctccaggagcacctcgtgggggcacagcggccctgggctgcctggtcaaggactacttcctatatactgtctgagcgggctggcaaggcgcatagnnnnnnn

SEQ ID NO: 80314 - DNA, 720 bp, Homo sapiens
  misc_feature: GYAE6OF01DV6DF.44.25.C03.1.454.CMB.1.raw
  modified_base (158)..(158): a, c, t, g, unknown or other
  misc_feature (158)..(158): n is a, c, g, or t
  modified_base (663)..(663): a, c, t, g, unknown or other
  misc_feature (663)..(663): n is a, c, g, or t
  modified_base (689)..(689): a, c, t, g, unknown or other
  misc_feature (689)..(689): n is a, c, g, or t
  modified_base (700)..(700): a, c, t, g, unknown or other
  misc_feature (700)..(700): n is a, c, g, or t
  modified_base (704)..(704): a, c, t, g, unknown or other
  misc_feature (704)..(704): n is a, c, g, or t
  modified_base (712)..(713): a, c, t, g, unknown or other
  misc_feature (712)..(713): n is a, c, g, or t
  modified_base (715)..(715): a, c, t, g, unknown or other
  misc_feature (715)..(715): n is a, c, g, or t
  modified_base (718)..(718): a, c, t, g, unknown or other
  misc_feature (718)..(718): n is a, c, g, or t
tcagacagtatatacacgaccggtgctcgatttagtagtgtagatttgggtttgggggctgttcctggaaggtgttggtacctttagagggtcaccatctcctgcactgggagcagatccaacatcgggacagattctgatgtccactggtaccaacnccttccaggaacacgcccccaaactcctcatctttggtaacaactatccggccctcgacggggtccctgaccgtattctctggcctccgaagtctaggccaccctcacgcccttccctggccaactccacgtcgggacctccgaggctaggaaagagtcggaagggttgtaatttagtttaaccgtcggacccgtaacgttccctaagtcgaaccacggtccgacgtccttacggtacgggtttgggggtttacgggtttcggttccgggggacggggtaaccgggaacccgaaggtcccgttaccggtacccggttccggtacgggtccaacggtaccccgaaggtcccttacccggtcccccgtacgggtcctacctttcccggttcccggttccccccgtcccttacccttcgtttaaacttacctttacgtaccgtttccggcgtacgggtccggggtccttacggggacgtaaacggggcctaccggtaagttaaccggngtcgacgtcgtcgtcgcgcgcgcgcncgcgcacgtcngcgnatacgacnncncgncg

SEQ ID NO: 80315 - DNA, 225 bp, Homo sapiens
  misc_feature: GYAE6OF01DO5V3.44.25.C03.1.454.CMB.1.raw
  modified_base (220)..(225): a, c, t, g, unknown or other
  misc_feature (220)..(225): n is a, c, g, or t
tcagacagtatatacacgaccggtgctcgatttagtagtgtagatttgggtttgggggaagaggaagactgacggtcctcccaggagttcaggtgctgggcaccttgggcagtgggggaggtgtgtcacaagatttgggctctgggcacagcggccctgggctgcctggtcaaggactacttccacgtctactgctgagcgggctggcaaggcgcatagnnnnnn

SEQ ID NO: 80316 - DNA, 693 bp, Homo sapiens
  misc_feature: GYAE6OF01DUHOP.44.25.C03.1.454.CMB.1.raw
  modified_base (207)..(207): a, c, t, g, unknown or other
  misc_feature (207)..(207): n is a, c, g, or t
  modified_base (264)..(264): a, c, t, g, unknown or other
  misc_feature (264)..(264): n is a, c, g, or t
  modified_base (301)..(301): a, c, t, g, unknown or other
  misc_feature (301)..(301): n is a, c, g, or t
  modified_base (324)..(324): a, c, t, g, unknown or other
  misc_feature (324)..(324): n is a, c, g, or t
  modified_base (378)..(378): a, c, t, g, unknown or other
  misc_feature (378)..(378): n is a, c, g, or t
  modified_base (391)..(391): a, c, t, g, unknown or other
  misc_feature (391)..(391): n is a, c, g, or t
tcagacagtatatacacgaccggtgctcgatttagtagtgtagatttgggtttggggggaagaggaagactgacggtcctcccaggagttcaggtgctgggcaccttgggcacgggggaggcttagttcagccgtggggggtccctgagactctcctgtgcagcctctggattcaccttcagtagctactggatgcacgtgggtccnccaagctccgaggggagggctggtgtggctcagtataatagtgagtgggatagacanagctacgcgactcgtagaacggcctatccactatccncgaagacgaacacgacaagaacncgctagtatcgagaacaaatcgaactgtctaggagacgacgaaggacgacggtntgtagtattacgngtacgacgaagcgggtcgggtggtacggggtaggttccggggtagttcgacgtaacttaacgtacgtaacgtacggtagtacggtacgttcggtaccgggaccggaacgggtaacccgtacggtacccgtaccgtccctccgtacgtaccgttacccttaccgaacccggtaaccgggtcccctaacggttccccggttaccccgttcccccggtacgggtccccgtcccggttccgtcccgtaacccggacggtacccgtcccgtaaccggttcccgggtacggggtaccctaacccgggg

SEQ ID NO: 80317 - DNA, 582 bp, Homo sapiens
  misc_feature: GYAE6OF01B3YLF.44.25.C03.1.454.CMB.1.raw
  modified_base (562)..(563): a, c, t, g, unknown or other
  misc_feature (562)..(563): n is a, c, g, or t
  modified_base (565)..(582): a, c, t, g, unknown or other
  misc_feature (565)..(582): n is a, c, g, or t
tcagacagtatatacacgaccggtgctcgatttagtagtgtagatttgggtttgggctggatccgtcagcccccagggaaggccctggagtggcttgcacacatcttctcgaatgaacgaaaaatcctacagtacatctctgaagagcagtttaaccatctccaaggacacctccaaaaggcaggtgtcttagtatgaccaacatggaccctgcggacacaggcacatatactgtgacagggtaatggacgggaaaagaacagcgttgttctagttattaataagtcttaccatcgtgacgtcgtggggacaaacgggccacggtcaccgtctccacgagccttacccaaccgacgggccccagttcccggtccttcccccgtggccccgtcccgtcgccctccgacggtacgccctaccgtccggtcgggggacaccgacggtccggcccgtcgggtccgtcgcccgtggtaccgaacgggtaccttaaccgttaccgtactattaccgttacgtcgtcggacggcgggtcgtcggaacgtaacgggccacgtagtagcgnngnnnnnnnnnnnnnnnnnn

SEQ ID NO: 80318 - DNA, 572 bp, Homo sapiens
  misc_feature: GYAE6OF01AUFKS.44.25.C03.1.454.CMB.1.raw
  modified_base (233)..(233): a, c, t, g, unknown or other
  misc_feature (233)..(233): n is a, c, g, or t
  modified_base (282)..(282): a, c, t, g, unknown or other
  misc_feature (282)..(282): n is a, c, g, or t
  modified_base (315)..(315): a, c, t, g, unknown or other
  misc_feature (315)..(315): n is a, c, g, or t
  modified_base (336)..(336): a, c, t, g, unknown or other
  misc_feature (336)..(336): n is a, c, g, or t
  modified_base (508)..(508): a, c, t, g, unknown or other
  misc_feature (508)..(508): n is a, c, g, or t
  modified_base (517)..(517): a, c, t, g, unknown or other
  misc_feature (517)..(517): n is a, c, g, or t
  modified_base (522)..(522): a, c, t, g, unknown or other
  misc_feature (522)..(522): n is a, c, g, or t
  modified_base (524)..(524): a, c, t, g, unknown or other
  misc_feature (524)..(524): n is a, c, g, or t
  modified_base (543)..(543): a, c, t, g, unknown or other
  misc_feature (543)..(543): n is a, c, g, or t
  modified_base (562)..(562): a, c, t, g, unknown or other
  misc_feature (562)..(562): n is a, c, g, or t
  modified_base (565)..(565): a, c, t, g, unknown or other
  misc_feature (565)..(565): n is a, c, g, or t
tcagacagtatatacacgaccggtgctcgatttagtagtgtagatttgggtttgggggggcagagggtcaccatctcctgcactgggagcagatccaacatcgggacagattctgatgtccactggtaccaacaccttccaggaacagcccccaaaatcctcatctttggtaaacaactatcggccctcaggggtccctgaccgattctctggctccgaagtctggccacctnacgccctccctggccatccacgtgggctccaggctagaagatggaggtnattatactgccaagtcctatcgacagcagcctnaggttggttgggtgttcgggnggacggtaccaaggtcctacggacccgttccgtaggtacacggacccgaaggtcctccggccccctggtcctacgtcgtccgttccccgccttctactacgtactacgtcgtcgtgaacggtcggtcgtaggaccgaacggtccgtactagtacgtcgatcgatgatacggntacgtcganctacncncgcgcacgtagacgcgtanacgtcacgtagctctacanacngtagtcg

SEQ ID NO: 80319 - DNA, 231 bp, Homo sapiens
  misc_feature: GYAE6OF01DD2GG.44.25.C03.1.454.CMB.1.raw
  modified_base (222)..(231): a, c, t, g, unknown or other
  misc_feature (222)..(231): n is a, c, g, or t
tcagacagtatatacacgaccggtgctcgatttagtagtgtagatttgggtttgggggaagaggaagactgacggtcctcccaggagttcaggtgctgggcaccttgggcacgggggaggtgtgtcacaagatttgggctctgggcacgagcggccctgggctgcctggtcaaggactacttcctatatactgtctagagcgggctggcaaggcgacatagnnnnnnnnnn

SEQ ID NO: 80320 - DNA, 375 bp, Homo sapiens
  misc_feature: GYAE6OF01D8IKW.44.25.C03.1.454.CMB.1.raw
  modified_base (334)..(375): a, c, t, g, unknown or other
  misc_feature (334)..(375): n is a, c, g, or t
tcagacagtatatacacgaccggtgctcgatttagtagtgtagatttgggtttggggggtgtggtggtctccactcccgccttgacggggctgctatctgcctccctggccatcactgggctccaggctgaagatgagggtgattattactgccagtcctatgacagcagcctcagtggtgggtgttcggcggaggaccaagctcgaccgtccgtgggtcacgcccgaaggcctcgtcccccgtcggtccacctccttcgtccccgccctcctactatactactcgtccgtgacggcgggtctagggacgaaacgggccggctaagttaaggcnnnnnnnnnnnnnnnnnnnnnnnnnnnnnnnnnnnnnnnnnn

SEQ ID NO: 80321 - DNA, 885 bp, Homo sapiens
  misc_feature: GYAE6OF01D1ILO.44.25.C03.1.454.CMB.1.raw
  modified_base (291)..(291): a, c, t, g, unknown or other
  misc_feature (291)..(291): n is a, c, g, or t
tcagacagtatatacacgaccggtgctcgatttagtagtgtagatttgggtttgggggactcctgtgccccaccatggacactctttgctacacactcctgctgctgaccacccttcctgggtcttgtcccaggtcacttgaaggagtctggtcctgtgctggtgaaacccacagacgaccctcacgctgacctgcaccatctcgtggttctctctacaacgatattagaagtgggtgtgagctggactccgtcacgccccgagggacggccgtggagtggcttgcacacncttcttctacgaatacgaaacgtaaaaactcctaactacgtacacttactcgtagaaagacgtacgtaacgtttaaaccattacccgtaaccgtaaaccggaaccctaaacccgtaaaccgaaaaacgggtaccgttaacggggtttacggtttaccgttttaaacggtaacgttaaccggtaaaacccgtaaacgtaaccgggtttaccgggaaacccccggttaggggtaaccccggaaaccgtaaccgggaaaccgggtacccaaaccgtttaaatttaaccgtttaaccggttcggttaacggacccggggttaaaggggttaacgtaacggggaaaccggggaaaaacgtaaaaccgtcgggttaacggttttacgggttttaacgtttaacggtttaaacggttttaaacgttaaaccggttttacccttaaaccggttacgttacccggtttacggggtaaccggttacccgggtttaacgggggaacgttaaaacccggggtcccgtaacccgggttaccccgtaacccgtttcccgtttaacccgtacccggtaacgttccccgttaaccccggtaaaccccggg

SEQ ID NO: 80322 - DNA, 254 bp, Homo sapiens
  misc_feature: GYAE6OF01CKVPQ.44.25.C03.1.454.CMB.1.raw
  modified_base (244)..(254): a, c, t, g, unknown or other
  misc_feature (244)..(254): n is a, c, g, or t
tcagacagtatatacacgaccggtgctcgatttagtagtgtagatttgggtttgggtgcccaagctgctggagggcacggtcaccacggtcaccgtctcctcagcttccaccaagggcccatcggtcttcccctggcgccctgctccaggagcacctcgtgggggcacagcggccctgggctgcctggtcaaggactacttcctatatactgtctgaggcgggctggacgaaggcgacagtagnnnnnnnnnnn

SEQ ID NO: 80323 - DNA, 261 bp, Homo sapiens
  misc_feature: GYAE6OF01AUE6J.44.25.C03.1.454.CMB.1.raw
  modified_base (134)..(134): a, c, t, g, unknown or other
  misc_feature (134)..(134): n is a, c, g, or t
  modified_base (221)..(261): a, c, t, g, unknown or other
  misc_feature (221)..(261): n is a, c, g, or t
tcagacagtatatacacgaccggtgctcgatttagtagtgtagatttgggtttgggggggaaggaggaagactgacggtcctcccaggagttcaggtgctgggcaccttgggcacgggggagtgtgtcacaagntttgggctctgggcacagcggccctgggctgcctggtcaaggactacttcctatatactgtctgagcgggctggcaaggcgcatagnnnnnnnnnnnnnnnnnnnnnnnnnnnnnnnnnnnnnnnnn

SEQ ID NO: 80324 - DNA, 135 bp, Homo sapiens
  misc_feature: GYAE6OF01EF1GJ.44.25.C03.1.454.CMB.1.raw
  modified_base (123)..(135): a, c, t, g, unknown or other
  misc_feature (123)..(135): n is a, c, g, or t
tcagacagtatatacacgaccggtgctcgatttagtagtgtagatttgggtttggggacaatggtcaccgtctcttcagcttccaccaagggcccatcggtcttccccctgcgccctgctccnnnnnnnnnnnnn

SEQ ID NO: 80325 - DNA, 276 bp, Homo sapiens
  misc_feature: GYAE6OF01C1LEQ.44.25.C03.1.454.CMB.1.raw
  modified_base (198)..(198): a, c, t, g, unknown or other
  misc_feature (198)..(198): n is a, c, g, or t
  modified_base (269)..(276): a, c, t, g, unknown or other
  misc_feature (269)..(276): n is a, c, g, or t
tcagacagtatatacacgaccggtgctcgatttagtagtgtagatttgggtttggggggaagaggaagactgacggtcctcccaggagttcaggtgctgggcaccttgggcacgggggaggtgtgtcacaagagtttgggctcgtgggcaccgtgggcagtgggggagtgtgtcacaagtatttgggctctgggcacngcggccctgggctgcctggtcaaggactacttccatactactgtctagagcgggctggcaaggcacatagnnnnnnnn

SEQ ID NO: 80326 - DNA, 224 bp, Homo sapiens
  misc_feature: GYAE6OF01BRW4G.44.25.C03.1.454.CMB.1.raw
  modified_base (220)..(224): a, c, t, g, unknown or other
  misc_feature (220)..(224): n is a, c, g, or t
tcagacagtatatacacgaccggtgctcgatttagtagtgtagatttgggtttggggggaagaggaagactgacggtcctcccaggagttcaggtgctgggcaccttgggcacgggggaggtgtgtcacaagatttgggctctgggcacagcggccctgggctgcctggtcaaggactacttcctatatactgtctgagcgggctggcaaggcgcatagnnnnn

SEQ ID NO: 80327 - DNA, 252 bp, Homo sapiens
  misc_feature: GYAE6OF01CZL4L.44.25.C03.1.454.CMB.1.raw
  modified_base (238)..(252): a, c, t, g, unknown or other
  misc_feature (238)..(252): n is a, c, g, or t
tcagacagtatatacacgaccggtgctcgatttagtagtgtagatttgggtttgggtgcccaagctgctggagggcacggtcaccacggtcaccgtctcctcagcttccaccaagggcccatcggtcttcccctggcgccctgctccaggagcacctctgggggcacaggcggccctgggctgcctggtcaaggctacttcctatatactgtctgagcgggctggcaaggcgcatagnnnnnnnnnnnnnnn

SEQ ID NO: 80328 - DNA, 168 bp, Homo sapiens
  misc_feature: GYAE6OF01BSEB3.44.25.C03.1.454.CMB.1.raw
  modified_base (166)..(168): a, c, t, g, unknown or other
  misc_feature (166)..(168): n is a, c, g, or t
tcagacagtatatacacgaccggtgctcgatttagtagtgtagatttgggtttgggggcggagggaccaaactgaccgtcctgggtcagcccaaggctgccccctcggtcactctgttcccgccctcctctatatactgtctgagcgggctggcaaggcgcatagnnn

SEQ ID NO: 80329 - DNA, 805 bp, Homo sapiens
  misc_feature: GYAE6OF01AJQZM.44.25.C03.1.454.CMB.1.raw
  modified_base (330)..(330): a, c, t, g, unknown or other
  misc_feature (330)..(330): n is a, c, g, or t
tcagacagtatatacacgaccggtgctcgatttagtagtgtagatttgggtttgggggactcctgtgccccaccatggacactctttgctacacactcctgctgctgaccacccttcctgggtcttgtcccaggtcaccttgaaggagtctggtcctgtgctggtgaaacccacagagaccctcacgctgacctgcaccatctctgggttctctctcaacgatattagaatgggtgtgagctggactccgtcacgcccccgagggaacggcccgtggagtcggcttgcacacatcttctcgaatgaacgaaaatcctaacagtacatctntagaagacgtctaacgttaaccactactaccgaacggtacctacctaaccgaaaacggtcgaggttcggttactttagtagtacgacctaacacgtaccggaccctaggaccggtaacgacgacgggacctaacgtattaaactttaccgtacggtttacggacccgttaaacgggggttaacgtaacggggtaaaccggggtaaaacggtaaaaccgtacgggtttaccggtttaggggtttttaccgttaaacgggttttaaagtttaaccgttttaaacgggtttaccctttaacccgttaacggtttccgttaaaccgggggtacccggttttaaccggggttaggggggaaaccccggttaaaacggggggtacccccgttacccggggttaaccccgtacccccgttttacccgaccccggtttaacccgaacggttacccccccgtttaacccgggtaaaacccccgg

SEQ ID NO: 80330 - DNA, 239 bp, Homo sapiens
  misc_feature: GYAE6OF01DU9UA.44.25.C03.1.454.CMB.1.raw
  modified_base (171)..(171): a, c, t, g, unknown or other
  misc_feature (171)..(171): n is a, c, g, or t
  modified_base (231)..(231): a, c, t, g, unknown or other
  misc_feature (231)..(231): n is a, c, g, or t
  modified_base (236)..(239): a, c, t, g, unknown or other
  misc_feature (236)..(239): n is a, c, g, or t
tcagacagtatatacacgaccggtgctcgatttagtagtgtagattttgggtttgggtgcccaagctgctggagggcacggtcaccacggtcaccgtctcctcagcttccaccaagggcccatcggtcttccccctggcgccctgctccgaggagcacctcgtggggcacngcggccctggctgcctggcaagactacttctatatactgtctgagcggctggacaaggcncatgnnnn

SEQ ID NO: 80331 - DNA, 725 bp, Homo sapiens
  misc_feature: GYAE6OF01DQORR.44.25.C03.1.454.CMB.1.raw
  modified_base (144)..(144): a, c, t, g, unknown or other
  misc_feature (144)..(144): n is a, c, g, or t
tcagacagtatatacacgaccggtgctcgatttagtagtgtagatttgggtttgggggactcctgtgcccaccatggacactctttgctacacactcctgctgctgaccacccttccgtggtcttgtccaggtcacttgaaggngtctggtctgtgctggtacgaaaccacaggacgacctcacgctcgacctgaccacattcttcgtgggttctctctacgaacgtataagttaggaagttggggtgtagagcgtggtactccgtacaccgaccccggaggggtacgccggtggacgtggcttgacactactacgttctcgtacgaagtacgaaacgtaaaactctacgactacgactactacgtaagaagtaacgacttaacgttaacactaccgtaacgaaacgaccaaccgtaaacgaaaggctagggttagttacgtaagtactaagaaccaagtaccgtcggacccgtaggaccgaacaccgtagacctaattacttaacgtacgtgaacggtggtaaaacgggtagtaaacgggaaacggaaacgtaaacgtcggttaacgtttggttaacggttaattaaacgtttaaggtaaccttacgttaactaggttacgtacggggttaccggtaagggtaaccgggaacggtaaacggaccccggtttacgacccgttacggtcccttacgtaccgtacgtacccctaaccggtaacccgg

SEQ ID NO: 80332 - DNA, 823 bp, Homo sapiens
  misc_feature: GYAE6OF01BZSI5.44.25.C03.1.454.CMB.1.raw
  modified_base (195)..(195): a, c, t, g, unknown or other
  misc_feature (195)..(195): n is a, c, g, or t
  modified_base (225)..(225): a, c, t, g, unknown or other
  misc_feature (225)..(225): n is a, c, g, or t
tcagacagtatatacacgaccggtgctcgatttagtagtgtagatttgggtttgggggggcacaagaggcagcactcaggacaatctccagcatggcctggtctcctctcctcctcactctcctcgctcactgcacagggtcctgggcccactctgtgctgacgcagccgccctcagtgtcgtcggggcccgggnaggaggtcaccatctcctgcacgtgggacncagactccaacagtcgggacagtattctgatcgtccacgtcggtaacccaacgtaccttaccgaaggaaaccaccgacccccctaaaacttccctactactttccgtttacggtaaacctaactacgtccggcccctacggtaccggggttccctacgacccgtactttccgtcgtcggtcctaccgtaacgttcctcggacctacccgtcaccggtccccttcccgtcggacccctaacgttacccgtaccggttccggggtacccttacccggaacgggtcccttaaacgggaaacgtaacgggtttacggggtaacggggtttaacgttaaacgtttttaccgttaaacccgttcggtacccgttaacggtttacccgttaacgttacgggaaacctacgggacccgtaaccgttcccgttacggtacggggttttacggggtttacggggttcgggttaccggggaaccgggtaaccggggtaacccgtaagggtcccgttacggggtacccggttcccgggttcgggtaaccccgaacggtaccccggtaagggtccccgttccccggttccccccggtcccgggttaacccg

SEQ ID NO: 80333 - DNA, 241 bp, Homo sapiens; identical to SEQ ID NO: 79989
  misc_feature: GYAE6OF01BPLQI.44.25.C03.1.454.CMB.1.raw
  modified_base (238)..(241): a, c, t, g, unknown or other
  misc_feature (238)..(241): n is a, c, g, or t

SEQ ID NO: 80334 - DNA, 624 bp, Homo sapiens
  misc_feature: GYAE6OF01CJDOB.44.25.C03.1.454.CMB.1.raw
  modified_base (135)..(135): a, c, t, g, unknown or other
  misc_feature (135)..(135): n is a, c, g, or t
  modified_base (304)..(304): a, c, t, g, unknown or other
  misc_feature (304)..(304): n is a, c, g, or t
  modified_base (313)..(313): a, c, t, g, unknown or other
  misc_feature (313)..(313): n is a, c, g, or t
  modified_base (334)..(334): a, c, t, g, unknown or other
  misc_feature (334)..(334): n is a, c, g, or t
  modified_base (599)..(600): a, c, t, g, unknown or other
  misc_feature (599)..(600): n is a, c, g, or t
  modified_base (602)..(608): a, c, t, g, unknown or other
  misc_feature (602)..(608): n is a, c, g, or t
  modified_base (610)..(624): a, c, t, g, unknown or other
  misc_feature (610)..(624): n is a, c, g, or t
tcagacagtatatacacgaccggtgctcgatttagtagtgtagatttgggtttgggggctgttcctggaaggtgttggtaccagagggtcaccatctcctgcactgggagcagatccaacatcgggacagattcngatgtccactggtaccaacaccttccaggaacacgcccccaaactcctcattctttaggtaaacaactatccggcccctcgacggggtcccctgaccgattctcgtcggctcccaagttctggccacctcacgccctccgtggcctatcactgggctccaggctgaagntggagggtnattagtactgcctagtcctancgactagctacgtccctagaggttgggttacggggtcggttacgggaccggggtacgggaacctaagccggtaacgtacccgttcccggtagggtaccacgggccccgtaaacggccttcccggacccccttcgggtcctaacccgttcctacccgggttccccctccccgttaccttacttaacgttacttaaccgtcggttccgtacgggacgggtcccgggtacctacggggacgaaacgggcgtaaccgtagtaggcagcnncnnnnnnngnnnnnnnnnnnnnnn

SEQ ID NO: 80335 - DNA, 451 bp, Homo sapiens
  misc_feature: GYAE6OF01EC4KF.44.25.C03.1.454.CMB.1.raw
  modified_base (259)..(259): a, c, t, g, unknown or other
  misc_feature (259)..(259): n is a, c, g, or t
  modified_base (315)..(315): a, c, t, g, unknown or other
  misc_feature (315)..(315): n is a, c, g, or t
  modified_base (337)..(337): a, c, t, g, unknown or other
  misc_feature (337)..(337): n is a, c, g, or t
  modified_base (399)..(399): a, c, t, g, unknown or other
  misc_feature (399)..(399): n is a, c, g, or t
  modified_base (422)..(422): a, c, t, g, unknown or other
  misc_feature (422)..(422): n is a, c, g, or t
  modified_base (424)..(451): a, c, t, g, unknown or other
  misc_feature (424)..(451): n is a, c, g, or t
tcagacagtatatacacgaccggtgctcgatttagtagtgtagatttgggtttgggggggcagagggtcaccatctcctgcactgggagcagatccaacatcgggacagattctgatgtccactggtaccaacaccttccaggacagcccccaaatcctcatcttgtaacaactatcgccctcagggtccctgaccgattctctggctccaagtctggcacctcagccctcctgccatcactggctccaggctgaagangaggtgattattactgcagtcctatgacagcagcctcgaggtggttggtgttcggnggaggaccaagcgtgaccgtcncggtcagcccaagctacgcccctcgtcactctcgtcccgtcctcctctatactactgtctgngcggctggacgaggcacgatagnannnnnnnnnnnnnnnnnnnnnnnnnnnn

SEQ ID NO: 80336 - DNA, 776 bp, Homo sapiens
  misc_feature: GYAE6OF01EE777.44.25.C03.1.454.CMB.1.raw
  modified_base (308)..(308): a, c, t, g, unknown or other
  misc_feature (308)..(308): n is a, c, g, or t
tcagacagtatatacacgaccggtgctcgatttagtagtgtagatttgggtttgggggaagaggaagactgacggtcctcccaggagttcaggtgctgggcaccttgggcacgggggagtgtgtcacaagatttgggctctgggcaccgtgggcagtgggggagtgtgtcacaagatttggacttcctgtcgccccacatggactctctttgctacacactcctgctgctcgaccccacccgttcgtgggtccttcgtcccaggtccaccgttgaaggtcgtctggtcctgtgctggtacgaacccanacgacgtacccctcgaccgtccttacgaccgtcgacctacctacgttcctccgttcggggttttcctccgttaccgtaccgtaaaacggtacttaacgttaaggtaaacgttggggttcgttaggacgtcgtacggtacgtcccgtcgaccggaccccgtaagggaaccggtcccgtagggacggttcggccgtttacgaccgtactaaccgtacgttccgtttaccgtacgtaaacgtaccgtaaaacgtaaaaacctttcccgtaaaccgtacgttaactacgttaccttacgtaacgtaacgtacggtaccgttaaacgtttaaccctaacttacccgtaccgaaacgtaacccgtaaccgtaaaccgaaaacgggtacgttaacgggttggttaacgtttaacggtaacgttaacgaaaccgtaacgtacgtaccgggtaacccgtaggtaccggtaaacccgg

SEQ ID NO: 80337 - DNA, 241 bp, Homo sapiens; identical to SEQ ID NO: 80024
  misc_feature: GYAE6OF01AW3UZ.44.25.C03.1.454.CMB.1.raw
  modified_base (238)..(241): a, c, t, g, unknown or other
  misc_feature (238)..(241): n is a, c, g, or t

SEQ ID NO: 80338 - DNA, 765 bp, Homo sapiens
  misc_feature: GYAE6OF01CHNQ1.44.25.C03.1.454.CMB.1.raw
  modified_base (510)..(510): a, c, t, g, unknown or other
  misc_feature (510)..(510): n is a, c, g, or t
tcagacagtatatacacgaccggtgctcgatttagtagtgtagatttgggtttgggggactcctgtgccccaccatggacactctttgctacacactcctgctgctcgaccacccttcctgggtcttcgtccaggtcacttgaaggagtctggtcctgtgctggtacgaaacccacagacgacctcacgctcgacctcgcaccattcttcgtcgggttctctctacaacgtattaagttaggtaaggtgggtgtgacgcgtggactccgtcgaccgacccggaaggggaacggccggtggaggtcggtcttaggaccacactacttcttacgtaacgtaaacgtaacgaaacgaaaactccgtaactaacgtactactacgtacgtaggaacgtacgacgttaacttaaccactacctaacgaaacggtaaccaacccgtaaacgaaaacggtacggtaaggttagtttacgtttaagtacgtacgaaaccaacgtacgtacggtaccgnggtaacgaactacgagactaataacttaactacgtaggtacgaacggttaaggtacgaacgggaaacggtaaaacgaacgttacgttggtttacggttaattacggtttaaacttaacgtaacgttaccgttaacgtagttaccggtacgggttaaccgtcggggtaaaccggggtaaccgaaacggggtcctaacccggtcgtaaccccgtcgttaaccgtactacccggttaaccctacccggggtaaacccg

SEQ ID NO: 80339 - DNA, 243 bp, Homo sapiens
  misc_feature: GYAE6OF01CV0TZ.44.25.C03.1.454.CMB.1.raw
  modified_base (224)..(243): a, c, t, g, unknown or other
  misc_feature (224)..(243): n is a, c, g, or t
tcagacagtatatacacgaccggtgctcgatttagtagtgtagattttgggtttggggggaagaggaagactgacggtcctcccaggagttcaggtgctgggcaccttgggcacgggggagtgtgtcacaagtatttgggctctgggcacagcggccctgggcctgcctggtcaaggactacttccacgtctactgctgaggcgggctggcaaggcgacatagnnnnnnnnnnnnnnnnnnnn

SEQ ID NO: 80340 - DNA, 242 bp, Homo sapiens
  misc_feature: GYAE6OF01AZSQO.44.25.C03.1.454.CMB.1.raw
  modified_base (239)..(242): a, c, t, g, unknown or other
  misc_feature (239)..(242): n is a, c, g, or t
tcagacagtatatacacgaccggtgctcgatttagtagtgtagatttgggtttgggtgcccaagctgctggagggcacggtcaccacggtcaccgtctcctcagcttccaccaagggcccatcggtcttccccctggcgccctgctccaggagcacctctgggggcacagcggccctgggctgcctggtcaaggactacttccacgtctactgctgagcgggctggcaaggcgcatagnnnn

SEQ ID NO: 80341 - DNA, 265 bp, Homo sapiens
  misc_feature: GYAE6OF01CHCWA.44.25.C03.1.454.CMB.1.raw
  modified_base (135)..(135): a, c, t, g, unknown or other
  misc_feature (135)..(135): n is a, c, g, or t
  modified_base (153)..(153): a, c, t, g, unknown or other
  misc_feature (153)..(153): n is a, c, g, or t
  modified_base (235)..(235): a, c, t, g, unknown or other
  misc_feature (235)..(235): n is a, c, g, or t
  modified_base (241)..(245): a, c, t, g, unknown or other
  misc_feature (241)..(245): n is a, c, g, or t
  modified_base (247)..(265): a, c, t, g, unknown or other
  misc_feature (247)..(265): n is a, c, g, or t
tcagacagtatatacacgaccggtgctcgatttagtagtgtagatttgggtttgggtgcccaagctgctggagggcacggtcaccacggtcaccgtctcctcagcttccaccaagggcccatcggtcttcccccnggcgccctgctccaggancacctcgtgggggcacaggcggccctgggctgccgtggtcaaggactacttcctgatcgcgtctgaggcggctggcaaggcncatagnnnnngnnnnnnnnnnnnnnnnnnn

SEQ ID NO: 80342 - DNA, 658 bp, Homo sapiens
  misc_feature: GYAE6OF01BXUPC.44.25.C03.1.454.CMB.1.raw
  modified_base (631)..(631): a, c, t, g, unknown or other
  misc_feature (631)..(631): n is a, c, g, or t
  modified_base (634)..(658): a, c, t, g, unknown or other
  misc_feature (634)..(658): n is a, c, g, or t
tcagacagtatatacacgaccggtgctcgatttagtagtgtagatttgggtttgggggctgttcctggaaggtgttggtaccagagggtcaccatctcctgcactgggagcagatccaacatcgggacagattctgatgtccactggtacccaacaccttccaggaacagccccccaaactcctcatctttggtaacaactatcggccctcaggggtccctgaccgtattctctggctccaagtctgccacctcagccctcctggccatcacgtgggcctccgaggctaggaagatggaggtgtatttacttacgtcgtacctagttacctaagtgtacgaacgccagtccccgttacgtagggtttggggtttcggggttgggtttccgggacgggggaacgggtacccgaaaggtcccgttaacggtacccggttacccggtggggtacccaaacgggtccccgaaacgggtcccgtcccggtcccccccgttaccgggtccttaacccgttccgtttacccgtttcccccgtcccccgttacccttcttaacgttaaccttcgttaccgttcgttcggaaccgggccgggttcgtacgggtaaccgtagggcccgtacgtagagtcgngtnnnnnnnnnnnnnnnnnnnnnnnnn

SEQ ID NO: 80343 - DNA, 579 bp, Homo sapiens
  misc_feature: GYAE6OF01EMURV.44.25.C03.1.454.CMB.1.raw
  modified_base (271)..(271): a, c, t, g, unknown or other
  misc_feature (271)..(271): n is a, c, g, or t
  modified_base (445)..(445): a, c, t, g, unknown or other
  misc_feature (445)..(445): n is a, c, g, or t
  modified_base (556)..(556): a, c, t, g, unknown or other
  misc_feature (556)..(556): n is a, c, g, or t
tcagacagtatatacacgaccggtgctcgatttagtagtgtagatttgggtttggggggaagaggaagactgacggtcctcccaggagttcaggtgctgggcaccttgggcacgggggaggtgtgtcacaagatttgggctctgggcaccgtgggcagtgggggagtgtgtcacaagatttggactcctgtgccccaccatggacactctttgctacacactcctgctgctgacccacccttctggtcttgtcccaggtcaccttgaaggngtctggtcctgtgctggtgaacccacagagaccctcacgctgacctgcacatctctggttctctctcaacgatattagaacgtgggtgtgagcgtggactccgtcacgccccgagggaacgcccgtaggagtggcttgcacacattctctacgaatgaaacgaaaactcctaanacgtaacacgttctacgtagaacgacgcttaacggtttaaacactactaccgaaacgacctaaccctaccgaaaagtcgaacgggttgttactttagatagaacctaaacncgtacggaccctggacggtaacg

SEQ ID NO: 80344 - DNA, 641 bp, Homo sapiens
  misc_feature: GYAE6OF01DTCAU.44.25.C03.1.454.CMB.1.raw
  modified_base (235)..(235): a, c, t, g, unknown or other
  misc_feature (235)..(235): n is a, c, g, or t
  modified_base (313)..(313): a, c, t, g, unknown or other
  misc_feature (313)..(313): n is a, c, g, or t
  modified_base (615)..(617): a, c, t, g, unknown or other
  misc_feature (615)..(617): n is a, c, g, or t
  modified_base (619)..(620): a, c, t, g, unknown or other
  misc_feature (619)..(620): n is a, c, g, or t
  modified_base (622)..(641): a, c, t, g, unknown or other
  misc_feature (622)..(641): n is a, c, g, or t
tcagacagtatatacacgaccggtgctcgatttagtagtgtagatttgggtttgggggctgttcctggaaggtgttggtaccagagggtcaccatctcctgcactgggagcagatccaacatcgggactagattctgatgtccactggaccaacaccttcaggaacacgacccccaaactcctcattctttaggtaaacaactactccggccctcgacggggtcccctgaccgtnttcctctggtctaccgaagtctcggcctaccctcaccgtccctccgtcggcacttccgacgtcgggcctccgacggtntacggtaagagtgggtagggtactaattttatacgtcgccgtacttcttagacgacacgtcgaacgtcccttacggttaggggttcgggttaggggtcggtttacggggacggggaacgtaaccgaggtaccgtaccgtacccgggttccgtaggggtccaaccggtacccggtacgtcccgttccccgccccgtttacggcccttcccgttcctcccggttacccccctcttaccgtttactacttacgttcgtactacggtcggacggtcggcggaccgtgacggacctgaatcgatccnnncnncnnnnnnnnnnnnnnnnnnnn

SEQ ID NO: 80345 - DNA, 330 bp, Homo sapiens
  misc_feature: GYAE6OF01A7EA3.44.25.C03.1.454.CMB.1.raw
  modified_base (303)..(303): a, c, t, g, unknown or other
  misc_feature (303)..(303): n is a, c, g, or t
  modified_base (308)..(330): a, c, t, g, unknown or other
  misc_feature (308)..(330): n is a, c, g, or t
tcagacagtatatacacgaccggtgctcgatttagtagtgtagatttgggtttggggggtgtggtggtctccactcccgccttgacggggctgctatctgcctccctggccatcactgggctccaggctgaagatgagggtgattattactgccagtcctatgacagcagcctcagtggttgggtgtcggcggaggaccaagctgaccgtcctgggtcagcccaaggctcgccccctggtcactctcgttccccaccctctactatatacctgtactgacgcgggctggcaaggccgtacaanagcannnnnnnnnnnnnnnnnnnnnnn

SEQ ID NO: 80346 - DNA, 251 bp, Homo sapiens
  misc_feature: GYAE6OF01BZZAH.44.25.C03.1.454.CMB.1.raw
  modified_base (233)..(233): a, c, t, g, unknown or other
  misc_feature (233)..(233): n is a, c, g, or t
  modified_base (239)..(251): a, c, t, g, unknown or other
  misc_feature (239)..(251): n is a, c, g, or t
tcagacagtatatacacgaccggtgctcgatttagtagtgtagatttgggtttgggtgcccaagctgctggagggcacggtcaccacggtcaccgtctcctcagcttccaccaagggcccatcggtcttccccctggcgccctgctccaggagcacctctgggggcacagcggccctgggctgcctggtcaaggactacttcctatatactgtctgagcgggctggcaaggcncatagnnnnnnnnnnnnn

SEQ ID NO: 80347 - DNA, 247 bp, Homo sapiens
  misc_feature: GYAE6OF01DXSVG.44.25.C03.1.454.CMB.1.raw
  modified_base (222)..(222): a, c, t, g, unknown or other
  misc_feature (222)..(222): n is a, c, g, or t
  modified_base (229)..(247): a, c, t, g, unknown or other
  misc_feature (229)..(247): n is a, c, g, or t
tcagacagtatatacacgaccggtgctcgatttagtagtgtagatttggggtttggggggaagaggaagactgacggtcctcccaggagttcaggtgcgtgggcaccttgggcagtgggggaggtgtgtcacaagtagtttgggctcgtgggcacgagcggccctgggctgcctggtacaaggactacttctattactgtctgacgcggctggacaagggcncagtagnnnnnnnnnnnnnnnnnnn

SEQ ID NO: 80348 - DNA, 639 bp, Homo sapiens
  misc_feature: GYAE6OF01ASQ9N.44.25.C03.1.454.CMB.1.raw
  modified_base (305)..(305): a, c, t, g, unknown or other
  misc_feature (305)..(305): n is a, c, g, or t
  modified_base (339)..(339): a, c, t, g, unknown or other
  misc_feature (339)..(339): n is a, c, g, or t
  modified_base (379)..(379): a, c, t, g, unknown or other
  misc_feature (379)..(379): n is a, c, g, or t
tcagacagtatatacacgaccggtgctcgatttagtagtgtagatttgggtttgggggaagaggaagactgacggtcctcccaggagttcaggtgctgggcaccttgggcacgggggagtgtgtcacaagatttgggctctgggcaccgtgggcagtggggggagtgtgtcacaagatttggactcctgtcgccccacatggacacttcttgctacacactcctgctgctcgaccctaccccttcgtgggtcttcgcccaggtccacgttgaaggtgtcgtggtcctgtgctggtacgaaacccngagaccgaccctcgacgtctcgacctgccacctntctcgttggttctctctacaactatatagagttggtgtgngtctggctccgtcgaccgcccggaggacgccgtggcgtcgtctcgcactactattcgttacacgtaagtacgaaaaccgtaaactcctaacgtacgtactacttacgtacgtaagaacgtacgtacttaacgttaactacgttaccgaaccgtaacggtaaccctaaccgtaaaccggaaacggtccggttaaggttacgttacgtttaacgtacgtaccgaaccgtaactaccgtacggtacccgaggaccgtaaaccg

SEQ ID NO: 80349 - DNA, 299 bp, Homo sapiens
  misc_feature: GYAE6OF01BQ1R9.44.25.C03.1.454.CMB.1.raw
  modified_base (227)..(227): a, c, t, g, unknown or other
  misc_feature (227)..(227): n is a, c, g, or t
  modified_base (234)..(234): a, c, t, g, unknown or other
  misc_feature (234)..(234): n is a, c, g, or t
  modified_base (249)..(249): a, c, t, g, unknown or other
  misc_feature (249)..(249): n is a, c, g, or t
  modified_base (252)..(252): a, c, t, g, unknown or other
  misc_feature (252)..(252): n is a, c, g, or t
  modified_base (255)..(299): a, c, t, g, unknown or other
  misc_feature (255)..(299): n is a, c, g, or t
tcagacagtatatacacgaccggtgctcgatttagtagtgtagatttgggtttgggtgcccaagctgctggagggcacggtcaccgacggtcaccgtctcctcagcttccaccaacgggcccatcggtccttcccctggcgccctgcctcaggagcacctcgtgggggcaacgacgccggccctgggctgcctggtacaaggactacttccacgtctactgacgtgngcgggcnggacaaggcgactanagnagnnnnnnnnnnnnnnnnnnnnnnnnnnnnnnnnnnnnnnnnnnnnn

SEQ ID NO: 80350 - DNA, 674 bp, Homo sapiens
  misc_feature: GYAE6OF01AILNR.44.25.C03.1.454.CMB.1.raw
  modified_base (187)..(187): a, c, t, g, unknown or other
  misc_feature (187)..(187): n is a, c, g, or t
  modified_base (223)..(223): a, c, t, g, unknown or other
  misc_feature (223)..(223): n is a, c, g, or t
  modified_base (314)..(314): a, c, t, g, unknown or other
  misc_feature (314)..(314): n is a, c, g, or t
  modified_base (386)..(386): a, c, t, g, unknown or other
  misc_feature (386)..(386): n is a, c, g, or t
tcagacagtatatacacgaccggtgctcgatttagtagtgtagatttgggttgggggaagaggaagacctgaccggtccgtccctaggagttctaggtgtcgtgggcaccttgggcacgggggaagtgtgtcaacaagatttgggctcgttggggcacgtgggcagtggggtagtgtgcactaaagntttggactctgtgcccacatgacactcttgcgtacnctactcctgctggcctgaccctacccttctggtcttcgcccaggtcctaccgttgaaggtctcttcggtcctagtgctcggtacaaacccngacgacgacccctcacggcctcggaccgtggccacgtacttcgtcgtcgggttcctcgtacgtacgaacgtnttaagttaggaagttgggtactagacgtccgtaggaccttacccggtaccgacccggaccccgggaaggggtacccgtcccgtacgggtacgtcgtccgttagaccaacctacgtacttaccgtactacgtaactacgtaaactaaacctcctaacgaacgtaaccatccgtagaacgaacgacgtaactaacgttaaccacttaccgtaacgaacgacctaccgtaacggaaagcgtaggtacgttacttgaactccgaacctactacgtacgtccaggtccgtacg

SEQ ID NO: 80351 - DNA, 733 bp, Homo sapiens
  misc_feature: GYAE6OF01AZE0G.44.25.C03.1.454.CMB.1.raw
  modified_base (338)..(338): a, c, t, g, unknown or other
  misc_feature (338)..(338): n is a, c, g, or t
tcagacagtatatacacgaccggtgctcgatttagtagtgtagatttgggtttgggggaagaggaagactgacggtcctcccaggagttcaggtgctgggcaccttgggcacgggggaggtgtgtcacaagatttgggctctgggcaccgtgggcagtggggggagtgtgtcacaagtatttggactcctgtcgccccacatggacactctttgctacacactcctgctgctgacccacccttcgtgggtcttcgtcccaggtcaccttgaaggtgtctggtcctgtagctggtacgaaacccagacgacgaccctcacgtctgaccctgaccacctntcctcgttgggttcctcgtctactaaacggtattagttaaggaacgttggggtacgtagagtcgtaggtaactcccggtacgacccggtccccggaaaggggtaaccgtcccggtagggtaacggttcggtcgttacgaccgtaaccaccgtaacgtttccttaccgtacggtaaacgttaaccgtaaaacgttaaaaccttcccgtaaaccgtaacgttaacctacgtttacccgttacgttaaacgaaggtaaccgtaactttaaaccgtttaacgacgttaacccgtaaccgtaaacggaaccctaacccgtaaccggaaaaacggtcggtaaggttacgtttacgtttagaactacgaaacacgtacgtaccggaccttcggacgtaaccg

SEQ ID NO: 80352 - DNA, 271 bp, Homo sapiens
  misc_feature: GYAE6OF01E3TYV.44.25.C03.1.454.CMB.1.raw
  modified_base (239)..(271): a, c, t, g, unknown or other
  misc_feature (239)..(271): n is a, c, g, or t
tcagacagtatatacacgaccggtgctcgatttagtagtgtagatttgggtttgggtgcccaagctgctggagggcacggtcaccacggtcaccgtctcctcagcttccaccaagggcccatcggtcttccccctggcgccctgcctccaggagcacctctgggggcacagcggccctgggctgcctggtcaaggactacttcctatatactgtctgagcggctggcaaggcgcatagnnnnnnnnnnnnnnnnnnnnnnnnnnnnnnnnn

SEQ ID NO: 80353 - DNA, 274 bp, Homo sapiens
  misc_feature: GYAE6OF01C46YB.44.25.C03.1.454.CMB.1.raw
  modified_base (250)..(251): a, c, t, g, unknown or other
  misc_feature (250)..(251): n is a, c, g, or t
  modified_base (253)..(274): a, c, t, g, unknown or other
  misc_feature (253)..(274): n is a, c, g, or t
tcagacagtatatacacgaccggtgctcgatttagtagtgtagatttgggtttgggtgcccaagtctgctggagggcacggtcaccacggtcaccgtctcctcagctccaccgaagggcccatcggtccttcccctggcgccctgctccaggacgcacctcgtggggcacacgccggccctgggctgcctggtacaaggactacttccacgttcgtactgctggacgtcggctggacaaggcgacatagnntnnnnnnnnnnnnnnnnnnnnnn

SEQ ID NO: 80354 - DNA, 146 bp, Homo sapiens
  misc_feature: GYAE6OF01D5K7K.44.25.C03.1.454.CMB.1.raw
  modified_base (129)..(146): a, c, t, g, unknown or other
  misc_feature (129)..(146): n is a, c, g, or t
tcagacagtatatacacgaccggtgctcgatttagtagtgtagatttgggttgggcacagcggccctgggctgcctggtcaaggactacttcctatatactgtctgagcgggctggcaaggcgcatagnnnnnnnnnnnnnnnnnn

SEQ ID NO: 80355 - DNA, 286 bp, Homo sapiens
  misc_feature: GYAE6OF01EINP7.44.25.C03.1.454.CMB.1.raw
  modified_base (269)..(269): a, c, t, g, unknown or other
  misc_feature (269)..(269): n is a, c, g, or t
  modified_base (275)..(286): a, c, t, g, unknown or other
  misc_feature (275)..(286): n is a, c, g, or t
tcagacagtatatacacgaccggtgctcgatttagtagtgtagatttgggtttggggggaagaggaagactgacggtcctcccaggagttcaggtgctgggcaccttgggcacgggggaggtgtgtcacaagtatttgggctcgtgggcaccggtgggcagtgggggagtgtgtcacaagtatttgggctcgtgggcacagccggccctgggctgcctggtcaaggtactacttcctatatactgtctagacgcgggctggcgaaggcncatagnnnnnnnnnnnn

SEQ ID NO: 80356 - DNA, 136 bp, Homo sapiens
  misc_feature: GYAE6OF01AFJBN.44.25.C03.1.454.CMB.1.raw
  modified_base (130)..(136): a, c, t, g, unknown or other
  misc_feature (130)..(136): n is a, c, g, or t
tcagacagtatatacacgaccggtgctcgatttagtagtgtagatttgggtttgggcacagcggccctgggctgcctggtcaaggactacttcctcgatcgcgtctgagcgggctggcaaggcgcatagnnnnnnn

SEQ ID NO: 80357 - DNA, 137 bp, Homo sapiens
  misc_feature: GYAE6OF01COZR7.44.25.C03.1.454.CMB.1.raw
  modified_base (130)..(137): a, c, t, g, unknown or other
  misc_feature (130)..(137): n is a, c, g, or t
tcagacagtatatacacgaccggtgctcgatttagtagtgtagatttgggtttgggcacagcggccctgggctgcctggtcaaggactacttccacgtctactgctgagcgggctggcaaggcgcatagnnnnnnnn

SEQ ID NO: 80358 - DNA, 910 bp, Homo sapiens
  misc_feature: GYAE6OF01ELW5Q.44.25.C03.1.454.CMB.1.raw
  modified_base (200)..(200): a, c, t, g, unknown or other
  misc_feature (200)..(200): n is a, c, g, or t
  modified_base (233)..(233): a, c, t, g, unknown or other
  misc_feature (233)..(233): n is a, c, g, or t
  modified_base (245)..(245): a, c, t, g, unknown or other
  misc_feature (245)..(245): n is a, c, g, or t
tcagacagtatatacacgaccggtgctcgatttagtagtgtagatttgggtttgggggggcacaagaggcagcactcaggacaatctccagcatggcctggtctcctctcctcctcactctcctcgctcactgcacagggtcctgggcccactctgtgctgacgcacgcccgccctcgagtcgtcgtcggggccccgggnaggacgggtcaccatcctcctgcacgtgggacncagactaccacngtcggacagtattctagactcggtacctacgtaccgtaaccaaccgtacccttacgaacggtaacacccgaaccccctaactccgtactacgtttaccgtttacggtaaacctaacgtccgtacccggtacccttacgggtaccggggttacccctacggaccgttaacttccgttacggtccggtaccttaccgtaacgttccgcggtaccctaccgtaccgaccgtccccttacccggtcggtacccttacgtacccgttaccggtcgggttaccccttaccgggaacgggttaccgtaacggtaaacggtacggttaacgggggttaacgggttaaccgtttaaccgttttaaccggttaaccgtttaccggtaacccttaaaccgggtttaacccttaggtaaaccggttaccgtaacgtaacccggtaacccgttacccggtttaccgggttaggggttttaccgggggtttacggggtttaccggggtaccgggggtaaaccggggtacccgggtaaacccgtaccggttaacccggttacccgggtaccccgggttttaccggggtaacccgggtacccgttaaacccccgggaacccgggttaacccggggttccccgttacccccgggttacccccggtccgggtttaaccccccg

SEQ ID NO: 80359 - DNA, 254 bp, Homo sapiens
  misc_feature: GYAE6OF01B1U2F.44.25.C03.1.454.CMB.1.raw
  modified_base (159)..(159): a, c, t, g, unknown or other
  misc_feature (159)..(159): n is a, c, g, or t
  modified_base (239)..(254): a, c, t, g, unknown or other
  misc_feature (239)..(254): n is a, c, g, or t
tcagacagtatatacacgaccggtgctcgatttagtagtgtagatttgggtttgggtgcccaagctgctggagggcacggtcaccacggtcaccgtctcctcagcttccacaagggcccatcggtcttcccctggcgccctgctccaggagcacctcgngggggcacagcggccctgggctgcctggtcaaggactacttcctatatactgtctggagcgggctggcaaggcgcatagnnnnnnnnnnnnnnnn

SEQ ID NO: 80360 - DNA, 268 bp, Homo sapiens
  misc_feature: GYAE6OF01COG72.44.25.C03.1.454.CMB.1.raw
  modified_base (241)..(268): a, c, t, g, unknown or other
  misc_feature (241)..(268): n is a, c, g, or t
tcagacagtatatacacgaccggtgctcgatttagtagtgtagatttgggtttgggtgcccaagctgctggagggcacggtcaccgtctcctcagcttccaccaagggcccatcggtcttcccctggcgccctgctccaggagcaccgtcgtgggggcacagccggcccgtgggctgccgtggtcaaggtactacttcctcgatcgtcgtctggaggcgggctgggacaaggctacatagnnnnnnnnnnnnnnnnnnnnnnnnnnnn

SEQ ID NO: 80361 - DNA, 632 bp, Homo sapiens
  misc_feature: GYAE6OF01BB69V.44.25.C03.1.454.CMB.1.raw
  modified_base (274)..(274): a, c, t, g, unknown or other
  misc_feature (274)..(274): n is a, c, g, or t
  modified_base (367)..(367): a, c, t, g, unknown or other
  misc_feature (367)..(367): n is a, c, g, or t
tcagacagtatatacacgaccggtgctcgatttagtagtgtagatttgggtttggggggaagaggaagactgacggtcctcccaggagttcaggtgctgggcaccttgggcacgggggaggtgtgtcacaagatttgggctctgggcaccgtgggcagtggggggaggtgtgtcacaagatttggactcctgtgccccacatggacactctttgctacacactcctgctgctgacccaccccttctgggtcttgtcccaggtcaccttgaaggngtctggtcctgtgctggtgaaacccacagacgaccctcacgctgacctgcaccatctctgggttctctctacaacgtatattagaagtgggtntgagcgtggactccgtcgaccgccccgaagggaacggcccgtgggacgtggtcttgcactactactcttcgtacgtaacgtacgaaacgtaaaactcctaactacgttacaacttccttacgtagaacgagacgttaacgtttaaaccctacttaccctacgaaacggtaccaacccctaaccgaaaacggtcgtacgggttacggttactttagtacgtacgtaaccctaaactacgtaccggtacccgttggaccggtaaccg

SEQ ID NO: 80362 - DNA, 554 bp, Homo sapiens
  misc_feature: GYAE6OF01C5XMS.44.25.C03.1.454.CMB.1.raw
  modified_base (134)..(134): a, c, t, g, unknown or other
  misc_feature (134)..(134): n is a, c, g, or t
  modified_base (232)..(232): a, c, t, g, unknown or other
  misc_feature (232)..(232): n is a, c, g, or t
  modified_base (264)..(264): a, c, t, g, unknown or other
  misc_feature (264)..(264): n is a, c, g, or t
  modified_base (269)..(270): a, c, t, g, unknown or other
  misc_feature (269)..(270): n is a, c, g, or t
  modified_base (508)..(508): a, c, t, g, unknown or other
  misc_feature (508)..(508): n is a, c, g, or t
  modified_base (513)..(513): a, c, t, g, unknown or other
  misc_feature (513)..(513): n is a, c, g, or t
  modified_base (515)..(515): a, c, t, g, unknown or other
  misc_feature (515)..(515): n is a, c, g, or t
  modified_base (521)..(524): a, c, t, g, unknown or other
  misc_feature (521)..(524): n is a, c, g, or t
  modified_base (526)..(526): a, c, t, g, unknown or other
  misc_feature (526)..(526): n is a, c, g, or t
  modified_base (528)..(528): a, c, t, g, unknown or other
  misc_feature (528)..(528): n is a, c, g, or t
  modified_base (531)..(533): a, c, t, g, unknown or other
  misc_feature (531)..(533): n is a, c, g, or t
  modified_base (535)..(535): a, c, t, g, unknown or other
  misc_feature (535)..(535): n is a, c, g, or t
  modified_base (537)..(538): a, c, t, g, unknown or other
  misc_feature (537)..(538): n is a, c, g, or t
  modified_base (540)..(540): a, c, t, g, unknown or other
  misc_feature (540)..(540): n is a, c, g, or t
  modified_base (542)..(544): a, c, t, g, unknown or other
  misc_feature (542)..(544): n is a, c, g, or t
  modified_base (546)..(554): a, c, t, g, unknown or other
  misc_feature (546)..(554): n is a, c, g, or t
tcagacagtatatacacgaccggtgctcgatttagtagtgtagatttgggtttgggggggcagagggtcaccatctcctgcactgggagcagatccaacatcgggacagatttctgatgtccactggtaccaanaccttccaggaacagccccccaaatcctcatctttggaacaactatcggccctcaggggtccctgaccgattctctggctccaaggtctggccacctnacgcctccctggccatcactgggcctcaggcngaagnngaggtgattattactgccacgtcctatgacagccagcctcagttggtttcggggtggttcgggcgggacgggtaccaaggtccgtcgacccggttcccgtggtacgacgcccgaaggccctaggcccccccgtcggtccacttacccgttccgttcccgtccccttcctcgtaacttctaccgtgttccgtaggtacggcgggtactcgggaccgaagggtaccgccgttaagtacgngtacncngatcgnnnncncngcnnncncnncntnnncnnnnnnnnn

SEQ ID NO: 80363 - DNA, 794 bp, Homo sapiens
  misc_feature: GYAE6OF01AM7G9.44.25.C03.1.454.CMB.1.raw
  modified_base (200)..(200): a, c, t, g, unknown or other
  misc_feature (200)..(200): n is a, c, g, or t
  modified_base (225)..(225): a, c, t, g, unknown or other
  misc_feature (225)..(225): n is a, c, g, or t
  modified_base (241)..(241): a, c, t, g, unknown or other
  misc_feature (241)..(241): n is a, c, g, or t
  modified_base (254)..(254): a, c, t, g, unknown or other
  misc_feature (254)..(254): n is a, c, g, or t
  modified_base (616)..(616): a, c, t, g, unknown or other
  misc_feature (616)..(616): n is a, c, g, or t
tcagacagtatatacacgaccggtgctcgatttagtagtgtagatttgggtttggggggcgacgaagaggcagcactcaggacaatctccagcatggcctggtctcctctcctcctcactctcctcgcctcactcgcacagggtcctcggcccactctgtgctgacgcagcccgccctcagtcgtccgcggggccccggnacggcgggtccacccatccgtcccngccgtacgtggggacncaggactccaaancgtcggggaacagagttcgtgactcgtcctactacggtacccaaaccgtaccctttccgaacggaaaccaccggtacccccccaaacttcccgtaacacctttaccgttttacggtaaacctaacgtacccgtacccggaccgttaccggtaaccggggtcccttacggtaaccctaacgtttccgttacccgtgggttaccctcccggttaacgtccgttaccgggcccaaccttccgaaccgtcccccttccgtccggccctacgtaccgtaccgtcgggttcccgctaccggcttaggaacctggtagggtacggtagttacctaggttaccgtcacccgttacgttcgtaactcgtanaacggtccctagtccccgttagagggttttgggttacggtccgggttaccggggagggttacccgggaaaccttcgggaccgtttccgggtacccggttacccggtcgggttaaacccgcccgggtaaccccggaacggggtccccgttcccggtaccccccggtcgggttaaccccg

SEQ ID NO: 80364 - DNA, 255 bp, Homo sapiens
  misc_feature: GYAE6OF01DPRNR.44.25.C03.1.454.CMB.1.raw
  modified_base (232)..(232): a, c, t, g, unknown or other
  misc_feature (232)..(232): n is a, c, g, or t
  modified_base (238)..(255): a, c, t, g, unknown or other
  misc_feature (238)..(255): n is a, c, g, or t
tcagacagtatatacacgaccggtgctcgatttagtagtgtagatttgggtttgggtgcccaagctgctggagggcacggtcaccacggtcaccgtctcctcagcttccaccaagggcccatcggtcttcccctggcgccctgctccaggagcacctctgggggacacagcggccctgggctgctggtcaaggactacttccacgtctactgctgagtcggctggcaaggcncatagnnnnnnnnnnnnnnnnnn

SEQ ID NO: 80365 - DNA, 695 bp, Homo sapiens
  misc_feature: GYAE6OF01A8F4A.44.25.C03.1.454.CMB.1.raw
  modified_base (176)..(176): a, c, t, g, unknown or other
  misc_feature (176)..(176): n is a, c, g, or t
  modified_base (215)..(215): a, c, t, g, unknown or other
  misc_feature (215)..(215): n is a, c, g, or t
  modified_base (238)..(238): a, c, t, g, unknown or other
  misc_feature (238)..(238): n is a, c, g, or t
  modified_base (268)..(268): a, c, t, g, unknown or other
  misc_feature (268)..(268): n is a, c, g, or t
  modified_base (456)..(456): a, c, t, g, unknown or other
  misc_feature (456)..(456): n is a, c, g, or t
tcagacagtatatacacgaccggtgctcgatttagtagtgtagatttgggtttgggggggcacaagaggcagcactcaggacaatctccagcatggcctggtctcctctcctcctcactctcctcgctcactgcacgagggtcctggcccactctgtcgctgacgcagcccgcctnagtcgtccgtcggggccccggaaggtacggtcaaccgtntcctcgtgacctacgtgggaacnccgaagtctaccaaacgtgtcggaacagtnttcgtagatcgtcctacgtacggtaaccaactcccttacgaacggaaccacgtacccccaatcctactattaccgttaggaaactaagttacgtcgaccctacggtccgggttaccacgaacggtcttctaccgcgtacctcgtaattcgtacggccacctagtcgtcccctgtacggactagtaccncggtacggtccacggtacggtactaaggtaacgtagtacggtaacggtagttactttaacgtaccgtcgtacccgagttaccgtaatacgtacaacggtcaaccgtacgttcgtaaggttgggtcggtccggtacgggtacgaccgggtaactaccgtcggtaaccggtacccggttcggaaccgggttacgaacccggtacgtaaccgggtgtaacccgttcccgaacggtttacccg

SEQ ID NO: 80366 - DNA, 849 bp, Homo sapiens
  misc_feature: GYAE6OF01AE8AL.44.25.C03.1.454.CMB.1.raw
  modified_base (222)..(222): a, c, t, g, unknown or other
  misc_feature (222)..(222): n is a, c, g, or t
tcagacagtatatacacgaccggtgctcgatttagtagtgtagatttggggtttgggggactcctgtcgccccacatggacactctttgctacacactctgctgctgacccaccctttccgtgggtcttgtcccagggtccacgttaggaacggattcgtcggtcctgtgtcgtggtacgaaacccacgagaccgtaccctcacgctacgacctgaccactntcttcggttggttcctctatacaaacgtagttagttaacgagggttgggtgacgtaggcgttggtaacctccgggtactaaccgggtaacccccgggaagggtaaccgggtccgttgggacgtcggtacttacggacactactacgtccttacgtaacgtaagttacgaaaaaccttaaacgtccgttaaacgacgtaacgtacttaccgtacgaaggaacgtacggtaaccttaaacgttaacccttaacgtaccggtaaacggtaaacccggtaaccctaaaccggaaaccggttaaacgtacggtaccggggttttaatttaacggtttaacggaacgtaccgtaaacgacgtacgtaccgtaaccgggtcaccgggtaacgaacacggtaacaacttaaacgttaccgtagggtacggacgttaacggtaaacgggtaagttaacgggaaacgggaaactacggtcttttaacgggtagtttaacgttaagttaaaccttaattacccgttactaaccgttcgtaacgggttccgggaacgttacgggaggtaaacccgggtacggaccgtaccgtaccggttactaccggtaccgttaacacggtcccgtacggtaacccgg

SEQ ID NO: 80367 - DNA, 754 bp, Homo sapiens
  misc_feature: GYAE6OF01B1HO4.44.25.C03.1.454.CMB.1.raw
tcagacagtatatacacgaccggtgctcgatttagtagtgtagatttgggtttggggggggtcacaagaggcagcgctctcgggacgtctccaccatggcctgggctctgctattcctcaccctcctcactcagggcacgagggtcctgggcccagtctgccctgactcagcctgcctccgtgtcgtgggtccactggacagtcgatcaccatcctcgtgcacgtggacgcccaggacggttaattctttcgtagtttactttaactttcgtctccgtgtactactaacagtcactaccgaacggtaaacccacccctaactcctatactactacttagtcgacggtcctaaagtacggtaccggtaccccttgggttaacggggtttacttaactaccggttacttccgtaccttccgtaccctacggaaccgttcccggaacaacccgtaccggtcccgttacctcgaacgtactccgtcggtcgggtacctcggacggacggtagacgggacggtacgttctaagtttaacgtttatttacgggttcgtccgttacaacgttaggtacgtttccggttcgacgtacctacttaccttacgtttagttcgggttacggtacgggtacggtaccgggtaaccgtaccggtacccgttcggtacccgttaacggtaacccgccccggtaacccggaaacccgtacccgtaaaccccggtcttaccgtaccccgttccttccccgggttaccccc

SEQ ID NO: 80368 - DNA, 922 bp, Homo sapiens
  misc_feature: GYAE6OF01BUA0I.44.25.C03.1.454.CMB.1.raw
  modified_base (133)..(133): a, c, t, g, unknown or other
  misc_feature (133)..(133): n is a, c, g, or t
  modified_base (281)..(281): a, c, t, g, unknown or other
  misc_feature (281)..(281): n is a, c, g, or t
  modified_base (315)..(315): a, c, t, g, unknown or other
  misc_feature (315)..(315): n is a, c, g, or t
tcagacagtatatacacgaccggtgctcgatttagtagtgtagatttgggtttgggggaagaggaagactgacggtcctcccaggagttcaggtgctgggcaccgttgggcacgggggagtgtgtcacaagtntttgggctcgtgggcaccggtgggcaagtgggggagtgtgtcacaagatttggactcctgtcgccccacagtggactacttcttgctacacactcctgctgctcgaccctcccttcgtggtccttcgcccaggtccacttggaaggtntcgtcggtcctggtacgctaggtacgaaaacccngacgaccgacccctgaaccggtctcggaaccttgaccaacctacgttccttcgtcgggttttacctcctaccggttaccaaaacggtattaagtttaaaggaacggttggggtgtacggtaaggcgtttacgggacctttaccccggacggtaaacccggccccccggaaaagggggtaaacccggtccccgtttagggaaaccccgggttggtccgtttacgggaaccctaacggtaacctacgtttccttaacggtaacccggttaaataacgggtaaaaccggttaaaaaacttccccggaacttaacgttaaccgtaacgtttaaccgtacccgtaaaggtaaaccggtacggtaacccgtttaaacggtttaaaacccaacgttttaccccggaaacccgttaaaaccgggaaaccccttaaaaccccggtaaaacccggtaaaacgggttaccgggttaaccggggtttaaccggttttaaaccgtttttaaaacgggtacccgttaaaaccccggggaaacccgtttaaaaacggtaaccccgggttaaaccccggggtaccccttaaaaccgggggttccccgggtaaaaaaccccggg

SEQ ID NO: 80369 - DNA, 751 bp, Homo sapiens
  misc_feature: GYAE6OF01D8G7F.44.25.C03.1.454.CMB.1.raw
tcagacagtatatacacgaccggtgctcgatttagtagtgtagatttgggtttgggggggcacaagaggcagcactcaggacaatctccagcatggcctggtctcctctcctcctcactctcctcgctcactgcacagggtcctgggcccactctgtgctgacgcagcccgccctcagtgtcgtcgggggcccccggggcaggagggtccaccacttcctcctgcacgtggggagcagactaccaactagtcggggaacagtatttccgtgaatcgtacccacgttacggtaacccaaacctacccttaccgaaggaaccaaccgaccccccctaaaactccctacatttccgttttacggtaaacctaactacgtcccggtccctacggaccggggttcccctcggaaccgtctttccgtcgtcggccttaccgaacggttccgtacggacctaaccttcgaccgtccccttccccgtggccctaacgtccaccggtcgggtaccctccgaggtctacggaagtacgtagggtaagggttgttaactttacgtacgtccgtaccgtacgtttaccctagtacgaaccgtacgacctaacggtccccttaggtacgggtttcgggggttggggttacggttccggggacggggtaccggaaccgtacggtccgtaccgggttcccggtaccggttacgggtaccaccgggtaccccgtagggtccccgtcccggtcccccggtgtaccccg

SEQ ID NO: 80370 - DNA, 825 bp, Homo sapiens
  misc_feature: GYAE6OF01C8273.44.25.C03.1.454.CMB.1.raw
  modified_base (207)..(207): a, c, t, g, unknown or other
  misc_feature (207)..(207): n is a, c, g, or t
  modified_base (236)..(236): a, c, t, g, unknown or other
  misc_feature (236)..(236): n is a, c, g, or t
  modified_base (797)..(797): a, c, t, g, unknown or other
  misc_feature (797)..(797): n is a, c, g, or t
tcagacagtatatacacgaccggtgctcgatttagtagtgtagatttgggtttgggggcttcagctgtgggcacaagaggcagcactcaggacaatctccagcatggcctggtctcctctcctcctcactctcctcgctcactgcacagggtcctgggcccactctgtgctgacgcagcccgcctcagtgtcgtcggggccccgggnaggaggtccacatcctctgcacgtgggancagactaccaaacgtgtacgggaacagtacttcgtagtaattccgtacctacgtacggtaacccaacctacccgttaccgaacggaaccctaccgacccccaaacgtccctactactttacgtttacggtaaacctacgtaccgtcccggtaccctaccggtaccggggttaccctacggtaacccgttactttccgtacgttccggtaccttacccgtaggttccgtcggacctacccggtaccgtccgtccccgtcccgtaccggacccttacgaccgtaacccggtcgggtacccgtaccggacggtacgtaacggaaacggttggtacgggtaacggttagttaaccgttttacgttaacccgtttcgtaacggtttcccttaggtaccgtaaccggacgttaccgacggttacccgttagggttacggggtttccgggggtttaggggttaccccggggttacgggggtaacccggggttaacgggtaccccggtaaagggtttcccccggtaaacgggttccccggggttacccggttacgggggttaaaccccnccggggtaaacccccggtaaccccgggg

SEQ ID NO: 80371 - DNA, 226 bp, Homo sapiens
  misc_feature: GYAE6OF01C4JS1.44.25.C03.1.454.CMB.1.raw
  modified_base (215)..(215): a, c, t, g, unknown or other
  misc_feature (215)..(215): n is a, c, g, or t
  modified_base (220)..(226): a, c, t, g, unknown or other
  misc_feature (220)..(226): n is a, c, g, or t
tcagacagtatatacacgaccggtgctcgatttagtagtgtagatttgggtttggggggaagaggaagactgacggtcctcccaggagttcaggtgctgggcaccttgggcacgggggaggtgtgtcacaagatttgggctctgggcacagccggccctgggctgcctggtcaaggactacttcctatatactgtctgagcgggctggcaaggcncatgnnnnnnn

SEQ ID NO: 80372 - DNA, 731 bp, Homo sapiens
  misc_feature: GYAE6OF01AT9LO.44.25.C03.1.454.CMB.1.raw
tcagacagtatatacacgaccggtgctcgatttagtagtgtagatttgggtttgggggaagaggaagactgacggtcctcccaggagttcaggtgctgggcaccttgggcacgggggaggtgtgtcacaagatttgggctctgggcaccgtggggcagtggggggaggtgtgtcacaagatttggactcctgtcgccccacatggacacttctttgcctacacctacctcctgctcgctcgacccctcccctttcgtggtcttcgtccaggtccacgttgaaggtcgtctcggtcctgtcgcgtggtacaaacccagacgacgtaccctcacgtctcgacctgccacctatcgttcgtggttcctccgtctacaacgtataatagtaaggtgggtgtagcgtcgtaggaccgttccgacgacccggaccccgaaggggacccgtccggtggacgggtcggtctcgaccaccgtactacttacccgttactaacgtaacgtaacgaaaaccgtaaaaccgttaccgtaacgtaaccgtactaccgttcgtacgtaagtaacgtaacgtaaccttaaccgtttaaacccacgttacccgtaaccgtaaaccgaaccctaacccgtaaaaccgaaaccgggtacgttacgggttagtttaaccgtttaacgtacgtaaccgtaaacccgaacgtaaccgtaaccgtaaccccggtacggtaaccggtaacccgg

SEQ ID NO: 80373 - DNA, 301 bp, Homo sapiens
  misc_feature: GYAE6OF01AQ44Y.44.25.C03.1.454.CMB.1.raw
  modified_base (245)..(245): a, c, t, g, unknown or other
  misc_feature (245)..(245): n is a, c, g, or t
  modified_base (247)..(247): a, c, t, g, unknown or other
  misc_feature (247)..(247): n is a, c, g, or t
  modified_base (250)..(301): a, c, t, g, unknown or other
  misc_feature (250)..(301): n is a, c, g, or t
tcagacagtatatacacgaccggtgctcgatttagtagtgtagatttgggtttgggtgcccaagctgctggagggcacggtcaccacggtcaccgtctcctcagcttccaccaagggcccatcgtcttcccctggcgccctgctccaggagcacctcgtgggggcacgaggccggccctggggctgccgtggtcaaggactacttccacgtctactgctggagcgggctgacgaaggcgcatagngnagnnnnnnnnnnnnnnnnnnnnnnnnnnnnnnnnnnnnnnnnnnnnnnnnnnnn

SEQ ID NO: 80374 - DNA, 262 bp, Homo sapiens
  misc_feature: GYAE6OF01A782E.44.25.C03.1.454.CMB.1.raw
  modified_base (234)..(234): a, c, t, g, unknown or other
  misc_feature (234)..(234): n is a, c, g, or t
  modified_base (240)..(262): a, c, t, g, unknown or other
  misc_feature (240)..(262): n is a, c, g, or t
tcagacagtatatacacgaccggtgctcgatttagtagtgtagatttgggtttgggtgcccaagctgctggagggcacggtcaccacggtcaccgtctcctcagcttccaccaaggcccatcggtcttccccctggcgccctgctccaggagcacctctgggggcacagcggccctgggctgcctggtcaaggactacttcctatatactgtctgaggcgggctggcaacggcncatagnnnnnnnnnnnnnnnnnnnnnnn

SEQ ID NO: 80375 - DNA, 780 bp, Homo sapiens
  misc_feature: GYAE6OF01EUYAO.44.25.C03.1.454.CMB.1.raw
tcagacagtatatacacgaccggtgctcgatttagtagtgtagatttgggtttgggggactcctgtgccccaccatggacactctttgctacacactcctgctgctgacccaccccttcctgggtcttgtcccaggtcaccttgaaggagtctggtcctgtgctggtacgaaacccacagacgaccctcacgctcgacctgcaccatctcgttgggttctcctctacaacgtattattagtaagtgggtgtgagcgtggactccgtcaccgaccccggagggaccggcccgtgggagtggtacgttcgccaaccactactcgttactcgtaatacggaaacgtaaaactcccgtaatactaacgtacttacgtctaaggaacgtaacgtacgttaaccgtttaacctaccttaccgtaacccgaacggtaaccctaacccgtaaccgaaaggtcggtaaggttcggtttaactttagtaactacgaaccctaacgacgtccggaccctcggaccgtaacgacgtacgacctaagtacttaacgtttacgtaggtcggtaaccgggtaaggttaacggtaacggggaaacggtaaaccgaaacgtacggttacggttttacggtttaagttacgttttaaagtttaaacgtttaacgttacccgttaacgttacgttccggtaacggggttacggttaccggggtacgggaaaccggaaccgggtaccgaaccggtccgtaccgtccttacctacgtacccgtccgtaaccggaccccggg

SEQ ID NO: 80376 - DNA, 793 bp, Homo sapiens
  misc_feature: GYAE6OF01B1MMS.44.25.C03.1.454.CMB.1.raw
tcagacagtatatacacgaccggtgctcgatttagtagtgtagatttgggtttgggggactcctgtgccccaccatggacactctttgctacacactcctgctgctgaccacccttcctgggtcttgtcccaggtcaccttgaaggagtctggtcctgtgctggtgaaacccacagacgaccctcacgctgacctgcaccatctcgtggttctctctcaacgatattagagtgggtgtagagcgtggactccgtcaccgaccccggagggaacggcccgtggaggtggcttcgacacactactcttctacgaataggaaacgaaaactcctaacgaacgtactactctacgagaagacgtactaacgttaacactctaaccgaacgaacctaacccgtaacgaaacggtcgtaggttcggttactttagtactaacgaaccaaacgtgtacccggtaccgaggacccggtaacaaccggacggacaactaagttaacgtttagtacggtacggtaaccgggtaacgggttaacggtacgggaaaaccggggaaaactaacggtaccggtttcgttttaacggtttacggtttaacgtttaaacgttttaacgttaaaccggttttacccgttaaaccgttaacggttcccggtttacggggaacccgggttttcgggtaacgggggtaaacccgaaacccgggggttaccccggtaaccggttacccggtaaccccctttaccggtaccccgttacggtacccgtttccccgtaaccccgtaaacccccgggg

SEQ ID NO: 80377 - DNA, 713 bp, Homo sapiens
  misc_feature: GYAE6OF01EZZQH.44.25.C03.1.454.CMB.1.raw
  modified_base (670)..(670): a, c, t, g, unknown or other
  misc_feature (670)..(670): n is a, c, g, or t
  modified_base (680)..(680): a, c, t, g, unknown or other
  misc_feature (680)..(680): n is a, c, g, or t
  modified_base (688)..(689): a, c, t, g, unknown or other
  misc_feature (688)..(689): n is a, c, g, or t
  modified_base (692)..(692): a, c, t, g, unknown or other
  misc_feature (692)..(692): n is a, c, g, or t
  modified_base (697)..(698): a, c, t, g, unknown or other
  misc_feature (697)..(698): n is a, c, g, or t
  modified_base (700)..(701): a, c, t, g, unknown or other
  misc_feature (700)..(701): n is a, c, g, or t
  modified_base (703)..(704): a, c, t, g, unknown or other
  misc_feature (703)..(704): n is a, c, g, or t
  modified_base (706)..(706): a, c, t, g, unknown or other
  misc_feature (706)..(706): n is a, c, g, or t
  modified_base (708)..(709): a, c, t, g, unknown or other
  misc_feature (708)..(709): n is a, c, g, or t
  modified_base (711)..(713): a, c, t, g, unknown or other
  misc_feature (711)..(713): n is a, c, g, or t
tcagacagtatatacacgaccggtgctcgatttagtagtgtagatttgggtttgggggctgttcctggaaggtgttggtaccagagggtcaccatctcctgcactgggagcagatccaacatcgggacagattctgatgtccactcggtacaacaccttcagaacacgaccccaaactcctcattctttggaacaactagtccgccctcgacgggtccctagaccgtactttcctacgtggtcctaccgtaacgtccgttcggacccaccctacaaccgtcccctccccgtagggaccccaagtcctaaccggtccgggtaccctacccgaaggtaccgttaaggaaaagttaggtagggtaaggggttaacgttaattttaacttaccgtccggtacccgtaacgttacccgttaagtacggaaccgtaccggaccgtaaccgtcccgttaaggtcgggtttggggttacgggttcggtaccggggacgggaacggtaaaccacggtccgtaccggtaccgttcccggtagggtaccaaccggtaacccgtaaccggtcccgacccgtccccggttacgtaccttaccgttccgtcccgttccccgtacccctcttactactactcgtcgtaccgaggtcggtcgtcgtacggacgacggcgatacgtntcgatacgtncgaatganncgncgagnnanncnnancnncnnn

SEQ ID NO: 80378 - DNA, 132 bp, Homo sapiens
  misc_feature: GYAE6OF01DPAWD.44.25.C03.1.454.CMB.1.raw
  modified_base (130)..(132): a, c, t, g, unknown or other
  misc_feature (130)..(132): n is a, c, g, or t
tcagacagtatatacacgaccggtgctcgatttagtagtgtagatttgggtttgggcacagcggccctgggctgcctggtcaaggactacttcctatatactgtctgagcgggctggcaaggcgcatagnnn

SEQ ID NO: 80379 - DNA, 553 bp, Homo sapiens
  misc_feature: GYAE6OF01EWDA3.44.25.C03.1.454.CMB.1.raw
  modified_base (237)..(237): a, c, t, g, unknown or other
  misc_feature (237)..(237): n is a, c, g, or t
  modified_base (345)..(345): a, c, t, g, unknown or other
  misc_feature (345)..(345): n is a, c, g, or t
  modified_base (361)..(361): a, c, t, g, unknown or other
  misc_feature (361)..(361): n is a, c, g, or t
  modified_base (366)..(366): a, c, t, g, unknown or other
  misc_feature (366)..(366): n is a, c, g, or t
  modified_base (383)..(383): a, c, t, g, unknown or other
  misc_feature (383)..(383): n is a, c, g, or t
  modified_base (425)..(425): a, c, t, g, unknown or other
  misc_feature (425)..(425): n is a, c, g, or t
  modified_base (503)..(503): a, c, t, g, unknown or other
  misc_feature (503)..(503): n is a, c, g, or t
  modified_base (507)..(507): a, c, t, g, unknown or other
  misc_feature (507)..(507): n is a, c, g, or t
  modified_base (511)..(511): a, c, t, g, unknown or other
  misc_feature (511)..(511): n is a, c, g, or t
  modified_base (515)..(515): a, c, t, g, unknown or other
  misc_feature (515)..(515): n is a, c, g, or t
  modified_base (519)..(519): a, c, t, g, unknown or other
  misc_feature (519)..(519): n is a, c, g, or t
  modified_base (530)..(530): a, c, t, g, unknown or other
  misc_feature (530)..(530): n is a, c, g, or t
  modified_base (532)..(534): a, c, t, g, unknown or other
  misc_feature (532)..(534): n is a, c, g, or t
  modified_base (542)..(542): a, c, t, g, unknown or other
  misc_feature (542)..(542): n is a, c, g, or t
  modified_base (544)..(544): a, c, t, g, unknown or other
  misc_feature (544)..(544): n is a, c, g, or t
  modified_base (546)..(546): a, c, t, g, unknown or other
  misc_feature (546)..(546): n is a, c, g, or t
  modified_base (548)..(549): a, c, t, g, unknown or other
  misc_feature (548)..(549): n is a, c, g, or t
tcagacagtatatacacgaccggtgctcgatttagtagtgtagatttgggtttgggggctgttcctggaaggtgttggtaccagagggtcaccatctcctgcactgggagcagatccaaacatcgggacagattctgatgtccactggtaccaacaccttccaggaacagcccccaaatcctcatcttttaggaaacaactactcggacccctgaggggtcccctggaccgatttcncgtgctaccgaaagttcgtcggacctacccttacgactccccttcccgtggaccctatccgaacgttgggccttccgagctagaacgatggagggttaatttattacngccagttcctatcgangcaanccctagagttggttggngtcggacggaggaccagctagcgttctggacagccgaggtcnccgccctgactatcccgttctccccacgttcctattacatcctgtcgtgagtcggctggacccgagacgtctaagtcngctnacgntaancgancgctagcagtnannnacgtagananananngtga

SEQ ID NO: 80380 - DNA, 672 bp, Homo sapiens
  misc_feature: GYAE6OF01BQ4NV.44.25.C03.1.454.CMB.1.raw
  modified_base (556)..(556): a, c, t, g, unknown or other
  misc_feature (556)..(556): n is a, c, g, or t
  modified_base (644)..(644): a, c, t, g, unknown or other
  misc_feature (644)..(644): n is a, c, g, or t
  modified_base (648)..(649): a, c, t, g, unknown or other
  misc_feature (648)..(649): n is a, c, g, or t
  modified_base (651)..(658): a, c, t, g, unknown or other
  misc_feature (651)..(658): n is a, c, g, or t
  modified_base (660)..(672): a, c, t, g, unknown or other
  misc_feature (660)..(672): n is a, c, g, or t
tcagacagtatatacacgaccggtgctcgatttagtagtgtagatttgggtttgggggctgttcctggaaggtgttggtaccagagggtcaccatctcctgcactgggagcagatccaacatcgggacagattctgatgtccactggtaccaacaccttccaggaacacgcccccaaactcctcatctttggtaacaactatccggccctcgacggggtccctgaccgtattcctctcggcctccaagtctgccacctcacgcctcccgtggccatccacgtcgggtcctccgaggctaggaagtacgtggagggtgtatttattaccgtcgccgtacgtaccttagtacgaacacgaccgtacgtcccgtacgttagggtttggggtttaggggttccgggttacggggacggggtaacgggaaccccgtaaaggtcccgttaccggtaaccccgggttccggttacggggtaccgacccggaccccgtacggtcccgtccccggttaccccccggttcgttcccgtaaccgttccgtttccccggtttcccccncccgtttacccgtacttaacgttacttacgtttcgtcggtaggaccggtccgggtcgtcgggccggtaacggccgcttaacggtagcngtcnncnnnnnnnncnnnnnnnnnnnnn

SEQ ID NO: 80381 - DNA, 798 bp, Homo sapiens
  misc_feature: GYAE6OF01EIXXT.44.25.C03.1.454.CMB.1.raw
tcagacagtatatacacgaccggtgctcgatttagtagtgtagatttgggtttgggggggcacaagaggcagcactcaggacaatctccagcatggcctggtctcctctcctcctcactctcctcgctcactgcacagggtcctggcccactctgtcgctcgacgcacgcccgccctcagtcgtcgtcgggggccccgggcaggacgggtccaccagtcctccgtgcacgtgggacgcagactaccaacgacgtacgggacagtactttcaggtatcgtaccacgtcgtaaccaactcccttacgaacggaacaccgaccccctaaactcctacgtagttcgtttaacggaaactaaccgtactccggcccctacggaccggggttaccccaggtacccgtaacttccgtacgtcggaccttacgaacgttcgtacgcctaacctcaccggtccctccgtgacctagtccacgtcggacctccgagtcgtaaggaaacgtacgtagggtaaacggttcgtaacttttaacgtaccgtacgtaccgttacgttacccgtaatacggtaaccacggtacctacggttacccgtaacgggttcgggtttagggggtttaccggggtttaccggtaccgggggtaaacccggggtacggggtaaaaccccgtacgggttacccgtacccgggtttaaacccggtccgggttaaccggggttaaccccgacccgggtaaaccccgggttaaccgttaccccgggttcccccgggtttcccccccgttaaacggggtttccccc

SEQ ID NO: 80382 - DNA, 890 bp, Homo sapiens
  misc_feature: GYAE6OF01DPIMT.44.25.C03.1.454.CMB.1.raw
tcagacagtatatacacgaccggtgctcgatttagtagtgtagatttgggtttgggggggcacaagaggcagcactcaggacaatctccagcatggcctggtctcctctcctcctcactcctcctcgctcactgcacgacgggtcctcgggccctacttcgtgtcgcgtggacgcacgccgcctcgagttcgtcggtccgggggcccgggcaggacggtcaccgacttcctccgtcgcctaacggtcgggagcaaggtacctaaccaacgtacgtaccgggactagtactttcgtcgtaacttccgtacctaacgttacggtaaccaacctaccttaccggaacggaacctacccggaacccctaaacgtcctataacgtttaccggtttaacggtaaactaccgttacggtcccggtacccgtacggaacccggggtttcccacggtaccgttattccgttccgtacggccttaaccggtaacggttccgacgtacccgtaaccttaccgacggttcccctaccgttacgggaccctaacgttccggtaacccggtcgggtacccttaccggtacggtacgtaaacggagttaacgggttagggtaacgggtttacgttaaaccgttttacggttacctccggtaacccgtttacggtttacccgttaacggtacggtaaccgaccggttaccggtaccggttaccggttaaccgggtttcggggttacgggggttttcgggtaccgggggtttaacgggggaaccgggtaccggtaacccggtaaacgggttcccgttaccggggttcccgtttccggggtacggttacccggaaccgtaacccgggaccggttccccggtcccggttaccccgttcgggttaccccg

SEQ ID NO: 80383 - DNA, 829 bp, Homo sapiens
  misc_feature: GYAE6OF01CZC6Z.44.25.C03.1.454.CMB.1.raw
  modified_base (196)..(196): a, c, t, g, unknown or other
  misc_feature (196)..(196): n is a, c, g, or t
  modified_base (200)..(200): a, c, t, g, unknown or other
  misc_feature (200)..(200): n is a, c, g, or t
  modified_base (226)..(226): a, c, t, g, unknown or other
  misc_feature (226)..(226): n is a, c, g, or t
  modified_base (239)..(239): a, c, t, g, unknown or other
  misc_feature (239)..(239): n is a, c, g, or t
tcagacagtatatacacgaccggtgctcgatttagtagtgtagatttgggtttgggggggcacaagaggcagcactcaggacaatctccagcatggcctggtctcctctcctcctcactctcctcgctcactgcacaggtcctgggcccactctgtgctgacgcagcccgccctcagtgtcgtcgggggccccggnaggnggtccaccatctcctgcacgtgggancagactaccaacngtacggatagattctgatcgacctacgtcgtaaccaactacctacgaaggaaccaccgacccctaaactcctacgtacttcgtttacgtaaacctaacgtacgtcccggaccctaggtacccgggtaccctacgtaacccgtatttccctcgttcggtaaccctttacccgaagtttccggacccggtaccctaacccgttaccgacccgttcccccgttcccggtaccggtaaccccttagttacccgtacccgggttaccgggtacccgttaaccccggacgggtaccgttaaacggaacgggttaaacggtacggggttaacgggtttaacgtttaaccgttttaaacgtttaccgtaccgggttaaccccgtttaacggttaacccgtttaacggtacggtaaaccgtaaccggacgttaacccggtaccgttacggttaacgggtttggggtttacgggttccgggttaaccggggaaccgggtaaacgggtacccgaacggtccggtacggtaacccggtcgggtacggttaccgaccggttaccgaaccggtccgtaccccggtccccgtaccgggttacccg

SEQ ID NO: 80384 - DNA, 302 bp, Homo sapiens
  misc_feature: GYAE6OF01CD9ER.44.25.C03.1.454.CMB.1.raw
  modified_base (280)..(302): a, c, t, g, unknown or other
  misc_feature (280)..(302): n is a, c, g, or t
tcagacagtatatacacgaccggtgctcgatttagtagtgtagatttgggtttgggtgcccaagctgctggagggcacggtcaccacggtcaccgtctcctcagcttccaccaagggcccatcggtcttccccctggcgccctgcctccaggagcaccctcgtcggggggcacgacggccgggcccgtggggctcggcccgttgggtaccgaaagggtaccttacctttcctaatacttacctgtcgtggacggcgggtctggacgaagggcacagtagnnnnnnnnnnnnnnnnnnnnnnn

SEQ ID NO: 80385 - DNA, 775 bp, Homo sapiens
  misc_feature: GYAE6OF01C6OZD.44.25.C03.1.454.CMB.1.raw
  modified_base (264)..(264): a, c, t, g, unknown or other
  misc_feature (264)..(264): n is a, c, g, or t
  modified_base (764)..(764): a, c, t, g, unknown or other
  misc_feature (764)..(764): n is a, c, g, or t
tcagacagtatatacacgaccggtgctcgatttagtagtgtagatttgggtttgggggcttcagctgtgggcacaagaggcagcactcaggacaatctccagcatggcctggtctcctctcctcctcactctcctcgctcactgcacagggtcctgggcccacttcgtgtcgctgaccgcacgcccgtccctgagtcggtccggtcgggggccccgggacaaggcgggtccaccattcctccgtacgccgtaacggtggggacncgtaagtacctaccaaacgacgtacggacagtacttcgtagactcgacctacgtacggtaacctaacctaccgttccgaaaggaacctaccggaaccccctaaacgtccctactaagtttcccgtttaacggaaacctaacgttaccgtacccggtccccgtacggtaaccggggttccccctagggtaaacccggtacttttcccggtaaccgttccgggtaccttaaccccgtaaaggttttcccgtacgggaccctaaacccggttccaacccgttcccgttccccgtacggaacccctacgttaccctaacgggttccgggtaccttaacccgggagtacccgttaaggaaacggtcgtaagggtaacgggtttacgtaactttacgttaacgtcgaacctacgttacctagtacgactacggactacgtccgtaagtggttacggtaggtcggtacgggcggaacggtaccaacggcgttccgtaccgtgcggtncccggtaaccg

SEQ ID NO: 80386 - DNA, 731 bp, Homo sapiens
  misc_feature: GYAE6OF01EZP94.44.25.C03.1.454.CMB.1.raw
  modified_base (235)..(235): a, c, t, g, unknown or other
  misc_feature (235)..(235): n is a, c, g, or t
  modified_base (674)..(674): a, c, t, g, unknown or other
  misc_feature (674)..(674): n is a, c, g, or t
  modified_base (684)..(684): a, c, t, g, unknown or other
  misc_feature (684)..(684): n is a, c, g, or t
  modified_base (688)..(688): a, c, t, g, unknown or other
  misc_feature (688)..(688): n is a, c, g, or t
  modified_base (694)..(694): a, c, t, g, unknown or other
  misc_feature (694)..(694): n is a, c, g, or t
  modified_base (711)..(711): a, c, t, g, unknown or other
  misc_feature (711)..(711): n is a, c, g, or t
  modified_base (728)..(728): a, c, t, g, unknown or other
  misc_feature (728)..(728): n is a, c, g, or t
tcagacagtatatacacgaccggtgctcgatttagtagtgtagatttgggtttggggctgttcctggaggtgttggtacagagggtcaccatctcctgcacgtggagcagatccaacatcgggacagattctgatgtccatggtaccaactccttcgaacggaacaccgaccccaaactcctctattcttaggtaacaactacgtccggccctcggacgggttccctagaccgtnttcctcgtcggtacctaccgaagttccgtcggacctacctacgccggtcccttcccgtggaccctaagtccgacgtcgggtacctccgagggtacctaaggaagacggttaggtagggttcaattttaccgttaccgcgtaccgtacgttacctaagtcgaaacgtcgtaccacggttcctagggttaggttgggtttcggggttacggtaccggacggggtaaccggaaccgtaagttcccgtacgttacccgggtccgttaacgggctacccggaccgtaacggcccgttaccccgtccccgttagtacccgttcttccgttaccccgttccccgtaccctttaccgttacgttaaccttacgttaccgttacggtcggttacgggaccggttaccgggtacttaccgggacgtaaccggtagtacgacgttacggncgtatccggntacntcgtcngtcagtacgctagcgtncgtctaagctagcacgntgc

SEQ ID NO: 80387 - DNA, 259 bp, Homo sapiens
  misc_feature: GYAE6OF01BB1RP.44.25.C03.1.454.CMB.1.raw
  modified_base (224)..(259): a, c, t, g, unknown or other
  misc_feature (224)..(259): n is a, c, g, or t
tcagacagtatatacacgaccggtgctcgatttagtagtgtagatttgggtttggggggaagaggaagactgacggtcctcccaggagttcaggtgctgggcaccttgggcagtgggggaggtgtgtcacaagatttgggctctgggcacagcggcctggctgcctggtcaaggactacttcctatatactgtctgagcgggtctggacaaggcgacaagtagnnnnnnnnnnnnnnnnnnnnnnnnnnnnnnnnnnnn

SEQ ID NO: 80388 - DNA, 829 bp, Homo sapiens
  misc_feature: GYAE6OF01A8F7N.44.25.C03.1.454.CMB.1.raw
  modified_base (178)..(178): a, c, t, g, unknown or other
  misc_feature (178)..(178): n is a, c, g, or t
tcagacagtatatacacgaccggtgctcgatttagtagtgtagatttgggtttggggggcacaagaggcagcactcaggacaatctccagcatggcctggtctcctctcctcctcacccttctcattcactgcacgaggtcctcggcccagtctgtgttcgacgcacgcccgccctcngttcgtctcggaccggccccaaggacaggcggtccacctacttctcctgtctcgtacggaacgaaccctctaagttgttaaggaaattattagtagtactcgtacggtaccagacctaccgtaccgaggacaccacccgacccctaaacttcctacgtttaatttaacgtacgtaaactaaaacttaacgtaacccggtacccgtaacccgtttacggaacgggtttaccctttaccggttaaccgggaaaccccgttttccttacccgttccggttaacccggtacccttaaccgggtaacgttccggtaccggtaccctaacccgtccgaacccgtacccccgtaccggtaccgacccttaaccgtacccccggtacccggtaacctaccccgggtaacggtaaccggggtaccgggaaccgggtaaccggttacccgttaagtttaacgttaaccggcgggtaaccgggtaggtaaccgggtagtaccgtacgtaaccgtcggtaacgtcggtacgggtccggtacggttacgttccggttcggtccggttacggaccggtacgggtacgtaccggtaccgtaccgtacgtacgaccgaccgaccggtacgcccgtccgtacccgtcgtaccgtccgtacgttccccg

SEQ ID NO: 80389 - DNA, 246 bp, Homo sapiens
  misc_feature: GYAE6OF01C97NF.44.25.C03.1.454.CMB.1.raw
  modified_base (238)..(246): a, c, t, g, unknown or other
  misc_feature (238)..(246): n is a, c, g, or t
tcagacagtatatacacgaccggtgctcgatttagtagtgtagatttgggtttgggtgcccaagctgctggagggcacggtcaccacggtcaccgtctcctcagcttccaccaagggcccatcggtcttcccctggcgccctgctccaggagcacctcgtgggggcacagcggccctgggctgcctggtcaaggctacttcctatatactgtctgagcgggctggcaaggcgcatagnnnnnnnnn

SEQ ID NO: 80390 - DNA, 244 bp, Homo sapiens
  misc_feature: GYAE6OF01A4E0A.44.25.C03.1.454.CMB.1.raw
  modified_base (217)..(217): a, c, t, g, unknown or other
  misc_feature (217)..(217): n is a, c, g, or t
  modified_base (223)..(244): a, c, t, g, unknown or other
  misc_feature (223)..(244): n is a, c, g, or t
tcagacagtatatacacgaccggtgctcgatttagtagtgtagatttgggtttggggggaagaggaagactgacggtcctcccaggagttcaggtgcgtgggcaccttgggcagtgggggaggtgtgtcacaagatttgggctctgggcacagcggccctgggctgcctggtccaaggctacttcctatatactgtctgagcgggctggcaagggcncagagnnnnnnnnnnnnnnnnnnnnnn

SEQ ID NO: 80391 - DNA, 710 bp, Homo sapiens
  misc_feature: GYAE6OF01D5GB4.44.25.C03.1.454.CMB.1.raw
tcagacagtatatacacgaccggtgctcgatttagtagtgtagatttgggtttgggggcttcagctgtgggcacaagaggcagcactcaggacaatctccagcagtggcctggtctcctctcctcctcactcctcctcgtctcactcgacaacgcggttccgtcgggccctacgtctggtcgcgtgacgcgcgcccgcctacgtggttcggtccgggtccgggggaccccggagacggtacgggtacccacgtacttcctaccgtcgaccgtacggacgggacgacgacgtaccgtaaccaacgacggtcgaacgtagtacgttcgtagtctcgtaccgtacgtaccgaacctacctaccgtacgaaccgaccgaccctaacccactctactacttacgtacaactcgtacgtccgaccgtacggtaccgtaccgtacgtctagtcgtacgtccgtacgtacgtaaccgtcgtacacctccgtactcccgtccgtcgtaccgctacgtcgtacgtcgcgacgtacgacgtagacgtaggtagtcgtacgtagttaccgtcacgtaccgttcgtaacgttacgacctacggacctacgtaccgtcggttacgggttaggtcggggttacgggtcggtacgggacgggtaaccgggacggtccggtaccggttaccggtcgggttaccggtcgaacggcccggttaaccggg

SEQ ID NO: 80392 - DNA, 822 bp, Homo sapiens
  misc_feature: GYAE6OF01DBG52.44.25.C03.1.454.CMB.1.raw
  modified_base (136)..(136): a, c, t, g, unknown or other
  misc_feature (136)..(136): n is a, c, g, or t
  modified_base (228)..(228): a, c, t, g, unknown or other
  misc_feature (228)..(228): n is a, c, g, or t
  modified_base (314)..(314): a, c, t, g, unknown or other
  misc_feature (314)..(314): n is a, c, g, or t
tcagacagtatatacacgaccggtgctcgatttagtagtgtagatttgggtttgggggcttcagctgtgggcacaagaggcagcactcaggacaatctccagcatggcctggtctcctctcctctcactctcctcnctcactgcacgacgggtcctcgggcccacttctgtggctacgacgcacgcccgccctcgagttcggtccgggtccgggggccccccgggganaacggggtacgggtcccaacctacttccctccgtacgacgtacggtggggaacgctaacgtacctaccaaacgacggtaccggganacgtacttcgtacggtactccgtaccgtacgtaccggtaaccccaaccgttacccgtaccggaaacgaacccggacccctaaccccctaaacttccctaacgttacgttaccggttttaaccggaaaacctacgttaccggtcccgtacccggtttacgaccggggttccccaaccggttacgttacctttccgtcgtaccggtaccttacccgagtttcccggacgtacccttaccgaccggtaccgtcccgtacccggtcgtaacctgtacccgtacggtcggtccgtacgcgtacgtagggaatacggtcggtacggtttacgtactttacgttacggcgttacccgaacgttacgtacgtaacgccgttaacgaccgttacgttaccggttcggtagggtttgggggttcggtacgggttcccgggggaacggttaaccgggaccgtccgggttaccgtacccgggtaccgggtacggtccgggacccgacgtaaaccccgggg

SEQ ID NO: 80393 - DNA, 518 bp, Homo sapiens
  misc_feature: GYAE6OF01ETG24.44.25.C03.1.454.CMB.1.raw
  modified_base (420)..(420): a, c, t, g, unknown or other
  misc_feature (420)..(420): n is a, c, g, or t
  modified_base (491)..(492): a, c, t, g, unknown or other
  misc_feature (491)..(492): n is a, c, g, or t
  modified_base (494)..(494): a, c, t, g, unknown or other
  misc_feature (494)..(494): n is a, c, g, or t
  modified_base (496)..(518): a, c, t, g, unknown or other
  misc_feature (496)..(518): n is a, c, g, or t
tcagacagtatatacacgaccggtgctcgatttagtagtgtagatttgggtttgggggctgttcctggaaggtgttggtaccagagggtcaccatctcctgcactgggagcagatccaacatcgggacagattctgatttccactggtaccaacaccttccaggaacagcccccaaatcctcatctttggtaaacaactatcggccctcaggggtccctgaccgtattctctcggctaccaagtcgtggccaacctcacgtccctcccctggccctatcatgggctccaggctgaagatgagggtgattattactcgccagtcctatgacagcagcctcagtgggttggttcgtcggcggacggaaccaagctcgccgtcgtcgggtcacggcccaacggctcgccccccgtgggtaccncgtccttccgttccccacccttcctctacgtacttacgtgtctgcggtggcgtcggacgagtcgacagacnngntnnnnnnnnnnnnnnnnnnnnnnn

SEQ ID NO: 80394 - DNA, 910 bp, Homo sapiens
  misc_feature: GYAE6OF01EQGV5.44.25.C03.1.454.CMB.1.raw
  modified_base (146)..(146): a, c, t, g, unknown or other
  misc_feature (146)..(146): n is a, c, g, or t
tcagacagtatatacacgaccggtgctcgatttagtagtgtagatttgggtttgggggacgtcctgtgcccaccatggacactctttgctacacactcctgctgctgaccacccttcctggtcttgtcccaggtcaccttgaaggngtctggtcctgtgctggtgaaacccacagagaccctcacgctgacctgcacattctcgtcggttctctctacaacgtatagttagaagttggggtgtgacggcgtaggactccgtcaccggcccgagggaacgccgtggtaggcggtctcgaccaacacgtactcttacgtacgaagttacggaaacgtaaaaacgttacccagtaactacactactcgtaagaagtacgtaccgttaacgtttaaaccacttacccgtaaccgtaaacgggtaacccctaaccggtaaaccgaaaacgggtacccggtaggggtttacgtttaaccgttttaaggtaccgtaaacggtaaacccgtaaacgttaaccgggtttacgggacccccggttaggaacccgggtaaacgaccggtaaacgggtaaacccaacgtttaaacgtttaactttaaaccgggttcgggtaccgtaacccgggtttaaacgggggtaaaccttacgggggaaaccccggggaaaattaaacgggtaacggtttaccgggtttttaccggttaggtttaaacggttttaaacgttttaacggttaaacccgttttaccggttaaacttaccggtacggggtttaccggggtaccgggttaacgggggtacccggggtaaacggtaaaacccggggtaacccggttacccgggttaacccgtcccccgtttaacggtacccctaacccgttacggtccccccttaacgggtaaaacccccgggg

SEQ ID NO: 80395 - DNA, 726 bp, Homo sapiens
  misc_feature: GYAE6OF01B54M9.44.25.C03.1.454.CMB.1.raw
  modified_base (356)..(356): a, c, t, g, unknown or other
  misc_feature (356)..(356): n is a, c, g, or t
tcagacagtatatacacgaccggtgctcgatttagtagtgtagatttgggtttgggggactcctgtgccccaccatggacactctttgctacacactcctgctgctgaccaccccttcctgggtcttgtcccaggtcaccttgaaggagtctggtcctgtgcgtggtacgaaacccacagacgaccctcacgctgacctgcaccatctcgtgggttctctctacaacgtatattagaagtgggtgtgagcgtggactccgtacgaccgacccggagggacggcccgtaggagtggcttcgcacgactacttcttctacgaatagaaaccgtaaaactcctaacacgtacactactntagaagagtactaacgttaacctactacctaaccgaacgaaccacccgtaacgaaacggcgtaggttagttacgtttagtaacgtacgaaccaactacgtaccggtacccgtacggaccgacgaacgacggactaacgttattaacgttacgtacgtacggaacggttacgggtaagtacgggaaacggtaaacgtaaccgtagtacgtttggttacgttagttaacttaagttaccgttaccttacgtacttacggtcgggtaccggtacgggtacgggtaaccgggaaccgggttaaccccggtacggttaccccgttacccgtccgttacccgacgtacccgttacccgtaacccggtaaccccggg

SEQ ID NO: 80396 - DNA, 757 bp, Homo sapiens
  misc_feature: GYAE6OF01BIC9W.44.25.C03.1.454.CMB.1.raw
  modified_base (147)..(147): a, c, t, g, unknown or other
  misc_feature (147)..(147): n is a, c, g, or t
  modified_base (176)..(176): a, c, t, g, unknown or other
  misc_feature (176)..(176): n is a, c, g, or t
  modified_base (309)..(309): a, c, t, g, unknown or other
  misc_feature (309)..(309): n is a, c, g, or t
tcagacagtatatacacgaccggtgctcgatttagtagtgtagatttgggtttgggggactcctgtgccccaccatggacactctttgctacacactcctgctgctgacccacccttcctgggtcttgtcccaggtcacttgaaggngtctggtcctgtgcgtggtacgaaacccnaagaccgaccctcacgctcggacctgaccaacctgttcttacggttcggtttcctctaccgtacaaacggtattaattaaggtagttggggtatcgagtcgtggactccgcgaccgcccgaggacgccgtggngtcgctgccacagtactcttacagaatgaaacgtaaactcctactagtactatctcgagaacgtacgtactaacgttaccacttacgaccgaacgtaactacccgtaacgaacggtacggtaggttcggttaacttacgtacgtacacgtaaacgtccgtaccgacccgtacggaccgtaccgaaacgagaacctacgtaaacgttatttaacgtacggtaccgtacggtaacgggtaacgtaacgggtaaacggaaaccgtaagttcggtaccggtttagttacgggttatttaacgttaacgttaaccggttacttacgtactttacgggtacccggtaagttacggggtaaccgggaaggtaaacccgggtacccggtaccgtaaccccgttccgttaccgttaacccgttaccgtacccggtcccgttaaaccgaaaccccggg

SEQ ID NO: 80397 - DNA, 247 bp, Homo sapiens
  misc_feature: GYAE6OF01A10HT.44.25.C03.1.454.CMB.1.raw
  modified_base (239)..(247): a, c, t, g, unknown or other
  misc_feature (239)..(247): n is a, c, g, or t
tcagacagtatatacacgaccggtgctcgatttagtagtgtagatttgggtttgggtgcccaagctgctggagggcacggtcaccacggtcaccgtctcctcagcttccaccaagggcccatcggtcttccccctggcgccctgctccaggagcacctctgggggcacagcggccctgggctgcctggtcaaggactacttccacgtctactgctgagcgggctggcaaggcgcatagnnnnnnnnn

SEQ ID NO: 80398 - DNA, 848 bp, Homo sapiens
  misc_feature: GYAE6OF01AV0SI.44.25.C03.1.454.CMB.1.raw
tcagacagtatatacacgaccggtgctcgatttagtagtgtagatttgggtttgggggcttcagctgtgggcacaagaggcagcactcaggacaatctccagcatggcctggtctcctctcctcctcactctcctcgctcactgcacgagggtcctcgggcccactctgtgctgacgcacgcccgccctcagttcgtcgtcgggggccccgggcaggacgggtccaccgagttcctccgtcgccacgtgggacgacagactaccaacgacgtcgggacagtacttcgtcgtatccgtaccaccgtacggtaacccctaacctacccgttaccgaacggtaacccgaacccgaacccccgtaaaccttccgtaactactttaccgtttaacggtaaacctaaacgttccgtacccggtccctaaccggtaccgggttaccccgttcggtaacccgtctttaccgtcgtacgggtacctaacccgtaacgttccgtcgggtacccctaccgttacccgacccggtaccccttcccgggtacgacccccgttatcccgtaacccgggtccgggtacctacccgggaaggtcccggttaaaggtaaacgggtacgttaaccgggggaaggttttaccggtttaaactttaaccgttacccggtaaccgttacccggttaacgttacccgttaaggtaccgaaccggtaccggtaccgtaccgtaaccgttcggggttacgggtttcgggggtttacggggtccgggtttaacccggggacggggaaacccgttaacggcccgtttacgtcccggggtacccgttacggccgggtccgaccgggtaaccccgg

SEQ ID NO: 80399 - DNA, 815 bp, Homo sapiens
  misc_feature: GYAE6OF01BFQWA.44.25.C03.1.454.CMB.1.raw
  modified_base (135)..(135): a, c, t, g, unknown or other
  misc_feature (135)..(135): n is a, c, g, or t
  modified_base (375)..(375): a, c, t, g, unknown or other
  misc_feature (375)..(375): n is a, c, g, or t
tcagacagtatatacacgaccggtgctcgatttagtagtgtagatttgggtttggggggaagaggaagactgacggtcctcccaggagttcaggtgctgggcaccttgggcacgggggggagtgtgtcacaagtntttgggctcgtgggcaccggtgggcaagtggggggagtgtgtcacgaagtatttggactcctagtcgcccccacatggacaccttctttgctaacacacctcctgctgctacgacccaccccttcgtgggtccttcggtaccccagggtcctaccttggaaggtctcgtggttacctggtcgtacgttaggtaccgaaaacccacgaacgaaccgtaccccgtcaacgccgtagtacccngtaccaacctacgtccgttaccggttggttacttccgttactaccaaaggtaattaagttaggaaggtggggtaagtcgtaacggtccgtaggtaccttaccggaccgacccgtaaccccggagggggtaacccgccggtagggacggtacggtcgttacgacacctacgtacgttccgttactaagtaaacgtaccgtaaaaacgtaaaccttacccgtaaaccgtaacttaaccgacttaccggtaacaaggtaaacgtaacgtaccgttaaaccgttaacccgtaacgttaacccgttaacggaaacccgtaaccttaaaccggtaaacccgtaaaagtccgggttaacgggttaacggtttaaccgttaagttaaccgtaaccgtaaacctaaaccgtacggttaacccggtacccgtaaaggtcccggaaacccg

SEQ ID NO: 80400 - DNA, 570 bp, Homo sapiens
  misc_feature: GYAE6OF01B87T0.44.25.C03.1.454.CMB.1.raw
  modified_base (268)..(268): a, c, t, g, unknown or other
  misc_feature (268)..(268): n is a, c, g, or t
  modified_base (278)..(278): a, c, t, g, unknown or other
  misc_feature (278)..(278): n is a, c, g, or t
  modified_base (296)..(296): a, c, t, g, unknown or other
  misc_feature (296)..(296): n is a, c, g, or t
  modified_base (298)..(298): a, c, t, g, unknown or other
  misc_feature (298)..(298): n is a, c, g, or t
  modified_base (300)..(301): a, c, t, g, unknown or other
  misc_feature (300)..(301): n is a, c, g, or t
  modified_base (309)..(309): a, c, t, g, unknown or other
  misc_feature (309)..(309): n is a, c, g, or t
  modified_base (312)..(312): a, c, t, g, unknown or other
  misc_feature (312)..(312): n is a, c, g, or t
  modified_base (319)..(319): a, c, t, g, unknown or other
  misc_feature (319)..(319): n is a, c, g, or t
  modified_base (328)..(328): a, c, t, g, unknown or other
  misc_feature (328)..(328): n is a, c, g, or t
  modified_base (331)..(331): a, c, t, g, unknown or other
  misc_feature (331)..(331): n is a, c, g, or t
  modified_base (339)..(340): a, c, t, g, unknown or other
  misc_feature (339)..(340): n is a, c, g, or t
  modified_base (344)..(345): a, c, t, g, unknown or other
  misc_feature (344)..(345): n is a, c, g, or t
  modified_base (376)..(376): a, c, t, g, unknown or other
  misc_feature (376)..(376): n is a, c, g, or t
  modified_base (389)..(389): a, c, t, g, unknown or other
  misc_feature (389)..(389): n is a, c, g, or t
  modified_base (393)..(393): a, c, t, g, unknown or other
  misc_feature (393)..(393): n is a, c, g, or t
  modified_base (410)..(410): a, c, t, g, unknown or other
  misc_feature (410)..(410): n is a, c, g, or t
tcagacagtatatacacgaccggtgctcgatttagtagtgtagatttgggtttgggtgcccaagctgctgggagggcacggtcaccacggtcaccgtctcctcagcttccaaccgaagggcccatcggtccttccccctggccgccctgctccgaggagccacctcgtcgggggcacaggccggccgtgggctcgctggtacgacggtactactccgtcgactcgcgtacgtggcgcgggcgtggacgaacgggcgacgtagtacgtnagctgctcgntatgacatcggatcggancntnncgcgcgcngancgcgctngcgctacgngtngtcgtagnnacannacactcgtgtactcgtctgacgcgctacacncgtactacgactntacncacgtacgtacgacganacgtacctactacgtcacgtacgtcgacgtccgtacgagtacgtacgacgtacgtacgtacgtacgtacgtaacgtcgtagtcgtcggtaactacgttaacgtacgtaaacggtctaaccgtacttaacggtcgtaccgacggtaccggtacggtcgtcg

SEQ ID NO: 80401 - DNA, 756 bp, Homo sapiens
  misc_feature: GYAE6OF01BI4C0.44.25.C03.1.454.CMB.1.raw
  modified_base (148)..(148): a, c, t, g, unknown or other
  misc_feature (148)..(148): n is a, c, g, or t
  modified_base (178)..(178): a, c, t, g, unknown or other
  misc_feature (178)..(178): n is a, c, g, or t
  modified_base (204)..(204): a, c, t, g, unknown or other
  misc_feature (204)..(204): n is a, c, g, or t
  modified_base (247)..(247): a, c, t, g, unknown or other
  misc_feature (247)..(247): n is a, c, g, or t
tcagacagtatatacacgaccggtgctcgatttagtagtgtagatttgggtttgggggactcctgtgccccacatggacactctttgctacacactcctgctgctgaccaccccttcctgggtcttgtcccaggtcaccgttgaaggngttctggtcctgtgctggtacgaaacccanagacgccctcacgctgacctgcaccntctcgttggttctctctacaacgtattaattagaagtgggtgngagcgtaggactccgtccgaccgccccgagggaccggccgtagggagtcggcttacgaccacactcttcttacgtacgagtaacgaactaaacttaccgactagtactactcgtactaagaagtactacgttaactaactcgtacctaacggaacgacctaaccgaacggtaacggtacgtaggttcgtttagttatacgtacgaactaagcgtacggtacctcggaacgacgtacgcgaactactaagtttacttgtacggtaacggtacggtaagggtaacgtaacgggaacggtaaacgacggttaagtcgttttacggtaagtttacgtttaacgttaagttaaccttacgttaaccgttaggttaacggttccgggtaagggtttacccgggtaaacgggggtaaacccgttaaccggggtacccggttaaacccgtacgggtaccccgttacccggttacccttaccggtaccgttacccccggtaaacccggtaaccccggg

SEQ ID NO: 80402 - DNA, 291 bp, Homo sapiens
  misc_feature: GYAE6OF01BGAJ9.44.25.C03.1.454.CMB.1.raw
  modified_base (266)..(291): a, c, t, g, unknown or other
  misc_feature (266)..(291): n is a, c, g, or t
tcagacagtatatacacgaccggtgctcgatttagtagtgtagatttgggtttgggtgcccaagctgctggagggcacggtcaccacggtcaccgtctcctcagcttccaccaagggcccatcggtccttccccctggcgccctgctccgaggagcaccctcgtcgggggcacgacggccggccctggggctcgccgttggtcaaggtaccttacctttcctattacgtactgtcgtggacggcgggctggacgaggcgacagtgnnnnnnnnnnnnnnnnnnnnnnnnnn

SEQ ID NO: 80403 - DNA, 266 bp, Homo sapiens
  misc_feature: GYAE6OF01A7JHU.44.25.C03.1.454.CMB.1.raw
  modified_base (240)..(266): a, c, t, g, unknown or other
  misc_feature (240)..(266): n is a, c, g, or t
tcagacagtatatacacgaccggtgctcgatttagtagtgtagatttgggtttgggtgcccaagctgctggagggcacggtcaccacggtcaccgtctcctcagcttccaccaagggcccatcggtcttccccctggcgccctgctccaggagcacctcgtgggggcacagcggccctgggctgcctggtcaaggactacttcctatatactgtctgagcgggctggcaaggcgcatagnnnnnnnnnnnnnnnnnnnnnnnnnnn

SEQ ID NO: 80404 - DNA, 355 bp, Homo sapiens
  misc_feature: GYAE6OF01BKRVY.44.25.C03.1.454.CMB.1.raw
  modified_base (269)..(270): a, c, t, g, unknown or other
  misc_feature (269)..(270): n is a, c, g, or t
  modified_base (272)..(272): a, c, t, g, unknown or other
  misc_feature (272)..(272): n is a, c, g, or t
  modified_base (275)..(275): a, c, t, g, unknown or other
  misc_feature (275)..(275): n is a, c, g, or t
  modified_base (278)..(278): a, c, t, g, unknown or other
  misc_feature (278)..(278): n is a, c, g, or t
  modified_base (281)..(284): a, c, t, g, unknown or other
  misc_feature (281)..(284): n is a, c, g, or t
  modified_base (286)..(355): a, c, t, g, unknown or other
  misc_feature (286)..(355): n is a, c, g, or t
tcagacagtatatacacgaccggtgctcgatttagtagtgtagatttgggtttgggtgcccaagctgctggagggcacggtcaccacggtcaccgtctcctcagcttccaccaagggcccatcggtccttccccctggcgccctgctccaggagcacctcgtgggggcacgagccggcccgtgggcctgccgtaggtcaacggacttacctttcctattactactcgtcttggacggcggggctggacgtaagggcgactatagctgcnngntantgntannnngnnnnnnnnnnnnnnnnnnnnnnnnnnnnnnnnnnnnnnnnnnnnnnnnnnnnnnnnnnnnnnnnnnnnnn

SEQ ID NO: 80405 - DNA, 233 bp, Homo sapiens
  misc_feature: GYAE6OF01BOQB3.44.25.C03.1.454.CMB.1.raw
  modified_base (222)..(233): a, c, t, g, unknown or other
  misc_feature (222)..(233): n is a, c, g, or t
tcagacagtatatacacgaccggtgctcgatttagtagtgtagatttgggtttggggggaagaggaagactgacggtcctcccaggagttcaggtgctgggcaccttgggcagtgggggaggtgtgtcacaagatttgggctctgggcacagcggccctgggctgcctggtcaaggactacttcctatatactgtctgagcgggctggcaaggcgcagtagnnnnnnnnnnnn

SEQ ID NO: 80406 - DNA, 776 bp, Homo sapiens
  misc_feature: GYAE6OF01DJABR.44.25.C03.1.454.CMB.1.raw
  modified_base (180)..(180): a, c, t, g, unknown or other
  misc_feature (180)..(180): n is a, c, g, or t
  modified_base (217)..(217): a, c, t, g, unknown or other
  misc_feature (217)..(217): n is a, c, g, or t
  modified_base (223)..(223): a, c, t, g, unknown or other
  misc_feature (223)..(223): n is a, c, g, or t
  modified_base (243)..(243): a, c, t, g, unknown or other
  misc_feature (243)..(243): n is a, c, g, or t
tcagacagtatatacacgaccggtgctcgatttagtagtgtagatttggggtttggggggactcctgtgccccaccatggacactctttgctacacactcctgctgctgacctacccttcctgggtcttggtcccaggtcaccttgaaggagtctggtcctgtgctgggtacaaacccanatacgaccctcacgctgacctgcaccatctgtggtcntcctanaacgatattagaagtgggtntaggagctggatccgacacgaccccgagggacgcctggaggtgctgcacacacttcctgtacgaatacgaaactaaaactcctaacgaatactactctactagaaagcgaacgtaagtttaaccagttacctaacgaaacgaccaacccgaacgtaaaaaggcgtagggttacggttacgtttaacgactacgaaacctaacgtacggtaccggaacccgtggaaccggaacaaccggaacggtctaaaccttaagttaccgttaacgttgggtacggtacgggtaaccggggttaaatacggggaaacccgggggtaaaattaaaccggacgggttacgttttacggtttaaaccgttaggttaaactttaaacgttaaccggttttaccgtaaaccggttacgttacgtaccggggttacggtaccggggtaaagggggaacccgtaaaacggggtaccggaaccccggtttcgaacccggtttccctacccggttacaacccggttccccttaacccggaaaaccccggg

SEQ ID NO: 80407 - DNA, 851 bp, Homo sapiens
  misc_feature: GYAE6OF01EKT9Q.44.25.C03.1.454.CMB.1.raw
  modified_base (417)..(417): a, c, t, g, unknown or other
  misc_feature (417)..(417): n is a, c, g, or t
  modified_base (566)..(566): a, c, t, g, unknown or other
  misc_feature (566)..(566): n is a, c, g, or t
  modified_base (836)..(836): a, c, t, g, unknown or other
  misc_feature (836)..(836): n is a, c, g, or t
tcagacagtatatacacgaccggtgctcgatttagtagtgtagatttgggtttgggggggcacaagaggcagcactcaggacaatctccagcatggcctggtctcctctcctcctcactctcctcactcactgtgcgtagggtccctgggcccagtctgtcgatgtctcacgaccctaccgtcaggtccgttaccggtaccggggaccccccgggtggtacgggggtacccaccgtacttccgttaccgtttcgttacggtaacggggtaaacgtaacggttacctaaagttacgtaccggtacttactttacgttccgtagttaccgtaaggtttcggttaccggtaccggggtaccttaccccggaacggacccccggtaaccccggtacccccggttaacttaccgttttaacncgttaccgtcgtaaccgtttacttaaccgtacggcccggttacccggtcccgtaacggggtacccgggtcccctacggtacccttacgttcctacggtccgtccttaaccggacgttcgtaccgactaccgacgtacgaccgttaccgntaccctcgttaccgtgtactcgtacgtacgttcgaggtacgtagtacgggtactcggttactactttaacgcgttgatcggacgaggtcggtaggacgtacggaaccggtaccggaccggtaacgttcggggttacggttaacgggtcccggggaacgggttacgtaacccggttacggttcccggaaccgtttacggcggtaacccgaccggaccggttccggacccttcccccgggtaaccgttaccctaccggttcccggtttcccncccgggtttaccccc

SEQ ID NO: 80408 - DNA, 852 bp, Homo sapiens
  misc_feature: GYAE6OF01B4G0C.44.25.C03.1.454.CMB.1.raw
  modified_base (437)..(437): a, c, t, g, unknown or other
  misc_feature (437)..(437): n is a, c, g, or t
tcagacagtatatacacgaccggtgctcgatttagtagtgtagatttgggtttgggggaagaggaagactgacggtcctcccaggagttcaggtgcgtgggcaccgttgggcacgggggagtgtgtcacaagatttgggctcgtgggcaccggtgggcagtgggggagtgtgtcacaagtatttggactcctgtcgccccactgtggactacttctttgctacactctcctgctgcctcgacccgtacccttcgtggtcctcgtccaggttctaccgttaggaacggtgttcgttacggtccttaggtcggccttagggttaccaaaacccgtgaacgacctcccctacgacgtacgtcgacctcgaccacctattccgttcggtcgttaccttcctacgtaacgaacgttaatttacgtaaggtaggtggggttanacgggtacgtcggtcggtaaccgttcccgaaccgacccgggtaccccggtaaaggggtacccgttcggttaggggtacgtcggttacgttaccgacctaaacggttctaacggtttcccgtttaacgtacggtaaaacgtaacccgtaaaaccgttaaacccgtttacccgtaaacggttaaccttaccggtacttcggttaaccggtaacgggtaaacgtaccggtttaaaccgttttaaaccgttaccctaacgttaccccggtaaacccgtaaacggtaaccccttaaaaccgggtaacccggaaagggtttccgggtaacggttttacgtttaaacccggttagaacccgttacggtaaaacctacccgggttaggtaacccccggtaacgacggggtacccgtaaacccg

SEQ ID NO: 80409 - DNA, 775 bp, Homo sapiens
  misc_feature: GYAE6OF01CG6OR.44.25.C03.1.454.CMB.1.raw
  modified_base (273)..(273): a, c, t, g, unknown or other
  misc_feature (273)..(273): n is a, c, g, or t
  modified_base (302)..(302): a, c, t, g, unknown or other
  misc_feature (302)..(302): n is a, c, g, or t
tcagacagtatatacacgaccggtgctcgatttagtagtgtagatttgggtttggggggaagaggaagactgacggtcctcccaggagttcaggtgctgggcaccttgggcacgggggaggtgtgtcacaagatttgggctctgggcaccgtgggcatgggggaggtgtgtcacaagatttggactcctgtgccccacagtggacactctttgctacacactcctgctgctgaccacccttctgggtcttcgtcccaggtcaccttgaacggngtctggtcctgtcgctggtacgaaacccncgtacgacgtacccctcacgtccgtcgtaacccgtgacctacctatccgttcgttacgggtttcctcgttacctacgaaaccgtagttaactttaacggaaaggttcggggtacgttacgacggttacgtagggtacctcccggtaccgacccgggtaccccccggtaagggggtaacccgcccggttagggtaacggttcgggttccgttacggacctaaccgtactacgttcctttaccgtaaccgtaaacgtacggaaaccgtaaaaactcccgtaacgtaacgtaactacgttccttacgtacggaaacgtacgtaccgttaaccgtttaaccaacgtttacccgtaccgtaaacgtacccgaaacccttaccggaaaacggttcggtaacgggttacgtttaacggttacgttacgtaacggtaccctaaaccgacggttaccggaacccgtggtaaccgtaacccgg

SEQ ID NO: 80410 - DNA, 925 bp, Homo sapiens
  misc_feature: GYAE6OF01CBC76.44.25.C03.1.454.CMB.1.raw
  modified_base (606)..(606): a, c, t, g, unknown or other
  misc_feature (606)..(606): n is a, c, g, or t
tcagacagtatatacacgaccggtgctcgatttagtagtgtagatttgggtttgggggactcctgtgccccaccatggacactctttgctacacactcctgctgctcgaccctaccccttccgtggtcttcgtcccaggtcctacgttgaaggagtcgtcggtccgtgtgctagtacgaaacccagagacgaccctcacgtcgtcgaccgtgacctactcgtcgtcgttcggttctcctacgtaacaacgttattaaaggttagaaggttcgggtgtagacgtcgtcggtaaccgttccgcggaaccccggccggaaggggtacccggtacggtaggtaggtccgtcgttaccgacgtaaccgaacttccgttacgttaccgaagttaaacgtaaacggtaaaaccgtaaaacctaccgtaaagtaccgtaacttcgtaacgtacgtaacgaagtacgttaaccgttaaacgttaaccgtaacctaccgtaaaccgacgtaaacccgaacccgtaaaacgggaaaccgttcggttaacggtttacggtttaggttaaaccgtggtaaacccgtaacgtaaccgtacggtaacccggacccgggtanaaccccggtaacggagtacccgtaaacgtacgtttaaagtccgttaagtagggtacccgtaaagggtaacggtaacggttaaaaccgggaagttaaaacgtaacggtcgttttaacggttaggttaacgttaagttttaaccgttaacttaaccggtttaataacgggtacggtttacgggaccggtttaacgggtaccggaaaccgggggtaaaggttaacccccgggtacggttaaccccggttaccggtaacccggtttacccctaacccgttaccgggttacccccgttaaaccgtccccgggtaaaacccccgg

SEQ ID NO: 80411 - DNA, 208 bp, Homo sapiens
  misc_feature: GYAE6OF01BY85N.44.25.C03.1.454.CMB.1.raw
  modified_base (165)..(208): a, c, t, g, unknown or other
  misc_feature (165)..(208): n is a, c, g, or t
tcagacagtatatacacgaccggtgctcgattttagtagtgtagatttgggtttggggggagggtgtgtcacaagatttgggctctgggcacagcggccctgggctgcctggtcaaggctacttccacgttctactgctggagcgggctggcaaggcgcaatagnnnnnnnnnnnnnnnnnnnnnnnnnnnnnnnnnnnnnnnnnnnn

SEQ ID NO: 80412 - DNA, 350 bp, Homo sapiens
  misc_feature: GYAE6OF01AOT52.44.25.C03.1.454.CMB.1.raw
  modified_base (140)..(140): a, c, t, g, unknown or other
  misc_feature (140)..(140): n is a, c, g, or t
  modified_base (257)..(257): a, c, t, g, unknown or other
  misc_feature (257)..(257): n is a, c, g, or t
  modified_base (281)..(350): a, c, t, g, unknown or other
  misc_feature (281)..(350): n is a, c, g, or t
tcagacagtatatacacgaccggtgctcgatttagtagtgtagatttgggtttgggtgcccaagctgctggagggcacggtcaccacggtcaccgtctcctcagcttccaccaagggcccatcggtccttccccctggcnccctgctcccaggacgcacccgtcgtgggggaccacacggccgggccccgtggggcctcgccgttggtaccaaggtaccttacttcctatattactggtctggacggtccgggtcgnggacgaacgggccgactaagtagnnnnnnnnnnnnnnnnnnnnnnnnnnnnnnnnnnnnnnnnnnnnnnnnnnnnnnnnnnnnnnnnnnnnnn

SEQ ID NO: 80413 - DNA, 270 bp, Homo sapiens
  misc_feature: GYAE6OF01BKYBF.44.25.C03.1.454.CMB.1.raw
  modified_base (221)..(221): a, c, t, g, unknown or other
  misc_feature (221)..(221): n is a, c, g, or t
  modified_base (245)..(270): a, c, t, g, unknown or other
  misc_feature (245)..(270): n is a, c, g, or t
tcagacagtatatacacgaccggtgctcgatttagtagtgtagatttgggtttgggtgcccaagctgctggagggcacggtcaccacggtcaccgtctcctcagcttccaccaagggcccatcggtctcccctggcgccctgctccaggagcacctcgtgggggcacgaggcggcccgtgggctgcctggtacaaggactacttcctcgatcgcgtctggngcgggctggacaaggcgcagtagnnnnnnnnnnnnnnnnnnnnnnnnnn

SEQ ID NO: 80414 - DNA, 746 bp, Homo sapiens
  misc_feature: GYAE6OF01C7OOA.44.25.C03.1.454.CMB.1.raw
  modified_base (192)..(192): a, c, t, g, unknown or other
  misc_feature (192)..(192): n is a, c, g, or t
  modified_base (207)..(207): a, c, t, g, unknown or other
  misc_feature (207)..(207): n is a, c, g, or t
  modified_base (284)..(284): a, c, t, g, unknown or other
  misc_feature (284)..(284): n is a, c, g, or t
  modified_base (319)..(319): a, c, t, g, unknown or other
  misc_feature (319)..(319): n is a, c, g, or t
  modified_base (411)..(411): a, c, t, g, unknown or other
  misc_feature (411)..(411): n is a, c, g, or t
tcagacagtatatacacgaccggtgctcgatttagtagtgtagatttgggtttgggggaagaggaagactgacggtcctcccaggagttcaggtgctgggcaccttgggcacgggggagtgtgtcacaagattttggctctggcaccgtgggcagtgggggagtgtgtcacaagtatttggaccttctgtcnccccacagtggaacncttcttgctacacactcctgctgctacgaccctaccccgtttctggtccttcgccctaggtccaacgttggaaggtntactcggtcctggtgtcgttcggtacaaacccganacgacgtaccctcgacgtcctagaccgtgaccactacgtcctcggttcggttctcgtactacaaacgtattacgttaagagttcggggttanacggtcgtcgtacggtaccgtccgttaaccgacccgggaccccggtaaaggggtaaaccggtcccgtaagggggtacggttaccggttaccgttacggacctaaccgtaacttaccgtttccgtttacgttaaaccggaacgtttaaccgaaaacgttaaaaacccttaccgtaaacgttaaccgttaactacgttactacgtaagaacgacgtaacgttagttaacctacttacgtaccgtaaacgaccctaaccgtaaacgaagacgtacggttagttaacgttagtaaccgttacgacgtaaacctaggtcccggaacctaggccgtaaacg

SEQ ID NO: 80415 - DNA, 283 bp, Homo sapiens
  misc_feature: GYAE6OF01BISKC.44.25.C03.1.454.CMB.1.raw
  modified_base (152)..(152): a, c, t, g, unknown or other
  misc_feature (152)..(152): n is a, c, g, or t
  modified_base (226)..(226): a, c, t, g, unknown or other
  misc_feature (226)..(226): n is a, c, g, or t
  modified_base (241)..(245): a, c, t, g, unknown or other
  misc_feature (241)..(245): n is a, c, g, or t
  modified_base (247)..(248): a, c, t, g, unknown or other
  misc_feature (247)..(248): n is a, c, g, or t
  modified_base (251)..(251): a, c, t, g, unknown or other
  misc_feature (251)..(251): n is a, c, g, or t
  modified_base (255)..(255): a, c, t, g, unknown or other
  misc_feature (255)..(255): n is a, c, g, or t
  modified_base (258)..(283): a, c, t, g, unknown or other
  misc_feature (258)..(283): n is a, c, g, or t
tcagacagtatatacacgaccggtgctcgatttagtagtgtagatttgggtttgggtgcccaagctgctggagggcacggtcaccacggtcaccgtctcctcagcttccaccaagggccatcggtcttccccctggcgccctgctccaggancacctcgtgggggccacacgcggccctgggctgccctggtcaaggactactccacgtctactgctggagcgggntggcaaggcgcatgnnnnntnngcnagcntcnnnnnnnnnnnnnnnnnnnnnnnnnn

SEQ ID NO: 80416 - DNA, 266 bp, Homo sapiens
  misc_feature: GYAE6OF01AC4Y6.44.25.C03.1.454.CMB.1.raw
  modified_base (238)..(245): a, c, t, g, unknown or other
  misc_feature (238)..(245): n is a, c, g, or t
  modified_base (248)..(266): a, c, t, g, unknown or other
  misc_feature (248)..(266): n is a, c, g, or t
tcagacagtatatacacgaccggtgctcgatttagtagtgtagatttgggtttgggtgcccaagctgctggagggcacggtcaccacggtcaccgtctcctcagcttccaccaagggcccatcggtcttccccctggcgccctgctccaggagcacctctgggggcacagcggccctgggctgcctggtcaaggctacttcctatatactgtctgagcgggctggcaaggcgcatagnnnnnnnntannnnnnnnnnnnnnnnnnn

SEQ ID NO: 80417 - DNA, 352 bp, Homo sapiens
  misc_feature: GYAE6OF01AJE4Q.44.25.C03.1.454.CMB.1.raw
  modified_base (306)..(352): a, c, t, g, unknown or other
  misc_feature (306)..(352): n is a, c, g, or t
tcagacagtatatacacgaccggtgctcgatttagtagtgtagatttgggtttgggtgcccaagctgctggagggcacggtcaccacggtcaccgtctcctcagcttccaccgaagggcccatccggtccttcccccgtggccgcccctgcctaccgaggacgccacccgtcggtcggggggccacgacggcccgggccccgttggggcctcggtcccgttagggtacgaaacgggaccttaaccttcctatacgttactcggtactggacggcggggtcgtggacgaacgggccgtacagttagnnnnnnnnnnnnnnnnnnnnnnnnnnnnnnnnnnnnnnnnnnnnnnn

SEQ ID NO: 80418 - DNA, 991 bp, Homo sapiens
  misc_feature: GYAE6OF01EJGXD.44.25.C03.1.454.CMB.1.raw
  modified_base (179)..(179): a, c, t, g, unknown or other
  misc_feature (179)..(179): n is a, c, g, or t
  modified_base (204)..(204): a, c, t, g, unknown or other
  misc_feature (204)..(204): n is a, c, g, or t
  modified_base (262)..(262): a, c, t, g, unknown or other
  misc_feature (262)..(262): n is a, c, g, or t
tcagacagtatatacacgaccggtgctcgatttagtagtgtagatttggggtttgggggggcacaagaggcagcactcaggacaatctccagcatggcctggtctcctctcctcctcactctcctcgctcactgcacgagggtcctcgggcccactctgtgctgacgcacgcccgcctnagtcggtcggtcgggggccccgggnacggtacgggtccaccgactcctccgtgcctacgtggacgaccaggtacggttaattnttcgtttacgttacctttaacgtttcgtccttaccgttaggttactacctaaactacttccgtaactaccgaaacgggtaaacccgtacccccaaaaacttccaactacctaacttacgtacgtacggtaccggaccttaaggtaacggtacggtacccgtacgggttaacggggttttacctaacgttccggtaccttaccgtaacgtccgtacccgttaaccgtaacgggtacccggaccctaaaccggacccgtaccccgtacccgttaacgaacttaaaccgttcccggttcggtaccgggtacccgttacccggtacggggtaccggtaacggggtaaaccgggtaaccgggtacggtacgttttaacgttaaacgttttaacgttttaacgggttttcggttaccggtacccttaacgggttaacggtttacgtttaccgggtttaccgggtaccggttaaccgttaccggtttaaccctttaaggttttaacccggtttaccgggtttaacccgggtttaaaccgggggtaaccgggtttaacccgggtaaacccggttaaacccgggttaccccggtaaccccggttttaacccggggtaaccgggttaaccccggtaacccccgggtaaaccccggaaacccccggggttaaacccccctaaacccggttaaccccggtttcccggttaaaccccgttaacccggtttttcccccccggg

SEQ ID NO: 80419 - DNA, 737 bp, Homo sapiens
  misc_feature: GYAE6OF01AZZKE.44.25.C03.1.454.CMB.1.raw
  modified_base (328)..(328): a, c, t, g, unknown or other
  misc_feature (328)..(328): n is a, c, g, or t
  modified_base (708)..(708): a, c, t, g, unknown or other
  misc_feature (708)..(708): n is a, c, g, or t
  modified_base (722)..(722): a, c, t, g, unknown or other
  misc_feature (722)..(722): n is a, c, g, or t
  modified_base (731)..(731): a, c, t, g, unknown or other
  misc_feature (731)..(731): n is a, c, g, or t
  modified_base (737)..(737): a, c, t, g, unknown or other
  misc_feature (737)..(737): n is a, c, g, or t
tcagacagtatatacacgaccggtgctcgatttagtagtgtagatttgggtttgggggctgttcctggaaggtgttggtaccagagggtcaccatctcctgcactgggagctagatccaacatcgggacagattctgatgtccactggtaaccaactaccttccaggaacacgtcccccaaatcctcattctttggtaacactatcgggccctcgaggggtccctgaccgtattctctggcctaccgaacggtctggccaccttcacgtccctcccgtggccatccacgtcgggccttcgacggtctagaacgtagtcggaggggttntacgtttaattacccgtggcctacgttactacgtcgacgtacgacgacgtcctacgtgggttagggtcgggttggttacgggcggggtacggaacgtaacggtcgttaccggaccggttccgtacgggtacctaccggtacccgtaaacggtccgttaccccgtacccccggttcggtacctaccgttccggtttacccgttaccccgttacccctccgtttaacgttaaccttcgttaccgtttcgttccggtacggtaccggggtaccggacccggttcgggaacccggttaggaacccggttacgtaaccggtaaggtcccgttacggcgtaacgcctaaggccttaacggactcgtcagaccgtagacacgtcgtnaaccgtgtaaaccnggatcggtntacgtn

SEQ ID NO: 80420 - DNA, 239 bp, Homo sapiens; identical to SEQ ID NO: 79905
  misc_feature: GYAE6OF02GTSIA.44.25.C03.1.454.CMB.1.raw
  modified_base (237)..(239): a, c, t, g, unknown or other
  misc_feature (237)..(239): n is a, c, g, or t

SEQ ID NO: 80421 - DNA, 321 bp, Homo sapiens
  misc_feature: GYAE6OF02GYWIV.44.25.C03.1.454.CMB.1.raw
  modified_base (295)..(321): a, c, t, g, unknown or other
  misc_feature (295)..(321): n is a, c, g, or t
tcagacagtatatacacgaccggtgctcgatttagtagtgtagatttgggtttggggttggtggtggtctccacgtcccgccttgacgggctgctatctgcctcctggccatcactggctccaggctgaagatgagggtgattattactgccagtcctatgacagcagcctcagtggttgggtgttcggcggagggaccaagctgaccgtcctgggtcagcccaaggctgccccctggtcactctgttcccacctcctctatatactgtctgagcgggctggcaaggcgcatagnnnnnnnnnnnnnnnnnnnnnnnnnnn

SEQ ID NO: 80422 - DNA, 234 bp, Homo sapiens
  misc_feature: GYAE6OF02GKI6N.44.25.C03.1.454.CMB.1.raw
  modified_base (231)..(234): a, c, t, g, unknown or other
  misc_feature (231)..(234): n is a, c, g, or t
tcagacagtatatacacgaccggtgctcgatttagtagtgtagattggttggtgccaagctgctggagggcacggtcaccacggtcaccgtctcctcagcttccaccaagggcccatcggtcttccctggcgccctgctccaggagcacctctggggcacagcggccctgggctgcctggtcaaggactacttcctatatactgtctgagcgggctggcaaggcgcatagnnnn

SEQ ID NO: 80423 - DNA, 239 bp, Homo sapiens
  misc_feature: GYAE6OF02IWHIH.44.25.C03.1.454.CMB.1.raw
  modified_base (237)..(239): a, c, t, g, unknown or other
  misc_feature (237)..(239): n is a, c, g, or t
tcagacagtatatacacgaccggtgctcgatttagtagtgtagatttgggtttgggtgcccaagctgctggagggcacggtcaccacggtcaccgtctcctcagcttccaccaagggcccatcggtcttcccctggcgccctgctccaggagcacctctggggcacagcggccctgggctgcctggtcaaggactacttccacgtctactgctgagcgggctggcaaggcgcatagnnn

SEQ ID NO: 80424 - DNA, 133 bp, Homo sapiens; identical to SEQ ID NO: 80088
  misc_feature: GYAE6OF02H4A61.44.25.C03.1.454.CMB.1.raw
  modified_base (130)..(133): a, c, t, g, unknown or other
  misc_feature (130)..(133): n is a, c, g, or t

SEQ ID NO: 80425 - DNA, 237 bp, Homo sapiens
  misc_feature: GYAE6OF02IRHOY.44.25.C03.1.454.CMB.1.raw
  modified_base (236)..(237): a, c, t, g, unknown or other
  misc_feature (236)..(237): n is a, c, g, or t
tcagacagtatatacacgaccggtgctcgatttagtagtgtagatttgggttgggtgcccaagctgctggagggcacggtcaccacggtcaccgtctcctcagcttccaccaagggcccatcggtcttcccctgacgccctgctccaggagcacctctggggcacagcggccctgggctgcctggtcaaggactacttccacgtctactgctgagcgggctggcaaggcgcatagnn

SEQ ID NO: 80426 - DNA, 234 bp, Homo sapiens
  misc_feature: GYAE6OF02FVLYP.44.25.C03.1.454.CMB.1.raw
  modified_base (231)..(234): a, c, t, g, unknown or other
  misc_feature (231)..(234): n is a, c, g, or t
tcagacagtatatacacgaccggtgctcgatttagtagtgtagattggttggtgccaagctgctggaggcacggtcaccacggtcaccgtctcctcagcttccaccaagggcccatcggtcttcccctggcgccctgctccaggagcacctctggggcacagcggccctgggctgcctggtcaaggactacttcctcgatcgcgtctgagcgggctggcaaggcgcatagnnnn

SEQ ID NO: 80427 - DNA, 238 bp, Homo sapiens; identical to SEQ ID NO: 79912
  misc_feature: GYAE6OF02JBRVQ.44.25.C03.1.454.CMB.1.raw
  modified_base (236)..(238): a, c, t, g, unknown or other
  misc_feature (236)..(238): n is a, c, g, or t

SEQ ID NO: 80428 - DNA, 219 bp, Homo sapiens
  misc_feature: GYAE6OF02IGTHQ.44.25.C03.1.454.CMB.1.raw
  modified_base (218)..(219): a, c, t, g, unknown or other
  misc_feature (218)..(219): n is a, c, g, or t
tcagacagtatatacacgaccggtgctcgatttagtagtgtagatttgggtttgggggaagaggaagactgacggtcctcccaggagttcaggtgctgggcaccttgggcacggggaggtgtgtcacaagatttgggctctgggcacagcggccctgggctgcctggtcaaggactacttccacgtctactgctgagcgggctggcaaggcgcatagnn

SEQ ID NO: 80429 - DNA, 245 bp, Homo sapiens
  misc_feature: GYAE6OF02HQRPE.44.25.C03.1.454.CMB.1.raw
  modified_base (211)..(211): a, c, t, g, unknown or other
  misc_feature (211)..(211): n is a, c, g, or t
  modified_base (216)..(245): a, c, t, g, unknown or other
  misc_feature (216)..(245): n is a, c, g, or t
tcagacagtatatacacgaccggtgctcgatttagtagtgtagatttgggtttggggaagaggaagtactgacggtcctccaggagttcaggtgcttggcaccttgggcacggggagtgtgtcacaagatttgggctctgggcacagcggccctgggctgcctggtctaaggactacttcctatatactgtcctgagcggctggcaaggcncatgnnnnnnnnnnnnnnnnnnnnnnnnnnnnnn

SEQ ID NO: 80430 - DNA, 265 bp, Homo sapiens
  misc_feature: GYAE6OF02GUIOX.44.25.C03.1.454.CMB.1.raw
  modified_base (220)..(265): a, c, t, g, unknown or other
  misc_feature (220)..(265): n is a, c, g, or t
tcagacagtatatacacgaccggtgctcgatttagtagtgtagatttgggtttgggggtaaggaggaagactgacggtcctcccaggagttcaggtgctgggcaccttgggcacggggaggtgtgtcacaagatttgggctctgggcacagcggccctgggctgcctggtcaaggactacttcctatatactgtctgagcgggctggcaaggcgcatagnnnnnnnnnnnnnnnnnnnnnnnnnnnnnnnnnnnnnnnnnnnnnn

SEQ ID NO: 80431 - DNA, 218 bp, Homo sapiens
  misc_feature: GYAE6OF02GZM2I.44.25.C03.1.454.CMB.1.raw
  modified_base (216)..(218): a, c, t, g, unknown or other
  misc_feature (216)..(218): n is a, c, g, or t
tcagacagtatatacacgaccggtgctcgatttagtagtgtagatttgggtttggggaagaggaagactgacggtcctcccaggagttcaggtgctgggcaccttgggcacggggaggtgtgtcacaagatttgggctctgggcacagcggccctgggctgcctggtcaaggactacttccacgtctactgctgagcggctggcaaggcgcatagnnn

SEQ ID NO: 80432 - DNA, 239 bp, Homo sapiens; identical to SEQ ID NO: 79905
  misc_feature: GYAE6OF02IKBXU.44.25.C03.1.454.CMB.1.raw
  modified_base (237)..(239): a, c, t, g, unknown or other
  misc_feature (237)..(239): n is a, c, g, or t

SEQ ID NO: 80433 - DNA, 129 bp, Homo sapiens; identical to SEQ ID NO: 79981
  misc_feature: GYAE6OF02GNOIA.44.25.C03.1.454.CMB.1.raw

SEQ ID NO: 80434 - DNA, 220 bp, Homo sapiens; identical to SEQ ID NO: 79937
  misc_feature: GYAE6OF02G35BW.44.25.C03.1.454.CMB.1.raw
  modified_base (218)..(220): a, c, t, g, unknown or other
  misc_feature (218)..(220): n is a, c, g, or t

SEQ ID NO: 80435 - DNA, 239 bp, Homo sapiens; identical to SEQ ID NO: 80423
  misc_feature: GYAE6OF02HZRWD.44.25.C03.1.454.CMB.1.raw
  modified_base (237)..(239): a, c, t, g, unknown or other
  misc_feature (237)..(239): n is a, c, g, or t

SEQ ID NO: 80436 - DNA, 239 bp, Homo sapiens
  misc_feature: GYAE6OF02H4BBK.44.25.C03.1.454.CMB.1.raw
  modified_base (236)..(239): a, c, t, g, unknown or other
  misc_feature (236)..(239): n is a, c, g, or t
tcagacagtatatacacgaccggtgctcgatttagtagtgtagatttgggtttgggtgcccaagctgctggagggcacggtcaccacggtcaccgtctcctcagcttccaccaagggcccatcggtcttcccctggcgccctgctccaggagcacctctggggcacagcggccctgggctgcctggtcaaggacacttccacgtctactgctgagcgggctggcaaggcgcatagnnnn

SEQ ID NO: 80437 - DNA, 219 bp, Homo sapiens
  misc_feature: GYAE6OF02ICJXH.44.25.C03.1.454.CMB.1.raw
  modified_base (217)..(219): a, c, t, g, unknown or other
  misc_feature (217)..(219): n is a, c, g, or t
tcagacagtatatacacgaccggtgctcgatttagtagtgtagatttgggtttggggaagaggaagactgacggtcctcccaggagttcaggtgctgggcaccttgggcacggggaggtgtgtcacaagatttgggctctgggcacagcggccctgggctgcctggtcaaggactacttcctatatactgtctgagcgggctggcaaggcgcatagnnn

SEQ ID NO: 80438 - DNA, 240 bp, Homo sapiens; identical to SEQ ID NO: 80130
  misc_feature: GYAE6OF02G1L4Z.44.25.C03.1.454.CMB.1.raw
  modified_base (238)..(240): a, c, t, g, unknown or other
  misc_feature (238)..(240): n is a, c, g, or t

SEQ ID NO: 80439 - DNA, 130 bp, Homo sapiens; identical to SEQ ID NO: 79921
  misc_feature: GYAE6OF02GV7N6.44.25.C03.1.454.CMB.1.raw
  modified_base (130)..(130): a, c, t, g, unknown or other
  misc_feature (130)..(130): n is a, c, g, or t

SEQ ID NO: 80440 - DNA, 511 bp, Homo sapiens
  misc_feature: GYAE6OF02GENP2.44.25.C03.1.454.CMB.1.raw
  modified_base (238)..(240): a, c, t, g, unknown or other
  misc_feature (238)..(240): n is a, c, g, or t
  modified_base (243)..(243): a, c, t, g, unknown or other
  misc_feature (243)..(243): n is a, c, g, or t
  modified_base (247)..(247): a, c, t, g, unknown or other
  misc_feature (247)..(247): n is a, c, g, or t
  modified_base (249)..(249): a, c, t, g, unknown or other
  misc_feature (249)..(249): n is a, c, g, or t
  modified_base (253)..(253): a, c, t, g, unknown or other
  misc_feature (253)..(253): n is a, c, g, or t
  modified_base (260)..(260): a, c, t, g, unknown or other
  misc_feature (260)..(260): n is a, c, g, or t
  modified_base (266)..(266): a, c, t, g, unknown or other
  misc_feature (266)..(266): n is a, c, g, or t
  modified_base (272)..(272): a, c, t, g, unknown or other
  misc_feature (272)..(272): n is a, c, g, or t
  modified_base (275)..(275): a, c, t, g, unknown or other
  misc_feature (275)..(275): n is a, c, g, or t
  modified_base (278)..(278): a, c, t, g, unknown or other
  misc_feature (278)..(278): n is a, c, g, or t
  modified_base (280)..(280): a, c, t, g, unknown or other
  misc_feature (280)..(280): n is a, c, g, or t
  modified_base (283)..(283): a, c, t, g, unknown or other
  misc_feature (283)..(283): n is a, c, g, or t
  modified_base (285)..(285): a, c, t, g, unknown or other
  misc_feature (285)..(285): n is a, c, g, or t
  modified_base (287)..(288): a, c, t, g, unknown or other
  misc_feature (287)..(288): n is a, c, g, or t
  modified_base (290)..(290): a, c, t, g, unknown or other
  misc_feature (290)..(290): n is a, c, g, or t
  modified_base (292)..(293): a, c, t, g, unknown or other
  misc_feature (292)..(293): n is a, c, g, or t
  modified_base (295)..(295): a, c, t, g, unknown or other
  misc_feature (295)..(295): n is a, c, g, or t
  modified_base (298)..(298): a, c, t, g, unknown or other
  misc_feature (298)..(298): n is a, c, g, or t
  modified_base (305)..(305): a, c, t, g, unknown or other
  misc_feature (305)..(305): n is a, c, g, or t
  modified_base (307)..(307): a, c, t, g, unknown or other
  misc_feature (307)..(307): n is a, c, g, or t
  modified_base (316)..(316): a, c, t, g, unknown or other
  misc_feature (316)..(316): n is a, c, g, or t
  modified_base (321)..(321): a, c, t, g, unknown or other
  misc_feature (321)..(321): n is a, c, g, or t
  modified_base (323)..(323): a, c, t, g, unknown or other
  misc_feature (323)..(323): n is a, c, g, or t
  modified_base (327)..(327): a, c, t, g, unknown or other
  misc_feature (327)..(327): n is a, c, g, or t
  modified_base (349)..(349): a, c, t, g, unknown or other
  misc_feature (349)..(349): n is a, c, g, or t
  modified_base (354)..(354): a, c, t, g, unknown or other
  misc_feature (354)..(354): n is a, c, g, or t
  modified_base (358)..(358): a, c, t, g, unknown or other
  misc_feature (358)..(358): n is a, c, g, or t
  modified_base (395)..(395): a, c, t, g, unknown or other
  misc_feature (395)..(395): n is a, c, g, or t
  modified_base (400)..(400): a, c, t, g, unknown or other
  misc_feature (400)..(400): n is a, c, g, or t
  modified_base (444)..(444): a, c, t, g, unknown or other
  misc_feature (444)..(444): n is a, c, g, or t
  modified_base (462)..(462): a, c, t, g, unknown or other
  misc_feature (462)..(462): n is a, c, g, or t
tcagacagtatatacacgaccggtgctcgatttagtagtgtagatttgggtttggggtaaggaggaagactgacggtccttcccgacggagttcgaacggtgcgtaggccaccttggcacggggagttgtgttcacaagatttggctcgtggccacagccgcccgtggactgccttggtcaaggactacttccctagtatacctgtcttgagccggcgtggcaaggccgccattacgnnngcngcgngngtanagtctgntgacanagaacngcngcncngcncncnntntnntntcncacagcncncgcgccgcncgtcngngcgngtgtcgtgcgagctctctctcncgtcncgcncgctacgcgctcgagtagttgtcgttacgttctgtcncgcgngtcgtcgtcgtcgtcgcgtacgttcggtcgggacggacggtggngagagacgacgtgtgcgngcgcgtacgtctctcgtctctccgtccgtccgtctctactactagtacg

SEQ ID NO: 80441 - DNA, 129 bp, Homo sapiens; identical to SEQ ID NO: 79980
  misc_feature: GYAE6OF02ITRA6.44.25.C03.1.454.CMB.1.raw

SEQ ID NO: 80442 - DNA, 245 bp, Homo sapiens
  misc_feature: GYAE6OF02F8ZC4.44.25.C03.1.454.CMB.1.raw
  modified_base (217)..(245): a, c, t, g, unknown or other
  misc_feature (217)..(245): n is a, c, g, or t
tcagacagtatatacacgaccggtgctcgatttagtagtgtagatttgggtttggggtacgaatggtcaccgtctcttcacgcttccaccaagggcccatccggtcttcccctggcgccctgctccaggagcacctctggggcacagcggccctgggctgcctggtcaaggactacttcctatatactgtctgagcgggctgggcaaggcgcatagnnnnnnnnnnnnnnnnnnnnnnnnnnnnn

SEQ ID NO: 80443 - DNA, 219 bp, Homo sapiens
  misc_feature: GYAE6OF02HZNBW.44.25.C03.1.454.CMB.1.raw
  modified_base (218)..(219): a, c, t, g, unknown or other
  misc_feature (218)..(219): n is a, c, g, or t
tcagacagtatatacacgaccggtgctcgatttagtagtgtagatttgggtttgggggaagaggaagactgacggtcctcccaggagttcaggtgctgggcaccttgggcacggggaggtgtgtcacaagatttgggctctgggcacagcggccctgggctgcctggtcaaggactacttcctcgatcgcgtctgagcgggctggcaaggcgcatagnn

SEQ ID NO: 80444 - DNA, 235 bp, Homo sapiens
  misc_feature: GYAE6OF02F4THN.44.25.C03.1.454.CMB.1.raw
  modified_base (135)..(135): a, c, t, g, unknown or other
  misc_feature (135)..(135): n is a, c, g, or t
  modified_base (139)..(139): a, c, t, g, unknown or other
  misc_feature (139)..(139): n is a, c, g, or t
  modified_base (145)..(145): a, c, t, g, unknown or other
  misc_feature (145)..(145): n is a, c, g, or t
  modified_base (151)..(151): a, c, t, g, unknown or other
  misc_feature (151)..(151): n is a, c, g, or t
  modified_base (153)..(153): a, c, t, g, unknown or other
  misc_feature (153)..(153): n is a, c, g, or t
  modified_base (158)..(158): a, c, t, g, unknown or other
  misc_feature (158)..(158): n is a, c, g, or t
  modified_base (163)..(163): a, c, t, g, unknown or other
  misc_feature (163)..(163): n is a, c, g, or t
  modified_base (170)..(170): a, c, t, g, unknown or other
  misc_feature (170)..(170): n is a, c, g, or t
  modified_base (172)..(172): a, c, t, g, unknown or other
  misc_feature (172)..(172): n is a, c, g, or t
  modified_base (201)..(201): a, c, t, g, unknown or other
  misc_feature (201)..(201): n is a, c, g, or t
  modified_base (216)..(216): a, c, t, g, unknown or other
  misc_feature (216)..(216): n is a, c, g, or t
  modified_base (226)..(226): a, c, t, g, unknown or other
  misc_feature (226)..(226): n is a, c, g, or t
  modified_base (229)..(229): a, c, t, g, unknown or other
  misc_feature (229)..(229): n is a, c, g, or t
  modified_base (231)..(235): a, c, t, g, unknown or other
  misc_feature (231)..(235): n is a, c, g, or t
tcagacagtatatacacgaccggtgctcgatttagtagtgtagatttgggtttgggtgcccaagctgctggagggcacggtcaccacggtcaccgtctcctcagcttccaccaagggcccacgtcgtcctcccgngccncctgcncgaggncnctggnggcangccgcgngncgcgtgagagtacttactactatactctntctgacggcggtcgngacgaggcanagngnnnnn

SEQ ID NO: 80445 - DNA, 190 bp, Homo sapiens
  misc_feature: GYAE6OF02H4OWG.44.25.C03.1.454.CMB.1.raw
  modified_base (188)..(190): a, c, t, g, unknown or other
  misc_feature (188)..(190): n is a, c, g, or t
tcagacagtatatacacgaccggtgctcgatttagtagtgtagatttgggtttggggaggtgtgtcacaagatttgggctctgggcaccgtgggcacggggaggtgtgtcacaagatttgggccctgggctgcctggtcaaggactacttcctatatactgtctgagcgggctggcaaggcgcatagnnn

SEQ ID NO: 80446 - DNA, 298 bp, Homo sapiens
  misc_feature: GYAE6OF02GZ9KM.44.25.C03.1.454.CMB.1.raw
  modified_base (294)..(298): a, c, t, g, unknown or other
  misc_feature (294)..(298): n is a, c, g, or t
tcagacagtatatacacgaccggtgctcgatttagtagtgtagatttgggtttgggtgtggtggtctccactcccgccttgacgggctgctatctgcctccctggccatcactgggctccaggctgaagatgagggtgattattactgccagtcctatgacagcagcctcagtggttgggtgttcggcggagggaccaagctgaccgtcctgggtcagcccaaggctgccccctcggtcactctgttcccacctcctctatatactgtctgagcgggctggcaaggcgcatagnnnnn

SEQ ID NO: 80447 - DNA, 343 bp, Homo sapiens
  misc_feature: GYAE6OF02GFDFD.44.25.C03.1.454.CMB.1.raw
  modified_base (299)..(301): a, c, t, g, unknown or other
  misc_feature (299)..(301): n is a, c, g, or t
  modified_base (303)..(343): a, c, t, g, unknown or other
  misc_feature (303)..(343): n is a, c, g, or t
tcagacagtatatacacgaccggtgctcgatttagtagtgtagatttgggtttgggggtgtggtggtctccactcccgccttgacggggctgctatctgcctccctggccatcactgggctccaggctgaagatgagggtgattattacttgccagtcctatgacagcagcctcagtggttgggtgttcggcggagggaccaagctgaccgtcctgggtcagcccaaggctgccccctcggtcactctgttcccgccctcctctatatactgtctgagcgggctggcaaggcgcatagnnngnnnnnnnnnnnnnnnnnnnnnnnnnnnnnnnnnnnnnnnnn

SEQ ID NO: 80448 - DNA, 273 bp, Homo sapiens
  misc_feature: GYAE6OF02IXKEJ.44.25.C03.1.454.CMB.1.raw
  modified_base (263)..(273): a, c, t, g, unknown or other
  misc_feature (263)..(273): n is a, c, g, or t
tcagacagtatatacacgaccggtgctcgatttagtagtgtagatttgggtttgggggaagaggaagactgacggtcctcccaggagttcaggtgctgggcaccttgggcacggggaggtgtgtcacaagatttgggctctgggcaccgtgggcatgggggaggtgtgtcacaagatttgggctctgggcacagcggccctgggctgcctggtcaaggactacttcctatatactgtctgagcgggctggcaaggcgcatagnnnnnnnnnnn

SEQ ID NO: 80449 - DNA, 271 bp, Homo sapiens
  misc_feature: GYAE6OF02ICQ0X.44.25.C03.1.454.CMB.1.raw
  modified_base (236)..(238): a, c, t, g, unknown or other
  misc_feature (236)..(238): n is a, c, g, or t
  modified_base (240)..(271): a, c, t, g, unknown or other
  misc_feature (240)..(271): n is a, c, g, or t
tcagacagtatatacacgaccggtgctcgatttagtagtgtagatttgggtttgggttggcccaagctgctggagggcacggtcaccgtctccgtcagcttacccaccaagggcccatcggtcttcccctggcgccctgctccaggagcacctctgggggcacagcggccctgggctgcctggtcaaggctacttccacgttctactgcgtgagcgggctggcaaggcgcgatagnnncnnnnnnnnnnnnnnnnnnnnnnnnnnnnnnnn

SEQ ID NO: 80450 - DNA, 220 bp, Homo sapiens
  misc_feature: GYAE6OF02GLIHY.44.25.C03.1.454.CMB.1.raw
  modified_base (217)..(220): a, c, t, g, unknown or other
  misc_feature (217)..(220): n is a, c, g, or t
tcagacagtatatacacgaccggtgctcgatttagtagtgtagatttgggtttggggaagaggaagactgacggtcctcccaggagttcaggtgctgggcaccttgggcatggggaggtgtgtcacaagatttgggctctgggcacagcggccctgggctgcctggtcaaggactacttcctatatactgtctgagcgggctggcaaggcgcatagnnnn

SEQ ID NO: 80451 - DNA, 138 bp, Homo sapiens; identical to SEQ ID NO: 80141
  misc_feature: GYAE6OF02H6R7D.44.25.C03.1.454.CMB.1.raw
  modified_base (130)..(138): a, c, t, g, unknown or other
  misc_feature (130)..(138): n is a, c, g, or t

SEQ ID NO: 80452 - DNA, 129 bp, Homo sapiens
  misc_feature: GYAE6OF02HWC83.44.25.C03.1.454.CMB.1.raw
tcagacagtatatacacgaccggtgctcgatttagtagtgtagatttgggtttgggaacagcggccctgggctgcctggtcaaggactacttcctcgatcgcgtctgagcgggctggcaaggcgcatag

SEQ ID NO: 80453 - DNA, 253 bp, Homo sapiens
  misc_feature: GYAE6OF02G13FN.44.25.C03.1.454.CMB.1.raw
  modified_base (239)..(253): a, c, t, g, unknown or other
  misc_feature (239)..(253): n is a, c, g, or t
tcagacagtatatacacgaccggtgctcgatttagtagtgtagatttgggtttgggtgcccaagctgctggagggcacggtcaccaacggtcaccgtctcctcagcttccaccaagggcccatcggtcttccccctggcgccctgctccaggagcacctctggggcacagcggccctgggctgcctggtcaaggactacttccacgtctactgctgagcgggctggcaaggcgcatagnnnnnnnnnnnnnnn

SEQ ID NO: 80454 - DNA, 242 bp, Homo sapiens
  misc_feature: GYAE6OF02IU4HY.44.25.C03.1.454.CMB.1.raw
  modified_base (238)..(242): a, c, t, g, unknown or other
  misc_feature (238)..(242): n is a, c, g, or t
tcagacagtatatacacgaccggtgctcgatttagtagtgtagatttgggtttgggtgcccaagctgctggagggcacggtcaccacggtcaccgtctcctcagcttccaccaaggtcccatcggtcttcccctggcgccctgctccaggagcacctctgggggcacagcggccctgggctgcctggtcaaggactacttcctcgatcgcgtctgagcgggctggcaaggcgcatagnnnnn

SEQ ID NO: 80455 - DNA, 219 bp, Homo sapiens
  misc_feature: GYAE6OF02G1O6M.44.25.C03.1.454.CMB.1.raw
  modified_base (218)..(219): a, c, t, g, unknown or other
  misc_feature (218)..(219): n is a, c, g, or t
tcagacagtatatacacgaccggtgctcgatttagtagtgtagatttgggtttgggggaagaggaagactgacggtcctcccaggagttcaggtgctgggcaccttgggcatggggaggtgtgtcacaagatttgggctctgggcacagcggccctgggctgcctggtcaaggactacttcctatatactgtctgagcgggctggcaaggcgcatagnn

SEQ ID NO: 80456 - DNA, 137 bp, Homo sapiens; identical to SEQ ID NO: 79969
  misc_feature: GYAE6OF02GJ1QL.44.25.C03.1.454.CMB.1.raw
  modified_base (137)..(137): a, c, t, g, unknown or other
  misc_feature (137)..(137): n is a, c, g, or t

SEQ ID NO: 80457 - DNA, 151 bp, Homo sapiens
  misc_feature: GYAE6OF02IKUDD.44.25.C03.1.454.CMB.1.raw
  modified_base (133)..(151): a, c, t, g, unknown or other
  misc_feature (133)..(151): n is a, c, g, or t
tcagacagtatatacacgaccggtgctcgatttagtagtgtagatttgggtttgggcgacagcggccctgggctgcctgggtcaaggactacttcctatatactgtctgagcgggctggtcaaggcgcatagnnnnnnnnnnnnnnnnnnn

SEQ ID NO: 80458 - DNA, 240 bp, Homo sapiens; identical to SEQ ID NO: 79966
  misc_feature: GYAE6OF02ISSRY.44.25.C03.1.454.CMB.1.raw
  modified_base (237)..(240): a, c, t, g, unknown or other
  misc_feature (237)..(240): n is a, c, g, or t

SEQ ID NO: 80459 - DNA, 239 bp, Homo sapiens; identical to SEQ ID NO: 79955
  misc_feature: GYAE6OF02GNHAT.44.25.C03.1.454.CMB.1.raw
  modified_base (238)..(239): a, c, t, g, unknown or other
  misc_feature (238)..(239): n is a, c, g, or t

SEQ ID NO: 80460 - DNA, 141 bp, Homo sapiens
  misc_feature: GYAE6OF02IFKD1.44.25.C03.1.454.CMB.1.raw
  modified_base (137)..(141): a, c, t, g, unknown or other
  misc_feature (137)..(141): n is a, c, g, or t
tcagacagtatatacacgaccggtgctcgatttagtagtgtagatttgggtttgggctctgggcacagcggccctgggctgcctggtcaaggactacttccacgtctactgctgagcgggctggcaaggcgcatagnnnnn

SEQ ID NO: 80461 - DNA, 251 bp, Homo sapiens
  misc_feature: GYAE6OF02I1SIY.44.25.C03.1.454.CMB.1.raw
  modified_base (237)..(251): a, c, t, g, unknown or other
  misc_feature (237)..(251): n is a, c, g, or t
tcagacagtatatacacgaccggtgctcgatttagtagtgtagatttgggttgggtgcccaagctgctggagggcacggtcaccacggtcaccgtctcctcagcttccaccaagggcccatcggtcttcccctggcgccctgctccaggagcacctctggggcacagcggccctgggctgcctggtcaaggctacttccacggtctactgcctgagcgggctggcaaggcgcatagnnnnnnnnnnnnnnn

SEQ ID NO: 80462 - DNA, 248 bp, Homo sapiens
  misc_feature: GYAE6OF02IPC2N.44.25.C03.1.454.CMB.1.raw
  modified_base (236)..(248): a, c, t, g, unknown or other
  misc_feature (236)..(248): n is a, c, g, or t
tcagacagtatatacacgaccggtgctcgatttagtagtgtagatttgggtttgggtgcccaagctgctggagggcacggtcaccacggtcaccgtctcctcagcttccaccaagggcccatcggtcttcccctggcgccctgctccaggagcacctctggggcacagcggccctgggctgcctggtcaaggactacttcctatatactgtctgagcggctggcaaggcgcatagnnnnnnnnnnnnn

SEQ ID NO: 80463 - DNA, 241 bp, Homo sapiens
  misc_feature: GYAE6OF02G9EQ2.44.25.C03.1.454.CMB.1.raw
  modified_base (237)..(241): a, c, t, g, unknown or other
  misc_feature (237)..(241): n is a, c, g, or t
tcagacagtatatacacgaccggtgctcgatttagtagtgtagatttgggtttgggtgcccaagctgctggagggcacggtcaccacggtcaccgtctcctcagcttccaccaagggcccatcggtcttcccctggcgccctgctccaggagcacctctggggcacagcggccctgggctgcctggtcaaggactacttcctcgatcgcgtctgagcgggctggcaaggcgcatagnnnnn

SEQ ID NO: 80464 - DNA, 258 bp, Homo sapiens
  misc_feature: GYAE6OF02HOSC8.44.25.C03.1.454.CMB.1.raw
  modified_base (192)..(194): a, c, t, g, unknown or other
  misc_feature (192)..(194): n is a, c, g, or t
  modified_base (196)..(196): a, c, t, g, unknown or other
  misc_feature (196)..(196): n is a, c, g, or t
  modified_base (198)..(258): a, c, t, g, unknown or other
  misc_feature (198)..(258): n is a, c, g, or t
tcagacagtatatacacgaccggtgctcgatttagtagtgtagatttgggtttggggtagggtgtgtcacaatatttgggctctgggcaccgtgggcaccggggaggtgtgtcacaagatttgggccctgggctgcctggtcaaggactacttccacgtctactgctgagcgggctggcaaggcgcatacgnnntngnnnnnnnnnnnnnnnnnnnnnnnnnnnnnnnnnnnnnnnnnnnnnnnnnnnnnnnnnnnnn

SEQ ID NO: 80465 - DNA, 239 bp, Homo sapiens; identical to SEQ ID NO: 80423
  misc_feature: GYAE6OF02G44G2.44.25.C03.1.454.CMB.1.raw
  modified_base (237)..(239): a, c, t, g, unknown or other
  misc_feature (237)..(239): n is a, c, g, or t

SEQ ID NO: 80466 - DNA, 241 bp, Homo sapiens; identical to SEQ ID NO: 80024
  misc_feature: GYAE6OF02HHEYJ.44.25.C03.1.454.CMB.1.raw
  modified_base (238)..(241): a, c, t, g, unknown or other
  misc_feature (238)..(241): n is a, c, g, or t

SEQ ID NO: 80467 - DNA, 219 bp, Homo sapiens; identical to SEQ ID NO: 80455
  misc_feature: GYAE6OF02F4B5X.44.25.C03.1.454.CMB.1.raw
  modified_base (218)..(219): a, c, t, g, unknown or other
  misc_feature (218)..(219): n is a, c, g, or t

SEQ ID NO: 80468 - DNA, 219 bp, Homo sapiens; identical to SEQ ID NO: 80455
  misc_feature: GYAE6OF02HQSGH.44.25.C03.1.454.CMB.1.raw
  modified_base (218)..(219): a, c, t, g, unknown or other
  misc_feature (218)..(219): n is a, c, g, or t

SEQ ID NO: 80469 - DNA, 298 bp, Homo sapiens
  misc_feature: GYAE6OF02GVG38.44.25.C03.1.454.CMB.1.raw
  modified_base (296)..(298): a, c, t, g, unknown or other
  misc_feature (296)..(298): n is a, c, g, or t
tcagacagtatatacacgaccggtgctcgatttagtagtgtagatttgggtttggggtgtggtggtctccactcccgccttgacgggctgctatctgcctccctggccatcactgggctccaggctgaagatgagggtgattattactgccagtcctatgacagcagcctcagtggttgggtgttcggcggagggaccaagctgaccgtcctgggtcagcccaaggctgccccctcggtcactctgttcccgccctcctctatatactgtctgagcgggctggcaaggcgcatagnnn

SEQ ID NO: 80470 - DNA, 130 bp, Homo sapiens; identical to SEQ ID NO: 79921
  misc_feature: GYAE6OF02G1VL2.44.25.C03.1.454.CMB.1.raw
  modified_base (130)..(130): a, c, t, g, unknown or other
  misc_feature (130)..(130): n is a, c, g, or t

SEQ ID NO: 80471 - DNA, 432 bp, Homo sapiens
  misc_feature: GYAE6OF02I4A3R.44.25.C03.1.454.CMB.1.raw
  modified_base (425)..(432): a, c, t, g, unknown or other
  misc_feature (425)..(432): n is a, c, g, or t
tcagacagtatatacacgaccggtgctcgatttagtagtgtagatttgggtttgggggcagagggtcaccatctcctgcactgggagcagatccaacatcgggacagattctgatgtccactggtaccaacaccttccaggaacagcccccaaactcctcatctttggtaacaactatcggccctcaggggtccctgaccgattctctggctccaagtctggcacctcagcctccctggccatcactgggctccaggctgaagatgagggtgattattactgccagtcctatgacagcagcctcagtggttggtgttcggcggagggaccaagctgaccgtcctggtcagcccaaggctgcccctggtcactctgttcccgccctcctctatatactgtctgagcgggctggcaaggcgcatagnnnnnnnn

SEQ ID NO: 80472 - DNA, 255 bp, Homo sapiens
  misc_feature: GYAE6OF02IOY1M.44.25.C03.1.454.CMB.1.raw
  modified_base (236)..(239): a, c, t, g, unknown or other
  misc_feature (236)..(239): n is a, c, g, or t
  modified_base (241)..(255): a, c, t, g, unknown or other
  misc_feature (241)..(255): n is a, c, g, or t
tcagacagtatatacacgaccggtgctcgatttagtagtgtagatttgggtttgggtggcccaagctgctggagggcacggtcaccacggtcaccgtctcctcagcttccaccaagggcccatcggtcttcccctggcgccctgctccaggagcacctctggggcacagcggccctgggctgcctggtcaaggctacttcacgtctactgctgagcgggctggcaaggcgcatagnnnngnnnnnnnnnnnnnnn

SEQ ID NO: 80473 - DNA, 191 bp, Homo sapiens
  misc_feature: GYAE6OF02G2RSZ.44.25.C03.1.454.CMB.1.raw
  modified_base (189)..(191): a, c, t, g, unknown or other
  misc_feature (189)..(191): n is a, c, g, or t
tcagacagtatatacacgaccggtgctcgatttagtagtgtagatttgggtttgggggaggtgtgtcacaagatttgggctctgggcaccgtgggcacggggaggtgtgtcacaagatttgggccctgggctgcctggtcaaggactacttcctcgatcgcgtctgagcgggctggcaaggcgcatagnnn

SEQ ID NO: 80474 - DNA, 191 bp, Homo sapiens
  misc_feature: GYAE6OF02JB4M4.44.25.C03.1.454.CMB.1.raw
  modified_base (188)..(191): a, c, t, g, unknown or other
  misc_feature (188)..(191): n is a, c, g, or t
tcagacagtatatacacgaccggtgctcgatttagtagtgtagatttgggtttggggaggtgtgtcacaagatttgggctctgggcaccgtgggcacggggaggtgtgtcacaagatttgggccctgggctgcctggtcaaggactacttcctatatactgtctgagcgggctggcaaggcgcatagnnnn

SEQ ID NO: 80475 - DNA, 241 bp, Homo sapiens
  misc_feature: GYAE6OF02HYUFU.44.25.C03.1.454.CMB.1.raw
  modified_base (237)..(241): a, c, t, g, unknown or other
  misc_feature (237)..(241): n is a, c, g, or t
tcagacagtatatacacgaccggtgctcgatttagtagtgtagatttgggtttgggtgcccaagctgctggagggcacggtcaccacggtcaccgtctcctcagcttccaccaagggcccatcggtcttcccctggcgccctgctccaggagcacctctggggcacagcggccctgggctgcctggtcaaggactacttcctatatactgtctgagcgggctggcaaggcgcatagnnnnn

SEQ ID NO: 80476 - DNA, 239 bp, Homo sapiens
  misc_feature: GYAE6OF02I2JCP.44.25.C03.1.454.CMB.1.raw
  modified_base (238)..(239): a, c, t, g, unknown or other
  misc_feature (238)..(239): n is a, c, g, or t
tcagacagtatatacacgaccggtgctcgatttagtagtgtagatttgggtttgggtgcccaagctgctggagggcacggtcaccacggtcaccgtctcctcagcttccaccaagggcccatcggtcttcccctggcgccctgctccaggagcacctctgggggcacagcggccctgggctgcctggtcaaggactacttccacgtctactgctgagcgggctggcaaggcgcatagnn

SEQ ID NO: 80477 - DNA, 215 bp, Homo sapiens
  misc_feature: GYAE6OF02F0WHH.44.25.C03.1.454.CMB.1.raw
  modified_base (213)..(215): a, c, t, g, unknown or other
  misc_feature (213)..(215): n is a, c, g, or t
tcagacagtatatacacgaccggtgctcgatttagtagtgtagatttgggtttgggggacaatggtcaccgtctcttcagcttccaccaagggcccatcggtcttcccctggcgccctgctccaggagcacctctggggcacagcggccctgggctgcctggtcaaggactacttcctatatactgtctgagcgggctggcaaggcgcatagnnn

SEQ ID NO: 80478 - DNA, 260 bp, Homo sapiens
  misc_feature: GYAE6OF02I3RPJ.44.25.C03.1.454.CMB.1.raw
  modified_base (239)..(260): a, c, t, g, unknown or other
  misc_feature (239)..(260): n is a, c, g, or t
tcagacagtatatacacgaccggtgctcgatttagtagtgtagatttgggtttggggtgcccaagctgctggagggcacggtcaccacggtcaccgtctcctcagcttccaccaagggcccatcggtcttcccctggcgccctgctccaggagcacctctgggggcacagcggccctgggctgcctggtcaaggactacttccacgtctactgctgagcgggctggcaaggcgcatagnnnnnnnnnnnnnnnnnnnnnn

SEQ ID NO: 80479 - DNA, 242 bp, Homo sapiens; identical to SEQ ID NO: 79920
  misc_feature: GYAE6OF02GMP57.44.25.C03.1.454.CMB.1.raw
  modified_base (238)..(242): a, c, t, g, unknown or other
  misc_feature (238)..(242): n is a, c, g, or t

SEQ ID NO: 80480 - DNA, 242 bp, Homo sapiens
  misc_feature: GYAE6OF02ILIA2.44.25.C03.1.454.CMB.1.raw
  modified_base (230)..(242): a, c, t, g, unknown or other
  misc_feature (230)..(242): n is a, c, g, or t
tcagacagtatatacacgaccggtgctcgatttagtagtgtagatttgggtttgggtggcccaagctgctggagggcacggtcaccgtctcctcagcttccaccaagggcccatcggtcttcccctggcgccctgctccaggagcacctctgggggcacagcggccctgggctgcctggtcaaggactacttccacgtctactgctgagcgggctggcaaggcgcatagnnnnnnnnnnnnn

SEQ ID NO: 80481 - DNA, 131 bp, Homo sapiens; identical to SEQ ID NO: 79918
  misc_feature: GYAE6OF02I6IUP.44.25.C03.1.454.CMB.1.raw
  modified_base (130)..(131): a, c, t, g, unknown or other
  misc_feature (130)..(131): n is a, c, g, or t

SEQ ID NO: 80482 - DNA, 300 bp, Homo sapiens
  misc_feature: GYAE6OF02FQYXT.44.25.C03.1.454.CMB.1.raw
  modified_base (297)..(300): a, c, t, g, unknown or other
  misc_feature (297)..(300): n is a, c, g, or t
tcagacagtatatacacgaccggtgctcgatttagtagtgtagatttgggtttggggtgtggtggtctccactcccgccttgacggggctgctatctgcctccctggccatcactgggctccaggctgaagatgagggtgattattactgccagtcctatgacagcagcctcagtggttgggtgttcggcggagggaccaagctgaccgtcctgggtcagcccaaggctgccccctcggtcactctgttcccgccctcctctatatactgtctgagcgggctggcaaggcgcatagnnnn

SEQ ID NO: 80483 - DNA, 218 bp, Homo sapiens
  misc_feature: GYAE6OF02GJ7R1.44.25.C03.1.454.CMB.1.raw
  modified_base (216)..(218): a, c, t, g, unknown or other
  misc_feature (216)..(218): n is a, c, g, or t
tcagacagtatatacacgaccggtgctcgatttagtagtgtagatttgggtttgggaagaggaagactgacggtcctcccaggagttcaggtgctgggcaccttgggcacggggaggtgtgtcacaagatttgggctctgggcacagcggccctgggctgcctggtcaaggactacttcctatatactgtctgagcgggctggcaaggcgcatagnnn

SEQ ID NO: 80484 - DNA, 216 bp, Homo sapiens
  misc_feature: GYAE6OF02JEBKE.44.25.C03.1.454.CMB.1.raw
  modified_base (214)..(216): a, c, t, g, unknown or other
  misc_feature (214)..(216): n is a, c, g, or t
tcagacagtatatacacgaccggtgctcgatttagtagtgtagatttgggtttgggggacaatggtcaccgtctcttcagcttccaccaagggcccatcggtcttcccctggcgccctgctccaggagcacctctgggggcacagcggccctgggctgcctggtcaaggactacttcctatatactgtctgagcgggctggcaaggcgcatagnnn

SEQ ID NO: 80485 - DNA, 239 bp, Homo sapiens; identical to SEQ ID NO: 79905
  misc_feature: GYAE6OF02FUKC0.44.25.C03.1.454.CMB.1.raw
  modified_base (237)..(239): a, c, t, g, unknown or other
  misc_feature (237)..(239): n is a, c, g, or t

SEQ ID NO: 80486 - DNA, 241 bp, Homo sapiens; identical to SEQ ID NO: 80024
  misc_feature: GYAE6OF02GTCOT.44.25.C03.1.454.CMB.1.raw
  modified_base (238)..(241): a, c, t, g, unknown or other
  misc_feature (238)..(241): n is a, c, g, or t

SEQ ID NO: 80487 - DNA, 238 bp, Homo sapiens
  misc_feature: GYAE6OF02I6LY0.44.25.C03.1.454.CMB.1.raw
  modified_base (237)..(238): a, c, t, g, unknown or other
  misc_feature (237)..(238): n is a, c, g, or t
tcagacagtatatacacgaccggtgctcgatttagtagtgtagatttgggtttgggtgcccaagctgctggagggcacggtcaccacggtcaccgtctcctcagcttccaccaaggcccatcggtcttcccctggcgccctgctccaggagcacctctgggggcacagcggccctgggctgcctggtcaaggactacttcctatatactgtctgagcgggctggcaaggcgcatagnn

SEQ ID NO: 80488 - DNA, 149 bp, Homo sapiens
  misc_feature: GYAE6OF02I9EIF.44.25.C03.1.454.CMB.1.raw
  modified_base (137)..(149): a, c, t, g, unknown or other
  misc_feature (137)..(149): n is a, c, g, or t
tcagacagtatatacacgaccggtgctcgatttagtagtgtagatttgggtttgggctctgggcacagcggccctgggctgcctggtcaaggactacttccacgtctactgctgagcgggctggcaaggcgcatagnnnnnnnnnnnnn

SEQ ID NO: 80489 - DNA, 218 bp, Homo sapiens
  misc_feature: GYAE6OF02F3F0F.44.25.C03.1.454.CMB.1.raw
  modified_base (216)..(218): a, c, t, g, unknown or other
  misc_feature (216)..(218): n is a, c, g, or t
tcagacagtatatacacgaccggtgctcgatttagtagtgtagatttgggtttggggaagaggaagactgacggtcctcccaggagttcaggtgctgggcaccttgggcatggggaggtgtgtcacaagatttgggctctgggcacagcggccctgggctgcctggtcaggactacttccacgtctactgctgagcgggctggcaaggcgcatagnnn

SEQ ID NO: 80490 - DNA, 242 bp, Homo sapiens; identical to SEQ ID NO: 79992
  misc_feature: GYAE6OF02HX9WJ.44.25.C03.1.454.CMB.1.raw
  modified_base (238)..(242): a, c, t, g, unknown or other
  misc_feature (238)..(242): n is a, c, g, or t

SEQ ID NO: 80491 - DNA, 219 bp, Homo sapiens; identical to SEQ ID NO: 80443
  misc_feature: GYAE6OF02HQJV7.44.25.C03.1.454.CMB.1.raw
  modified_base (218)..(219): a, c, t, g, unknown or other
  misc_feature (218)..(219): n is a, c, g, or t

SEQ ID NO: 80492 - DNA, 173 bp, Homo sapiens
  misc_feature: GYAE6OF02IEBRW.44.25.C03.1.454.CMB.1.raw
  modified_base (172)..(173): a, c, t, g, unknown or other
  misc_feature (172)..(173): n is a, c, g, or t
tcagacagtatatacacgaccggtgctcgatttagtagtgtagatttgggtttggggttttcggcggagggacccgactgaccgtcctaagtcagcccaaggctgccccctcggtcactctgttcccaccctcctctatatactgtctgagcgggctggcaaggcgcatagnn

SEQ ID NO: 80493 - DNA, 218 bp, Homo sapiens
  misc_feature: GYAE6OF02G8NRQ.44.25.C03.1.454.CMB.1.raw
  modified_base (218)..(218): a, c, t, g, unknown or other
  misc_feature (218)..(218): n is a, c, g, or t
tcagacagtatatacacgaccggtgctcgatttagtagtgtagatttgggtttgggggaagaggaagactgacggtcctcccaggagttcaggtgctgggcaccttgggcacggggaggtgtgtcacaagatttgggctctgggcacagcggccctgggctgcctggtcaaggactacttcctatatactgtctgagcgggctggcaaggcgcatagn

SEQ ID NO: 80494 - DNA, 300 bp, Homo sapiens
  misc_feature: GYAE6OF02GUKBV.44.25.C03.1.454.CMB.1.raw
  modified_base (297)..(300): a, c, t, g, unknown or other
  misc_feature (297)..(300): n is a, c, g, or t
tcagacagtatatacacgaccggtgctcgatttagtagtgtagatttgggtttgggggtgtggtggtctccactcccgccttgacggggctgctatctgcctccctggccatcactgggctccaggctgaagatgagggtgattattactgccagtcctatgacagcagcctcagtggttgggtgttcggcggagggaccaagctggccgtcctgggtcagcccaaggctgccccctcggtcactctgttcccacctcctctatatactgtctgagcgggctggcaaggcgcatagnnnn

SEQ ID NO: 80495 - DNA, 232 bp, Homo sapiens
  misc_feature: GYAE6OF02JESWM.44.25.C03.1.454.CMB.1.raw
  modified_base (222)..(232): a, c, t, g, unknown or other
  misc_feature (222)..(232): n is a, c, g, or t
tcagacagtatatacacgaccggtgctcgatttagtagtgtagatttgggtttgggggaagaggaagactgacggtcctcccaggagttcaggtgctgggcaccttgggcgacggggaggtgtgtcacaagatttggctctgggcacagcggcccgtgggcgtgcctggtcgaaggactcttccacgtctactgctgagcgggcgtggcgaaggcgcatagnnnnnnnnnnn

SEQ ID NO: 80496 - DNA, 218 bp, Homo sapiens
  misc_feature: GYAE6OF02HUOWT.44.25.C03.1.454.CMB.1.raw
  modified_base (218)..(218): a, c, t, g, unknown or other
  misc_feature (218)..(218): n is a, c, g, or t
tcagacagtatatacacgaccggtgctcgatttagtagtgtagatttgggtttgggggaagaggaagactgacggtcctcccaggagttcaggtgctgggcaccttgggcacggggaggtgtgtcacaagatttgggctctggacacagcggccctgggctgcctggtcaaggactacttcctatatactgtctgagcgggctggcaaggcgcatagn

SEQ ID NO: 80497 - DNA, 221 bp, Homo sapiens
  misc_feature: GYAE6OF02G3STV.44.25.C03.1.454.CMB.1.raw
  modified_base (219)..(221): a, c, t, g, unknown or other
  misc_feature (219)..(221): n is a, c, g, or t
tcagacagtatatacacgaccggtgctcgatttagtagtgtagatttgggtttgggggaagaggaagactgacggtcctcccaggagttcaggtgctgggcaccttgggcacgggggaggtgtgtcacaagatttgggctctggacacagcggccctgggctgcctggtcaaggactacttcctatatactgtctgagcgggctggcaaggcgcatagnnn

SEQ ID NO: 80498 - DNA, 242 bp, Homo sapiens; identical to SEQ ID NO: 80340
  misc_feature: GYAE6OF02GKH38.44.25.C03.1.454.CMB.1.raw
  modified_base (239)..(242): a, c, t, g, unknown or other
  misc_feature (239)..(242): n is a, c, g, or t

SEQ ID NO: 80499 - DNA, 241 bp, Homo sapiens; identical to SEQ ID NO: 79947
  misc_feature: GYAE6OF02HSULH.44.25.C03.1.454.CMB.1.raw
  modified_base (239)..(241): a, c, t, g, unknown or other
  misc_feature (239)..(241): n is a, c, g, or t

SEQ ID NO: 80500 - DNA, 242 bp, Homo sapiens; identical to SEQ ID NO: 79992
  misc_feature: GYAE6OF02FRUW1.44.25.C03.1.454.CMB.1.raw
  modified_base (238)..(242): a, c, t, g, unknown or other
  misc_feature (238)..(242): n is a, c, g, or t

SEQ ID NO: 80501 - DNA, 357 bp, Homo sapiens
  misc_feature: GYAE6OF02F50CV.44.25.C03.1.454.CMB.1.raw
  modified_base (305)..(305): a, c, t, g, unknown or other
  misc_feature (305)..(305): n is a, c, g, or t
  modified_base (311)..(357): a, c, t, g, unknown or other
  misc_feature (311)..(357): n is a, c, g, or t
tcagacagtatatacacgaccggtgctcgatttagtagtgtagatttgggtttggggggtgtggtggtcgtccacgtcccgccgttgacggggctggctatctggccctccctggccatcacgttgggctccaggctgaagatgagggtgattattacgtgccagtcctatgaccagccagcctcagtggttgggtgttcggcggagggaccaagctgaccgtcctgggtcagcccaaggctcgccccctggtcactcttgtcccaccctctactatatactgtctgagcgggctggcaaggccncatagnnnnnnnnnnnnnnnnnnnnnnnnnnnnnnnnnnnnnnnnnnnnnnn

SEQ ID NO: 80502 - DNA, 454 bp, Homo sapiens
  misc_feature: GYAE6OF02GM33V.44.25.C03.1.454.CMB.1.raw
  modified_base (442)..(442): a, c, t, g, unknown or other
  misc_feature (442)..(442): n is a, c, g, or t
  modified_base (448)..(454): a, c, t, g, unknown or other
  misc_feature (448)..(454): n is a, c, g, or t
tcagacagtatatacacgaccggtgctcgatttagtagtgtagatttgggttggggctggttcctggaaggtgttggtaccagagggtcaccatctcctgcactgggagcagatccaacatcgggacagattctgatgtccactggtaccaacaccttccaggaacagcccccaaactcctcatctttggtaacaactatcggccctcaggggtccctgaccgattctctggctccaagtctggcacctcagcctccctggccatcactgggctccaggctgaagatgagggtgattattactgccagtcctatgacagcagcctcagtggttgggtgttcggcggagggaccaagctgaccgtcctgggtcagcccaaggctcgccccctggtcactctgttcccaccctcctctaatactgtctgagcggctggcaggcncatagnnnnnnn

SEQ ID NO: 80503 - DNA, 434 bp, Homo sapiens
  misc_feature: GYAE6OF02GT4HW.44.25.C03.1.454.CMB.1.raw
  modified_base (426)..(434): a, c, t, g, unknown or other
  misc_feature (426)..(434): n is a, c, g, or t
tcagacagtatatacacgaccggtgctcgatttagtagtgtagatttgggtttggggggcagagggtcaccatctcctgcactgggagcagatccaacatcgggacagattctgatgtccactggtaccaacaccttccaggaacagcccccaaactcctcatctttggtaacaactatcggccctcaggggtccctgaccgattctctggctccaagtctggcacctcagcctccctggccatcactgggctccaggctgaagatgagggtgattattactgccagtcctatgacagcagcctcagtggttgggtgttcggcggagggaccaagctgaccgtcctggtcagcccaaggctgcccctggtcactctgttcccaccctctctatatactgtctgagcgggctggcaaggcgcatagnnnnnnnnn

SEQ ID NO: 80504 - DNA, 304 bp, Homo sapiens
  misc_feature: GYAE6OF02GHDUR.44.25.C03.1.454.CMB.1.raw
  modified_base (298)..(304): a, c, t, g, unknown or other
  misc_feature (298)..(304): n is a, c, g, or t
tcagacagtatatacacgaccggtgctcgatttagtagtgtagatttgggtttgggggtgtggtggtctccactcccgccttgacggggctgctatctgcctccctggccatcactgggctccaggctgaagatgagggtgattattactgccagtcctatgacagcagcctcagtggttgggtgttcggcggagggaccaagctgaccgtcctgggtcagcccaaggctgccccctcggtcactctgttcccgccctcctctatatactgtctgagcgggctggcaaggcgcatagnnnnnnn

SEQ ID NO: 80505 - DNA, 267 bp, Homo sapiens
  misc_feature: GYAE6OF02FKKQ9.44.25.C03.1.454.CMB.1.raw
  modified_base (264)..(267): a, c, t, g, unknown or other
  misc_feature (264)..(267): n is a, c, g, or t
tcagacagtatatacacgaccggtgctcgatttagtagtgtagatttgggtttgggggaagaggaagactgacggtcctcccaggagttcaggtgctgggcaccttgggcacgggggaggtgtgtcacaagatttgggctctgggcaccgtgggcatgggggaggtgtgtcacaagatttgggctctgggcacagcggccctgggctgcctggtcaaggactacttcctatatactgtctgagcgggctggcaaggcgcatagnnnn

SEQ ID NO: 80506 - DNA, 241 bp, Homo sapiens; identical to SEQ ID NO: 80475
  misc_feature: GYAE6OF02I04JV.44.25.C03.1.454.CMB.1.raw
  modified_base (237)..(241): a, c, t, g, unknown or other
  misc_feature (237)..(241): n is a, c, g, or t

SEQ ID NO: 80507 - DNA, 240 bp, Homo sapiens; identical to SEQ ID NO: 79926
  misc_feature: GYAE6OF02IO8L2.44.25.C03.1.454.CMB.1.raw
  modified_base (238)..(240): a, c, t, g, unknown or other
  misc_feature (238)..(240): n is a, c, g, or t

SEQ ID NO: 80508 - DNA, 218 bp, Homo sapiens; identical to SEQ ID NO: 80493
  misc_feature: GYAE6OF02I90R5.44.25.C03.1.454.CMB.1.raw
  modified_base (218)..(218): a, c, t, g, unknown or other
  misc_feature (218)..(218): n is a, c, g, or t

SEQ ID NO: 80509 - DNA, 189 bp, Homo sapiens
  misc_feature: GYAE6OF02GGYXT.44.25.C03.1.454.CMB.1.raw
  modified_base (188)..(189): a, c, t, g, unknown or other
  misc_feature (188)..(189): n is a, c, g, or t
tcagacagtatatacacgaccggtgctcgatttagtagtgtagatttgggtttggggaggtgtgtcacaatatttgggctctgggcaccgtgggcacggggaggtgtgtcacaagatttgggccctgggctgcctggtcaaggactacttcctatatactgtctgagcgggctggcaaggcgcatagnn

SEQ ID NO: 80510 - DNA, 220 bp, Homo sapiens; identical to SEQ ID NO: 79937
  misc_feature: GYAE6OF02FM9GR.44.25.C03.1.454.CMB.1.raw
  modified_base (218)..(220): a, c, t, g, unknown or other
  misc_feature (218)..(220): n is a, c, g, or t

SEQ ID NO: 80511 - DNA, 135 bp, Homo sapiens
  misc_feature: GYAE6OF02G08CQ.44.25.C03.1.454.CMB.1.raw
  modified_base (131)..(135): a, c, t, g, unknown or other
  misc_feature (131)..(135): n is a, c, g, or t
tcagacagtatatacacgaccggtgctcgatttagtagtgtagatttgggtttgggcacagcggccctgggctgcctggtcaaggactacttccacgtctactgtctgagcgggctggcaaggcgcatagnnnnn

SEQ ID NO: 80512 - DNA, 292 bp, Homo sapiens
  misc_feature: GYAE6OF02I50G8.44.25.C03.1.454.CMB.1.raw
  modified_base (215)..(215): a, c, t, g, unknown or other
  misc_feature (215)..(215): n is a, c, g, or t
  modified_base (245)..(292): a, c, t, g, unknown or other
  misc_feature (245)..(292): n is a, c, g, or t
tcagacagtatatacacgaccggtgctcgatttagtagtgtagatttgggtttgggggaagaggaagactgacggtcctcccaggagttcaggtgcgttggctaccgttggcgtaacgggggaggtgtcgtcaacaagtaggtttgggcctcgtgggcacagggccggccctgggctgcctgggtacaacggactacttcctatactactgttcngagcgggcttcggacgaaggtcactatagnnnnnnnnnnnnnnnnnnnnnnnnnnnnnnnnnnnnnnnnnnnnnnnn

SEQ ID NO: 80513 - DNA, 220 bp, Homo sapiens; identical to SEQ ID NO: 79977
  misc_feature: GYAE6OF02I9921.44.25.C03.1.454.CMB.1.raw
  modified_base (219)..(220): a, c, t, g, unknown or other
  misc_feature (219)..(220): n is a, c, g, or t

SEQ ID NO: 80514 - DNA, 265 bp, Homo sapiens
  misc_feature: GYAE6OF02GIJ0Q.44.25.C03.1.454.CMB.1.raw
  modified_base (245)..(265): a, c, t, g, unknown or other
  misc_feature (245)..(265): n is a, c, g, or t
tcagacagtatatacacgaccggtgctcgatttagtagtgtagatttgggtttgggtgcccaagctgctggagggcacggtcaccacggttcaccgtcttcctcagcttccaccaagggcccatcggtcttccccctggcgcccctgctccaggtagcacctctgggggcactagcggccctgggctgcctggtcaaggactacttcctatatactgtctgagcgggctggcaaggcgcagtagnnnnnnnnnnnnnnnnnnnnn

SEQ ID NO: 80515 - DNA, 241 bp, Homo sapiens; identical to SEQ ID NO: 80024
  misc_feature: GYAE6OF02HCTI4.44.25.C03.1.454.CMB.1.raw
  modified_base (238)..(241): a, c, t, g, unknown or other
  misc_feature (238)..(241): n is a, c, g, or t

SEQ ID NO: 80516 - DNA, 129 bp, Homo sapiens; identical to SEQ ID NO: 79980
  misc_feature: GYAE6OF02F1P7Z.44.25.C03.1.454.CMB.1.raw

SEQ ID NO: 80517 - DNA, 133 bp, Homo sapiens
  misc_feature: GYAE6OF02I7058.44.25.C03.1.454.CMB.1.raw
  modified_base (132)..(133): a, c, t, g, unknown or other
  misc_feature (132)..(133): n is a, c, g, or t
tcagacagtatatacacgaccggtgctcgatttagtagtgtagatttgggtttgggtcgacagcggccctgggctgcctggtcaaggactacttcctatatactgtctgagcgggctggcaaggcgcatagnn

SEQ ID NO: 80518 - DNA, 243 bp, Homo sapiens
  misc_feature: GYAE6OF02GAEMO.44.25.C03.1.454.CMB.1.raw
  modified_base (239)..(243): a, c, t, g, unknown or other
  misc_feature (239)..(243): n is a, c, g, or t
tcagacagtatatacacgaccggtgctcgatttagtagtgtagatttgggtttgggtgcccaagctgctggagggcacggtcaccacggtcaccgtctcctcagcctccaccaagggcccatcggtcttccccctggcaccctcctccaagagcacctctgggggcacagcggccctgggctgcctggtcaaggactacttcctcgatcgcgtctgagcgggctggcaaggcgcatagnnnnn

SEQ ID NO: 80519 - DNA, 249 bp, Homo sapiens
  misc_feature: GYAE6OF02H1EKG.44.25.C03.1.454.CMB.1.raw
  modified_base (223)..(249): a, c, t, g, unknown or other
  misc_feature (223)..(249): n is a, c, g, or t
tcagacagtatatacacgaccggtgctcgatttagtagtgtagatttgggtttggggggaagaggaagactgacggtcctcccaggagttcaggtgctgggcacccttgggcatgggggaggtggtgtcacaagatttgggctctgggcacagcggaccctgggctgcctggtcaaggactacttccacgtctactgctgagcgggctggcaaggcgcatagnnnnnnnnnnnnnnnnnnnnnnnnnnn

SEQ ID NO: 80520 - DNA, 220 bp, Homo sapiens
  misc_feature: GYAE6OF02FFXCY.44.25.C03.1.454.CMB.1.raw
  modified_base (218)..(220): a, c, t, g, unknown or other
  misc_feature (218)..(220): n is a, c, g, or t
tcagacagtatatacacgaccggtgctcgatttagtagtgtagatttgggtttgggggaagaggaagactgacggtcctcccaggagttcaggtgctgggcaccttgggcacggggaggtgtgtcacaagatttgggctctgggcacagcggccctgggctgcctggtcaaggactacttccacgtctactgctgagcgggctggcaaggcgcatagnnn

SEQ ID NO: 80521 - DNA, 239 bp, Homo sapiens
  misc_feature: GYAE6OF02I66W2.44.25.C03.1.454.CMB.1.raw
  modified_base (236)..(239): a, c, t, g, unknown or other
  misc_feature (236)..(239): n is a, c, g, or t
tcagacagtatatacacgaccggtgctcgatttagtagtgtagatttgggtttgggtgcccaagctgctggagggcacggtcaccacggtcaccgtctcctcagcttccaccaagggcccatcggtcttcccctggcgccctgctccaggagcacctctggggcacagcggccctgggctgcctggtcaaggctacttcctatatactgtctgagcgggctggcaaggcgcatagnnnn

SEQ ID NO: 80522 - DNA, 266 bp, Homo sapiens
  misc_feature: GYAE6OF02HI8AX.44.25.C03.1.454.CMB.1.raw
  modified_base (262)..(266): a, c, t, g, unknown or other
  misc_feature (262)..(266): n is a, c, g, or t
tcagacagtatatacacgaccggtgctcgatttagtagtgtagatttgggtttgggggaagaggaagactgacggtcctcccaggagttcaggtgctgggcaccttgggcacggggaggtgtgtcacaagatttgggctctgggcaccgtgggcatggggaggtgtgtcacaagatttgggctctgggcacagcggccctgggctgcctggtcaaggactacttcctatatactgtctgagcgggctggcaaggcgcatagnnnnn

SEQ ID NO: 80523 - DNA, 267 bp, Homo sapiens; identical to SEQ ID NO: 80505
  misc_feature: GYAE6OF02INA81.44.25.C03.1.454.CMB.1.raw
  modified_base (264)..(267): a, c, t, g, unknown or other
  misc_feature (264)..(267): n is a, c, g, or t

SEQ ID NO: 80524 - DNA, 215 bp, Homo sapiens
  misc_feature: GYAE6OF02FXOQM.44.25.C03.1.454.CMB.1.raw
  modified_base (213)..(215): a, c, t, g, unknown or other
  misc_feature (213)..(215): n is a, c, g, or t
tcagacagtatatacacgaccggtgctcgatttagtagtgtagatttgggtttggggacaatggtcaccgtctcttcagcttccaccaagggcccatcggtcttcccctggcgccctgctccaggagcacctctgggggcacagcggccctgggctgcctggtcaaggactacttcctatatactgtctgagcgggctggcaaggcgcatagnnn

SEQ ID NO: 80525 - DNA, 241 bp, Homo sapiens
  misc_feature: GYAE6OF02HGJTC.44.25.C03.1.454.CMB.1.raw
  modified_base (239)..(241): a, c, t, g, unknown or other
  misc_feature (239)..(241): n is a, c, g, or t
tcagacagtatatacacgaccggtgctcgatttagtagtgtagatttgggtttgggtgcccaagctgctggagggcacggtcaccacggtccccgtctcctcagcttccaccaagggcccatcggtcttccccctggcgccctgctccaggagcacctctgggggcacagcggccctgggctgcctggtcaaggactacttcctatatactgtctgagcgggctggcaaggcgcatagnnn

SEQ ID NO: 80526 - DNA, 141 bp, Homo sapiens
  misc_feature: GYAE6OF02G3PO1.44.25.C03.1.454.CMB.1.raw
  modified_base (120)..(120): a, c, t, g, unknown or other
  misc_feature (120)..(120): n is a, c, g, or t
  modified_base (141)..(141): a, c, t, g, unknown or other
  misc_feature (141)..(141): n is a, c, g, or t
tcagacagtatatacacgaccggtgctcgatttagtagtgtagatttgggtttgggctctgggcacagcggccctgggctgcctggtcaaggactacttcctatatactgtctgggggancgggctggcaaggcgcatagn

SEQ ID NO: 80527 - DNA, 239 bp, Homo sapiens; identical to SEQ ID NO: 80476
  misc_feature: GYAE6OF02HT7Q0.44.25.C03.1.454.CMB.1.raw
  modified_base (238)..(239): a, c, t, g, unknown or other
  misc_feature (238)..(239): n is a, c, g, or t

SEQ ID NO: 80528 - DNA, 480 bp, Homo sapiens
  misc_feature: GYAE6OF02IW1VP.44.25.C03.1.454.CMB.1.raw
  modified_base (279)..(279): a, c, t, g, unknown or other
  misc_feature (279)..(279): n is a, c, g, or t
  modified_base (281)..(281): a, c, t, g, unknown or other
  misc_feature (281)..(281): n is a, c, g, or t
  modified_base (286)..(287): a, c, t, g, unknown or other
  misc_feature (286)..(287): n is a, c, g, or t
  modified_base (290)..(290): a, c, t, g, unknown or other
  misc_feature (290)..(290): n is a, c, g, or t
  modified_base (294)..(294): a, c, t, g, unknown or other
  misc_feature (294)..(294): n is a, c, g, or t
  modified_base (296)..(297): a, c, t, g, unknown or other
  misc_feature (296)..(297): n is a, c, g, or t
  modified_base (304)..(304): a, c, t, g, unknown or other
  misc_feature (304)..(304): n is a, c, g, or t
  modified_base (307)..(307): a, c, t, g, unknown or other
  misc_feature (307)..(307): n is a, c, g, or t
  modified_base (310)..(310): a, c, t, g, unknown or other
  misc_feature (310)..(310): n is a, c, g, or t
  modified_base (312)..(312): a, c, t, g, unknown or other
  misc_feature (312)..(312): n is a, c, g, or t
  modified_base (314)..(314): a, c, t, g, unknown or other
  misc_feature (314)..(314): n is a, c, g, or t
  modified_base (316)..(316): a, c, t, g, unknown or other
  misc_feature (316)..(316): n is a, c, g, or t
  modified_base (318)..(318): a, c, t, g, unknown or other
  misc_feature (318)..(318): n is a, c, g, or t
  modified_base (320)..(320): a, c, t, g, unknown or other
  misc_feature (320)..(320): n is a, c, g, or t
  modified_base (322)..(322): a, c, t, g, unknown or other
  misc_feature (322)..(322): n is a, c, g, or t
  modified_base (324)..(324): a, c, t, g, unknown or other
  misc_feature (324)..(324): n is a, c, g, or t
  modified_base (330)..(331): a, c, t, g, unknown or other
  misc_feature (330)..(331): n is a, c, g, or t
  modified_base (333)..(334): a, c, t, g, unknown or other
  misc_feature (333)..(334): n is a, c, g, or t
  modified_base (336)..(336): a, c, t, g, unknown or other
  misc_feature (336)..(336): n is a, c, g, or t
  modified_base (341)..(341): a, c, t, g, unknown or other
  misc_feature (341)..(341): n is a, c, g, or t
  modified_base (344)..(344): a, c, t, g, unknown or other
  misc_feature (344)..(344): n is a, c, g, or t
  modified_base (346)..(346): a, c, t, g, unknown or other
  misc_feature (346)..(346): n is a, c, g, or t
  modified_base (348)..(348): a, c, t, g, unknown or other
  misc_feature (348)..(348): n is a, c, g, or t
  modified_base (353)..(354): a, c, t, g, unknown or other
  misc_feature (353)..(354): n is a, c, g, or t
  modified_base (360)..(361): a, c, t, g, unknown or other
  misc_feature (360)..(361): n is a, c, g, or t
  modified_base (363)..(363): a, c, t, g, unknown or other
  misc_feature (363)..(363): n is a, c, g, or t
  modified_base (369)..(369): a, c, t, g, unknown or other
  misc_feature (369)..(369): n is a, c, g, or t
  modified_base (385)..(386): a, c, t, g, unknown or other
  misc_feature (385)..(386): n is a, c, g, or t
  modified_base (388)..(388): a, c, t, g, unknown or other
  misc_feature (388)..(388): n is a, c, g, or t
  modified_base (391)..(391): a, c, t, g, unknown or other
  misc_feature (391)..(391): n is a, c, g, or t
  modified_base (397)..(397): a, c, t, g, unknown or other
  misc_feature (397)..(397): n is a, c, g, or t
  modified_base (401)..(401): a, c, t, g, unknown or other
  misc_feature (401)..(401): n is a, c, g, or t
  modified_base (404)..(404): a, c, t, g, unknown or other
  misc_feature (404)..(404): n is a, c, g, or t
  modified_base (426)..(426): a, c, t, g, unknown or other
  misc_feature (426)..(426): n is a, c, g, or t
  modified_base (430)..(430): a, c, t, g, unknown or other
  misc_feature (430)..(430): n is a, c, g, or t
  modified_base (436)..(436): a, c, t, g, unknown or other
  misc_feature (436)..(436): n is a, c, g, or t
  modified_base (448)..(448): a, c, t, g, unknown or other
  misc_feature (448)..(448): n is a, c, g, or t
tcagacagtatatacacgaccggtgctcgatttagtagtgtagatttgggtttggggggaagaggaagactgacggtcctccaggagttcaggtacgctggggcaccttgggcacgggggacggtgtcgtcacgaagatttgggctcgtgggtcaccgttgggcatgggggaggtgtgtcacaagatttgggctctgggcacagcggcctgggctggcctgggtcaagggctacttccgtatactacgtgtctgagcgggctcggcaaggcgctatagntnatcannagntcangnngcagctngancgngngngngngngngngcacanngnnanatatntcncncncgcgnngacacnncncacacncacacacacacacacnngntgngcacanacanacncgacgacgacgcgacgacgtgngtgngagacncgacgcgtacgngacgacgacgacgcgtcgtcgtcgtcgtgtcg

SEQ ID NO: 80529 - DNA, 190 bp, Homo sapiens
  misc_feature: GYAE6OF02HKWGO.44.25.C03.1.454.CMB.1.raw
  modified_base (189)..(190): a, c, t, g, unknown or other
  misc_feature (189)..(190): n is a, c, g, or t
tcagacagtatatacacgaccggtgctcgatttagtagtgtagatttgggtttgggggaggtgtgtcacaagatttgggctctgggcaccgtgggcacggggaggtgtgtcacaagatttgggccctgggctgcctggtcaaggactacttccacgtctactgctgagcgggctggcaaggcgcatagnn

SEQ ID NO: 80530 - DNA, 529 bp, Homo sapiens
  misc_feature: GYAE6OF02HTK4P.44.25.C03.1.454.CMB.1.raw
tcagacagtatatacacgaccggtgctcgatttagtagtgtagatttgggtttgggggactcctgtgccccaccatggacactctttgctacacactcctgctgctgaccaccccttcctgggtcttgtcccaggtcaccttgaaggagtctggtcctgtgctggtgaaacccacagagaccctcacgctgacctgcaccatctctgggttctctctcaacgatattagaatgggtgtgagctggatccgtcagccccagggaaggccctggagtggcttgcacacatcttctcgaatgacgaaaaatcctacagtacatctctgaagagcagtttaaccatctccaaggacacctcaaaagcaggtgtctttagtatgacaacatggaccctgcgacacaggcacatattactgtgcacgggtaatgacgggaaagaacaggctggtttctgtattataagttcttaaccatctggacgtcgtgggacaaagggccacggtcaccgtctacctcgacgcttccaaccg

SEQ ID NO: 80531 - DNA, 294 bp, Homo sapiens
  misc_feature: GYAE6OF02F3GFY.44.25.C03.1.454.CMB.1.raw
  modified_base (201)..(201): a, c, t, g, unknown or other
  misc_feature (201)..(201): n is a, c, g, or t
  modified_base (203)..(207): a, c, t, g, unknown or other
  misc_feature (203)..(207): n is a, c, g, or t
  modified_base (209)..(294): a, c, t, g, unknown or other
  misc_feature (209)..(294): n is a, c, g, or t
tcagacagtatatacacgaccggtgctcgatttagtagtgtagatttgggtttgggggagggtgtgtctacaagtatttgggctctgggctaccgtgggcacgggggaggtgtggtcacaagatttgggccctgggctggccctggtcaaggactacttccgtatattactggtctgagcgggctggcaaggcgcactagntnnnnncnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 80532 - DNA, 617 bp, Homo sapiens
  misc_feature: GYAE6OF02ILC77.44.25.C03.1.454.CMB.1.raw
  modified_base (266)..(266): a, c, t, g, unknown or other
  misc_feature (266)..(266): n is a, c, g, or t
  modified_base (271)..(271): a, c, t, g, unknown or other
  misc_feature (271)..(271): n is a, c, g, or t
tcagacagtatatacacgaccggtgctcgatttagtagtgtagatttgggtttggggtgcccaagactggctgggagggcgacggtcaccaacggtcaccggtcttcctcagccttccgacctaagggccctatccggtctttccccctggcgccctgctccaggagccaccgtctggggcacagcggccctgggcttcgcctggtccaaggctacttcctatatacgtgtctggacgccgggctggacaagggcgacactagcantgttntgccacatacatatgctgacagcagaaatggacagtctcctaaactaccttgtacttacgtcggtcgttccgtaccggcgtacgtccggttaccgtaccgtacttactacgtcgtcgacgtcggtcgtcggtacgtacttctactctcaccactcacgacacgtcgtcgacgacgcgtagaagtagtgtggtacgttagtttagttacgttcgtacgtacgtactaactacttacttactttactttcgttcttacgttcggtacggtacggtaacgtacggtaggtacgtacgtacgtaacgtaacgtacgtcgtcgtacgacgtacctactcgtcgttctctac

SEQ ID NO: 80533 - DNA, 247 bp, Homo sapiens; identical to SEQ ID NO: 80397
  misc_feature: GYAE6OF02GTP94.44.25.C03.1.454.CMB.1.raw
  modified_base (239)..(247): a, c, t, g, unknown or other
  misc_feature (239)..(247): n is a, c, g, or t

SEQ ID NO: 80534 - DNA, 219 bp, Homo sapiens; identical to SEQ ID NO: 80027
  misc_feature: GYAE6OF02JEXKX.44.25.C03.1.454.CMB.1.raw
  modified_base (219)..(219): a, c, t, g, unknown or other
  misc_feature (219)..(219): n is a, c, g, or t

SEQ ID NO: 80535 - DNA, 242 bp, Homo sapiens; identical to SEQ ID NO: 79920
  misc_feature: GYAE6OF02IR3K9.44.25.C03.1.454.CMB.1.raw
  modified_base (238)..(242): a, c, t, g, unknown or other
  misc_feature (238)..(242): n is a, c, g, or t

SEQ ID NO: 80536 - DNA, 241 bp, Homo sapiens
  misc_feature: GYAE6OF02IDW43.44.25.C03.1.454.CMB.1.raw
  modified_base (239)..(241): a, c, t, g, unknown or other
  misc_feature (239)..(241): n is a, c, g, or t
tcagacagtatatacacgaccggtgctcgatttagtagtgtagatttgggtttgggtgcccaagctgctggagggcacggtcaccacggtcactgtctcctcagcttccaccaagggcccatcggtcttccccctggcgccctgctccaggagcacctctgggggcacagcggccctgggctgcctggtcaaggactacttcctcgatcgcgtctgagcgggctggcaaggcgcatagnnn

SEQ ID NO: 80537 - DNA, 242 bp, Homo sapiens; identical to SEQ ID NO: 80340
  misc_feature: GYAE6OF02G7U0T.44.25.C03.1.454.CMB.1.raw
  modified_base (239)..(242): a, c, t, g, unknown or other
  misc_feature (239)..(242): n is a, c, g, or t

SEQ ID NO: 80538 - DNA, 313 bp, Homo sapiens
  misc_feature: GYAE6OF02IBI1B.44.25.C03.1.454.CMB.1.raw
  modified_base (242)..(242): a, c, t, g, unknown or other
  misc_feature (242)..(242): n is a, c, g, or t
  modified_base (244)..(313): a, c, t, g, unknown or other
  misc_feature (244)..(313): n is a, c, g, or t
tcagacagtatatacacgaccggtgctcgattttagtagtgtagatttgggtttggggttggcccaagctgctggagggcacggtcaccgtctccgtcagcttacccaccaagggcccatcggtcttccccctggcgccctgctccaggagcacctcctgggggcacagcggccctgggctgcctggtcaaggctacttcacgttctactgcgtgagcgggctggcaaggcgcgatagcatncnnnnnnnnnnnnnnnnnnnnnnnnnnnnnnnnnnnnnnnnnnnnnnnnnnnnnnnnnnnnnnnnnnnnnn

SEQ ID NO: 80539 - DNA, 239 bp, Homo sapiens; identical to SEQ ID NO: 80476
  misc_feature: GYAE6OF02GL7AH.44.25.C03.1.454.CMB.1.raw
  modified_base (238)..(239): a, c, t, g, unknown or other
  misc_feature (238)..(239): n is a, c, g, or t

SEQ ID NO: 80540 - DNA, 130 bp, Homo sapiens; identical to SEQ ID NO: 79944
  misc_feature: GYAE6OF02FJUEB.44.25.C03.1.454.CMB.1.raw
  modified_base (130)..(130): a, c, t, g, unknown or other
  misc_feature (130)..(130): n is a, c, g, or t

SEQ ID NO: 80541 - DNA, 260 bp, Homo sapiens
  misc_feature: GYAE6OF02IJ3RX.44.25.C03.1.454.CMB.1.raw
  modified_base (238)..(260): a, c, t, g, unknown or other
  misc_feature (238)..(260): n is a, c, g, or t
tcagacagtatatacacgaccggtgctcgatttagtagtgtagatttgggtttgggtgcccaagctgctggagggcacggtcaccacggtcaccgtctcctcagcttccaccaagggcccatcggtcttcccctggcgccctgctccaggagcacctctgggggcacagcggccctgggctgcctggtcaaggactacttcctatatactgtctgagcgggctggcaaggcgcatagnnnnnnnnnnnnnnnnnnnnnnn

SEQ ID NO: 80542 - DNA, 239 bp, Homo sapiens; identical to SEQ ID NO: 79905
  misc_feature: GYAE6OF02GARQ4.44.25.C03.1.454.CMB.1.raw
  modified_base (237)..(239): a, c, t, g, unknown or other
  misc_feature (237)..(239): n is a, c, g, or t

SEQ ID NO: 80543 - DNA, 230 bp, Homo sapiens
  misc_feature: GYAE6OF02H063A.44.25.C03.1.454.CMB.1.raw
  modified_base (215)..(230): a, c, t, g, unknown or other
  misc_feature (215)..(230): n is a, c, g, or t
tcagacagtatatacacgaccggtgctcgatttagtagtgtagatttgggtttgggggaagaggaagactgacggtcctccaggagttcaggtgctgggcaccttgggcacggggaggtgtgtcacaagatttgggctctgggcacagcggccctgggctgcctggtcaaggctacttcctatatactgtctgagcggctggcaaggcgcatagnnnnnnnnnnnnnnnn

SEQ ID NO: 80544 - DNA, 240 bp, Homo sapiens
  misc_feature: GYAE6OF02G9CLL.44.25.C03.1.454.CMB.1.raw
  modified_base (238)..(240): a, c, t, g, unknown or other
  misc_feature (238)..(240): n is a, c, g, or t
tcagacagtatatacacgaccggtgctcgatttagtagtgtagatttgggtttgggtgcccaagctgctggagggcacggtcaccacggtcaccgtctcctcagcttccaccaagggcccatcggtcttcccctggcgccctgctccaggagcacctctgggggcacagcggccctgggctgcccggtcaaggactacttcctcgatcgcgtctgagcgggctggcaaggcgcatagnnn

SEQ ID NO: 80545 - DNA, 300 bp, Homo sapiens
  misc_feature: GYAE6OF02G4NCV.44.25.C03.1.454.CMB.1.raw
  modified_base (298)..(300): a, c, t, g, unknown or other
  misc_feature (298)..(300): n is a, c, g, or t
tcagacagtatatacacgaccggtgctcgatttagtagtgtagatttgggtttgggggtgtggtggtctccactcccgccttgacggggctgctatctgcctccctggccatcactgggctccaggctgaagatgagggtgattattactgccagtcctatgacagcagcctcagtggttgggtgttcggcggagggaccaagctgaccgtcctgggtcagcccaaggctgccccctcggtcactctgttcccaccctcctctatatactgtctgagcgggctggcaaggcgcatagnnn

SEQ ID NO: 80546 - DNA, 239 bp, Homo sapiens; identical to SEQ ID NO: 79955
  misc_feature: GYAE6OF02GZPAD.44.25.C03.1.454.CMB.1.raw
  modified_base (238)..(239): a, c, t, g, unknown or other
  misc_feature (238)..(239): n is a, c, g, or t

SEQ ID NO: 80547 - DNA, 242 bp, Homo sapiens
  misc_feature: GYAE6OF02HLV1W.44.25.C03.1.454.CMB.1.raw
  modified_base (239)..(242): a, c, t, g, unknown or other
  misc_feature (239)..(242): n is a, c, g, or t
tcagacagtatatacacgaccggtgctcgatttagtagtgtagatttgggtttgggtgcccaagctgctggagggcacggtcaccacggtcaccgtctcctcagcttccaccaagggcccatcggtcttccccctggcgccctgctccaggagcacctccgagagcacagcggccctgggctgcctggtcaaggactacttcctatatactgtctgagcgggctggcaaggcgcatagnnnn

SEQ ID NO: 80548 - DNA, 131 bp, Homo sapiens; identical to SEQ ID NO: 79918
  misc_feature: GYAE6OF02FSC6O.44.25.C03.1.454.CMB.1.raw
  modified_base (130)..(131): a, c, t, g, unknown or other
  misc_feature (130)..(131): n is a, c, g, or t

SEQ ID NO: 80549 - DNA, 241 bp, Homo sapiens; identical to SEQ ID NO: 80103
  misc_feature: GYAE6OF02GRSFN.44.25.C03.1.454.CMB.1.raw
  modified_base (239)..(241): a, c, t, g, unknown or other
  misc_feature (239)..(241): n is a, c, g, or t

SEQ ID NO: 80550 - DNA, 243 bp, Homo sapiens; identical to SEQ ID NO: 80070
  misc_feature: GYAE6OF02H4EUJ.44.25.C03.1.454.CMB.1.raw
  modified_base (239)..(243): a, c, t, g, unknown or other
  misc_feature (239)..(243): n is a, c, g, or t

SEQ ID NO: 80551 - DNA, 292 bp, Homo sapiens
  misc_feature: GYAE6OF02G80Z5.44.25.C03.1.454.CMB.1.raw
  modified_base (234)..(234): a, c, t, g, unknown or other
  misc_feature (234)..(234): n is a, c, g, or t
  modified_base (237)..(241): a, c, t, g, unknown or other
  misc_feature (237)..(241): n is a, c, g, or t
  modified_base (243)..(292): a, c, t, g, unknown or other
  misc_feature (243)..(292): n is a, c, g, or t
tcagacagtatatacacgaccggtgctcgatttagtagtgtagatttgggtttgggggaagaggaagacgtgacggtcctcccgaggagttcacggtgctgggcaaccttgggcacgggggtaggtggtgtcacaagatttgggctactgggcacgagcggcccctgggctgccgtggtcaaaggacttacttccacgtctacttgctgagcgggctggcaaggcgcagtaggnggnnnnngnnnnnnnnnnnnnnnnnnnnnnnnnnnnnnnnnnnnnnnnnnnnnnnnnn

SEQ ID NO: 80552 - DNA, 236 bp, Homo sapiens
  misc_feature: GYAE6OF02J12SU.44.25.C03.1.454.CMB.1.raw
  modified_base (229)..(236): a, c, t, g, unknown or other
  misc_feature (229)..(236): n is a, c, g, or t
tcagacagtatatacacgaccggtgctcgatttagtagtgtagatttgggtttgggtgcccaagctgctggagggcacggtcaccgtctcctcagcttccaccaagggcccatcggtcttcccctggcgccctgctccaggagcacctctgggggcacagcggccctgggctgcctggtcaaggactacttcctatatactgtctgagcgggctggcaaggcgcatagnnnnnnnn

SEQ ID NO: 80553 - DNA, 320 bp, Homo sapiens
  misc_feature: GYAE6OF02IE1S0.44.25.C03.1.454.CMB.1.raw
  modified_base (318)..(320): a, c, t, g, unknown or other
  misc_feature (318)..(320): n is a, c, g, or t
tcagacagtatatacacgaccggtgctcgatttagtagtgtagatttgggtttggggggtgtggtggtctccactcccgccttgacggggctgctatctgccttccaggccactgtcacggctccctggccatcactgggctccaggctgaagatgagggtgattattactgccagtcctatgacagcagcctcagtggttgggtgttcggcggagggaccaagctgaccgtctgggtcagcccaaggctgccccctggtcactctgttccccaccctcctctatatactgtctgagcgggctggcaaggcgcatagnnn

SEQ ID NO: 80554 - DNA, 129 bp, Homo sapiens; identical to SEQ ID NO: 79981
  misc_feature: GYAE6OF02GKXIL.44.25.C03.1.454.CMB.1.raw

SEQ ID NO: 80555 - DNA, 130 bp, Homo sapiens; identical to SEQ ID NO: 79921
  misc_feature: GYAE6OF02IPM5T.44.25.C03.1.454.CMB.1.raw
  modified_base (130)..(130): a, c, t, g, unknown or other
  misc_feature (130)..(130): n is a, c, g, or t

SEQ ID NO: 80556 - DNA, 160 bp, Homo sapiens
  misc_feature: GYAE6OF02HN2WM.44.25.C03.1.454.CMB.1.raw
  modified_base (159)..(160): a, c, t, g, unknown or other
  misc_feature (159)..(160): n is a, c, g, or t
tcagacagtatatacacgaccggtgctcgatttagtagtgtagatttgggtttggggaggtgtgtcacaagatttgggctctgggcacagcggccctgggctgcctggtcaaggactacttcctatatactgtctgagcgggctggcaaggcgcatagnn

SEQ ID NO: 80557 - DNA, 266 bp, Homo sapiens
  misc_feature: GYAE6OF02JD8P3.44.25.C03.1.454.CMB.1.raw
  modified_base (240)..(266): a, c, t, g, unknown or other
  misc_feature (240)..(266): n is a, c, g, or t
tcagacagtatatacacgaccggtgctcgatttagtagtgtagatttgggtttgggtgcccaagctgctggagggcacggtcaccacggtcaccgtctcctcagccttccaccaagggcccatcggtcttccccctggcgccctgctccaggagcacctctgggggcacagcggccctgggctgcctggtcaaggactacttcctatatactgtctgagcgggctggcaaggcgcatagnnnnnnnnnnnnnnnnnnnnnnnnnnn

SEQ ID NO: 80558 - DNA, 242 bp, Homo sapiens; identical to SEQ ID NO: 79920
  misc_feature: GYAE6OF02H6JV7.44.25.C03.1.454.CMB.1.raw
  modified_base (238)..(242): a, c, t, g, unknown or other
  misc_feature (238)..(242): n is a, c, g, or t

SEQ ID NO: 80559 - DNA, 192 bp, Homo sapiens
  misc_feature: GYAE6OF02HI4Y2.44.25.C03.1.454.CMB.1.raw
  modified_base (188)..(192): a, c, t, g, unknown or other
  misc_feature (188)..(192): n is a, c, g, or t
tcagacagtatatacacgaccggtgctcgatttagtagtgtagatttgggtttggggaggtgtgtcacaagatttgggctctgggcaccgtgggcacggggaggtgtgtcacaagatttgggccctgggctgcctggtcaaggactacttcctatatactgtctgagcgggctggcaaggcgcatagnnnnn

SEQ ID NO: 80560 - DNA, 130 bp, Homo sapiens; identical to SEQ ID NO: 79921
  misc_feature: GYAE6OF02FXWU9.44.25.C03.1.454.CMB.1.raw
  modified_base (130)..(130): a, c, t, g, unknown or other
  misc_feature (130)..(130): n is a, c, g, or t

SEQ ID NO: 80561 - DNA, 241 bp, Homo sapiens; identical to SEQ ID NO: 80463
  misc_feature: GYAE6OF02HCF7H.44.25.C03.1.454.CMB.1.raw
  modified_base (237)..(241): a, c, t, g, unknown or other
  misc_feature (237)..(241): n is a, c, g, or t

SEQ ID NO: 80562 - DNA, 223 bp, Homo sapiens
  misc_feature: GYAE6OF02IR9VX.44.25.C03.1.454.CMB.1.raw
  modified_base (219)..(223): a, c, t, g, unknown or other
  misc_feature (219)..(223): n is a, c, g, or t
tcagacagtatatacacgaccggtgctcgatttagtagtgtagatttgggtttgggggaagaggaagactgacggtcctcccaggagttcaggtgctgggcaccttgggcacgggggaggtgtgtcacaagatttgggctctgggcacagcggccctgggctgcctggtcaaggactacttcctatatactgtctgagcgggctggcaaggcgcatagnnnnn

SEQ ID NO: 80563 - DNA, 483 bp, Homo sapiens
  misc_feature: GYAE6OF02JADYR.44.25.C03.1.454.CMB.1.raw
  modified_base (473)..(483): a, c, t, g, unknown or other
  misc_feature (473)..(483): n is a, c, g, or t
tcagacagtatatacacgaccggtgctcgatttagtagtgtagatttgggtttgggctggatccgtcagcccccagggaaggccctggagtggcttgcacacatcttctcgaatgacgaaaaatcctacagtacatctctgaagagcagtttaaccatctccaaggacacctccaaaaggcaggtggtctttagtatgaccaacatggaccctgcggacacaggcacatattactgtgcacgggtaatgcgggaaagaaacagctggtttctgtattataagtcttaccatctggacgtctggggcaaagggaccacggtcaccgtctcctcagcttccaccaagggcccatcggtcttccccctggcgccctgctccaggacgcacctctcgggggcacgagcggccctgggcctgcctggtcaaggactactccacgtctactgctgagcgggctgggcaaggcgcatagnnnnnnnnnnn

SEQ ID NO: 80564 - DNA, 238 bp, Homo sapiens
  misc_feature: GYAE6OF02HHP2H.44.25.C03.1.454.CMB.1.raw
  modified_base (238)..(238): a, c, t, g, unknown or other
  misc_feature (238)..(238): n is a, c, g, or t
tcagacagtatatacacgaccggtgctcgatttagtagtgtagatttgggtttgggtgcccaagctgctggagggcacggtcaccacggtcaccgtctcctcagcttccaccaagggcccatcggtcttcccctggcgccctgctccaggagcacctctgggggcacagcggccctgggctgcctggtcaaggactacttccacgtctactgctgagcgggctggcaaggcgcatagn

SEQ ID NO: 80565 - DNA, 228 bp, Homo sapiens
  misc_feature: GYAE6OF02GNBI8.44.25.C03.1.454.CMB.1.raw
  modified_base (228)..(228): a, c, t, g, unknown or other
  misc_feature (228)..(228): n is a, c, g, or t
tcagacagtatatacacgaccggtgctcgatttagtagtgtagatttgggtttgggtgcccaagctgctggagggcacggtcaccgtctcctcagcttccaccaagggcccatcggtcttcccctggcgccctgctccaggagcacctctggggcacagcggccctgggctgcctggtcaaggactacttcctatatactgtctgagcgggctggcaaggcgcatagn

SEQ ID NO: 80566 - DNA, 241 bp, Homo sapiens; identical to SEQ ID NO: 79947
  misc_feature: GYAE6OF02F9MU2.44.25.C03.1.454.CMB.1.raw
  modified_base (239)..(241): a, c, t, g, unknown or other
  misc_feature (239)..(241): n is a, c, g, or t

SEQ ID NO: 80567 - DNA, 253 bp, Homo sapiens
  misc_feature: GYAE6OF02HF83G.44.25.C03.1.454.CMB.1.raw
  modified_base (223)..(227): a, c, t, g, unknown or other
  misc_feature (223)..(227): n is a, c, g, or t
  modified_base (229)..(253): a, c, t, g, unknown or other
  misc_feature (229)..(253): n is a, c, g, or t
tcagacagtatatacacgaccggtgctcgatttagtagtgtagatttgggtttgggggaagaggaagactgaccggtcctcccaggagttcaggtgctgggcaccttgggcacgggggaggtgtgtcacaagatttgggctctgggcacagcggccctgggctgtcctggtcaaggacttacttcctatatactgtctgagcgggctggcaaggcgcgatagnnnnngnnnnnnnnnnnnnnnnnnnnnnnnn

SEQ ID NO: 80568 - DNA, 223 bp, Homo sapiens
  misc_feature: GYAE6OF02JBE8R.44.25.C03.1.454.CMB.1.raw
  modified_base (219)..(223): a, c, t, g, unknown or other
  misc_feature (219)..(223): n is a, c, g, or t
tcagacagtatatacacgaccggtgctcgatttagtagtgtagatttgggtttgggggaagaggaagactgacggtcctcccaggagttcaggtgctgggcaccttgggcacgggggaggtgtgtcacaagatttgggctctgggcacagcggccctgggctgcctggtcaaggactacttcctcgatcgcgtctgagcgggctggcaaggcgcatagnnnnn

SEQ ID NO: 80569 - DNA, 269 bp, Homo sapiens
  misc_feature: GYAE6OF02HAWHE.44.25.C03.1.454.CMB.1.raw
  modified_base (238)..(269): a, c, t, g, unknown or other
  misc_feature (238)..(269): n is a, c, g, or t
tcagacagtatatacacgaccggtgctcgatttagtagtgtagatttgggtttgggtggcccaagctgctggagggcacggtcaccacggtcaccgtctcctcagcttccaccaaggccatcggtcttcccctggcgccctgctccaggagcaccgtctgggggcacagcggccctgggctgcctggtcaaggactacgttccacgtctactgctgagcggctggcaaggcgcatagnnnnnnnnnnnnnnnnnnnnnnnnnnnnnnnn

SEQ ID NO: 80570 - DNA, 241 bp, Homo sapiens; identical to SEQ ID NO: 79989
  misc_feature: GYAE6OF02F7K1B.44.25.C03.1.454.CMB.1.raw
  modified_base (238)..(241): a, c, t, g, unknown or other
  misc_feature (238)..(241): n is a, c, g, or t

SEQ ID NO: 80571 - DNA, 155 bp, Homo sapiens; identical to SEQ ID NO: 80018
  misc_feature: GYAE6OF02HE26D.44.25.C03.1.454.CMB.1.raw
  modified_base (155)..(155): a, c, t, g, unknown or other
  misc_feature (155)..(155): n is a, c, g, or t

SEQ ID NO: 80572 - DNA, 221 bp, Homo sapiens; identical to SEQ ID NO: 79959
  misc_feature: GYAE6OF02GT48J.44.25.C03.1.454.CMB.1.raw
  modified_base (219)..(221): a, c, t, g, unknown or other
  misc_feature (219)..(221): n is a, c, g, or t

SEQ ID NO: 80573 - DNA, 249 bp, Homo sapiens
  misc_feature: GYAE6OF02F3CFK.44.25.C03.1.454.CMB.1.raw
  modified_base (239)..(249): a, c, t, g, unknown or other
  misc_feature (239)..(249): n is a, c, g, or t
tcagacagtatatacacgaccggtgctcgatttagtagtgtagatttgggtttgggtgcccgaagctgctggagggcacggtcaccacggtcaccgtctcctcagcttccaccaagggcccatcggtcttcccctggcgccctgctccaggagcacctctgggggcacagcggccctgggctgcctggtcaaggactacttcctatatactgtctgagcgggctggcaaggcgcatagnnnnnnnnnnn

SEQ ID NO: 80574 - DNA, 313 bp, Homo sapiens
  misc_feature: GYAE6OF02IFSZK.44.25.C03.1.454.CMB.1.raw
  modified_base (302)..(302): a, c, t, g, unknown or other
  misc_feature (302)..(302): n is a, c, g, or t
  modified_base (307)..(313): a, c, t, g, unknown or other
  misc_feature (307)..(313): n is a, c, g, or t
tcagacagtatatacacgaccggtgctcgatttagtagtgtagatttgggtttgggggggtcacaagaggcagcgctctcgggacgtctccaccatggcctgggctctgctgctcctcactctcctcacccaggacacagggtcctgggcccagtctgccctgactcagcctgcctccgtgtctggtcgcctggacagtcggtcaccatctcctgcactggagccagcggtcagcccaaggccaaccccatgtcactctgttcccgcctctctatatactgtctgagcgggctggcaaggcncatgnnnnnnn

SEQ ID NO: 80575 - DNA, 267 bp, Homo sapiens
  misc_feature: GYAE6OF02GP03J.44.25.C03.1.454.CMB.1.raw
  modified_base (264)..(267): a, c, t, g, unknown or other
  misc_feature (264)..(267): n is a, c, g, or t
tcagacagtatatacacgaccggtgctcgatttagtagtgtagatttgggtttgggggaagaggaagactgacggtcctcccaggagttcaggtgctgggcaccttgggcacgggggaggtgtgtcacaagatttgggctctgggcaccgtgggcatgggggaggtgtgtcacaagatttgggctctgggcacagcggccctgggctgcctggtcaaggactatttccacgtctactgctgagcgggctggcaaggcgcatagnnnn

SEQ ID NO: 80576 - DNA, 223 bp, Homo sapiens
  misc_feature: GYAE6OF02HH51J.44.25.C03.1.454.CMB.1.raw
  modified_base (218)..(223): a, c, t, g, unknown or other
  misc_feature (218)..(223): n is a, c, g, or t
tcagacagtatatacacgaccggtgctcgatttagtagtgtagatttgggtttgggggaagaggaagactgacggtcctcccaggagttcaggtgctggtcaccttgggcatggggaggtgtgtcacaagatttgggctctgggcacagcggccctgggctgcctggtcaaggactacttccacgtctactgctgagcgggctggcaaggcgcatagnnnnnn

SEQ ID NO: 80577 - DNA, 261 bp, Homo sapiens
  misc_feature: GYAE6OF02GACNV.44.25.C03.1.454.CMB.1.raw
  modified_base (240)..(261): a, c, t, g, unknown or other
  misc_feature (240)..(261): n is a, c, g, or t
tcagacagtatatacacgaccggtgctcgatttagtagtgtagatttggggtttgggtgcccaagctgctggagggcacggtcaccacggtcaccgtctcctcagcttccaccaagggcccatcggtcttccccctggcgccctggctccaggagcacctctgggggcacagcggccctgggctgcctggtcaaggctacttcctcgatcgcgtctgagcgggctggcaaggcgcatagnnnnnnnnnnnnnnnnnnnnnn

SEQ ID NO: 80578 - DNA, 242 bp, Homo sapiens; identical to SEQ ID NO: 80340
  misc_feature: GYAE6OF02HQ8L1.44.25.C03.1.454.CMB.1.raw
  modified_base (239)..(242): a, c, t, g, unknown or other
  misc_feature (239)..(242): n is a, c, g, or t

SEQ ID NO: 80579 - DNA, 240 bp, Homo sapiens; identical to SEQ ID NO: 79926
  misc_feature: GYAE6OF02JEN4P.44.25.C03.1.454.CMB.1.raw
  modified_base (238)..(240): a, c, t, g, unknown or other
  misc_feature (238)..(240): n is a, c, g, or t

SEQ ID NO: 80580 - DNA, 501 bp, Homo sapiens
  misc_feature: GYAE6OF02GAWFN.44.25.C03.1.454.CMB.1.raw
  modified_base (409)..(409): a, c, t, g, unknown or other
  misc_feature (409)..(409): n is a, c, g, or t
  modified_base (424)..(424): a, c, t, g, unknown or other
  misc_feature (424)..(424): n is a, c, g, or t
  modified_base (440)..(440): a, c, t, g, unknown or other
  misc_feature (440)..(440): n is a, c, g, or t
  modified_base (461)..(461): a, c, t, g, unknown or other
  misc_feature (461)..(461): n is a, c, g, or t
  modified_base (489)..(489): a, c, t, g, unknown or other
  misc_feature (489)..(489): n is a, c, g, or t
tcagacagtatatacacgaccggtgctcgatttagtagtgtagatttgggtttgggggcttcagctgtgggcacaagaggcagcactcaggacaatctccagcatggcctggtctcctctcctcctcactctcctagctcactgcacagggtcctgggcccactctgtgctgacgcagccgccctcagtgtctggggccccgggcagagggtcaccatctcctgcactgggagcagatccaacatcgggacagattctgatgtccactggtaccaacaccttccaggaacacgcccccaaactcctcatcttggtaacactatcggcctcgagggtccctgaccgattctctggctccaagtctggcacctcacgcctccctggccatcacgtggctccaggctgaagntgaggtgattatacngaccagtcctatgacngcagcctcgagtggttgggtntcggcggaggaccaggctggaccgtcgngggtcagtcccg

SEQ ID NO: 80581 - DNA, 138 bp, Homo sapiens; identical to SEQ ID NO: 80060
  misc_feature: GYAE6OF02F45E4.44.25.C03.1.454.CMB.1.raw
  modified_base (137)..(138): a, c, t, g, unknown or other
  misc_feature (137)..(138): n is a, c, g, or t

SEQ ID NO: 80582 - DNA, 221 bp, Homo sapiens; identical to SEQ ID NO: 79959
  misc_feature: GYAE6OF02IXI44.44.25.C03.1.454.CMB.1.raw
  modified_base (219)..(221): a, c, t, g, unknown or other
  misc_feature (219)..(221): n is a, c, g, or t

SEQ ID NO: 80583 - DNA, 243 bp, Homo sapiens; identical to SEQ ID NO: 80006
  misc_feature: GYAE6OF02H7F95.44.25.C03.1.454.CMB.1.raw
  modified_base (239)..(243): a, c, t, g, unknown or other
  misc_feature (239)..(243): n is a, c, g, or t

SEQ ID NO: 80584 - DNA, 243 bp, Homo sapiens
  misc_feature: GYAE6OF02HJZ7X.44.25.C03.1.454.CMB.1.raw
  modified_base (223)..(243): a, c, t, g, unknown or other
  misc_feature (223)..(243): n is a, c, g, or t
tcagacagtatatacacgaccggtgctcgatttagtagtgtagatttgggtttgggggaaggaggaaggactgacggtcctcccaggagttcaggtgctgggcaccttgggcagtgggggaggtgtgtcacaagatttgggctctgggcaccagcggccctgggctgcctggtcaaggctacttcctatatactgtctgagcgggctggccaaggcgcatagnnnnnnnnnnnnnnnnnnnnn

SEQ ID NO: 80585 - DNA, 240 bp, Homo sapiens
  misc_feature: GYAE6OF02GEW5K.44.25.C03.1.454.CMB.1.raw
  modified_base (238)..(240): a, c, t, g, unknown or other
  misc_feature (238)..(240): n is a, c, g, or t
tcagacagtatatacacgaccggtgctcgatttagtagtgtagatttgggtttgggtgcccaatctgctggagggcacggtcaccacggtcaccgtctcctcagcttccaccaagggcccatcggtcttcccctggcgccctgctccaggagcacctctgggggcacagcggccctgggctgcctggtcaaggactacttccacgtctactgctgagcgggctggcaaggcgcatagnnn

SEQ ID NO: 80586 - DNA, 176 bp, Homo sapiens
  misc_feature: GYAE6OF02H8RGR.44.25.C03.1.454.CMB.1.raw
  modified_base (136)..(176): a, c, t, g, unknown or other
  misc_feature (136)..(176): n is a, c, g, or t
tcagacagtatatacacgaccggtgctcgatttagtagtgtagatttgggttgggcacagcggtccctgggctgcccttaggtcaaggactacttccacgtctactgctgagcgggctgggcaaggcgcataggcnnnnnnnnnnnnnnnnnnnnnnnnnnnnnnnnnnnnnnnnn

SEQ ID NO: 80587 - DNA, 267 bp, Homo sapiens; identical to SEQ ID NO: 80505
  misc_feature: GYAE6OF02FZMAJ.44.25.C03.1.454.CMB.1.raw
  modified_base (264)..(267): a, c, t, g, unknown or other
  misc_feature (264)..(267): n is a, c, g, or t

SEQ ID NO: 80588 - DNA, 175 bp, Homo sapiens
  misc_feature: GYAE6OF02IY5RH.44.25.C03.1.454.CMB.1.raw
  modified_base (128)..(128): a, c, t, g, unknown or other
  misc_feature (128)..(128): n is a, c, g, or t
  modified_base (134)..(175): a, c, t, g, unknown or other
  misc_feature (134)..(175): n is a, c, g, or t
tcagacagtatatacacgaccggtgctcgatttagtagtgtagatttgggtttgggctctggcacagcggcctggctgcctggtcaaggactacttcctatatactgtctgagcggtctggcaaggcncatagnnnnnnnnnnnnnnnnnnnnnnnnnnnnnnnnnnnnnnnnnn

SEQ ID NO: 80589 - DNA, 459 bp, Homo sapiens
  misc_feature: GYAE6OF02IK315.44.25.C03.1.454.CMB.1.raw
  modified_base (441)..(441): a, c, t, g, unknown or other
  misc_feature (441)..(441): n is a, c, g, or t
  modified_base (446)..(459): a, c, t, g, unknown or other
  misc_feature (446)..(459): n is a, c, g, or t
tcagacagtatatacacgaccggtgctcgatttagtagtgtagatttgggtttgggggctgttcctggaaggtgttggtaccagagggtcaccatctcctgcactgggagcagatccaacatcgggacagattctgatgtccactggtaccaacaccttccaggaacagcccccaaactcctcatctttggtaacaactatcggccctcaggggtcccctgaccgattctctggctccaagtctggcacctcagcctcctggccatcactggctccaggctgaagatgaggtgattattactgccagtcctatgacagcagcctcagtgttggtgttcggcggaggaccaagctgaccgtcctgggtcagcccaaggctgccccctggtcactctgttccccgcctcctctatactactgtctgagcgggctggcaagcgnatagnnnnnnnnnnnnnn

SEQ ID NO: 80590 - DNA, 219 bp, Homo sapiens
  misc_feature: GYAE6OF02FHCAY.44.25.C03.1.454.CMB.1.raw
  modified_base (215)..(219): a, c, t, g, unknown or other
  misc_feature (215)..(219): n is a, c, g, or t
tcagacagtatatacacgaccggtgctcgatttagtagtgtagatttgggtttgggggaagaggaagactgacggtcctccaggagttcaggtgctgggcaccttgggcacggggagtgtgtcacaagatttgggctctgggcacagcggcctgggctgcctggtcaaggactacttcctatatactgtctgagcgggctggcaaggcgcatagnnnnn

SEQ ID NO: 80591 - DNA, 220 bp, Homo sapiens; identical to SEQ ID NO: 80074
  misc_feature: GYAE6OF02FZLCR.44.25.C03.1.454.CMB.1.raw
  modified_base (219)..(220): a, c, t, g, unknown or other
  misc_feature (219)..(220): n is a, c, g, or t

SEQ ID NO: 80592 - DNA, 299 bp, Homo sapiens
  misc_feature: GYAE6OF02F2X2U.44.25.C03.1.454.CMB.1.raw
  modified_base (298)..(299): a, c, t, g, unknown or other
  misc_feature (298)..(299): n is a, c, g, or t
tcagacagtatatacacgaccggtgctcgatttagtagtgtagatttgggtttgggggtgtggtggtctccactcccgccttgacggggctgctatctgcctccctggccatcactgggctccaggctgaagatgagggtgattattactgccagtcctatgacagcagcctcagtggttgggtgttcggcggagggaccaagctgaccgtcctgggtcagcccaaggctgccccctcggtcactctgttcccgccctcctctatatactgtctgagcgggctggcaaggcgcatagnn

SEQ ID NO: 80593 - DNA, 287 bp, Homo sapiens
  misc_feature: GYAE6OF02GJFUI.44.25.C03.1.454.CMB.1.raw
  modified_base (242)..(287): a, c, t, g, unknown or other
  misc_feature (242)..(287): n is a, c, g, or t
tcagacagtatatacacgaccggtgctcgatttagtagtgtagatttgggtttgggtgcccaagctgctggagggcacggtcaccacggtcaccgtctcctcagcttccaccaagggcccatcggtcttcccctggcgccctgctccaggagcacctctgggggcacgagcggccctgggcctggcctggtcaaggcctacttcctatactactgtctgagcgggctggcaaggcgcatagnnnnnnnnnnnnnnnnnnnnnnnnnnnnnnnnnnnnnnnnnnnnnn

SEQ ID NO: 80594 - DNA, 436 bp, Homo sapiens
  misc_feature: GYAE6OF02F225Q.44.25.C03.1.454.CMB.1.raw
  modified_base (430)..(436): a, c, t, g, unknown or other
  misc_feature (430)..(436): n is a, c, g, or t
tcagacagtatatacacgaccggtgctcgatttagtagtgtagatttgggtttggggggcagagggtcaccatctcctgcactgggagcagatccaacatcgggacagattctgatgtccactggtaccaacaccttccaggaacagcccccaaactcctcatctttggtaacaactatcggccctcaggggtccctgaccgattctctggctccaagtctggcacctcagcctccctggccatcactgggctccaggctgaagatgagggtgattattactgccagtcctatgacagcagcctcagtggttgggtgttcggcggagggaccaagctgaccgtcctggtcagcccaaggctgcccctggtcactctcgttcccgccctcctctatactactgtctgagcgggctgggcaaggcgcatagnnnnnnn

SEQ ID NO: 80595 - DNA, 242 bp, Homo sapiens; identical to SEQ ID NO: 80017
  misc_feature: GYAE6OF02FQ09Z.44.25.C03.1.454.CMB.1.raw
  modified_base (239)..(242): a, c, t, g, unknown or other
  misc_feature (239)..(242): n is a, c, g, or t

SEQ ID NO: 80596 - DNA, 241 bp, Homo sapiens; identical to SEQ ID NO: 79947
  misc_feature: GYAE6OF02GJ56R.44.25.C03.1.454.CMB.1.raw
  modified_base (239)..(241): a, c, t, g, unknown or other
  misc_feature (239)..(241): n is a, c, g, or t

SEQ ID NO: 80597 - DNA, 241 bp, Homo sapiens; identical to SEQ ID NO: 79947
  misc_feature: GYAE6OF02H1V72.44.25.C03.1.454.CMB.1.raw
  modified_base (239)..(241): a, c, t, g, unknown or other
  misc_feature (239)..(241): n is a, c, g, or t

SEQ ID NO: 80598 - DNA, 245 bp, Homo sapiens
  misc_feature: GYAE6OF02H35V9.44.25.C03.1.454.CMB.1.raw
  modified_base (238)..(245): a, c, t, g, unknown or other
  misc_feature (238)..(245): n is a, c, g, or t
tcagacagtatatacacgaccggtgctcgatttagtagtgtagatttgggtttgggtgcccaagctgctggagggcacggtcaccacggtcaccgtctcctcagcttccaccaagggcccatcggtcttcccctggcgccctgctccaggagcacctctgggggcacagcggccctgggctgcctggtcaaggactacttccacgtctactgctgagcgggctggcaaggcgcatagnnnnnnnn

SEQ ID NO: 80599 - DNA, 293 bp, Homo sapiens
  misc_feature: GYAE6OF02JP4RA.44.25.C03.1.454.CMB.1.raw
  modified_base (229)..(230): a, c, t, g, unknown or other
  misc_feature (229)..(230): n is a, c, g, or t
  modified_base (232)..(232): a, c, t, g, unknown or other
  misc_feature (232)..(232): n is a, c, g, or t
  modified_base (234)..(234): a, c, t, g, unknown or other
  misc_feature (234)..(234): n is a, c, g, or t
  modified_base (237)..(241): a, c, t, g, unknown or other
  misc_feature (237)..(241): n is a, c, g, or t
  modified_base (243)..(293): a, c, t, g, unknown or other
  misc_feature (243)..(293): n is a, c, g, or t
tcagacagtatatacacgaccggtgctcgatttagtagtgtagatttgggtttggggggaagaggaagactgaccggtcctcccaggagttcaggtgcttgggcaccttgggcatgggggaggtgtgtcacaagatttgggctctgggctacagcggccctgggcttgcctggtcaaaggtactacttccacgtctactgctgagcgggctgggcaaggcgcagtaggnngngngcnnnnncnnnnnnnnnnnnnnnnnnnnnnnnnnnnnnnnnnnnnnnnnnnnnnnnnnn

SEQ ID NO: 80600 - DNA, 242 bp, Homo sapiens; identical to SEQ ID NO: 79920
  misc_feature: GYAE6OF02HZGB7.44.25.C03.1.454.CMB.1.raw
  modified_base (238)..(242): a, c, t, g, unknown or other
  misc_feature (238)..(242): n is a, c, g, or t

SEQ ID NO: 80601 - DNA, 195 bp, Homo sapiens
  misc_feature: GYAE6OF02HYU8D.44.25.C03.1.454.CMB.1.raw
  modified_base (190)..(195): a, c, t, g, unknown or other
  misc_feature (190)..(195): n is a, c, g, or t
tcagacagtatatacacgaccggtgctcgatttagtagtgtagatttgggtttgggggaggtgtgtcacaagatttgggctctgggcaccgtgggcacgggggaggtgtgtcacaagatttgggccctgggctgcctggtcaaggactacttccacgtctactgctgagcgggctggcaaggcgcatagnnnnnn

SEQ ID NO: 80602 - DNA, 221 bp, Homo sapiens; identical to SEQ ID NO: 79959
  misc_feature: GYAE6OF02FJIZ0.44.25.C03.1.454.CMB.1.raw
  modified_base (219)..(221): a, c, t, g, unknown or other
  misc_feature (219)..(221): n is a, c, g, or t

SEQ ID NO: 80603 - DNA, 130 bp, Homo sapiens; identical to SEQ ID NO: 79921
  misc_feature: GYAE6OF02IV2AO.44.25.C03.1.454.CMB.1.raw
  modified_base (130)..(130): a, c, t, g, unknown or other
  misc_feature (130)..(130): n is a, c, g, or t

SEQ ID NO: 80604 - DNA, 260 bp, Homo sapiens
  misc_feature: GYAE6OF02FMF9B.44.25.C03.1.454.CMB.1.raw
  modified_base (239)..(260): a, c, t, g, unknown or other
  misc_feature (239)..(260): n is a, c, g, or t
tcagacagtatatacacgaccggtgctcgatttagtagtgtagatttgggtttgggtgcccaagctgctggagggcacggtcaccacggtcaccgtctcctcagcttccaccaagggcccatcggtcttcccctggcgccctgctccaggagcacctctgggggcacagcggccctgggctgcctggtcaaggactacttcctatatactgtctgagcgggctggcaaggcgcgatagnnnnnnnnnnnnnnnnnnnnnn

SEQ ID NO: 80605 - DNA, 219 bp, Homo sapiens
  misc_feature: GYAE6OF02HKXIX.44.25.C03.1.454.CMB.1.raw
  modified_base (219)..(219): a, c, t, g, unknown or other
  misc_feature (219)..(219): n is a, c, g, or t
tcagacagtatatacacgaccggtgctcgatttagtagtgtagatttgggtttgggggaagaggaagactgacggtcctcccaggagttcaggtgctgggcaccttgggcatgggggaggtgtgtcacaagatttgggctctgggcacagcggccctgggctgcctggtcaaggactacttcctatatactgtctgagcgggctggcaaggcgcatagn

SEQ ID NO: 80606 - DNA, 248 bp, Homo sapiens
  misc_feature: GYAE6OF02FONTY.44.25.C03.1.454.CMB.1.raw
  modified_base (239)..(248): a, c, t, g, unknown or other
  misc_feature (239)..(248): n is a, c, g, or t
tcagacagtatatacacgaccggtgctcgatttagtagtgtagatttgggtttgggtgcccaagctgctggagggcacggtcaccacggtcaccgtctcctcagcttccaccaagggcccatcggtcttccccctggcgccctgctccaggagcacctctgggggcacagcggccctgggctgcctggtcaaggactacttccacgtctactgctgagcgggctggcaaggcgcatagnnnnnnnnnn

SEQ ID NO: 80607 - DNA, 133 bp, Homo sapiens; identical to SEQ ID NO: 80088
  misc_feature: GYAE6OF02F8JH7.44.25.C03.1.454.CMB.1.raw
  modified_base (130)..(133): a, c, t, g, unknown or other
  misc_feature (130)..(133): n is a, c, g, or t

SEQ ID NO: 80608 - DNA, 240 bp, Homo sapiens; identical to SEQ ID NO: 80130
  misc_feature: GYAE6OF02HD8UZ.44.25.C03.1.454.CMB.1.raw
  modified_base (238)..(240): a, c, t, g, unknown or other
  misc_feature (238)..(240): n is a, c, g, or t

SEQ ID NO: 80609 - DNA, 221 bp, Homo sapiens; identical to SEQ ID NO: 79997
  misc_feature: GYAE6OF02G1CLO.44.25.C03.1.454.CMB.1.raw
  modified_base (219)..(221): a, c, t, g, unknown or other
  misc_feature (219)..(221): n is a, c, g, or t

SEQ ID NO: 80610 - DNA, 524 bp, Homo sapiens
  misc_feature: GYAE6OF02F9EUO.44.25.C03.1.454.CMB.1.raw
  modified_base (222)..(222): a, c, t, g, unknown or other
  misc_feature (222)..(222): n is a, c, g, or t
  modified_base (408)..(408): a, c, t, g, unknown or other
  misc_feature (408)..(408): n is a, c, g, or t
  modified_base (417)..(417): a, c, t, g, unknown or other
  misc_feature (417)..(417): n is a, c, g, or t
tcagacagtatatacacgaccggtgctcgatttagtagtgtagatttgggtttgggggggcacaagaggcagcactcaggacaatctccagcatggcctggtctcctctcctcctcactctcctcgctcactgcacagggtcctgggcccactctgtgctgacgcagccgccctcagtgtctggggccccgggcagagggtcaccatctcctgcactgggancagatccaacatcgggacagattctgatgtccactggtaccaacaccttcaggaacagcccccaaatcctcatcttggaacaactatccggccctcgacggggtccctgaccgtattcctctggcctccaagtctggcacctcacgccctccctggcccatccacgtgggcctccgaggctgaagntggagggtnattattactgcctagtcctatcgacagcagcctgaggttggttgggtgttcgggcggaggaccagcgtgaccgtcgtggtcacgccgaggcctcgtccccctggtcc

SEQ ID NO: 80611 - DNA, 219 bp, Homo sapiens; identical to SEQ ID NO: 80027
  misc_feature: GYAE6OF02HGU24.44.25.C03.1.454.CMB.1.raw
  modified_base (219)..(219): a, c, t, g, unknown or other
  misc_feature (219)..(219): n is a, c, g, or t

SEQ ID NO: 80612 - DNA, 301 bp, Homo sapiens
  misc_feature: GYAE6OF02GER98.44.25.C03.1.454.CMB.1.raw
  modified_base (298)..(301): a, c, t, g, unknown or other
  misc_feature (298)..(301): n is a, c, g, or t
tcagacagtatatacacgaccggtgctcgatttagtagtgtagatttgggtttgggggtgtggtggtctccactcccgccttgacggggctgctatctgcctccctggccatcactgggctccaggctgaagatgagggtgattattactgccagtcctatgacagcagcctcagtggttgggtgttcggcggagggaccaagctgaccgtcctgggtcagcccaaggctgccccctcggtcactctgttcccaccctcctctatatactgtctgagcgggctggcaaggcgcatagnnnn

SEQ ID NO: 80613 - DNA, 268 bp, Homo sapiens
  misc_feature: GYAE6OF02GA74M.44.25.C03.1.454.CMB.1.raw
  modified_base (229)..(268): a, c, t, g, unknown or other
  misc_feature (229)..(268): n is a, c, g, or t
tcagacagtatatacacgaccggtgctcgatttagtagtgtagatttgggtttgggggaagaggaagactgacggtccctcccaggagttcaggtgcttgggcaccttgggcacgggggaggtgtcgtcactaagatttgggctactgggcacagcggccctgggcctgccctggtcaaggactacttccacgtcgtaactgctgagccgggctggcaaggcgcatagnnnnnnnnnnnnnnnnnnnnnnnnnnnnnnnnnnnnnnnn

SEQ ID NO: 80614 - DNA, 249 bp, Homo sapiens
  misc_feature: GYAE6OF02HDW20.44.25.C03.1.454.CMB.1.raw
  modified_base (240)..(249): a, c, t, g, unknown or other
  misc_feature (240)..(249): n is a, c, g, or t
tcagacagtatatacacgaccggtgctcgatttagtagtgtagatttgggtttgggtgcccaagctgctggagggcacggtcaccacggtcaccgtctcctcagcttccaccaagggcccatcggtcttccccctggcgccctgctccaggagcacctctgggggcacagcggccctgggctgcctggtcaaggactacttcctatagtactgtctgagcgggctggcaaggcgcatagnnnnnnnnnn

SEQ ID NO: 80615 - DNA, 239 bp, Homo sapiens
  misc_feature: GYAE6OF02F4JFN.44.25.C03.1.454.CMB.1.raw
  modified_base (238)..(239): a, c, t, g, unknown or other
  misc_feature (238)..(239): n is a, c, g, or t
tcagacagtatatacacgaccggtgctcgatttagtagtgtagatttgggtttgggtgcccaagctgctggagggcacgttcaccacggtcaccgtctcctcagcttccaccaagggcccatcggtcttcccctggcgccctgctccaggagcacctctgggggcacagcggccctgggctgcctggtcaaggactacttcctatatactgtctgagcgggctggcaaggcgcatagnn

SEQ ID NO: 80616 - DNA, 218 bp, Homo sapiens
  misc_feature: GYAE6OF02GFINL.44.25.C03.1.454.CMB.1.raw
  modified_base (218)..(218): a, c, t, g, unknown or other
  misc_feature (218)..(218): n is a, c, g, or t
tcagacagtatatacacgaccggtgctcgatttagtagtgtagatttgggtttgggggaagaggaagactgacggtcctcccaggagttcaggtgctgggcaccttgggcatggggaggtgtgtcacaagatttgggctctgggcacagcggccctgggctgcctggtcaaggactacttccacgtctactgctgagcgggctggcaaggcgcatagn

SEQ ID NO: 80617 - DNA, 242 bp, Homo sapiens
  misc_feature: GYAE6OF02FVBI1.44.25.C03.1.454.CMB.1.raw
  modified_base (239)..(242): a, c, t, g, unknown or other
  misc_feature (239)..(242): n is a, c, g, or t
tcagacagtatatacacgaccggtgctcgatttagtagtgtagatttgggtttgggtgcccaagctgctggagggcacggtcaccacggtcaccgtctcctcagcttccaccaagggcccatcgatcttccccctggcgccctgctccaggagcacctctgggggcacagcggccctgggctgcctggtcaaggactacttcctatatactgtctgagcgggctggcaaggcgcatagnnnn

SEQ ID NO: 80618 - DNA, 301 bp, Homo sapiens
  misc_feature: GYAE6OF02G7GLI.44.25.C03.1.454.CMB.1.raw
  modified_base (298)..(301): a, c, t, g, unknown or other
  misc_feature (298)..(301): n is a, c, g, or t
tcagacagtatatacacgaccggtgctcgatttagtagtgtagatttgggtttgggggtgtggtggtctccactcccgccttgacggggctgctatctgcctccctggccatcactgggctccaggctgaagatgagggtgattattactgccagtcctatgacagcagcctcagtggttgggtgttcggcggagggaccaagctgaccgtcctgggtcagcccaaggctgccccctcggtcactctgttcccgccctcctctatatactgtctgagcgggctggcaaggcgcatagnnnn

SEQ ID NO: 80619 - DNA, 324 bp, Homo sapiens
  misc_feature: GYAE6OF02F0HII.44.25.C03.1.454.CMB.1.raw
  modified_base (129)..(129): a, c, t, g, unknown or other
  misc_feature (129)..(129): n is a, c, g, or t
  modified_base (132)..(132): a, c, t, g, unknown or other
  misc_feature (132)..(132): n is a, c, g, or t
  modified_base (138)..(138): a, c, t, g, unknown or other
  misc_feature (138)..(138): n is a, c, g, or t
  modified_base (149)..(149): a, c, t, g, unknown or other
  misc_feature (149)..(149): n is a, c, g, or t
  modified_base (305)..(308): a, c, t, g, unknown or other
  misc_feature (305)..(308): n is a, c, g, or t
  modified_base (310)..(324): a, c, t, g, unknown or other
  misc_feature (310)..(324): n is a, c, g, or t
tcagacagtatatacacgaccggtgctcgattagtagtgtagattggtttggtgcccaagctgctggagggcacggtcaccacggtcaccgtctcctcagcttccaccaagggcccatcggtcttcccncgngcctcnctcacggagcncctcgtggggcgaccagccggtcccgtcgggtacgtcgtccgttcggtacgtaaccggtaaccgttacctttacccttaacttaagttaccgttcgggttcggttacggacgggccggggtccggttacgaccggaacggtaccggcctaataggnnnntnnnnnnnnnnnnnnn

SEQ ID NO: 80620 - DNA, 476 bp, Homo sapiens
  misc_feature: GYAE6OF02FIPD4.44.25.C03.1.454.CMB.1.raw
  modified_base (467)..(476): a, c, t, g, unknown or other
  misc_feature (467)..(476): n is a, c, g, or t
tcagacagtatatacacgaccggtgctcgatttagtagtgtagatttgggtttgggctggatccgtcagcccccagggaaggccctggagtggcttgcacacatcttctcgaatgacgaaaaatcctacagtacatctctgaagagcagtttaaccatctccaaggacacctccaaaaggcaggtggtctttagtatgaccaacatggaccctgcggacacaggcacatattactgtgcacgggtaatgcgggaaagaacagctggttctgtattataagtcttaccatctggacgtctggggcaaagggaccacggtcaccgtctcctcagcttccaccaagggcccatcggtcttcccctggcgccctgctccaggagcacctctgggggcacgagcggccctgggctgcctggtcaaggactacttcctatatactgtctgagcgggctggcaaggcgcatagnnnnnnnnnn

SEQ ID NO: 80621 - DNA, 305 bp, Homo sapiens
  misc_feature: GYAE6OF02IJQQ3.44.25.C03.1.454.CMB.1.raw
  modified_base (300)..(305): a, c, t, g, unknown or other
  misc_feature (300)..(305): n is a, c, g, or t
tcagacagtatatacacgaccggtgctcgatttagtagtgtagatttgggtttggggggtgtggtggtctccactcccgccttgacggggctgctatctgcctccctggccatcactgggctccaggctgaagatgagggtgattattactgccagtcctatgacagcagcctcagtggttgggtgttcggcggagggaccaagctgaccgtcctgggtcagccaaggctcgccccctcggtcactctcgttccccacctcctctatatactgtctgagcgggctggcaaggcgcatagnnnnnn

SEQ ID NO: 80622 - DNA, 360 bp, Homo sapiens
  misc_feature: GYAE6OF02JZI87.44.25.C03.1.454.CMB.1.raw
  modified_base (311)..(312): a, c, t, g, unknown or other
  misc_feature (311)..(312): n is a, c, g, or t
  modified_base (316)..(316): a, c, t, g, unknown or other
  misc_feature (316)..(316): n is a, c, g, or t
  modified_base (318)..(360): a, c, t, g, unknown or other
  misc_feature (318)..(360): n is a, c, g, or t
tcagacagtatatacacgaccggtgctcgatttagtagtgtagatttgggtttgggggggtgtggtggtctccactcccgccttgacggggctgctatctgcctccctggccatcactgggctccaggcttcgaagatgaggtgacttattactgccagtcctatggacaggccagcctcagtggttgggtgttcggcggagggacccaagctgaccgtccgtcgggtcagcccaaggcctgccccctcggtcactctcgttcccaccctcctcatactactgtctgagtcggcttggcaaggcacatagnngcancnnnnnnnnnnnnnnnnnnnnnnnnnnnnnnnnnnnnnnnnnnn

SEQ ID NO: 80623 - DNA, 242 bp, Homo sapiens; identical to SEQ ID NO: 80158
  misc_feature: GYAE6OF02JD08S.44.25.C03.1.454.CMB.1.raw
  modified_base (237)..(242): a, c, t, g, unknown or other
  misc_feature (237)..(242): n is a, c, g, or t

SEQ ID NO: 80624 - DNA, 321 bp, Homo sapiens
  misc_feature: GYAE6OF02GFHDT.44.25.C03.1.454.CMB.1.raw
  modified_base (297)..(299): a, c, t, g, unknown or other
  misc_feature (297)..(299): n is a, c, g, or t
  modified_base (301)..(321): a, c, t, g, unknown or other
  misc_feature (301)..(321): n is a, c, g, or t
tcagacagtatatacacgaccggtgctcgatttagtagtgtagatttgggtttgggggtgtggtggtctccactcccgccttgacggggctgctatctgcctccctggccatcactgggctccaggctgaagatgagggtgattattactgccagtcctatgacagcagcctcagtggttgggtgttcggcggagggaccaagctgaccgtcctgggtcagcccaaggctgccccctggtcactctgttcccgccctcctctatatactgtctgagcgggctggcaaggcgcatagnnnannnnnnnnnnnnnnnnnnnnn

SEQ ID NO: 80625 - DNA, 221 bp, Homo sapiens; identical to SEQ ID NO: 79959
  misc_feature: GYAE6OF02F0JKD.44.25.C03.1.454.CMB.1.raw
  modified_base (219)..(221): a, c, t, g, unknown or other
  misc_feature (219)..(221): n is a, c, g, or t

SEQ ID NO: 80626 - DNA, 274 bp, Homo sapiens
  misc_feature: GYAE6OF02JGLPR.44.25.C03.1.454.CMB.1.raw
  modified_base (137)..(137): a, c, t, g, unknown or other
  misc_feature (137)..(137): n is a, c, g, or t
  modified_base (228)..(228): a, c, t, g, unknown or other
  misc_feature (228)..(228): n is a, c, g, or t
  modified_base (233)..(237): a, c, t, g, unknown or other
  misc_feature (233)..(237): n is a, c, g, or t
  modified_base (239)..(274): a, c, t, g, unknown or other
  misc_feature (239)..(274): n is a, c, g, or t
tcagacagtatatacacgaccggtgctcgatttagtagtgtagatttgggtttgggtggcccaagctgctggagggcacggtcaccacggtcaccgtctcctcagcttccaccaggcccatcggtcttcccctggcnccctgctccaggagccacctctggggcacagcggccctgggctgcctggtcaaggctacttccaggtcactgctgagcggctggcaaggcnatagnnnnngnnnnnnnnnnnnnnnnnnnnnnnnnnnnnnnnnnnn

SEQ ID NO: 80627 - DNA, 558 bp, Homo sapiens
  misc_feature: GYAE6OF02JM1YO.44.25.C03.1.454.CMB.1.raw
  modified_base (261)..(262): a, c, t, g, unknown or other
  misc_feature (261)..(262): n is a, c, g, or t
  modified_base (531)..(535): a, c, t, g, unknown or other
  misc_feature (531)..(535): n is a, c, g, or t
tcagacagtatatacacgaccggtgctcgatttagtagtgtagatttgggtttggggggggtcacaagaggcagcgctctcgggacgtctccaccatggcctggctctgctgctcctcactctcctcaccaggacacaggtccgtcggccagtctcgcctcgactcacgcctcgcctccgtgtcgtcgggtcgcctggacagtcggtcacactctcctcgcactggacgccacgacggtaatattcttacgtcttaacttnntctctgtatacaacactactactacaacggtaacgaccctaacctactactacactactactagacggacgtaacgtaacgtacggaccgtacgtacgggtttacgttaacgtacgtacttctactacgtacctaccgtaacgtaccggaccgaaccgaccgaccgtacccgtacgtacgtaactactcgtacggtcgtaccgacgacgtacggacggacggacgtacgtacgtaacttaatttacgttagttacgtctacgtacgtannnnntcgttccgtcgtactactactac

SEQ ID NO: 80628 - DNA, 517 bp, Homo sapiens
  misc_feature: GYAE6OF02FRYNH.44.25.C03.1.454.CMB.1.raw
  modified_base (358)..(358): a, c, t, g, unknown or other
  misc_feature (358)..(358): n is a, c, g, or t
  modified_base (472)..(472): a, c, t, g, unknown or other
  misc_feature (472)..(472): n is a, c, g, or t
  modified_base (491)..(517): a, c, t, g, unknown or other
  misc_feature (491)..(517): n is a, c, g, or t
tcagacagtatatacacgaccggtgctcgatttagtagtgtagatttgggtttggggcggtgttacctggaaggtgttggttaccacgagggtcgacccatcgtacctcgcacctgggagcctagacttcccaacctatccgggaccagattctcgatggtcccaccgtgggtaccaactacctttccaggaacagcccccaaactcctcatctttggtaacactatcggccctcgagggtccctgacccgattctctggcctccgaagtctggcacctcagccctccctggccatcacctgggacctccgaggctcgacggacgaggctgacttatactggcagctcatagtaaaanagcaacactcgttatattcggcggaggaccaagctgaccgtcgtaggtcagcccaaggctgccccctggtcactctcgtcccgcctccctctatactactgtctgtagtccggnttcggcacggcgcatacgnnnnnnnnnnnnnnnnnnnnnnnnnnn

SEQ ID NO: 80629 - DNA, 538 bp, Homo sapiens
  misc_feature: GYAE6OF02HTSEQ.44.25.C03.1.454.CMB.1.raw
  modified_base (410)..(410): a, c, t, g, unknown or other
  misc_feature (410)..(410): n is a, c, g, or t
tcagacagtatatacacgaccggtgctcgatttagtagtgtagatttgggtttgggggactcctgtgccccaccatggacactctttgctacacactcctgctgctgaccaccccttcctgggtcttgtcccaggtcaccttgaaggagtctggtcctgtgctggtgaaacccacagagaccctcacgctgacctgcaccatctctgggttctctctcaacgatattagaatgggtgtgagctggatccgtcagccccagggaaggccctggagtggcttgcacacatcttctcgaatgacgaaaaatcctaacagtacatctctgaagagcagtttaaccatctccaagacacctccaaaaggcaggtggtctttagtatgaccaacatggaccctgcgacacaggcanatattactgtgcaacgggttaatggacggaaagaacagctggtttctgtattattaagtcttaaccatctggacgtcgtggggacaaagggaccacggtacaccgtctcctcagtccttccaacccgg

SEQ ID NO: 80630 - DNA, 525 bp, Homo sapiens
  misc_feature: GYAE6OF02H6MSY.44.25.C03.1.454.CMB.1.raw
tcagacagtatatacacgaccggtgctcgatttagtagtgtagatttgggtttgggggcacaagaggcagcactcaggacaatctccagcatggcctggtctcctctcctcctcactctcctcgctcactgcacagggtcctgggcccactctgtgctgacgcagccgccctcagtgtctggggccccgggcagagggtcaccatctcctgcactgggagcagatccaacatcgggacagattctgatgtccactggtaccaacaccttccaggaaccagcccccaaactcctcatctttggaacaactatcggccctcaggggtccctgaccgatctctggctccaagtctggcacctcagcctccctggcccatcactgggctccaggctgaagatgagggtgattattactagccagtcctatcgacagcagcctcagtggttgggtgttcgggcggagggaccaaggcgtgaccggtccgtgggttcgacggcccaaggccgtacgtcccccgtcgtcccg

SEQ ID NO: 80631 - DNA, 220 bp, Homo sapiens; identical to SEQ ID NO: 80074
  misc_feature: GYAE6OF02GIH3D.44.25.C03.1.454.CMB.1.raw
  modified_base (219)..(220): a, c, t, g, unknown or other
  misc_feature (219)..(220): n is a, c, g, or t

SEQ ID NO: 80632 - DNA, 241 bp, Homo sapiens
  misc_feature: GYAE6OF02HHUY5.44.25.C03.1.454.CMB.1.raw
  modified_base (239)..(241): a, c, t, g, unknown or other
  misc_feature (239)..(241): n is a, c, g, or t
tcagacagtatatacacgaccggtgctcgatttagtagtgtagatttgggtttgggttcccaagctgctggagggcacggtcaccacggtcaccgtctcctcagcttccaccaagggcccatcggtcttccccctggcgccctgctccaggagcacctctgggggcacagcggccctgggctgcctggtcaaggactacttccacgtctactgctgagcgggctggcaaggcgcatagnnn

SEQ ID NO: 80633 - DNA, 279 bp, Homo sapiens
  misc_feature: GYAE6OF02IVMW1.44.25.C03.1.454.CMB.1.raw
  modified_base (245)..(247): a, c, t, g, unknown or other
  misc_feature (245)..(247): n is a, c, g, or t
  modified_base (249)..(279): a, c, t, g, unknown or other
  misc_feature (249)..(279): n is a, c, g, or t
tcagacagtatatacacgaccggtgctcgatttagtagtgtagatttgggtttgggtgcccgaagctgctggagggcacggtcaccaccggtcaccgtctcctcagcttccaccaagggcccatcggtcttccccctggcgcccgtgctccaggagcaccctctgggggccacagcggccctgggctgcctggtcaaggactacttcctatatactgtctgagcgggctggcaaggcgtcatagnnnannnnnnnnnnnnnnnnnnnnnnnnnnnnnnn

SEQ ID NO: 80634 - DNA, 302 bp, Homo sapiens
  misc_feature: GYAE6OF02IVQUZ.44.25.C03.1.454.CMB.1.raw
  modified_base (273)..(273): a, c, t, g, unknown or other
  misc_feature (273)..(273): n is a, c, g, or t
  modified_base (297)..(302): a, c, t, g, unknown or other
  misc_feature (297)..(302): n is a, c, g, or t
tcagacagtatatacacgaccggtgctcgatttagtagtgtagatttgggtttgggggtgtggtggtcgtccactcccgccttgacgggctgctatctgcctcctggccatcactgggctccaggctgaagatgagggtgattattactgccagtcctatgacagcagcctcagtggttgggtgttcggcggagggaccaaggctgaccgtcctgggtcagcccaaggctgccccctggtcactctcgtcccgccctctctatactactgtcngagcgggctggcaaggcgcatagnnnnnn

SEQ ID NO: 80635 - DNA, 641 bp, Homo sapiens
  misc_feature: GYAE6OF02ICVQ4.44.25.C03.1.454.CMB.1.raw
  modified_base (348)..(348): a, c, t, g, unknown or other
  misc_feature (348)..(348): n is a, c, g, or t
tcagacagtatatacacgaccggtgctcgatttagtagtgtagatttgggtttggggggcacaagaggcagcactcaggacaatctccagcatggcctggtctcctctcctcctcactctcctcgctcactgcacagggtcctgggcccactctgtgctgacgcagccgccctcagtgtcgtgggggccccgggcaggagggtcaccatctcctgcactgggagcagatccaacagtcgggacagattctgatcgtccacgtggtaccaacaccttccaggaacacgaccccaaactcctacattcttagtaacactagtccgcctcgacgggtccctgaccgattcnccgtggcctccaagtctggcacctcacgtccctccgtcggcctatccgacgtcgggtcctccgacggtctagaaacgtagtagggtagggttgtaagtttaacttacgtcgtacccgtagttcccgtaagttcgaacgacggccgaacgtcccttacgtacgggttcgggtttcgggttcggtttccggggacgggtacgggaacccgtaaggccgttaccggaccggttcccggttacgggtcgaccggacccgtaacgggtcccgtaccggtccccccgtacggttacccg

SEQ ID NO: 80636 - DNA, 242 bp, Homo sapiens; identical to SEQ ID NO: 80017
  misc_feature: GYAE6OF02GNN1J.44.25.C03.1.454.CMB.1.raw
  modified_base (239)..(242): a, c, t, g, unknown or other
  misc_feature (239)..(242): n is a, c, g, or t

SEQ ID NO: 80637 - DNA, 289 bp, Homo sapiens
  misc_feature: GYAE6OF02FHPDH.44.25.C03.1.454.CMB.1.raw
  modified_base (171)..(171): a, c, t, g, unknown or other
  misc_feature (171)..(171): n is a, c, g, or t
  modified_base (285)..(285): a, c, t, g, unknown or other
  misc_feature (285)..(285): n is a, c, g, or t
tcagacagtatatacacgaccggtgctcgatttagtagtgtagatttgggtttgggggtgtggtggtctccactcccgccttgacgggctgctatctgcctccctggccatcactggctccaggctgaagatgagggtgattattactgccagtcctatgacagcagcctnagtggttggtgttcggcggaggaccagctgaccgtcctgggtcagcccaggctgccccctggtcactctgttccccgccctctctatatactgtctgagcggtctggcaaggcncatg

SEQ ID NO: 80638 - DNA, 251 bp, Homo sapiens; identical to SEQ ID NO: 80192
  misc_feature: GYAE6OF02GOM2T.44.25.C03.1.454.CMB.1.raw
  modified_base (239)..(251): a, c, t, g, unknown or other
  misc_feature (239)..(251): n is a, c, g, or t

SEQ ID NO: 80639 - DNA, 242 bp, Homo sapiens; identical to SEQ ID NO: 80085
  misc_feature: GYAE6OF02HAH15.44.25.C03.1.454.CMB.1.raw
  modified_base (239)..(242): a, c, t, g, unknown or other
  misc_feature (239)..(242): n is a, c, g, or t

SEQ ID NO: 80640 - DNA, 239 bp, Homo sapiens
  misc_feature: GYAE6OF02FN9T6.44.25.C03.1.454.CMB.1.raw
  modified_base (238)..(239): a, c, t, g, unknown or other
  misc_feature (238)..(239): n is a, c, g, or t
tcagacagtatatacacgaccggtgctcgatttagtagtgtagatttgggtttgggtgcccaagctgctggagggcacggtcaccacggtcaccgtctcctcagcctccaccaagggcccatcggtcttcccctggcaccctcctccaagagcacctctgggggcacagcggccctgggctgcctggtcaaggactacttcctatatactgtctgagcgggctggcaaggcgcatagnn

SEQ ID NO: 80641 - DNA, 301 bp, Homo sapiens
  misc_feature: GYAE6OF02HN50A.44.25.C03.1.454.CMB.1.raw
  modified_base (297)..(301): a, c, t, g, unknown or other
  misc_feature (297)..(301): n is a, c, g, or t
tcagacagtatatacacgaccggtgctcgatttagtagtgtagatttgggtttgggggtgtggtggtctccactcccgccttgacggggctgctatctgcctccctggccatcactgggctccaggctgaagatgagggtgattattactgccagtcctatgacagcagcctcagtggttgggtgttcggcggagggaccaagctgaccgtcctgggtcagcccaaggctgccccctcggtcactctgttcccgcctcctctatatactgtctgagcgggctggcaaggcgcatagnnnnn

SEQ ID NO: 80642 - DNA, 535 bp, Homo sapiens
  misc_feature: GYAE6OF02GRW31.44.25.C03.1.454.CMB.1.raw
  modified_base (388)..(388): a, c, t, g, unknown or other
  misc_feature (388)..(388): n is a, c, g, or t
tcagacagtatatacacgaccggtgctcgatttagtagtgtagatttgggtttgggggactcctgtgccccaccatggacactctttgctacacactcctgctgctgaccaccccttcctgggtcttgtcccaggtcaccttgaaggagtctggtcctgtgctggtgaaacccacagagaccctcacgctgacctgcaccatctctgggttctctctcaacgatattagaatgggtgtgagctggatccgtcacgccccagggaaggccctggagtggcttgcacacatcttctcgaatgacgaaaaatcctacagtacatctctgaagagcagtttaaccatctccaaggacacctacaaaaggcaggtgtctttagtatgaccaanatggaccctgcgacacaggcacatatactgtgcgaacgggtaatggacgggaaagaacgagcttggtttctgtaattataagtcttaacatcgtgacgtcgtgggacaaagggccacggtcaccgtctcctcagtccttccaaccgg

SEQ ID NO: 80643 - DNA, 552 bp, Homo sapiens
  misc_feature: GYAE6OF02JASO8.44.25.C03.1.454.CMB.1.raw
  modified_base (273)..(273): a, c, t, g, unknown or other
  misc_feature (273)..(273): n is a, c, g, or t
  modified_base (422)..(422): a, c, t, g, unknown or other
  misc_feature (422)..(422): n is a, c, g, or t
  modified_base (458)..(458): a, c, t, g, unknown or other
  misc_feature (458)..(458): n is a, c, g, or t
tcagacagtatatacacgaccggtgctcgatttagtagtgtagatttgggtttggggggaagaggaagactgacggtcctcccaggagttcaggtgctgggcaccttgggcacgggggaggtgtgtcacaagatttgggctctggggcaccgtgggcatgggggaggtgtgtcacaagatttggactcctgtgccccaccatggacactctttgctacacactcctgctgctgaccaccccttctgggtcttgtccccaggtcaccttgaagngtctggtcctgtgctggtgaaaccccacagagacccctcacgctgacctgcaccatctctgggttctctctcaacgatattagaatgggtgtgagctggatccgtcagcccccagggaacggccctggagtggcttgcacacatcttcncgaatgaacgaaaatcctacagtacatctctgaagngactagtttaaccattctaccaagaccacctaccaaaaggctaacggtggtctttaagtatacgacctaacacgtacggaccctgacggtaacg

SEQ ID NO: 80644 - DNA, 242 bp, Homo sapiens; identical to SEQ ID NO: 79932
  misc_feature: GYAE6OF02HRTW4.44.25.C03.1.454.CMB.1.raw
  modified_base (238)..(242): a, c, t, g, unknown or other
  misc_feature (238)..(242): n is a, c, g, or t

SEQ ID NO: 80645 - DNA, 591 bp, Homo sapiens
  misc_feature: GYAE6OF02HIJYJ.44.25.C03.1.454.CMB.1.raw
  modified_base (435)..(435): a, c, t, g, unknown or other
  misc_feature (435)..(435): n is a, c, g, or t
tcagacagtatatacacgaccggtgctcgatttagtagtgtagatttgggtttgggggactcctgtgccccaccatggacactctttgctacacactcctgctgctgaccaccccttcctgggtcttgtcccaggtcaccttgaaggagtctggtcctgtgctggtgaaacccacagagaccctcacgctgacctgcaccatctctgggttctctctcaacgatattagaatgggtgtgagctggatccgtcacgccccagggaaggccctggagtggcttgcacacatcttctcgaatgacgaaaaatcctacagtacatctctgaagagcagttaaccatctccaaggacacctaccaaaggcaggtgtcttagtatgaccaacagtcggccctggcgacacgaggcacatacttactgtgacgacgggtaanggaacgggaaagaaacagacttcggttactagttaattactaagttacttaaccgtattccgtaggtacgttacggtggggaaccgaaagggtacccgaacgggtacctacccggttacctcccgttaccgacgtacccgttacccgaaacccggg

SEQ ID NO: 80646 - DNA, 130 bp, Homo sapiens; identical to SEQ ID NO: 79944
  misc_feature: GYAE6OF02I2STP.44.25.C03.1.454.CMB.1.raw
  modified_base (130)..(130): a, c, t, g, unknown or other
  misc_feature (130)..(130): n is a, c, g, or t

SEQ ID NO: 80647 - DNA, 220 bp, Homo sapiens
  misc_feature: GYAE6OF02F1CHB.44.25.C03.1.454.CMB.1.raw
  modified_base (219)..(220): a, c, t, g, unknown or other
  misc_feature (219)..(220): n is a, c, g, or t
tcagacagtatatacacgaccggtgctcgatttagtagtgtagatttgggtttgggggaagaggaagactgacggtcctcccaggagttcaggtgctgggcaccttgggcatgggggaggtgtgtcacaagatttgggctctgggcacagcggccctgggctgcctggtcaaggactacttcctcgatcgcgtctgagcgggctggcaaggcgcatagnn

SEQ ID NO: 80648 - DNA, 712 bp, Homo sapiens
  misc_feature: GYAE6OF02J13A3.44.25.C03.1.454.CMB.1.raw
  modified_base (232)..(232): a, c, t, g, unknown or other
  misc_feature (232)..(232): n is a, c, g, or t
  modified_base (367)..(367): a, c, t, g, unknown or other
  misc_feature (367)..(367): n is a, c, g, or t
tcagacagtatatacacgaccggtgctcgatttagtagtgtagatttgggtttgggggggtcgacaagaggcagcactcaggacaatctccagcatggcctggtctcctctcctcctcactctcctcgctcactgcacagggtcctgggcccactctgtgctgacgcagccgccctcagtcgtctggggccccgggacaggagggtccaccatcctcctgccactggggacncagactccaaacagtcggggaacaggattctgatgtccactggtaccacaccttccaggaacacgaccccaaactcctcatcctttaggtaaccaactagtccggccctcgtacgggtcccctgaccgtattccnctggcctcaagtctgcacctcacgcctcccgtgcctacgtccacgtcgggacctccgaggtccgtagaaacggtctacgggagggttacgaacttttaacgttacctcggaccctacgttacctacgttacggacctaacggccctacgggtacccttacggtaacgggtttcggggtttggggttaccggtttaccggggaccggggtaaccgggtaacccggtaaacgggtcccggttaaccgggttaccccggttacccgggtttgggggaacccctacgggtaaccccccgggtaagggtcccccgttacccgggttacccccccggttggggttaccccc

SEQ ID NO: 80649 - DNA, 647 bp, Homo sapiens
  misc_feature: GYAE6OF02F9RFJ.44.25.C03.1.454.CMB.1.raw
tcagacagtatatacacgaccggtgctcgatttagtagtgtagatttgggtttgggggcttcagctgtgggcacaagaggcagcactacaggacaatctccagcatggcctggtctcctctcctcctcactctcctcgctcactgcacagggtcctgggcccactctgtgctgacgcagccgccctcagtgtctgggggccccgggcagagggtcaccatctcctgcacgtgggagcagactccaacagtcgggacagattctgatcgtccactcggtaccaacaccttccgaggaaccacgacccccaaactcctacacttcttacggtaacaactagtccggccctcgacgggtccctagaccgtacttctctcggctcctaagtctcggcctacctcgacgccccttcccgtcggccctactcacgtcgggcctccgaggctaggaacgtagtcggtagggtgtaatttacgttaacgtcgtaccgtacgttaccttagtcggaacacggcctaacggtcccttacggtagggtttcggggtttcggggttcggttaccggggacggggtaaccgggtaaccgtaacgggtccgttaccgggtacccggttcccggtacggggttacccacgggtaacccccgg

SEQ ID NO: 80650 - DNA, 482 bp, Homo sapiens
  misc_feature: GYAE6OF02ITTOQ.44.25.C03.1.454.CMB.1.raw
  modified_base (432)..(432): a, c, t, g, unknown or other
  misc_feature (432)..(432): n is a, c, g, or t
  modified_base (444)..(444): a, c, t, g, unknown or other
  misc_feature (444)..(444): n is a, c, g, or t
  modified_base (461)..(482): a, c, t, g, unknown or other
  misc_feature (461)..(482): n is a, c, g, or t
tcagacagtatatacacgaccggtgctcgatttagtagtgtagatttgggtttgggggctgttcctggaaggtgttggtaccagagggtcaccatctcctgcactgggagcagatccaacatcgggacagattctgatgtccactggtaccaacaccttccaggaacagccccccaaactcctcatctttggtaacaactatcggccctcaggggtccctgaccgattctctggctccaagtctggcacctcagccctccctggccatcactgggctccaggctgaagatgagggtgattattactgccagtcctatgacagcagcctcagtggttgggtgttcgggcggtaggaccaagctcggaccgtccgtggtcacgccaaggctcgcccctggtcacctctcgttccccgcctcctctatatacgtntctgagcggtcngcgacgcggcagtacgnnnnnnnnnnnnnnnnnnnnnn

SEQ ID NO: 80651 - DNA, 222 bp, Homo sapiens
  misc_feature: GYAE6OF02FN2BD.44.25.C03.1.454.CMB.1.raw
  modified_base (219)..(222): a, c, t, g, unknown or other
  misc_feature (219)..(222): n is a, c, g, or t
tcagacagtatatacacgaccggtgctcgatttagtagtgtagatttgggtttgggggaagaggaagactgacggtcctcccaggagttcaggtgctgggcaccttgggcacgggggaggtgtgtcacaagatttgggctctgggcacagcggccctgggctgcctggtcaaggactacttcctcgatcgcgtctgagcgggctggcaaggcgcatagnnnn

SEQ ID NO: 80652 - DNA, 222 bp, Homo sapiens
  misc_feature: GYAE6OF02IQ6GJ.44.25.C03.1.454.CMB.1.raw
  modified_base (217)..(222): a, c, t, g, unknown or other
  misc_feature (217)..(222): n is a, c, g, or t
tcagacagtatatacacgaccggtgctcgatttagtagtgtagatttgggtttgggggaagaggaagactgacggtcctcccaggagttcaggtgctgggcaccttgggcatgggggaggtgtgtcacaagatttgggctctgggcacagcgccctgggctgcctggtcaaggctacttcctatatactgtctgagcgggctggcaaggcgcatagnnnnnn

SEQ ID NO: 80653 - DNA, 132 bp, Homo sapiens; identical to SEQ ID NO: 80378
  misc_feature: GYAE6OF02I7S2X.44.25.C03.1.454.CMB.1.raw
  modified_base (130)..(132): a, c, t, g, unknown or other
  misc_feature (130)..(132): n is a, c, g, or t

SEQ ID NO: 80654 - DNA, 243 bp, Homo sapiens; identical to SEQ ID NO: 80006
  misc_feature: GYAE6OF02G4LQP.44.25.C03.1.454.CMB.1.raw
  modified_base (239)..(243): a, c, t, g, unknown or other
  misc_feature (239)..(243): n is a, c, g, or t

SEQ ID NO: 80655 - DNA, 304 bp, Homo sapiens; identical to SEQ ID NO: 80504
  misc_feature: GYAE6OF02HITH1.44.25.C03.1.454.CMB.1.raw
  modified_base (298)..(304): a, c, t, g, unknown or other
  misc_feature (298)..(304): n is a, c, g, or t

SEQ ID NO: 80656 - DNA, 161 bp, Homo sapiens
  misc_feature: GYAE6OF02H0HHB.44.25.C03.1.454.CMB.1.raw
  modified_base (159)..(161): a, c, t, g, unknown or other
  misc_feature (159)..(161): n is a, c, g, or t
tcagacagtatatacacgaccggtgctcgatttagtagtgtagatttgggtttggggaggtgtgtcacaagatttgggctctgggcacagcggccctgggctgcctggtcaaggactacttcctatatactgtctgagcgggctggcaaggcgcatagnnn

SEQ ID NO: 80657 - DNA, 241 bp, Homo sapiens; identical to SEQ ID NO: 80475
  misc_feature: GYAE6OF02I5GYD.44.25.C03.1.454.CMB.1.raw
  modified_base (237)..(241): a, c, t, g, unknown or other
  misc_feature (237)..(241): n is a, c, g, or t

SEQ ID NO: 80658 - DNA, 548 bp, Homo sapiens
  misc_feature: GYAE6OF02F3L67.44.25.C03.1.454.CMB.1.raw
tcagacagtatatacacgaccggtgctcgatttagtagtgtagatttgggtttgggggactcctgtgccccaccatggacactctttgctacacactcctgctgctgaccaccccttcctgggtcttgtcccaggtcaccttgaaggagtctggtcctgtgctggtgaaacccacagagaccctcacgctgacctgcaccatctctgggttctctctcaacgatattagaatgggtgtgagctggatccgtcagccccagggaaggccctggagtggcttgcacacatcttctcgaatgacgaaaaatcctacagtacatctctgaagagctagtttaaccatcctaccaaggacacctaccaaaaggcaggtgtctttagtatgaccaacatgacctgcggacacaggcacatatactgtgcgacgggtaatggaggaaagaacagacgtgtttcagttattagtaatcttaacattcgtgtacgtcgtggggacaaacggggacctacggtaccaccgttctacctcacgtcttacccgaacccgg

SEQ ID NO: 80659 - DNA, 262 bp, Homo sapiens
  misc_feature: GYAE6OF02GF85J.44.25.C03.1.454.CMB.1.raw
  modified_base (239)..(262): a, c, t, g, unknown or other
  misc_feature (239)..(262): n is a, c, g, or t
tcagacagtatatacacgaccggtgctcgatttagtagtgtagatttgggtttgggtgcccaagctgctggagggcacggtcaccacggtcaccgtctcctcagcttccaccaagggcccatcggtcttccccctggcgccctgctccaggagcacctctgggggcacagcggccctgggctgcctggtcaaggactacttcctatatactgtctgagcgggctggcaaggcgcatagnnnnnnnnnnnnnnnnnnnnnnnn

SEQ ID NO: 80660 - DNA, 273 bp, Homo sapiens
  misc_feature: GYAE6OF02IS2U2.44.25.C03.1.454.CMB.1.raw
  modified_base (264)..(273): a, c, t, g, unknown or other
  misc_feature (264)..(273): n is a, c, g, or t
tcagacagtatatacacgaccggtgctcgatttagtagtgtagatttgggtttgggggaagaggaagactgacggtcctcccaggagttcaggtgctgggcaccttgggcacgggggaggtgtgtcacaagatttgggctctgggcaccgtgggcatgggggaggtgtgtcacaagatttgggctctgggcacagcggccctgggctgcctggtcaaggactacttcctcgatcgcgtctgagcgggctggcaaggcgcatagnnnnnnnnnn

SEQ ID NO: 80661 - DNA, 261 bp, Homo sapiens
  misc_feature: GYAE6OF02IXNDT.44.25.C03.1.454.CMB.1.raw
  modified_base (240)..(261): a, c, t, g, unknown or other
  misc_feature (240)..(261): n is a, c, g, or t
tcagacagtatatacacgaccggtgctcgatttagtagtgtagatttgggtttgggttggcccaagctgctggagggcacggtcaccacggtcaccgtctcctcacgcttccaccaagggcccatcggtcttcccctggcgccctgctccaggagcacctctgggggcacagcggccctgggctgcctggtcaaggctacttcctatatactgtctgagcgggctggcaaggcgcatagnnnnnnnnnnnnnnnnnnnnnn

SEQ ID NO: 80662 - DNA, 304 bp, Homo sapiens
  misc_feature: GYAE6OF02HP9AV.44.25.C03.1.454.CMB.1.raw
  modified_base (295)..(304): a, c, t, g, unknown or other
  misc_feature (295)..(304): n is a, c, g, or t
tcagacagtatatacacgaccggtgctcgatttagtagtgtagatttgggtttgggggtgtggtggtctccactcccgccttgacggggctgctatctgcctccctggccatcactgggctccaggctgaggacgaggctgactatttctgctcctcatatgcaggcgacaggttttatgtcttcggaactgggaccaaggtcaccgtcctacgtcagcccaaggccaaccccactgtcactctgttccccgcctcctctatatactgtctgagcgggctggcaaggcgcatagnnnnnnnnnn

SEQ ID NO: 80663 - DNA, 243 bp, Homo sapiens; identical to SEQ ID NO: 80118
  misc_feature: GYAE6OF02H9DP2.44.25.C03.1.454.CMB.1.raw
  modified_base (238)..(243): a, c, t, g, unknown or other
  misc_feature (238)..(243): n is a, c, g, or t

SEQ ID NO: 80664 - DNA, 219 bp, Homo sapiens
  misc_feature: GYAE6OF02GN6ID.44.25.C03.1.454.CMB.1.raw
  modified_base (219)..(219): a, c, t, g, unknown or other
  misc_feature (219)..(219): n is a, c, g, or t
tcagacagtatatacacgaccggtgctcgatttagtagtgtagatttgggtttgggggaagaggaagactgacggtcctcccaggagttcaggtgctgggcaccttgggcatgggggaggtgtgtcacaagatttgggctctgggcacagcggccctgggctgcctggtcaaggactacttccacgtctactgctgagcgggctggcaaggcgcatagn

SEQ ID NO: 80665 - DNA, 480 bp, Homo sapiens
  misc_feature: GYAE6OF02HOIGP.44.25.C03.1.454.CMB.1.raw
  modified_base (440)..(440): a, c, t, g, unknown or other
  misc_feature (440)..(440): n is a, c, g, or t
  modified_base (448)..(448): a, c, t, g, unknown or other
  misc_feature (448)..(448): n is a, c, g, or t
  modified_base (466)..(466): a, c, t, g, unknown or other
  misc_feature (466)..(466): n is a, c, g, or t
  modified_base (470)..(480): a, c, t, g, unknown or other
  misc_feature (470)..(480): n is a, c, g, or t
tcagacagtatatacacgaccggtgctcgatttagtagtgtagatttgggtttgggctggatccgtcagcccccagggaaggccctggagtggcttgcacacatcttctcgaatgacgaaaaatcctacagtacatctctgaagagcagtttaaccatctccaaggacacctccaaaaggcaggtggtctttagatgaccaacatggaccctgcggacacaggcacatattactgtgcacggggtaatggcgggaaagaacagctggtttctgtattgtaagtcttaccatctggacgtctggggcaaagggaccacggtcaccgtctcctcagcttccaccaagggcccatcggtcttcccctggccgccctgctccaggagcacctcgtggggcacgagcggccctgggctcgcctggtcaaggactacgttcctatntactgtcngagcgggctggcaggcgnatgnnnnnnnnnnn

SEQ ID NO: 80666 - DNA, 666 bp, Homo sapiens
  misc_feature: GYAE6OF02INZ5P.44.25.C03.1.454.CMB.1.raw
tcagacagtatatacacgaccggtgctcgatttagtagtgtagatttgggtttgggggcttcagatgtgggcacaagaggcagcactcaggacaatctccagcatggcctggtctcctctcctcctcactctcctcgctcactgcacagggtcctgggcccactctgtgctgacgcagccgccctcagtgtctggggccccggggcagagggtcaccatcctcctgcacgtgggagcagatccaacagtcgggacagattctgatgtccacgtcggtaaccaacaccttccgaaggaacaccggcccccaaaactccctacacttcttttacggtaaacaacttactcccgggtaccctcgacggggtcccctaggtacccgtactttcctcgtcgggtaccttaccgtaagtccgttacgggcctaacccgtcgaaccgtcccttcccgtcggcccacttcccacgttcggggccttcccgagggtccttaggaaacgtagtcgggtaagggttctaacgtttaatacgtcgtacccgtagttaccctagtacgacgtaagccaacgtcctcgtagggttcgggtttcgggtggtttccggggacggaacggggtaccaaggtcgttccggtaacccggttcgtccggggtacctacggacccgg

SEQ ID NO: 80667 - DNA, 464 bp, Homo sapiens
  misc_feature: GYAE6OF02HRE76.44.25.C03.1.454.CMB.1.raw
  modified_base (439)..(439): a, c, t, g, unknown or other
  misc_feature (439)..(439): n is a, c, g, or t
  modified_base (449)..(449): a, c, t, g, unknown or other
  misc_feature (449)..(449): n is a, c, g, or t
  modified_base (455)..(464): a, c, t, g, unknown or other
  misc_feature (455)..(464): n is a, c, g, or t
tcagacagtatatacacgaccggtgctcgatttagtagtgtagatttgggtttgggggctgttcctggaaggtgttggtaccggagggtcaccatctcctgcactgggagcagatccaacatcgggacagattctgatgtccactggtaccaacaccttccaggaacagcccccaaactcctcatctttggtaacaactatcggccctcaggggtccctgaccgattctctggctccaagtctggcacctcagcctccctggccatcactgggctccaggctgaagatgagggtgattattactgccagtcctatgacagcagcctcagtggttgggtgttcgggcggaggaccaagctgaccgtctgggtcacgcccaaggcctcgccccctggtcactctcgttccccaccctcctctatatactgtctgagcgggntggcaaggcncatagnnnnnnnnnn

SEQ ID NO: 80668 - DNA, 464 bp, Homo sapiens
  misc_feature: GYAE6OF02G9IZQ.44.25.C03.1.454.CMB.1.raw
  modified_base (451)..(464): a, c, t, g, unknown or other
  misc_feature (451)..(464): n is a, c, g, or t
tcagacagtatatacacgaccggtgctcgatttagtagtgtagatttgggtttgggggctgttcctggaaggtgttggtaccagagggtcaccatctcctgcactgggagcagatccaacatcgggacagattctgatgtccactggtaccaacaccttccaggaacagcccccaaactcctcatctttggtaacaactatcggccctcaggggtccctgaccgattctctggctccaagtctggcacctcagcctccctggccatcactgggctccaggctgaagatgagggtgattattactgccagtcctatgacagcagcctcagtggttgggtgttcggcggaggaccaagctgaccgtctgggtcagcccaaggctcgcccctggtccactctcgttcccgccctcctctatatactgtctgagcgggctggcaaggcgcatagnnnnnnnnnnnnnn

SEQ ID NO: 80669 - DNA, 229 bp, Homo sapiens
  misc_feature: GYAE6OF02F31P8.44.25.C03.1.454.CMB.1.raw
  modified_base (220)..(229): a, c, t, g, unknown or other
  misc_feature (220)..(229): n is a, c, g, or t
tcagacagtatatacacgaccggtgctcgatttagtagtgtagatttgggtttggggggaagaggaagactgacggtcctcccaggagttcaggtgctgggcaccttgggcacgggggaggtgtgtcacaagatttgggctctgggcacagcggccctgggctgcctggtcaaggactacttcctcgatcgcgtctgagcgggctggcaaggcgcatagnnnnnnnnnn

SEQ ID NO: 80670 - DNA, 315 bp, Homo sapiens
  misc_feature: GYAE6OF02IR3CO.44.25.C03.1.454.CMB.1.raw
  modified_base (302)..(302): a, c, t, g, unknown or other
  misc_feature (302)..(302): n is a, c, g, or t
  modified_base (308)..(315): a, c, t, g, unknown or other
  misc_feature (308)..(315): n is a, c, g, or t
tcagacagtatatacacgaccggtgctcgatttagtagtgtagatttgggtttggggggcacaagaggcagcactcaggacaatctccagcatggcctggtctcctctcctcctcactctcctctctcactgcacagggtcctgggcccactctgtgctgacgcagccgccctcagtgtctggggccccgggcaggagggtcaccatctcctgcactggagccagcggtcagcccaaggccaaccccatgtcactctgttccccaccctctctatactactgtctgagcggctggcaaggcncatagnnnnnnnn

SEQ ID NO: 80671 - DNA, 599 bp, Homo sapiens
  misc_feature: GYAE6OF02IXYAG.44.25.C03.1.454.CMB.1.raw
  modified_base (314)..(314): a, c, t, g, unknown or other
  misc_feature (314)..(314): n is a, c, g, or t
tcagacagtatatacacgaccggtgctcgatttagtagtgtagatttgggtttgggggctgttcctggaaggtgttggtaccagtggacatcagaatctgtcccgatgttggatctgctcccagtgcaggagatggtgaccctctgccccggggccccagacactgagggcggctgcgtcagcacagagtgggcccaggaccctgtgcagtgagcgaggagagtgaggaggagaggagaccaggccatgctggagattgtctgagtgctgcctcttgtcgcccacagctgaagcagacgcctaccaaactcctnattctttaggaacaactactcgccctacgacggggtcctgaccgtattctctggcctccgaagttcgtcggcacccgtcacgcccttccctggaccactcaccgtcgggccttccgacggtctaggaaacgtacgtagggtagggttataacgtttacgttacgtcggaccgtaacgttccctagtacgacgtacgcgacgtccctggtaacggtttgggttacgggttcggttacgggaccgggtacgggaacccgtaaggccgttacgggacccgttaccggg

SEQ ID NO: 80672 - DNA, 254 bp, Homo sapiens
  misc_feature: GYAE6OF02G1KZ1.44.25.C03.1.454.CMB.1.raw
  modified_base (238)..(254): a, c, t, g, unknown or other
  misc_feature (238)..(254): n is a, c, g, or t
tcagacagtatatacacgaccggtgctcgatttagtagtgtagatttgggtttgggtgcccaagctgctggagggcacggtcaccacggtcaccgtctcctcagcttccaccaagggcccatcggtcttccccctggcgccctgctccaggagcacctctgggggcacagcggccctgggctgcctggtcaaggctacttccacgtctactgctgagcgggctggcaaggcgcatagnnnnnnnnnnnnnnnnn

SEQ ID NO: 80673 - DNA, 129 bp, Homo sapiens; identical to SEQ ID NO: 79980
  misc_feature: GYAE6OF02GTIJW.44.25.C03.1.454.CMB.1.raw

SEQ ID NO: 80674 - DNA, 566 bp, Homo sapiens
  misc_feature: GYAE6OF02I9IMH.44.25.C03.1.454.CMB.1.raw
  modified_base (438)..(438): a, c, t, g, unknown or other
  misc_feature (438)..(438): n is a, c, g, or t
tcagacagtatatacacgaccggtgctcgatttagtagtgtagatttgggtttgggggactcctgtgccccaccatggacactctttgctacacactcctgctgctgaccaccccttcctgggtcttgtcccaggtcaccttgaggagtctggtcctgtgctggtgaaacccacagagaccctcacgctgacctgcaccatctctgggttctctctcaacgatattagaatgggtgtgagctggatccgtcacgcccccagggaaggccctggagtggcttgcacacatcttctcgaatgacgaaaatcctacagtacatctctgaagagcagtttaaccatctccaaggacacctaccaaagcaggtgtctttagtatcgaccaacatcggaccctgacggacacgacggcacatattactgtgacgacgggttaancggagggaaacgaaacgacgcgttaggtttcgtagttaagttataagtccttacaatcgttggacgttcggtggggaacaacgggacctacgggtacctaccggtctccctcgacgtctccaacccgg

SEQ ID NO: 80675 - DNA, 231 bp, Homo sapiens
  misc_feature: GYAE6OF02HDBGL.44.25.C03.1.454.CMB.1.raw
  modified_base (229)..(231): a, c, t, g, unknown or other
  misc_feature (229)..(231): n is a, c, g, or t
tcagacagtatatacacgaccggtgctcgatttagtagtgtagatttgggtttgggtgcccaagctgctggagggcacggtcaccgtctcctcagcttccaccaagggcccatcggtcttcccctggcgccctgctccaggagcacctctgggggcacagcggccctgggctgcctggtcaaggactacttcctatatactgtctgagcgggctggcaaggcgcatagnnn

SEQ ID NO: 80676 - DNA, 244 bp, Homo sapiens; identical to SEQ ID NO: 80207
  misc_feature: GYAE6OF02H4YHU.44.25.C03.1.454.CMB.1.raw
  modified_base (239)..(244): a, c, t, g, unknown or other
  misc_feature (239)..(244): n is a, c, g, or t

SEQ ID NO: 80677 - DNA, 216 bp, Homo sapiens
  misc_feature: GYAE6OF02FUHEM.44.25.C03.1.454.CMB.1.raw
  modified_base (215)..(216): a, c, t, g, unknown or other
  misc_feature (215)..(216): n is a, c, g, or t
tcagacagtatatacacgaccggtgctcgatttagtagtgtagatttgggtttgggggacaatggtcaccgtctcttcagcttccaccaagggcccatcggtcttccccctggcgccctgctccaggagcacctctgggggcacagcggccctgggctgcctggtcaaggactacttcctatatactgtctgagcgggctggcaaggcgcatagnn

SEQ ID NO: 80678 - DNA, 243 bp, Homo sapiens; identical to SEQ ID NO: 80214
  misc_feature: GYAE6OF02H0TIJ.44.25.C03.1.454.CMB.1.raw
  modified_base (238)..(243): a, c, t, g, unknown or other
  misc_feature (238)..(243): n is a, c, g, or t

SEQ ID NO: 80679 - DNA, 566 bp, Homo sapiens
  misc_feature: GYAE6OF02HPI7J.44.25.C03.1.454.CMB.1.raw
  modified_base (265)..(265): a, c, t, g, unknown or other
  misc_feature (265)..(265): n is a, c, g, or t
  modified_base (536)..(536): a, c, t, g, unknown or other
  misc_feature (536)..(536): n is a, c, g, or t
  modified_base (540)..(544): a, c, t, g, unknown or other
  misc_feature (540)..(544): n is a, c, g, or t
  modified_base (546)..(546): a, c, t, g, unknown or other
  misc_feature (546)..(546): n is a, c, g, or t
  modified_base (548)..(550): a, c, t, g, unknown or other
  misc_feature (548)..(550): n is a, c, g, or t
  modified_base (552)..(552): a, c, t, g, unknown or other
  misc_feature (552)..(552): n is a, c, g, or t
  modified_base (554)..(555): a, c, t, g, unknown or other
  misc_feature (554)..(555): n is a, c, g, or t
  modified_base (557)..(557): a, c, t, g, unknown or other
  misc_feature (557)..(557): n is a, c, g, or t
  modified_base (559)..(559): a, c, t, g, unknown or other
  misc_feature (559)..(559): n is a, c, g, or t
  modified_base (561)..(566): a, c, t, g, unknown or other
  misc_feature (561)..(566): n is a, c, g, or t
tcagacagtatatacacgaccggtgctcgatttagtagtgtagatttgggtttgggcgtggatccgtcagcccccagggaaggccctggagtggcttgcacacatcttctcgaatgacgaaaaatcctacagtacatctctgaagagcagtttaaccatctccaaggacacctcaaaaggtcaggtggtctttagtatgaccaacatggaccctgcggacacgaggcacatactactgtgcacggtaatggaccggaaaagaacngtacgttgtttcgtgtaatttataagttctaccattcgtggacgtgtgggacgaaaggccaggtccacgtctcctcagcttccgacgaacggccaagtcggtccttcccgaggcctcccgtagcctccgaaggacgtacccgtaccgttcggtcggggacctaacgcggtcccgggccccgtgggtcctcggccgttaggacgaacggtacctacgttccaacgttctacgtgcgtagacgcgactggacaggtaccacgacgtagctagntagnnnnngngnnngngnngngngnnnnnn

SEQ ID NO: 80680 - DNA, 483 bp, Homo sapiens
  misc_feature: GYAE6OF02JC8A0.44.25.C03.1.454.CMB.1.raw
  modified_base (294)..(294): a, c, t, g, unknown or other
  misc_feature (294)..(294): n is a, c, g, or t
  modified_base (462)..(483): a, c, t, g, unknown or other
  misc_feature (462)..(483): n is a, c, g, or t
tcagacagtatatacacgaccggtgctcgatttagtagtgtagatttgggtttgggggctgttcctggaaggtgttggtaccagagggtcaccatctcctgcactgggagcagatccaacatcgggacagattctgatgtccactggtaccaacaccttccaggaacagcccccaaactcctcatctttggtaacaactatcggccctcaggggtccctgaccgattctctggctccaagtctggcacctcagcctccctggccatcactgggctccaggctgaagatgaggtnattattactgccagtcctatgacagcagcctcagtgggtttggcgttcggcggaggaccaagctcgaccgtcgtggtcagcccaaggctcgcccctggtcactcgtcgttcccgccctctctatactactcgtctgagccggtctcgggactacgggcgtcagtacgnnnnnnnnnnnnnnnnnnnnnn

SEQ ID NO: 80681 - DNA, 550 bp, Homo sapiens
  misc_feature: GYAE6OF02GDI47.44.25.C03.1.454.CMB.1.raw
tcagacagtatatacacgaccggtgctcgatttagtagtgtagatttgggtttgggggactcctgtgccccaccatggacactctttgctacacactcctgctgctgaccaccccttcctgggtcttgtcccaggtcaccttgaaggagtctggtcctgtgctggtgaaacccacagagaccctcacgctgacctgcaccatctctgggttctctctcaacgatattagaatgggtgtgagctggatccgtcagcccccagggaaggccctggagtggcttgcacacatcttctcgaatgaacgaaaaatcctacagtacatctctgaagagcagtttaaccatctaccaaggacacctacaaaaggcaggtgtctttagtatgaccaacatggaccctgcgacacaggcacatatactgtgcgacgggtaatggacgggaaagaacgagacttggtttactgttaatttagtaagttcttaaccatcgtggacgttcgtagggacaaagggccacggtccaccgtcctccgtcacgtccttccaaccgg

SEQ ID NO: 80682 - DNA, 244 bp, Homo sapiens
  misc_feature: GYAE6OF02HOXZC.44.25.C03.1.454.CMB.1.raw
  modified_base (239)..(244): a, c, t, g, unknown or other
  misc_feature (239)..(244): n is a, c, g, or t
tcagacagtatatacacgaccggtgctcgatttagtagtgtagatttgggtttgggtgcccaagctgctggagggcacggtcaccacggtcaccgtctcctcagcttccaccaagggcccatcggtcttcccctggcgccctgctccaggagcacctctgggggcacagcggccctgggctgcctggtcaaggactacttcctatatactggtctgagcgggctggcaaggcgcatagnnnnnn

SEQ ID NO: 80683 - DNA, 305 bp, Homo sapiens
  misc_feature: GYAE6OF02H1YPX.44.25.C03.1.454.CMB.1.raw
  modified_base (297)..(305): a, c, t, g, unknown or other
  misc_feature (297)..(305): n is a, c, g, or t
tcagacagtatatacacgaccggtgctcgatttagtagtgtagatttgggtttgggggtgtggtggtctccactcccgccttgacggggctgctatctgcctccctggccatcactgggctccaggctgaagatgagggtgattattactgccagtcctatgacagcagcctcagtggttgggtgttcggcggagggaccaagctgaccgtcctgggtcagcccaaggctgccccctcggtcactctgttcccgcctcctctatatactgtctgagcgggctggcaaggcgcatagnnnnnnnnn

SEQ ID NO: 80684 - DNA, 573 bp, Homo sapiens
  misc_feature: GYAE6OF02GF2N3.44.25.C03.1.454.CMB.1.raw
tcagacagtatatacacgaccggtgctcgatttagtagtgtagatttgggtttgggggcttcagctgtgggcacaagaggcagcactcaggacaatctccagcatggcctggtctcctctcctcctcactctcctcgctcactgcacagggtcctgggcccactctgtgctgacgcagccgccctcagtgtctcgggggccccgggcagagggtcaccatctcctgcactgggagcagactaccaacagtcgggacagattctgatgtccactcggtaaccaacaccttccaggaacacgacccccaaactcctcattctttacggtaacaactatccggccctcgacgggtccctgaccgtattctcgtcggcctccaagtcctaggcctaccctcgaccgccctccctcggccatcacgtcgggcctccgacggctagaagagtggagggtatatttactacgtgcctagtctagtcgacacgcacgtcctcgtaggttgggtttagggtcggttcgggacgggaacgggacctaggcgtcggaccgttccgtcgggtacaccgtacccgg

SEQ ID NO: 80685 - DNA, 242 bp, Homo sapiens; identical to SEQ ID NO: 80017
  misc_feature: GYAE6OF02F5Q63.44.25.C03.1.454.CMB.1.raw
  modified_base (239)..(242): a, c, t, g, unknown or other
  misc_feature (239)..(242): n is a, c, g, or t

SEQ ID NO: 80686 - DNA, 483 bp, Homo sapiens
  misc_feature: GYAE6OF02FQHR6.44.25.C03.1.454.CMB.1.raw
  modified_base (475)..(483): a, c, t, g, unknown or other
  misc_feature (475)..(483): n is a, c, g, or t
tcagacagtatatacacgaccggtgctcgatttagtagtgtagatttgggtttgggctggatccgtcagcccccagggaaggccctggagtggcttgcacacatcttctcgaatgacgaaaaatcctacagtacatctctgaagagcagtttaaccatctccaaggacacctccaaaaggcaggtggtctttagtatgaccaacatggaccctgcggacacaggcacatattactgtgcacgggtaatgcgggaaagaacagctggttctgtattataagtctttaccatctggacgtctggggcaaagggaccacggtcaccgtctcctcagcttccaccaagggcccatcggtcttccccctggcgccctgctccaggacgcacctctggggggcacgacgcggcccgtgggctgcctggtcaaggcctacttccacgtctactgctgacgcgggctggcaagggcgcatagnnnnnnnnn

SEQ ID NO: 80687 - DNA, 219 bp, Homo sapiens
  misc_feature: GYAE6OF02FLA2E.44.25.C03.1.454.CMB.1.raw
  modified_base (168)..(219): a, c, t, g, unknown or other
  misc_feature (168)..(219): n is a, c, g, or t
tcagacagtatatacacgaccggtgctcgatttagtagtgtagatttgggtttgggggtagggttggtgtcacaagatttgggctctgggcacagcggccctgggctgccgtggtcaagggactacttccacgtctactgcctgagcggggctggcaaggcgcatagnnnnnnnnnnnnnnnnnnnnnnnnnnnnnnnnnnnnnnnnnnnnnnnnnnnn

SEQ ID NO: 80688 - DNA, 243 bp, Homo sapiens
  misc_feature: GYAE6OF02GVEQL.44.25.C03.1.454.CMB.1.raw
  modified_base (239)..(243): a, c, t, g, unknown or other
  misc_feature (239)..(243): n is a, c, g, or t
tcagacagtatatacacgaccggtgctcgatttagtagtgtagatttgggtttgggtgcccaagctgctggatggcacggtcaccacggtcaccgtctcctcagcttccaccaagggcccatcggtcttccccctggcgccctgctccaggagcacctctgggggcacagcggccctgggctgcctggtcaaggactacttcctatatactgtctgagcgggctggcaaggcgcatagnnnnn

SEQ ID NO: 80689 - DNA, 242 bp, Homo sapiens; identical to SEQ ID NO: 80340
  misc_feature: GYAE6OF02GS98V.44.25.C03.1.454.CMB.1.raw
  modified_base (239)..(242): a, c, t, g, unknown or other
  misc_feature (239)..(242): n is a, c, g, or t

SEQ ID NO: 80690 - DNA, 565 bp, Homo sapiens
  misc_feature: GYAE6OF02JMJA4.44.25.C03.1.454.CMB.1.raw
  modified_base (216)..(216): a, c, t, g, unknown or other
  misc_feature (216)..(216): n is a, c, g, or t
  modified_base (304)..(304): a, c, t, g, unknown or other
  misc_feature (304)..(304): n is a, c, g, or t
  modified_base (322)..(322): a, c, t, g, unknown or other
  misc_feature (322)..(322): n is a, c, g, or t
  modified_base (325)..(325): a, c, t, g, unknown or other
  misc_feature (325)..(325): n is a, c, g, or t
  modified_base (327)..(327): a, c, t, g, unknown or other
  misc_feature (327)..(327): n is a, c, g, or t
  modified_base (541)..(541): a, c, t, g, unknown or other
  misc_feature (541)..(541): n is a, c, g, or t
  modified_base (543)..(544): a, c, t, g, unknown or other
  misc_feature (543)..(544): n is a, c, g, or t
  modified_base (546)..(546): a, c, t, g, unknown or other
  misc_feature (546)..(546): n is a, c, g, or t
  modified_base (548)..(549): a, c, t, g, unknown or other
  misc_feature (548)..(549): n is a, c, g, or t
  modified_base (552)..(552): a, c, t, g, unknown or other
  misc_feature (552)..(552): n is a, c, g, or t
  modified_base (554)..(555): a, c, t, g, unknown or other
  misc_feature (554)..(555): n is a, c, g, or t
  modified_base (557)..(557): a, c, t, g, unknown or other
  misc_feature (557)..(557): n is a, c, g, or t
  modified_base (559)..(561): a, c, t, g, unknown or other
  misc_feature (559)..(561): n is a, c, g, or t
  modified_base (563)..(564): a, c, t, g, unknown or other
  misc_feature (563)..(564): n is a, c, g, or t
tcagacagtatatacacgaccggtgctcgatttagtagtgtagatttgggtttgggggctgttcctggaaggtgttggtaccagagggtcaccatctcctgcatgggagcagatccaacatcgggacagattctgatgtccactggtaccaacaccttcaggaacagccccaaactcctcatctttggaacaactatccggccctcacgggtcccngaccgattctctggctccaagtctggcacctcgacgcctccctggaccatcactcgggcctccgagctgaagatgagggtcatattancgcagtccatgacagccntcngngtggtagtcgtcggaggacgacagcgtcgaccgtcgtaggacacggacccgaggtccgtacccgtcccgtacgtctaccgtaccgttccccgttccccgtaacccttaccttacgttaacgtacgttaccgttggtaccgtagggaccggtccgggtcggtaccggaccggtaacgggccgtaactaacgtagcgcgagacgcgtagcgagcgngnngngnncgncnncngnnngnnc

SEQ ID NO: 80691 - DNA, 290 bp, Homo sapiens
  misc_feature: GYAE6OF02FVP07.44.25.C03.1.454.CMB.1.raw
  modified_base (249)..(290): a, c, t, g, unknown or other
  misc_feature (249)..(290): n is a, c, g, or t
tcagacagtatatacacgaccggtgctcgatttagtagtgtagatttgggtttggggttgggcccaagctgctggagggcacggtcgaccacggtcaccgtctcctcaggcttccaccaagggcccatcggtcttccccctggcgccctgcgtccaggagcacctcgtgggggcacagccggccctgggctgcctggtcaaggactacttccgtatatactgtctgagcgggctggcaaggcgcatagnnnnnnnnnnnnnnnnnnnnnnnnnnnnnnnnnnnnnnnnnn

SEQ ID NO: 80692 - DNA, 223 bp, Homo sapiens
  misc_feature: GYAE6OF02GIG0N.44.25.C03.1.454.CMB.1.raw
  modified_base (219)..(223): a, c, t, g, unknown or other
  misc_feature (219)..(223): n is a, c, g, or t
tcagacagtatatacacgaccggtgctcgatttagtagtgtagatttgggtttgggggaagaggaagactgacggtcctcccaggagttcaggtgctgggcaccttgggcacgggggaggtgtgtcacaagatttgggctctgggcacagcggccctgggctgcctggtcaaggactacttccacgtctactgctgagcgggctggcaaggcgcatagnnnnn

SEQ ID NO: 80693 - DNA, 242 bp, Homo sapiens; identical to SEQ ID NO: 80017
  misc_feature: GYAE6OF02FLJGL.44.25.C03.1.454.CMB.1.raw
  modified_base (239)..(242): a, c, t, g, unknown or other
  misc_feature (239)..(242): n is a, c, g, or t

SEQ ID NO: 80694 - DNA, 258 bp, Homo sapiens
  misc_feature: GYAE6OF02JGRWM.44.25.C03.1.454.CMB.1.raw
  modified_base (238)..(258): a, c, t, g, unknown or other
  misc_feature (238)..(258): n is a, c, g, or t
tcagacagtatatacacgaccggtgctcgatttagtagtgtagatttgggtttgggtgcccaagctgctggagggcacggtcaccacggtcaccgtctcctcagcttccaccaaggcccatcggtcttcccctggcgccctgctccaggagcacctctgggggcacagcggccctgggctgcctggtcaaggactacttccacgtctactgctgagcgggctggcaaggcgcgatagnnnnnnnnnnnnnnnnnnnnn

SEQ ID NO: 80695 - DNA, 267 bp, Homo sapiens
  misc_feature: GYAE6OF02FGCPU.44.25.C03.1.454.CMB.1.raw
  modified_base (264)..(267): a, c, t, g, unknown or other
  misc_feature (264)..(267): n is a, c, g, or t
tcagacagtatatacacgaccggtgctcgatttagtagtgtagatttgggtttgggggaagaggaagactgacggtcctcccaggagttcaggtgctgggcaccttgggcacgggggaggtgtgtcacaagatttgggctctgggcaccgtgggcatgggggaggtgtgtcacaagatttgggctctgggcacagcggccctgggctgcctggtcaaggactacttccacgtctactgctgagcgggctggcaaggcgcatagnnnn

SEQ ID NO: 80696 - DNA, 243 bp, Homo sapiens; identical to SEQ ID NO: 80006
  misc_feature: GYAE6OF02IJPLZ.44.25.C03.1.454.CMB.1.raw
  modified_base (239)..(243): a, c, t, g, unknown or other
  misc_feature (239)..(243): n is a, c, g, or t

SEQ ID NO: 80697 - DNA, 243 bp, Homo sapiens; identical to SEQ ID NO: 80006
  misc_feature: GYAE6OF02G1EZA.44.25.C03.1.454.CMB.1.raw
  modified_base (239)..(243): a, c, t, g, unknown or other
  misc_feature (239)..(243): n is a, c, g, or t

SEQ ID NO: 80698 - DNA, 302 bp, Homo sapiens
  misc_feature: GYAE6OF02H76AT.44.25.C03.1.454.CMB.1.raw
  modified_base (291)..(291): a, c, t, g, unknown or other
  misc_feature (291)..(291): n is a, c, g, or t
  modified_base (297)..(302): a, c, t, g, unknown or other
  misc_feature (297)..(302): n is a, c, g, or t
tcagacagtatatacacgaccggtgctcgatttagtagtgtagatttgggtttggggggtgtggtggtctccactcccgccttgacggggctgctatctgcctccctggccatcactgggctccaggctgaagatgagggtgattattactgccagtcctatgacagcagcctcagtggttgggtgttcggcggagggaccaagctgaccgtcctgggtcagcccaaggctgccccctggtcactctgttcccacctcctctatatactgtctgagcgggctggcaaggcncatagnnnnnn

SEQ ID NO: 80699 - DNA, 622 bp, Homo sapiens
  misc_feature: GYAE6OF02GA6M0.44.25.C03.1.454.CMB.1.raw
tcagacagtatatacacgaccggtgctcgatttagtagtgtagatttgggtttgggggcttcagctgtgggcacaagaggcagcactcaggacaatctccagcatggcctggtctcctctcctcctcactctcctcgctcactgcacagggtcctgggcccactctgtgctgacgcagccgccctcagtgtctgggggccccggggcaggagggtcaccatctcctgcacgtgggagcagactccaacatcgggacagattctgatcgtaccactcggtaacccaacctaccttccaaggaaccaccgaccccccaaactccctacacttctttaggtaaccaactacgtccggcccctcgacggggttccctcgaccgtacttcctcgtcggctaccaagtcctcggccaccctcacgtccctcccgtcggccactccaccgtgggcctccgaggctagaagtagtagggtagggtagtatttacttacgtcgtacctacggtccttagtacgacagaccacgccttacgtaggttgggtttcggggtcggttccgggacgggtaacgggtacccgaaggtccgtacggtacccgttcggtcgggtaccacggtaccccgg

SEQ ID NO: 80700 - DNA, 535 bp, Homo sapiens
  misc_feature: GYAE6OF02JDORC.44.25.C03.1.454.CMB.1.raw
  modified_base (401)..(401): a, c, t, g, unknown or other
  misc_feature (401)..(401): n is a, c, g, or t
  modified_base (429)..(429): a, c, t, g, unknown or other
  misc_feature (429)..(429): n is a, c, g, or t
  modified_base (437)..(437): a, c, t, g, unknown or other
  misc_feature (437)..(437): n is a, c, g, or t
  modified_base (532)..(533): a, c, t, g, unknown or other
  misc_feature (532)..(533): n is a, c, g, or t
tcagacagtatatacacgaccggtgctcgatttagtagtgtagatttgggtttgggggacgcctagttcggccgggggggcccctaagactctcctgtctcgtctctgaacccacctttagcagctactggatgcactgggtccgccaagctccaggaaagggcctgatgtgggtctcacgtattaacaccgatgggactatcactggttactcagacgccgtgaagggccgattcatcatctccagagacaatgtcgaaaacacggtgtaatttacaaatgaaacagtctaagagtcgaggacacggctgtctactattgtgtgagaccttatgatttcacgttgggggattatcgtttgggccacacgtggggccagggaccttggtcgtcgtctcctnagcttccacaggccatcgtctccctgcncctgctcnggagcacctctggggcacgacgcggcctggctcgccgtggtcaaggactactctatatctgtcgtgacgcgggctcggcgaacggtcgcagtagnngc

SEQ ID NO: 80701 - DNA, 244 bp, Homo sapiens; identical to SEQ ID NO: 80207
  misc_feature: GYAE6OF02HS9WS.44.25.C03.1.454.CMB.1.raw
  modified_base (239)..(244): a, c, t, g, unknown or other
  misc_feature (239)..(244): n is a, c, g, or t

SEQ ID NO: 80702 - DNA, 271 bp, Homo sapiens
  misc_feature: GYAE6OF02I3X2R.44.25.C03.1.454.CMB.1.raw
  modified_base (264)..(271): a, c, t, g, unknown or other
  misc_feature (264)..(271): n is a, c, g, or t
tcagacagtatatacacgaccggtgctcgatttagtagtgtagatttgggtttgggggaagaggaagactgacggtcctcccaggagttcaggtgctgggcaccttgggcacgggggaggtgtgtcacaagatttgggctctgggcaccgtgggcatgggggaggtgtgtcacaagatttgggctctgggcacagcggccctgggctgcctggtcaaggactacttcctatatactgtctgagcgggctggcaaggcgcatagnnnnnnnn

SEQ ID NO: 80703 - DNA, 223 bp, Homo sapiens
  misc_feature: GYAE6OF02FVNMS.44.25.C03.1.454.CMB.1.raw
  modified_base (213)..(213): a, c, t, g, unknown or other
  misc_feature (213)..(213): n is a, c, g, or t
  modified_base (219)..(223): a, c, t, g, unknown or other
  misc_feature (219)..(223): n is a, c, g, or t
tcagacagtatatacacgaccggtgctcgatttagtagtgtagatttgggtttgggggaagaggaagactgacggtcctcccaggagttcaggtgctgggcaccttgggcacgggggaggtgtgtcacaagatttgggctctgggcacagcggccctgggctgcctggtcaaggactacttcctatatactgtctgagcgggctggcaaggcncatagnnnnn

SEQ ID NO: 80704 - DNA, 606 bp, Homo sapiens
  misc_feature: GYAE6OF02HYCLI.44.25.C03.1.454.CMB.1.raw
  modified_base (193)..(193): a, c, t, g, unknown or other
  misc_feature (193)..(193): n is a, c, g, or t
  modified_base (222)..(222): a, c, t, g, unknown or other
  misc_feature (222)..(222): n is a, c, g, or t
  modified_base (233)..(233): a, c, t, g, unknown or other
  misc_feature (233)..(233): n is a, c, g, or t
  modified_base (284)..(284): a, c, t, g, unknown or other
  misc_feature (284)..(284): n is a, c, g, or t
tcagacagtatatacacgaccggtgctcgatttagtagtgtagatttgggtttggggggcacaagaggcagcactcaggacaatctccagcatggcctggtctcctctcctcctcactctcctcgctcactgcacagggtcctgggcccactctgtgctgacgcagccgccctcagtgtctggggccccgggnagagggtcaccatctcctgcacgtgggancagactccaanagtcgggacaggattctgatgtccacgtggtaccaacaccttccaggaacncgacccccaaactcctcatctttaggtaacaactatccggccctcgacgggtcccgagtcggttctctcggtctcaagtctggcaaccgacggcctccctcgaccgtctcgtcgggcctcgaggctgacgagtgaggctagtattattactgcagcctcgagtggacggtccaccgttagtcgttagtttgtccgttttcgggcggtaacggggacccaaggtaccgttacggacccggtcccggttaacggtaccgaaccgtaccccgaaggtcccgtacccggtcccccgtaccgggtccctaccgttcccgttccccgg

SEQ ID NO: 80705 - DNA, 638 bp, Homo sapiens
  misc_feature: GYAE6OF02FMAS8.44.25.C03.1.454.CMB.1.raw
  modified_base (269)..(269): a, c, t, g, unknown or other
  misc_feature (269)..(269): n is a, c, g, or t
tcagacagtatatacacgaccggtgctcgatttagtagtgtagatttgggtttggggggaagaggaagactgacggtcctcccaggagttcaggtgctgggcaccttgggcacgggggaggtgtgtcacaagatttgggctctgggcaccgtgggcatgggggaggtgtgtcacaagatttggactcctgtgccccacatggacactctttgctacacactcctgctgctgaccacccttctgggtcttgtcccaggtcaccttgaggngtctggtcctgtgctggtacgaaacccacagacgacccctcacgctcgacctgccaccatctcgtggttctctctcaacgtatattagagtgggtgtgagcgtggactccgtacaccgccccgagggaccgccgtaggacgtggtctgaccacactacttcttactacgaactacgaacgtaaaactcctaacacgtactactacctacgagtaacgacgtacgttaactttaaccacttacctaaccgtaaacgaaccctaacccgtaccgaaacggtacggttaagggttaccggtttacgtttaacgttaacgtaccgtaacctaacgtaaccggttaccggaccccgttacggacccggtaaccg

SEQ ID NO: 80706 - DNA, 313 bp, Homo sapiens
  misc_feature: GYAE6OF02FXQKJ.44.25.C03.1.454.CMB.1.raw
  modified_base (246)..(247): a, c, t, g, unknown or other
  misc_feature (246)..(247): n is a, c, g, or t
  modified_base (249)..(251): a, c, t, g, unknown or other
  misc_feature (249)..(251): n is a, c, g, or t
  modified_base (253)..(258): a, c, t, g, unknown or other
  misc_feature (253)..(258): n is a, c, g, or t
  modified_base (260)..(313): a, c, t, g, unknown or other
  misc_feature (260)..(313): n is a, c, g, or t
tcagacagtatatacacgaccggtgctcgatttagtagtgtagatttgggtttggggtgcccaagtctgctggagggctacggtcaccacggtcaccgtctccgtcagcttccaccaagggcccatcggtcttccccctggtcgcccttggctccaggagcacctctgggggcacagcggccctgggctgcctggtcaaggactacttcgtatatcgtctgtagcgggctggcaaggcgcgatagnngnnngnnnnnngnnnnnnnnnnnnnnnnnnnnnnnnnnnnnnnnnnnnnnnnnnnnnnnnnnnnnn

SEQ ID NO: 80707 - DNA, 128 bp, Homo sapiens
  misc_feature: GYAE6OF02GKKZS.44.25.C03.1.454.CMB.1.raw
tcagacagtatatacacgaccggtgctcgatttagtagtgtagatttgggtttgggcacagcggccctgggctgcctggtcaaggactcttcctatatactgtctgagcgggctggcaaggcgcatag

SEQ ID NO: 80708 - DNA, 242 bp, Homo sapiens; identical to SEQ ID NO: 80085
  misc_feature: GYAE6OF02HIKPN.44.25.C03.1.454.CMB.1.raw
  modified_base (239)..(242): a, c, t, g, unknown or other
  misc_feature (239)..(242): n is a, c, g, or t

SEQ ID NO: 80709 - DNA, 562 bp, Homo sapiens
  misc_feature: GYAE6OF02FPWVQ.44.25.C03.1.454.CMB.1.raw
  modified_base (443)..(443): a, c, t, g, unknown or other
  misc_feature (443)..(443): n is a, c, g, or t
  modified_base (494)..(494): a, c, t, g, unknown or other
  misc_feature (494)..(494): n is a, c, g, or t
  modified_base (521)..(521): a, c, t, g, unknown or other
  misc_feature (521)..(521): n is a, c, g, or t
  modified_base (559)..(560): a, c, t, g, unknown or other
  misc_feature (559)..(560): n is a, c, g, or t
tcagacagtatatacacgaccggtgctcgatttagtagtgtagatttgggtttgggggacgcctagttcggccggggggcccctaagactctcctgtctcgtctctgaacccacctttagcagctactggatgcactgggtccgccaagctccaggaagggcctgatgtgggtctcacgtattaacaccgatgggactatcactggttactcagacgccgtgaagggccgattcatcatctccagagacaatgtcgaaaaacacggtgtaatttacaaatgaacagtctaagagtcgaggacacggctgtctactattgtgtgagaccttatgtattttcgacgtttggggggagttagttcgtttgggcccacgtactgggggccaggggaccttggtcgtcgtctcctcagcttccaccaagggccatcggtcttcccccnggccgccctgcctccgaggacgccacctcgtcggggcacgagccggcccgnggctgcctggcaaggctacttcctatntactgtctggacgcgggctgggacaaggcgacagtagnncg

SEQ ID NO: 80710 - DNA, 628 bp, Homo sapiens
  misc_feature: GYAE6OF02HI5IU.44.25.C03.1.454.CMB.1.raw
tcagacagtatatacacgaccggtgctcgatttagtagtgtagatttgggtttgggggactcctgtgccccaccatggacactctttgctacacactcctgctgctgaccaccccttcctgggtcttgtcccaggtcaccttgaaggagtctggtcctgtgctggtgaaacccacagagaccctcacgctgacctgcaccatctctgggttctctctcaacgatattagaatgggtgtgagctggatccgtcagccccagggaaggccctggagtggcttgcacacatctctcgaatgacgaaaaatcctacagtacatctctgaagagcagtttaaccatctccaagacacctaccaaaaggcaggtggtactttagtattacggacctaacagtacggaccctggacggacaacaggcaacaattattactgttagacctaacggggttaaatcggacgggtaaagaaacaggtacgttaggtttacgttagtttaattaattaagttacctttaacctattccgtaggtaaccggttcgtagggggaaccaaaggggtaaccccgtaacgggtacccgtaacccggttccttaccgtaccgtaacggtccttaccccaacccggg

SEQ ID NO: 80711 - DNA, 268 bp, Homo sapiens
  misc_feature: GYAE6OF02H9W7R.44.25.C03.1.454.CMB.1.raw
  modified_base (238)..(268): a, c, t, g, unknown or other
  misc_feature (238)..(268): n is a, c, g, or t
tcagacagtatatacacgaccggtgctcgatttagtagtgtagatttgggtttgggtgcccaagctgctggagggcacggtcaccacggtcaccgtctcctcagcttccaccaagggcccatcggtcttccccctggcgccctgctccaggagcacctctgggggcacagcggccctggactgcctggtcaaggctacttcctatatactgtctgagcgggctggcaaggcgcatagnnnnnnnnnnnnnnnnnnnnnnnnnnnnnnn

SEQ ID NO: 80712 - DNA, 301 bp, Homo sapiens; identical to SEQ ID NO: 80612
  misc_feature: GYAE6OF02GMX3P.44.25.C03.1.454.CMB.1.raw
  modified_base (298)..(301): a, c, t, g, unknown or other
  misc_feature (298)..(301): n is a, c, g, or t

SEQ ID NO: 80713 - DNA, 149 bp, Homo sapiens; identical to SEQ ID NO: 80488
  misc_feature: GYAE6OF02HVSX6.44.25.C03.1.454.CMB.1.raw
  modified_base (137)..(149): a, c, t, g, unknown or other
  misc_feature (137)..(149): n is a, c, g, or t

SEQ ID NO: 80714 - DNA, 243 bp, Homo sapiens; identical to SEQ ID NO: 80118
  misc_feature: GYAE6OF02GRFUF.44.25.C03.1.454.CMB.1.raw
  modified_base (238)..(243): a, c, t, g, unknown or other
  misc_feature (238)..(243): n is a, c, g, or t

SEQ ID NO: 80715 - DNA, 654 bp, Homo sapiens
  misc_feature: GYAE6OF02JGA33.44.25.C03.1.454.CMB.1.raw
  modified_base (226)..(226): a, c, t, g, unknown or other
  misc_feature (226)..(226): n is a, c, g, or t
  modified_base (254)..(254): a, c, t, g, unknown or other
  misc_feature (254)..(254): n is a, c, g, or t
  modified_base (464)..(464): a, c, t, g, unknown or other
  misc_feature (464)..(464): n is a, c, g, or t
  modified_base (479)..(479): a, c, t, g, unknown or other
  misc_feature (479)..(479): n is a, c, g, or t
tcagacagtatatacacgaccggtgctcgatttagtagtgtagatttgggtttgggggggcacaagaggcagcactcaggacaatctccagcatggcctggtctcctctcctcctcactctcctcgctcactgcacagggtcctgggcccactctgtgctgacgcagccgccctcagtgtcgtcggggccccgggcaggagggtcaccatcctcctgcactgggancagactccaacagtcgggacagacttcngatgtccacgtggtaccaacaccttccaaggaaccacgaccccccaaatccctcacttcgttttagaaacaactactccggccctcgacgggtccctgaccgtattcctcgtcggcctaccgaacgttcctacggcctaccgttcaacgtccctcccgtcggccctagtccgacgtcgggcctccgaggctaggaagagtgggacgggtntaatttacgttacgngtaccgcgtttacctagtacgaaccgacgtaccacgtaccctcgttagggttgggttacgggttggttccgggacgggtacggacctaacggtcgtaccggtacccggtttccggtacgggaccgtaccggccccggtaaggtccccttcccgggtcccccgttacggtaccccg

SEQ ID NO: 80716 - DNA, 738 bp, Homo sapiens
  misc_feature: GYAE6OF02J2TRQ.44.25.C03.1.454.CMB.1.raw
  modified_base (238)..(238): a, c, t, g, unknown or other
  misc_feature (238)..(238): n is a, c, g, or t
  modified_base (286)..(286): a, c, t, g, unknown or other
  misc_feature (286)..(286): n is a, c, g, or t
  modified_base (300)..(300): a, c, t, g, unknown or other
  misc_feature (300)..(300): n is a, c, g, or t
tcagacagtatatacacgaccggtgctcgatttagtagtgtagatttgggtttgggggaagaggaagactgacggtcctcccaggagttcaggtgctgggcaccttgggcacgggggaggtgtggtcacaagatttgggctcgtgggcaccgtgggcagtgggggagtgtgtcacaagatttggactcctgtcgccccacatggacactctttgctacacactcctgctgctgacccncccttctggtccttgtcccagtccaccgttgaagtgtctggcctgtcnctggtcaaaccccngagaccgtaccctcaccggtctcgaccctgccctacctgtcctcggttcggtttcctcctacctacccgtaaagtacttacgttttaaacggaacggttcgggggtttagtacggacgttcccgtaagggtacccgttcccgtaaccgacccggacccccggtaaggggaacccggcccgtttaggggacgttcgggtcctacggtaccaccgtaaacgttccgttccgttaccgtacgtaaaacgttaccggaaaaccgtaaaacctttccgaaaccgtagtaactacgtccttacgaacgtagaacgtccgttaaacgttacccctatacccgtaacaacgtaccctaccgtaaccgaaacggtccgtaaagggtttcccaagttttacgaccgttacgaaccctaggtacctaccgggaccctggtaccgaaccg

SEQ ID NO: 80717 - DNA, 808 bp, Homo sapiens
  misc_feature: GYAE6OF02FIISZ.44.25.C03.1.454.CMB.1.raw
  modified_base (210)..(210): a, c, t, g, unknown or other
  misc_feature (210)..(210): n is a, c, g, or t
  modified_base (243)..(243): a, c, t, g, unknown or other
  misc_feature (243)..(243): n is a, c, g, or t
tcagacagtatatacacgaccggtgctcgatttagtagtgtagatttgggtttgggggcttcagctgtgggcacaagaggcagcactcaggacaatctccagcatggcctggtctcctctcctcctcactctcctcgctcactgcacagggtcctgggcccactctgtgctgacgcagcccgccctcagtgtcgtgggggcccccggggnaggacgggtcaccatcctcctgcacgtggggancagactccaaacagtccggggacagattctgatcgtccacgtggtacccaactaccttccaaggaaccacgacccccaaactcctactactcctttaggtaaacctaacgttacgtccggacccctcggacggggtccctacggaccgtactttccgtcgtcggtacctacctaacggttccgtcgggccctacccgtcgaccgtccccttcccgtcgggacccctaacgtacccgtaccggttcggggcccttacccggaacgggtccttaacgggaaacggtacgttacgggggtaacgggggttacgttaaacgtttttaacgtttaacgttaccgggtacccgttaacggttaccccgtttaaaggtccggtaaaccgtacggtacccgacggttaccccttacgggttacgggtttcggggggttttccgggggtttcggggttacccggggggtaaccgggggtaacccgggggtaacccgttaaacgggttcccggttaaccggggtacccccgggtttccgggtaccgggggtacccgtacccgggtaacccccggg

SEQ ID NO: 80718 - DNA, 242 bp, Homo sapiens; identical to SEQ ID NO: 80017
  misc_feature: GYAE6OF02F9ME1.44.25.C03.1.454.CMB.1.raw
  modified_base (239)..(242): a, c, t, g, unknown or other
  misc_feature (239)..(242): n is a, c, g, or t

SEQ ID NO: 80719 - DNA, 515 bp, Homo sapiens
  misc_feature: GYAE6OF02G2ULX.44.25.C03.1.454.CMB.1.raw
  modified_base (223)..(223): a, c, t, g, unknown or other
  misc_feature (223)..(223): n is a, c, g, or t
  modified_base (407)..(407): a, c, t, g, unknown or other
  misc_feature (407)..(407): n is a, c, g, or t
tcagacagtatatacacgaccggtgctcgatttagtagtgtagatttgggtttgggggggcacaagaggcagcactcaggacaatctccagcatggcctggtctcctctcctcctcactctcctcgctcactgcacagggtcctgggcccactctgtgctgacgcagccgccctcagtgtctggggcccccgggcagagggtcaccatctcctgcactgggancagatccaacatcgggacagattctgatgtccactggtaccaacaccttccaggaacacgcccccaaactcctcatctttggtaacaactatcggccctcaggggtccctgaccgatctctggctcaagtctggcacctcagcctccctggccatcactgggctccaggctgaagatgagggtnattactactgtgaagcatgggatgacaggccggaaggctggggtgttcgggcggaggaccaaggttcgaccgtcctaggtcagcccaaggctcgcccctggtccatcg

SEQ ID NO: 80720 - DNA, 222 bp, Homo sapiens
  misc_feature: GYAE6OF02F6FS0.44.25.C03.1.454.CMB.1.raw
  modified_base (219)..(222): a, c, t, g, unknown or other
  misc_feature (219)..(222): n is a, c, g, or t
tcagacagtatatacacgaccggtgctcgatttagtagtgtagatttgggtttgggggaagaggaagactgacggtcctcccaggagttcaggtgctgggcaccttgggcatgggggaggtgtgtcacaagatttgggctctgggcacagcggccctgggctgcctggtcaaggactacttcctatatactgtctgagcgggctggcaaggcgcatagnnnn

SEQ ID NO: 80721 - DNA, 309 bp, Homo sapiens
  misc_feature: GYAE6OF02F8C38.44.25.C03.1.454.CMB.1.raw
  modified_base (302)..(309): a, c, t, g, unknown or other
  misc_feature (302)..(309): n is a, c, g, or t
tcagacagtatatacacgaccggtgctcgatttagtagtgtagatttgggtttggggggtgtggtggtctccactcccgccttgacggggctgctatctgcctccctggccatcactgggctccaggctgaagatgagggtgattattactgccagtcctatgacagcagcctcagtggttgggtgttcggcggagggaccaagctgaccgtcctgggtcagcccaaggctcgccccctcggtcactctgttccccgccctcctctatactactgtctgagcgggctggcaaggcgcatagnnnnnnnn

SEQ ID NO: 80722 - DNA, 479 bp, Homo sapiens
  misc_feature: GYAE6OF02H7J6P.44.25.C03.1.454.CMB.1.raw
  modified_base (346)..(346): a, c, t, g, unknown or other
  misc_feature (346)..(346): n is a, c, g, or t
  modified_base (463)..(464): a, c, t, g, unknown or other
  misc_feature (463)..(464): n is a, c, g, or t
  modified_base (466)..(479): a, c, t, g, unknown or other
  misc_feature (466)..(479): n is a, c, g, or t
tcagacagtatatacacgaccggtgctcgatttagtagtgtagatttgggtttgggggctgttcctggaaggtgttggtaccagagggtcaccatctcctgcactgggagcagatccaacatcgggacagattctgatgtccactggtaccaacaccttccaggaacagcccccaaactcctcatctttggtaacaactatcggccctcaggggtccctgaccgattctctggctccaagtctggcacctcagcctccctggccatcactgggctccaggctgaagatgagggtgattattactgccaggtcctatgacagcagcctcagtggttgggtgttcggnggaggaccaagctgaccgtcgtgggtcacgcccaaggcctcgccccctcgggtcactctccgttccccaccctcctctactactactgtctgacgcgggctggcgaggcgcagtagnngnnnnnnnnnnnnnn

SEQ ID NO: 80723 - DNA, 156 bp, Homo sapiens
  misc_feature: GYAE6OF02HFADG.44.25.C03.1.454.CMB.1.raw
  modified_base (132)..(132): a, c, t, g, unknown or other
  misc_feature (132)..(132): n is a, c, g, or t
  modified_base (134)..(156): a, c, t, g, unknown or other
  misc_feature (134)..(156): n is a, c, g, or t
tcagacagtatatacacgaccggtgctcgatttagtagtgtagatttgggtttgggcacagcggccctgggctgcctggtcaaggactacttcctagtactactgtctgagcgggctggcaaggcgcatagncnnnnnnnnnnnnnnnnnnnnnnn

SEQ ID NO: 80724 - DNA, 574 bp, Homo sapiens
  misc_feature: GYAE6OF02FO1CH.44.25.C03.1.454.CMB.1.raw
  modified_base (222)..(222): a, c, t, g, unknown or other
  misc_feature (222)..(222): n is a, c, g, or t
  modified_base (247)..(247): a, c, t, g, unknown or other
  misc_feature (247)..(247): n is a, c, g, or t
  modified_base (404)..(404): a, c, t, g, unknown or other
  misc_feature (404)..(404): n is a, c, g, or t
  modified_base (414)..(414): a, c, t, g, unknown or other
  misc_feature (414)..(414): n is a, c, g, or t
tcagacagtatatacacgaccggtgctcgatttagtagtgtagatttgggtttgggggggcacaagaggcagcactcaggacaatctccagcatggcctggtctcctctcctcctcactctcctcgctcactgcacagggtcctgggcccactctgtgctgacgcagccgccctcagtgtctggggccccgggcagagggtcaccatctcctgcactgggancagatccaacatcgggacagattcngatgtccactggtaccaacaccttccaggaacagcccccaaactcctcatctttggtaacaactatcggccctcaggggtccctgaccgattctctggctccaagtctggcacctcacgccctccctggccatcactgggcctccgaggctagaagngtggagggtnatttattactcgccgtagtacctagtcgacagctacgcctacgtaggttgggttggtggttccgggagggtacgggaaccgaggtcgttaccggacccgttccggtcgggtaccaccggacccgtaagggtcccgtacccggtcccccggtggtaccccg

SEQ ID NO: 80725 - DNA, 221 bp, Homo sapiens; identical to SEQ ID NO: 79959
  misc_feature: GYAE6OF02HFTUP.44.25.C03.1.454.CMB.1.raw
  modified_base (219)..(221): a, c, t, g, unknown or other
  misc_feature (219)..(221): n is a, c, g, or t

SEQ ID NO: 80726 - DNA, 787 bp, Homo sapiens
  misc_feature: GYAE6OF02F0DX5.44.25.C03.1.454.CMB.1.raw
  modified_base (190)..(190): a, c, t, g, unknown or other
  misc_feature (190)..(190): n is a, c, g, or t
tcagacagtatatacacgaccggtgctcgatttagtagtgtagatttgggtttgggggcgttacagcctagtgggcacaagaggcagcactcaggacaatctccagcatggcctggtctcctctcctcctcactctcctcgctcactgcacagggtcctgggcccactctgtgctgacgcagcccgcctnagtgtcgtcggggccccgggcaggacgggtcaccattcctccgtgcacgtgggagcagactccaacagtcggacagtattcgtgatcgtaccgacgttcggtaaccaacgtacccgttaccgaaggtaaccaccggacccccaaagtccctacgtacttccgtttagtaaacctaactacgtccggtaccctacgacggggtaccctacgaaccgtactttccgtcgtacggtcctacccgaagttccgtacggacctacctacgacgtacccctccgtacggacccttaagtccgtaacgtccgggtaccctaccgtacgggtccgttaggaaagtacgttacgggtacgggtacgtaaccgttttaagtacgttacgtacccgttacgttacccgttaagttacgtaaccgtacggtaccgtaacgggtcccttaacgggttacggggtttacggggtttacggggttttacggggttaccggggttacgggggtaaacccggggttaacccgttaaacgggttccgggttaacccggttaccccgggtttacccgggttacccggggttaccggaaccccgggttaacccgggg

SEQ ID NO: 80727 - DNA, 283 bp, Homo sapiens
  misc_feature: GYAE6OF02H8JK4.44.25.C03.1.454.CMB.1.raw
  modified_base (237)..(237): a, c, t, g, unknown or other
  misc_feature (237)..(237): n is a, c, g, or t
  modified_base (244)..(283): a, c, t, g, unknown or other
  misc_feature (244)..(283): n is a, c, g, or t
tcagacagtatatacacgaccggtgctcgatttagtagtgtagatttgggtttgggtggcccaagctgctggagggcacggtcaccacggtcaccgtctcctcagcttccaccaagggcccatcggtcttccccctggcgccctgctccaggagcacctctgggggcacagcggccctgggctgcctggtcaaggactacttcctatatactgtctggagcgggtctggcaagggcncataggnnnnnnnnnnnnnnnnnnnnnnnnnnnnnnnnnnnnnnnn

SEQ ID NO: 80728 - DNA, 245 bp, Homo sapiens; identical to SEQ ID NO: 80161
  misc_feature: GYAE6OF02H8S5V.44.25.C03.1.454.CMB.1.raw
  modified_base (239)..(245): a, c, t, g, unknown or other
  misc_feature (239)..(245): n is a, c, g, or t

SEQ ID NO: 80729 - DNA, 241 bp, Homo sapiens
  misc_feature: GYAE6OF02IMAD2.44.25.C03.1.454.CMB.1.raw
  modified_base (237)..(241): a, c, t, g, unknown or other
  misc_feature (237)..(241): n is a, c, g, or t
tcagacagtatatacacgaccggtgctcgatttagtagtgtagatttgggtttgggtgcccaagctgctggagggcacggtcaccacggtcaccgtctcctcagcttccaccaagggcccatcggtcttccccctggcgccctgctccaggagcacctctggggcacagcggccctgggctgcctggtcaaggactacttcctatatactgtctgagcggctggcaaggcgcatagnnnnn

SEQ ID NO: 80730 - DNA, 232 bp, Homo sapiens
  misc_feature: GYAE6OF02JSOBI.44.25.C03.1.454.CMB.1.raw
  modified_base (228)..(232): a, c, t, g, unknown or other
  misc_feature (228)..(232): n is a, c, g, or t
tcagacagtatatacacgaccggtgctcgatttagtagtgtagatttgggtttgggtgcccaagctgctggagggcacggtcaccgtctcctcagcttccaccaagggcccatcggtcttccccctggcgccctgctccaggagcacctctggggcacagcggccctgggctgcctggtcaaggactacttcctatatactgtctgagcggctggcaaggcgcatagnnnnn

SEQ ID NO: 80731 - DNA, 554 bp, Homo sapiens
  misc_feature: GYAE6OF02G5WWU.44.25.C03.1.454.CMB.1.raw
  modified_base (237)..(237): a, c, t, g, unknown or other
  misc_feature (237)..(237): n is a, c, g, or t
  modified_base (262)..(262): a, c, t, g, unknown or other
  misc_feature (262)..(262): n is a, c, g, or t
  modified_base (527)..(527): a, c, t, g, unknown or other
  misc_feature (527)..(527): n is a, c, g, or t
  modified_base (531)..(531): a, c, t, g, unknown or other
  misc_feature (531)..(531): n is a, c, g, or t
  modified_base (535)..(542): a, c, t, g, unknown or other
  misc_feature (535)..(542): n is a, c, g, or t
  modified_base (544)..(553): a, c, t, g, unknown or other
  misc_feature (544)..(553): n is a, c, g, or t
tcagacagtatatacacgaccggtgctcgatttagtagtgtagatttgggtttgggctggatccgtcagcccccagggaaggccctggagtggcttgcacacatcttctcgaatgacgaaaaatcctacagtacatctctgaagagcagttttaaccatctccaaggacacctccaaaaaggcaggtggtctttagtatgaccaacatggaccctgcggacacaggcacatattacngtgcaacgggtaatgacgggaaaanaaacagctggtttctgtattaataagtcttaccatctggacgtctggggacaaaggggaccacggtcaaccgtctcctcacgcttaccacccaaggggccccaagtccggtccttccccctggccgccctgcccttccgaaggacgccacctcgtacgggggcacgacgcggccccgtgggcctggccgtgggtccaagggacttacttcccacgtcttactcggcttgcggcgggtctcgggcaaacgggcgacgaagtaggcncgtngacnnnnnnnngnnnnnnnnnnc

SEQ ID NO: 80732 - DNA, 256 bp, Homo sapiens
  misc_feature: GYAE6OF02FS3DQ.44.25.C03.1.454.CMB.1.raw
  modified_base (239)..(256): a, c, t, g, unknown or other
  misc_feature (239)..(256): n is a, c, g, or t
tcagacagtatatacacgaccggtgctcgatttagtagtgtagatttgggtttgggtgcccaagctgctggagggcacggtcaccacggtcaccgtctcctcagcttccaccaagggcccatcggtcttccccctggcgccctgctccaggagcacctctgggggcacagcggccctgggctgcctggtcaaggactacttccacgtctactgctgagcgggctggcaaggcgcatagnnnnnnnnnnnnnnnnnn

SEQ ID NO: 80733 - DNA, 271 bp, Homo sapiens
  misc_feature: GYAE6OF02GU3OT.44.25.C03.1.454.CMB.1.raw
  modified_base (258)..(258): a, c, t, g, unknown or other
  misc_feature (258)..(258): n is a, c, g, or t
  modified_base (264)..(271): a, c, t, g, unknown or other
  misc_feature (264)..(271): n is a, c, g, or t
tcagacagtatatacacgaccggtgctcgatttagtagtgtagatttgggtttggggggaagaggaagactgacggtcctcccaggagttcaggtgctgggcaccttgggcacgggggaggtgtgtcacaagatttgggctctgggcaccgtgggcatgggggagtgtgtcacaagatttgggctctgggcacagcggccctgggctgcctggtcaaggactacttcctatatactgtctgagcgggctggcaaggcncatagnnnnnnnn

SEQ ID NO: 80734 - DNA, 128 bp, Homo sapiens; identical to SEQ ID NO: 80707
  misc_feature: GYAE6OF02FLMRI.44.25.C03.1.454.CMB.1.raw

SEQ ID NO: 80735 - DNA, 248 bp, Homo sapiens
  misc_feature: GYAE6OF02F2X89.44.25.C03.1.454.CMB.1.raw
  modified_base (241)..(248): a, c, t, g, unknown or other
  misc_feature (241)..(248): n is a, c, g, or t
tcagacagtatatacacgaccggtgctcgatttagtagtgtagatttgggtttgggtgcccgaagctgctggagggcacggtcaccgacggtcaccgtctcctcagcttccaccaagggcccatcggtcttccccctggcgccctgctccaggagcacctctgggggcacagcggccctgggctgcctggtcaaggactacttcctatatactgtctgagcgggctggcaaggcgcatagnnnnnnnn

SEQ ID NO: 80736 - DNA, 543 bp, Homo sapiens
  misc_feature: GYAE6OF02FUD1W.44.25.C03.1.454.CMB.1.raw
  modified_base (260)..(260): a, c, t, g, unknown or other
  misc_feature (260)..(260): n is a, c, g, or t
  modified_base (264)..(264): a, c, t, g, unknown or other
  misc_feature (264)..(264): n is a, c, g, or t
  modified_base (504)..(504): a, c, t, g, unknown or other
  misc_feature (504)..(504): n is a, c, g, or t
  modified_base (522)..(522): a, c, t, g, unknown or other
  misc_feature (522)..(522): n is a, c, g, or t
  modified_base (525)..(543): a, c, t, g, unknown or other
  misc_feature (525)..(543): n is a, c, g, or t
tcagacagtatatacacgaccggtgctcgatttagtagtgtagatttgggtttggactggatccgtcagcccccagggaaggccctggagtggcttgcacacatcttctcgaatgacgaaaaatcctacagtacatctctgaagagcagtttaaccatctccaaggacacctccaaaaggcaggtggtctttagtatgaccaacatggaccctgcggacacgaggcacatatactgtgcacgggtaatggacgggaaaanaacngctggttctgtatataagtcttacatctggacgtcgtggggcaaagggccacggtcaccgtcctcctcagccttccaccgaacgggcccagtccgtccttccccctcggccgccctgcctccgacggacgcaccgtcgtcggggaccacgaccgccggcccgtcggggtcctcggcccgtgggtacaacggtacctaccgttcccaccgtccttaccgtcgaccgtggacgcggggtcgnggacgagggcgcagtagncgnnnnnnnnnnnnnnnnnnn

SEQ ID NO: 80737 - DNA, 224 bp, Homo sapiens; identical to SEQ ID NO: 80326
  misc_feature: GYAE6OF02FQF64.44.25.C03.1.454.CMB.1.raw
  modified_base (220)..(224): a, c, t, g, unknown or other
  misc_feature (220)..(224): n is a, c, g, or t

SEQ ID NO: 80738 - DNA, 871 bp, Homo sapiens
  misc_feature: GYAE6OF02HNQ50.44.25.C03.1.454.CMB.1.raw
  modified_base (158)..(158): a, c, t, g, unknown or other
  misc_feature (158)..(158): n is a, c, g, or t
tcagacagtatatacacgaccggtgctcgatttagtagtgtagatttgggtttgggggactcctgtgcccaccatggacactctttgctacacactcctgctgctgaccacccttcctgggtcttgtcccaggtcaccttgaaggagtctggtcctgngtcgtggaccgaaccagagaccgaccctacgacgtctacgtaccgtcgaccactacttccttcggttcggttctctcctacgaacgtattagttaagtaggttgggtggtaggacgtcgtaggtacgtccgtaccgacccgaccccgggaaggggaccggtccggtaggggtaggtcggttcgttacgactaaccaacttacttccgtttaccgtaacggtaacgtaaccgggaaaaacttaaaaaacccttacccctaaacggtaacgttaactacgtttcctttacggaacggaaaggaccgtaacgtttaaaccgttaaacctacgttaccctaaccggaaaccgaccctaacccgtaaacggaaacggacggttacgggttacgttttacgtttaaagtacgtaacctaaaaccgtaacgttacgggtaacccggttcccgacgggtaaccccgggtaaaccgaacgggaacggtaaaccaacttaaacgtttaaccttacggtagggtacggtacggtaaacgggttagacggggaaaacggtaaacaacgtcgtaggttttcgttaacgttagtttaactttaacggttaccttacctaacgttcgttacgggtcggttacgtacggggtacgggaaacggtaaccggggtaccgtacgtacccgtacgttcccgtccgtacgtaccgttccccgactaacccgggg

SEQ ID NO: 80739 - DNA, 244 bp, Homo sapiens; identical to SEQ ID NO: 80207
  misc_feature: GYAE6OF02G9WY8.44.25.C03.1.454.CMB.1.raw
  modified_base (239)..(244): a, c, t, g, unknown or other
  misc_feature (239)..(244): n is a, c, g, or t

SEQ ID NO: 80740 - DNA, 254 bp, Homo sapiens
  misc_feature: GYAE6OF02GJNZA.44.25.C03.1.454.CMB.1.raw
  modified_base (239)..(254): a, c, t, g, unknown or other
  misc_feature (239)..(254): n is a, c, g, or t
tcagacagtatatacacgaccggtgctcgatttagtagtgtagatttgggtttgggtgcccaagctgctggagggcacggtcaccacggtcaccgtctcctcagcttccaccaagggcccatcggtcttccccctggcgccctgctccaggagcacctctgggggcacagcggccctgggctggcctggtcaagactacttccacgtctactgctgagcgggctggcaaggcgcatagnnnnnnnnnnnnnnnn

SEQ ID NO: 80741 - DNA, 567 bp, Homo sapiens
  misc_feature: GYAE6OF02G58NJ.44.25.C03.1.454.CMB.1.raw
  modified_base (273)..(273): a, c, t, g, unknown or other
  misc_feature (273)..(273): n is a, c, g, or t
tcagacagtatatacacgaccggtgctcgatttagtagtgtagatttgggtttgggggaagaggaagactgacggtcctcccaggagttcaggtgctgggcaccttggccacgggggaggtgtgtcacaagatttgggctctgggcaccgtgggcatgggggacggtgtgtcacaagatttggactcctgtgccccacatggacactctttgctacacactcctgctgctgacccaccccttcctgggtcttgtcccaggtcaccttgaaggngtctggtcctgtgctggtgaaacccacagagaccctcacgctgacctgccaccatctctgggttctctctcaacgatattagaatgggtgtgagctggactccgtcacgcccccagggacggccctggagtggcttgcacacatcttctcgaatgaacgaaaatcctaacagtacatctctagaagagctaagtttaaccattcctaccaaacgaccacctaccgaaaacggcgtaaggttcggttacgtttacgtaatacgaaccaacgtacgtacggaccctgaccggtacg

SEQ ID NO: 80742 - DNA, 245 bp, Homo sapiens; identical to SEQ ID NO: 80239
  misc_feature: GYAE6OF02H16SI.44.25.C03.1.454.CMB.1.raw
  modified_base (239)..(245): a, c, t, g, unknown or other
  misc_feature (239)..(245): n is a, c, g, or t

SEQ ID NO: 80743 - DNA, 668 bp, Homo sapiens
  misc_feature: GYAE6OF02JVH13.44.25.C03.1.454.CMB.1.raw
tcagacagtatatacacgaccggtgctcgatttagtagtgtagatttgggtttgggggactcctgtgccccaccatggacactctttgctacacactcctgctgctgaccaccccttcctgggtcttgtcccaggtcaccttgaaggagtctggtcctgtgctggtgaaacccacagagaccctcacgctgacctgcaccatctctgggttctctctcaacgatattagaatgggtgtgagctggatccgtcacgccccgagggaagccctggagtggcttgcacacatcttctcgaatgaacgtaaaaatcctaacagtacatctctagaagagactaagttaaccatcctaccaaacggaccaaccctaacgaaaaggactagggttagtactttagtacgtacgaaccaactacgtacggaccctaggaccgaacaacgacggcaactatacttacgtgtacgacgaacgggttaatacgggaacgggaaaagaacgaggtacgttaggttttacgtaaggttaactttaaagttaaacgttaccgttaaacctagttaccgttacgggtaaccgttcggtacgggggtaactaaacggggaacccttacgggtacccgtacccgttccgtcccgtacgtacggttacccttacccgtaacccgg

SEQ ID NO: 80744 - DNA, 499 bp, Homo sapiens
  misc_feature: GYAE6OF02HVIUB.44.25.C03.1.454.CMB.1.raw
  modified_base (148)..(148): a, c, t, g, unknown or other
  misc_feature (148)..(148): n is a, c, g, or t
  modified_base (236)..(238): a, c, t, g, unknown or other
  misc_feature (236)..(238): n is a, c, g, or t
  modified_base (240)..(241): a, c, t, g, unknown or other
  misc_feature (240)..(241): n is a, c, g, or t
  modified_base (244)..(245): a, c, t, g, unknown or other
  misc_feature (244)..(245): n is a, c, g, or t
  modified_base (249)..(249): a, c, t, g, unknown or other
  misc_feature (249)..(249): n is a, c, g, or t
  modified_base (251)..(251): a, c, t, g, unknown or other
  misc_feature (251)..(251): n is a, c, g, or t
  modified_base (258)..(258): a, c, t, g, unknown or other
  misc_feature (258)..(258): n is a, c, g, or t
  modified_base (269)..(269): a, c, t, g, unknown or other
  misc_feature (269)..(269): n is a, c, g, or t
  modified_base (275)..(275): a, c, t, g, unknown or other
  misc_feature (275)..(275): n is a, c, g, or t
  modified_base (291)..(291): a, c, t, g, unknown or other
  misc_feature (291)..(291): n is a, c, g, or t
  modified_base (294)..(294): a, c, t, g, unknown or other
  misc_feature (294)..(294): n is a, c, g, or t
  modified_base (304)..(304): a, c, t, g, unknown or other
  misc_feature (304)..(304): n is a, c, g, or t
  modified_base (312)..(312): a, c, t, g, unknown or other
  misc_feature (312)..(312): n is a, c, g, or t
  modified_base (314)..(314): a, c, t, g, unknown or other
  misc_feature (314)..(314): n is a, c, g, or t
  modified_base (316)..(316): a, c, t, g, unknown or other
  misc_feature (316)..(316): n is a, c, g, or t
  modified_base (334)..(334): a, c, t, g, unknown or other
  misc_feature (334)..(334): n is a, c, g, or t
  modified_base (336)..(336): a, c, t, g, unknown or other
  misc_feature (336)..(336): n is a, c, g, or t
  modified_base (338)..(338): a, c, t, g, unknown or other
  misc_feature (338)..(338): n is a, c, g, or t
  modified_base (343)..(343): a, c, t, g, unknown or other
  misc_feature (343)..(343): n is a, c, g, or t
  modified_base (353)..(353): a, c, t, g, unknown or other
  misc_feature (353)..(353): n is a, c, g, or t
  modified_base (355)..(355): a, c, t, g, unknown or other
  misc_feature (355)..(355): n is a, c, g, or t
  modified_base (360)..(360): a, c, t, g, unknown or other
  misc_feature (360)..(360): n is a, c, g, or t
  modified_base (367)..(367): a, c, t, g, unknown or other
  misc_feature (367)..(367): n is a, c, g, or t
tcagacagtatatacacgaccggtgctcgatttagtagtgtagatttgggtttgggtgtccctaaggctagcgtggagggcacgggtcaccgtctacctcagcttccaccaagggcccagtcgtcttccctggcgcctgctccaggancacctcgtggggcacgaggcggcctgggctgcctggtcaaggctacttccacgtctactgctgacgcgggctggacaaggcacatagnnncnncannctancncatagancatgctgacangaacgnatacacaatctattgngcncactcgcgcncgcacgantngngcgcgtcgcgcactctcncncncacanacgacgcgcncncgcgnagagcgngtatatatatacactactatatactactactacgtcgtacgtacgtacgacgacgacgacgtagtacgtagtacgtacgtacgtacgtacgtacgtacgacgtacgtacgtacgtcgtactacgtacgtacg

SEQ ID NO: 80745 - DNA, 270 bp, Homo sapiens
  misc_feature: GYAE6OF02HYSGA.44.25.C03.1.454.CMB.1.raw
  modified_base (263)..(270): a, c, t, g, unknown or other
  misc_feature (263)..(270): n is a, c, g, or t
tcagacagtatatacacgaccggtgctcgatttagtagtgtagatttgggtttgggggaagaggaagactgacggtcctcccaggagttcaggtgctgggcaccttgggcacgggggaggtgtgtcacaagatttgggctctgggcaccgtgggcatgggggagtgtgtcacaagatttgggctctgggcacagcggccctgggctgcctggtcaaggactacttccacgtctactgctgagcgggctggcaaggcgcatagnnnnnnnn

SEQ ID NO: 80746 - DNA, 244 bp, Homo sapiens
  misc_feature: GYAE6OF02GDKK8.44.25.C03.1.454.CMB.1.raw
  modified_base (239)..(244): a, c, t, g, unknown or other
  misc_feature (239)..(244): n is a, c, g, or t
tcagacagtatatacacgaccggtgctcgatttagtagtgtagatttgggtttgggtgcccaagctgctggagggcacggtcaccacggtcaccgtctcctcagcttccaccaagggcccatcggtcttccccctggcgccctgctccaggagcacctctgggggcacagcggtcctgggctgcctggtcaaggactacttcctatatactgtctgagcgggctggcaaggcgcatagnnnnnn

SEQ ID NO: 80747 - DNA, 240 bp, Homo sapiens; identical to SEQ ID NO: 79965
  misc_feature: GYAE6OF02FU09Z.44.25.C03.1.454.CMB.1.raw
  modified_base (239)..(240): a, c, t, g, unknown or other
  misc_feature (239)..(240): n is a, c, g, or t

SEQ ID NO: 80748 - DNA, 293 bp, Homo sapiens
  misc_feature: GYAE6OF02J36T0.44.25.C03.1.454.CMB.1.raw
  modified_base (271)..(293): a, c, t, g, unknown or other
  misc_feature (271)..(293): n is a, c, g, or t
tcagacagtatatacacgaccggtgctcgatttagtagtgtagatttgggtttgggtgcccaagctgctggagggcacggtcaccacggtcaccgtctcctcagctccaccgaagggcccatccggtccttcccccgtggccgccctgcctccgaggcgccaccgtcggtgggggccacgcggccggcccgtgggctcggccgtggtacaacggtacctacttcctatactcgtgtcgtggcggcgggtcgtggacgaacggccacagtgnnnnnnnnnnnnnnnnnnnnnnn

SEQ ID NO: 80749 - DNA, 715 bp, Homo sapiens
  misc_feature: GYAE6OF02HNKVE.44.25.C03.1.454.CMB.1.raw
tcagacagtatatacacgaccggtgctcgatttagtagtgtagatttgggtttgggggacgcctagttcggccgggggggcccctaagactctcctgtctcgtctctgaacccacctttagcagctactggatgcactgggtccgccaagctccaggaaagggcctgatgtgggtctcacgtattaacaccgatgggactatcactggtactcagacgccgtgaagggccgattcatcatctccagagacaatgtacgaaaaacacggtgtaatttaacaaaatgaaacagtactaagagtacgagacacggctgtctactattgtgtgagaccttatgattttcgacttgggggagttatcgtttcgggcccacgaccgtggggccaggggaacctttgggtccgttcggtacttcctctaacggtctttacccgaaaccaacggggcccctacgttacccggttccctttccccccgttcgggtcccgtccccgtcgacccttccgacgggacgccacccgttccgtacgggggccaaccgaacggccgggtacccgtcggggccgttacggtcccgttacgggtaccgtaaaacgggtacccgttaacctttacccgttaattaacgttacgttacggttaccgtacggtacggtaccgggggtccgtacgggtaaccgaacggggaccgtaccgaacgttaagggctagcg

SEQ ID NO: 80750 - DNA, 235 bp, Homo sapiens
  misc_feature: GYAE6OF02G760I.44.25.C03.1.454.CMB.1.raw
  modified_base (230)..(235): a, c, t, g, unknown or other
  misc_feature (230)..(235): n is a, c, g, or t
tcagacagtatatacacgaccggtgctcgatttagtagtgtagatttgggtttgggtgcccaagctgctggagggcacggtcaccgtctcctcagcttccaccaagggcccatcggtcttccccctggcgccctgctccaggagcacctctgggggcacagcggccctgggctgcctggtcaaggactacttcctcgatcgcgtctgagcgggctggcaaggcgcatagnnnnnn

SEQ ID NO: 80751 - DNA, 541 bp, Homo sapiens
  misc_feature: GYAE6OF02HVLDJ.44.25.C03.1.454.CMB.1.raw
  modified_base (259)..(259): a, c, t, g, unknown or other
  misc_feature (259)..(259): n is a, c, g, or t
  modified_base (308)..(308): a, c, t, g, unknown or other
  misc_feature (308)..(308): n is a, c, g, or t
  modified_base (328)..(328): a, c, t, g, unknown or other
  misc_feature (328)..(328): n is a, c, g, or t
  modified_base (340)..(340): a, c, t, g, unknown or other
  misc_feature (340)..(340): n is a, c, g, or t
  modified_base (515)..(516): a, c, t, g, unknown or other
  misc_feature (515)..(516): n is a, c, g, or t
  modified_base (518)..(541): a, c, t, g, unknown or other
  misc_feature (518)..(541): n is a, c, g, or t
tcagacagtatatacacgaccggtgctcgatttagtagtgtagatttggggtttgggggctgttcctggaaggtgttggtaccagagggtcaccatctcctgcactgggagcagatccaacatcgggacagattctgatgtccactggtaccaacaccttccaggaacacgcccccaaactcctcatctttggtaaacaaactatccggccctcgacggggtcccctgaccgattctctggctccaagtctggcacctnagccctccctggccatcacgtgggcctccaggctagaagatggagggtnatttatactgccagtcctangacagcagcctnaggttgggttggttgtcgggcggaacggacaagtctcgaccgtccgtgggaccacgacccaagggcctcccgcccccgtcggtccaacgttccgtccggttcccccgccctccctattaagtacttacgtcgtctggacggtccgggctcgggacgtaagggccacaacgtagcnncnnnnnnnnnnnnnnnnnnnnnnnn

SEQ ID NO: 80752 - DNA, 505 bp, Homo sapiens
  misc_feature: GYAE6OF02FF3AD.44.25.C03.1.454.CMB.1.raw
  modified_base (480)..(480): a, c, t, g, unknown or other
  misc_feature (480)..(480): n is a, c, g, or t
  modified_base (485)..(485): a, c, t, g, unknown or other
  misc_feature (485)..(485): n is a, c, g, or t
  modified_base (488)..(505): a, c, t, g, unknown or other
  misc_feature (488)..(505): n is a, c, g, or t
tcagacagtatatacacgaccggtgctcgatttagtagtgtagatttgggtttgggggctgttcctggaaggtgttggtaccagagggtcaccatctcctgcactgggagcagatccaacatcgggacagattctgatgtccactggtaccaacaccttccaggaacagcccccaaactcctcatctttaggtaaacaactatccggccctcaggggtccctgaccgattctctggcctccaagtctggccacctcagccctccctggccatcactgggctccaggctgaagatgagggtgattattactgccagtcctatgacagcacgcctgagtgggttgggtgttcgggcggagggtaccaaggctacggacccgtccgtggggtcacggccccaaggcctccggcccccctggtccaccgttctcgttccccgccctcctctatactactgtctggacgcgggctggcaggcganatagnagnnnnnnnnnnnnnnnnnn

SEQ ID NO: 80753 - DNA, 245 bp, Homo sapiens; identical to SEQ ID NO: 80122
  misc_feature: GYAE6OF02IS25A.44.25.C03.1.454.CMB.1.raw
  modified_base (238)..(245): a, c, t, g, unknown or other
  misc_feature (238)..(245): n is a, c, g, or t

SEQ ID NO: 80754 - DNA, 764 bp, Homo sapiens
  misc_feature: GYAE6OF02HCHOL.44.25.C03.1.454.CMB.1.raw
  modified_base (722)..(722): a, c, t, g, unknown or other
  misc_feature (722)..(722): n is a, c, g, or t
  modified_base (733)..(733): a, c, t, g, unknown or other
  misc_feature (733)..(733): n is a, c, g, or t
  modified_base (735)..(735): a, c, t, g, unknown or other
  misc_feature (735)..(735): n is a, c, g, or t
  modified_base (739)..(739): a, c, t, g, unknown or other
  misc_feature (739)..(739): n is a, c, g, or t
  modified_base (742)..(742): a, c, t, g, unknown or other
  misc_feature (742)..(742): n is a, c, g, or t
  modified_base (751)..(751): a, c, t, g, unknown or other
  misc_feature (751)..(751): n is a, c, g, or t
  modified_base (755)..(756): a, c, t, g, unknown or other
  misc_feature (755)..(756): n is a, c, g, or t
  modified_base (758)..(758): a, c, t, g, unknown or other
  misc_feature (758)..(758): n is a, c, g, or t
  modified_base (760)..(760): a, c, t, g, unknown or other
  misc_feature (760)..(760): n is a, c, g, or t
  modified_base (762)..(763): a, c, t, g, unknown or other
  misc_feature (762)..(763): n is a, c, g, or t
tcagacagtatatacacgaccggtgctcgatttagtagtgtagatttgggtttgggctggatccgtcagccccagggaaggccctggagtggcttgcacacatcttctcgaatgacgaaaaatcctacagtacatctctgaagagcagtttaaccatctccaaggacacctccaaaaggcaggtggtctttagtatgaccaaactagtccggaccgtcggaccgaacacgacggacaactattaattacgtggtcgaccggtaacgggtaagtcgggaacgggaaaaacgaaacgacgtacgtttcggtttacgttaggttaatttaaagttaacgtttaccttaacctacgttcggtacgggttaccgtacgggttcggggaaacggtaaaccgggaccggtaccggtaccgaacccgttccttcctacgacgttccttaccgaaccggaacggaccctacggtccggtttccccttccccggtcggccccgtcccgtcgtacccgtaccggacggaccgacccgtaaccgtccggggtacggggacccaccggaccgggcccggtcccgggtcggggacccttccggtcccgggttacggtaaaccggaacggttaccctttacccgtccggtaaccgttaccgttacgttcgtcggttacgggccgggttccgggtcgtaccgggtaaaccgacggggcccgtaacttaaggacgggcncgtagcgtcgngngcgncgngcgcgcgcncgcnngncncnnc

SEQ ID NO: 80755 - DNA, 301 bp, Homo sapiens
  misc_feature: GYAE6OF02I3RTN.44.25.C03.1.454.CMB.1.raw
  modified_base (216)..(216): a, c, t, g, unknown or other
  misc_feature (216)..(216): n is a, c, g, or t
  modified_base (247)..(301): a, c, t, g, unknown or other
  misc_feature (247)..(301): n is a, c, g, or t
tcagacagtatatacacgaccggtgctcgatttagtagtgtagatttgggtttgggtgcccaagcctgcctggagggtcacggtctaccacggttcaccgtctcctcagcttccaccaagggcccatcggtcttcccctggcgtcccgtgctccaggagctacctctgggggcactaagcggccctgggctgccgtggtcaaggctacgttccatntacgtgtctgagcggctgggcaggcgcatgnnnnnnnnnnnnnnnnnnnnnnnnnnnnnnnnnnnnnnnnnnnnnnnnnnnnnnn

SEQ ID NO: 80756 - DNA, 465 bp, Homo sapiens
  misc_feature: GYAE6OF02G4QVO.44.25.C03.1.454.CMB.1.raw
  modified_base (419)..(419): a, c, t, g, unknown or other
  misc_feature (419)..(419): n is a, c, g, or t
  modified_base (451)..(465): a, c, t, g, unknown or other
  misc_feature (451)..(465): n is a, c, g, or t
tcagacagtatatacacgaccggtgctcgatttagtagtgtagatttgggtttgggggctgttcctggaaggtgttggtaccagagggtcaccatctcctgcactgggagcagatccaacatcgggacagattctgatgtccactggtaccaacaccttccaggaacagcccccaaactcctcatctttggtaacaactatcggccctcaggggtccctgaccgattctctggctccaagtctggcacctcagcctccctggccatcactggctccaggctgaagatgagggtgattattactgccagtcctatgacagcagcctcagtggttggtgttcggcggaggaccaagctgaccgtccgtggtcagcccaaggctcgcccctcggtcactctcgttccccgccctcctctatntactgtctgagcgggctggcaggcgcagtagnnnnnnnnnnnnnnn

SEQ ID NO: 80757 - DNA, 648 bp, Homo sapiens
  misc_feature: GYAE6OF02I9PLI.44.25.C03.1.454.CMB.1.raw
  modified_base (267)..(267): a, c, t, g, unknown or other
  misc_feature (267)..(267): n is a, c, g, or t
tcagacagtatatacacgaccggtgctcgatttagtagtgtagatttgggtttgggggacgcctagttcggccgggggggcccctaagactctcctgtctcgtctctgaacccacctttagcagctactggatgcactgggtccgccaagctccaggaaaggcctgatgtggtctcacgtattaacaccgatgggactatcactggttactcagacgccgtaggaacgggccgattcatcatctaccagagacaatgtacgaaaacncggttagtaattaacaaatagaacagtactaagagtcaagggtacacgggctaggtctactattgtgtgagaccttatgattttcactttgggggattagtcggtttggccctagactggggccaggggaaccttggtcgtcgtctcgtcagcttcgacctaagggcccaagtccggtcttccccgtggcctacccgtgcctccgaggacgccgaccgtcgtcggggaccacgacggccggtccgtagggcctcggccgttacgggtaccaaagggtacctaaccgttacccgaacgttcctacgtcgtaccgttagaccggtccgggtaccgttacgggaccgtaacgggtccggtaaccgtaacgtacggactacgacg

SEQ ID NO: 80758 - DNA, 456 bp, Homo sapiens
  misc_feature: GYAE6OF02HHVCK.44.25.C03.1.454.CMB.1.raw
  modified_base (272)..(272): a, c, t, g, unknown or other
  misc_feature (272)..(272): n is a, c, g, or t
  modified_base (441)..(441): a, c, t, g, unknown or other
  misc_feature (441)..(441): n is a, c, g, or t
  modified_base (443)..(456): a, c, t, g, unknown or other
  misc_feature (443)..(456): n is a, c, g, or t
tcagacagtatatacacgaccggtgctcgatttagtagtgtagatttgggtttggggggggcagagggtcaccatctcctgcactgggagcagatccaacatcgggacagattctgatgtccactggtaccaacaccttccaggaacagcccccaaatcctcatctttggtaacaactatcggccctcaggggtccctgaccgattctctggctccaagtctggcacctcagcctcctgccatcactgggctccaggctgaagatgagggtnattattactgcctagtcctatgacagcagcctcgagtggttgggtgttcgggcggagggaccaagctgaccgtcgtgggtcacgcccgaaggtcctcgccccctggtcacgttctcgttccccaccttctactatactactgtctggacgcgggctggacaggcgcagngnnnnnnnnnnnnnn

SEQ ID NO: 80759 - DNA, 479 bp, Homo sapiens
  misc_feature: GYAE6OF02H0PBM.44.25.C03.1.454.CMB.1.raw
  modified_base (286)..(286): a, c, t, g, unknown or other
  misc_feature (286)..(286): n is a, c, g, or t
  modified_base (293)..(293): a, c, t, g, unknown or other
  misc_feature (293)..(293): n is a, c, g, or t
  modified_base (346)..(346): a, c, t, g, unknown or other
  misc_feature (346)..(346): n is a, c, g, or t
  modified_base (368)..(368): a, c, t, g, unknown or other
  misc_feature (368)..(368): n is a, c, g, or t
  modified_base (456)..(479): a, c, t, g, unknown or other
  misc_feature (456)..(479): n is a, c, g, or t
tcagacagtatatacacgaccggtgctcgatttagtagtgtagatttgggtttgggggctgttcctggaaggtgttggtaccagagggtcaccatctcctgcactgggagcagatccaacatcgggacagattctgatgtccactggtaccaacaccttccaggaacagcccccaaactcctcatctttggtaacaactatcggccctcgacggggtccctgaccgattctcgtgctccaagtctggcacctcagcctcctgccatcactggctccagctagaagntgaggtnattattactgacctagtcctagtgacagcagcctgagttgggttggtgtcggnggacggaccagctgaccgtcgnggtcacgccaggctccgccctgtcactctctcccacctctactatctactgtctgacgtccgggctcggacgacggccgacgagtgcnnnnnnnnnnnnnnnnnnnnnnnn

SEQ ID NO: 80760 - DNA, 591 bp, Homo sapiens
  misc_feature: GYAE6OF02HACG6.44.25.C03.1.454.CMB.1.raw
  modified_base (356)..(356): a, c, t, g, unknown or other
  misc_feature (356)..(356): n is a, c, g, or t
tcagacagtatatacacgaccggtgctcgatttagtagtgtagatttgggtttggggagcttcagctgtgggtagagaagacaggactcaggacgatctccagcatggccagcttccctctcctcctcaccctcctcactcactgtgcagggtcctgggcccagtctgtgatgtctcagccaccctcagcgtctcgggacccccgggcagggggtcaccatctcttgttctggaaggagtccatatcggatcttatcctgtcaactggtatcgggactccgaggcaccggcccccgactccttatctatgctaactaatcagccggcctcgacggggtccctgcccgtattcctcnggtcctcaagtctggcacgtacacggctaccgtggacctacttccgttgacttcctccgtagtctacggagagtaggacggtctaggtaactttactacgtgtgcagcgtatgggatgacacggaccgggaacgtcgtaggggtcgttccgggacgggacggtaccgtaaggttccgaccggttccgtacgggactaccggaccgaacggtccgtacccgcccccgtggtacccg

SEQ ID NO: 80761 - DNA, 247 bp, Homo sapiens
  misc_feature: GYAE6OF02HGHP1.44.25.C03.1.454.CMB.1.raw
  modified_base (240)..(247): a, c, t, g, unknown or other
  misc_feature (240)..(247): n is a, c, g, or t
tcagacagtatatacacgaccggtgctcgatttagtagtgtagatttgggtttgggtgcccaagctgctggagggcacggtcaccacggtcaccgtctcctcagcttccaccaagggcccatcggtcttccccctggcgccctgctccaggagcacctcgtgggggcacaggcggccctgggctgcctggtcaaggactacttccacgtctactgctgagcggctggcaaggcgcatagnnnnnnnn

SEQ ID NO: 80762 - DNA, 240 bp, Homo sapiens
  misc_feature: GYAE6OF02I9SCN.44.25.C03.1.454.CMB.1.raw
  modified_base (233)..(240): a, c, t, g, unknown or other
  misc_feature (233)..(240): n is a, c, g, or t
tcagacagtatatacacgaccggtgctcgatttagtagtgtagattgggtttgggtgccaagctgctggagggcacggtcaccacggtcaccgtctcctcagcttccaccaagggcccatcggtcttcccctggcgccctgctccaggagcacctctggggcacagcggccctgggctgcctggtcaaggctacttccacgtctactgctgagcgggctggcaggcgcatagnnnnnnnn

SEQ ID NO: 80763 - DNA, 631 bp, Homo sapiens
  misc_feature: GYAE6OF02GSYUI.44.25.C03.1.454.CMB.1.raw
  modified_base (267)..(267): a, c, t, g, unknown or other
  misc_feature (267)..(267): n is a, c, g, or t
  modified_base (604)..(604): a, c, t, g, unknown or other
  misc_feature (604)..(604): n is a, c, g, or t
  modified_base (607)..(607): a, c, t, g, unknown or other
  misc_feature (607)..(607): n is a, c, g, or t
  modified_base (609)..(612): a, c, t, g, unknown or other
  misc_feature (609)..(612): n is a, c, g, or t
  modified_base (614)..(616): a, c, t, g, unknown or other
  misc_feature (614)..(616): n is a, c, g, or t
  modified_base (618)..(631): a, c, t, g, unknown or other
  misc_feature (618)..(631): n is a, c, g, or t
tcagacagtatatacacgaccggtgctcgatttagtagtgtagatttgggtttgggctggatccgtcagcccccagggaaggccctggagtggcttgcacacatcttctcgaatgacgaaaaatcctacagtacatctctgaagagcagtttaaccatctccaaggacacctccaaaaggcaggtggtctttagtatgaccaacatggaccctgcggacacaggcacatattactgtgcgacgggtaatcggacgggaaaagaaacnggcttggttttctagttatttataagttcttaaccattctggacgtcgtggggacaaaagggacccacggtccaaccgtcctcctacacgccttaccgaaccgaacgggccccaacgttccggtaccttccccccgtcggcccgtcccctgcctccgagggacgcctacccgtcggtcggggggaccaacgaccggcccgggtacccgtcggggtacctcgggccccgttagggtaccgtaaacgggtaccttaacccgttccccgaaccgttcctaaccgttcgcgtacggacgggtccgggcgtcgggcgtaaacggggccgacgaacgtacggncgngnnnngnnngnnnnnnnnnnnnnn

SEQ ID NO: 80764 - DNA, 162 bp, Homo sapiens
  misc_feature: GYAE6OF02GNM2E.44.25.C03.1.454.CMB.1.raw
  modified_base (131)..(162): a, c, t, g, unknown or other
  misc_feature (131)..(162): n is a, c, g, or t
tcagacagtatatacacgaccggtgctcgatttagtagtgtagatttgggtttgggcacggagcggccctgggctgcctggtcaaggctacttcctcgatcgcgtctgagcgggctggcaaggcgcatagnnnnnnnnnnnnnnnnnnnnnnnnnnnnnnnn

SEQ ID NO: 80765 - DNA, 241 bp, Homo sapiens
  misc_feature: GYAE6OF02HVSQL.44.25.C03.1.454.CMB.1.raw
  modified_base (218)..(241): a, c, t, g, unknown or other
  misc_feature (218)..(241): n is a, c, g, or t
tcagacagtatatacacgaccggtgctcgatttagtagtgtagatttgggtttgggggaagaggaagactgacggtcctcccaggagttcaggtgctgggcaccttgggcacgggggagtgtgtcacaagatttgggctctggcacagcggccctgggctgcctggtacaaggactacttcctatatactgtctgagcgggctggcaaggcgcatagnnnnnnnnnnnnnnnnnnnnnnnn

SEQ ID NO: 80766 - DNA, 247 bp, Homo sapiens
  misc_feature: GYAE6OF02FX44V.44.25.C03.1.454.CMB.1.raw
  modified_base (239)..(247): a, c, t, g, unknown or other
  misc_feature (239)..(247): n is a, c, g, or t
tcagacagtatatacacgaccggtgctcgatttagtagtgtagatttgggtttgggtgcccaagctgctggagggcacggtcaccacggtcaccgtctcctcagcttccaccaagggcccatcggtcttccccctggcgccctgctccaggagcacctctgggggcacagcggccctgggctgcctggtcaaggactacttcctatatactgtctgagcgggctggcaaggcgcatagnnnnnnnnn

SEQ ID NO: 80767 - DNA, 641 bp, Homo sapiens
  misc_feature: GYAE6OF02HTS80.44.25.C03.1.454.CMB.1.raw
  modified_base (261)..(261): a, c, t, g, unknown or other
  misc_feature (261)..(261): n is a, c, g, or t
  modified_base (265)..(265): a, c, t, g, unknown or other
  misc_feature (265)..(265): n is a, c, g, or t
  modified_base (286)..(286): a, c, t, g, unknown or other
  misc_feature (286)..(286): n is a, c, g, or t
  modified_base (294)..(294): a, c, t, g, unknown or other
  misc_feature (294)..(294): n is a, c, g, or t
  modified_base (572)..(572): a, c, t, g, unknown or other
  misc_feature (572)..(572): n is a, c, g, or t
  modified_base (576)..(576): a, c, t, g, unknown or other
  misc_feature (576)..(576): n is a, c, g, or t
  modified_base (584)..(584): a, c, t, g, unknown or other
  misc_feature (584)..(584): n is a, c, g, or t
  modified_base (618)..(618): a, c, t, g, unknown or other
  misc_feature (618)..(618): n is a, c, g, or t
  modified_base (637)..(637): a, c, t, g, unknown or other
  misc_feature (637)..(637): n is a, c, g, or t
tcagacagtatatacacgaccggtgctcgatttagtagtgtagatttgggtttgggggctgttcctggaaggtgttggtaccagagggtcaccatctcctgcactgggagcagatccaacatcgggacagattctgatgtccactggttaccaacaccttccaggtaacacgcccccaaactcctcatctttaggaaccaactatcggccctcgaggggtccctgaccgattctctggctcaagtctgcactcagcctccngccntcactggcctcaggctagagntggaggtnatttatacgtgacctagtcctagtacgacagtcgagtccctagtaggttgggttaggggtcgttccggggacgggtaacgggaccctaaggtcctaggtacccgttcgttgggtaccacggacccgtaaggcctcccgggcccccgtacggtccctaccgttcccgtttcggttaccccccgtccccttaccgttaccgttaattaacccgttacgtcgtacgtcggtaacggtcggggtaccgttcgggaccgtaacgggccgtaacgtagtacggntagngcgtacgngactacgacgtcgagagagcgtacgcgtctcgtntcgtacgtatcgacgtcgngacg

SEQ ID NO: 80768 - DNA, 226 bp, Homo sapiens; identical to SEQ ID NO: 80228
  misc_feature: GYAE6OF02GKN57.44.25.C03.1.454.CMB.1.raw
  modified_base (219)..(226): a, c, t, g, unknown or other
  misc_feature (219)..(226): n is a, c, g, or t

SEQ ID NO: 80769 - DNA, 682 bp, Homo sapiens
  misc_feature: GYAE6OF02IKKTB.44.25.C03.1.454.CMB.1.raw
tcagacagtatatacacgaccggtgctcgatttagtagtgtagatttgggtttgggggactcctgtgccccaccatggacactctttgctacacactcctgctgctgaccaccccttcctgggtcttgtcccaggtcaccttgaaggagtctggtcctgtgctggtgaaacccacagagaccctcacgctgacctgcacatctctgggttctctctcaacgatattagaagtgggtgtgagctgggactccgtcacgccccgagggaacggcccgtggagtggcttgcacacatcttctcgaatagaacgtaaaaatcctacagtacatctactagaagacgcaacgttttaaccatacctaccgaaaggtaaccaacccttaaccgaaaacggtcgtaagggttacggttacgtttaagtacgtacgaaccaaacgtacgtaccggacccgttaggaccggaacaaccgaggacaactattaactttacgtgtacgtacgaacgggtaagtcggaacgggaaaagaaacaggttaccttcggtttacgttagttactttaagttaaacgttccttaaaccgtagttccgtagggtacgtcggtcgggggaaacgaacgggacccgtacgggtaccctacccggttacctccgttacgacgttccccgtaccgtaaacccgg

SEQ ID NO: 80770 - DNA, 467 bp, Homo sapiens
  misc_feature: GYAE6OF02GSZP2.44.25.C03.1.454.CMB.1.raw
  modified_base (456)..(467): a, c, t, g, unknown or other
  misc_feature (456)..(467): n is a, c, g, or t
tcagacagtatatacacgaccggtgctcgatttagtagtgtagatttgggtttgggggctgttcctggaaggtgttggtaccagagggtcaccatctcctgcactgggagcagatccaacatcgggacagattctgatgtccactggtaccaacaccttccaggaacagccccccaaaactcctcatctttggtaacaactatcggccctcaggggtccctgaccgattctctggctccaagtctggcacctcagccctccctggccatcactgggctccaggctgaagatgagggtgattattactgccagtcctatgacagcagcctcagtggttggtgttcggcggaggaccaagctgaccgtctggtcacgcccaaggctcgccccctggtccactctcgttcccgccctcctctatatactgtctgacgcggcgtggcaaggcgcagtagnnnnnnnnnnnn

SEQ ID NO: 80771 - DNA, 497 bp, Homo sapiens
  misc_feature: GYAE6OF02HZ3JD.44.25.C03.1.454.CMB.1.raw
  modified_base (341)..(341): a, c, t, g, unknown or other
  misc_feature (341)..(341): n is a, c, g, or t
  modified_base (366)..(366): a, c, t, g, unknown or other
  misc_feature (366)..(366): n is a, c, g, or t
  modified_base (470)..(470): a, c, t, g, unknown or other
  misc_feature (470)..(470): n is a, c, g, or t
  modified_base (475)..(497): a, c, t, g, unknown or other
  misc_feature (475)..(497): n is a, c, g, or t
tcagacagtatatacacgaccggtgctcgatttagtagtgtagatttgggtttgggggctgttcctggaaggtgttggtaccagagggtcaccatctcctgcactgggagcagatccaacatcgggacagattctgatgtccactggtaccaacaccttccaggaacacgcccccaaatcctcatctttggaacaactatcggccctcaggggtccctgaccgattctctggctccaagtctggcacctcagcctccctggccatcactggctcaggctgaagatgaggtgattattactgccagtcctatgacagcagcctcagtggttgggtgttcggnggtaggaccaagctcgaccgtccgngggtcacgtcccgaaaggcctcgcccccgtggtcctacgtcctcgttccccaccctccctctactatactgtctgacgcggctcggcgaacggcgactagtagnctgcnnnnnnnnnnnnnnnnnnnnnnn

SEQ ID NO: 80772 - DNA, 679 bp, Homo sapiens
  misc_feature: GYAE6OF02JX6F9.44.25.C03.1.454.CMB.1.raw
  modified_base (298)..(298): a, c, t, g, unknown or other
  misc_feature (298)..(298): n is a, c, g, or t
  modified_base (343)..(343): a, c, t, g, unknown or other
  misc_feature (343)..(343): n is a, c, g, or t
tcagacagtatatacacgaccggtgctcgatttagtagtgtagatttgggtttgggggtacgtcctgtgccccaccactggacactctttgctacacactcctgctgctgaccacccttcctggtcttgtcccaggtcaccttgaaggagtctggtcctgtgctggttcgaaacccacagtagaccctcacgctgacctgcaccatctcgtggttctcgtcgtcaacgatattagaagtgggtgtcgagctggctccgtcacgccccagggtacgccctggagtggcttcgcacgatntcgttctcatgaacgtaaaatccgaactagtacagtctgtgagancgtagtttaaccagtccacgtaagacctaacctacaaagcgtaagtcggtactttagtacttacggaacctaacgacgttaccggaccctacgtacggaaccaccgaggtcaaccgttagtaattaaccgtcgtactacgtaacggtacgaggtaacggaaaccgtaaacggaacgtcgttacggttttaccgtagttaagttttaaacgaaccgtttacgtaaccttaatccggtacggttaaacggttccgaacgggtaaccggtaacgggtccccgttagtacccggaaggttcccttaacctccggtacgttcccgtacccgtaaacccggg

SEQ ID NO: 80773 - DNA, 304 bp, Homo sapiens
  misc_feature: GYAE6OF02HKN77.44.25.C03.1.454.CMB.1.raw
  modified_base (295)..(304): a, c, t, g, unknown or other
  misc_feature (295)..(304): n is a, c, g, or t
tcagacagtatatacacgaccggtgctcgatttagtagtgtagatttgggtttgggggtgtggtggtctccactcccgccttgacggggctgctatctgcctccctggccatcactgggctccaggctgaagatgagggtgattattactgccagtcctatgacagcagcctcagtggttgggtgttcggcggagggaccaagctgaccgtctgggtcagcccaaggctgccccctggtcactctgttcccaccctctctatatactgtctgagcgggctggcaaggcgcatagnnnnnnnnnn

SEQ ID NO: 80774 - DNA, 541 bp, Homo sapiens
  misc_feature: GYAE6OF02JT9C6.44.25.C03.1.454.CMB.1.raw
  modified_base (158)..(158): a, c, t, g, unknown or other
  misc_feature (158)..(158): n is a, c, g, or t
  modified_base (241)..(243): a, c, t, g, unknown or other
  misc_feature (241)..(243): n is a, c, g, or t
  modified_base (246)..(246): a, c, t, g, unknown or other
  misc_feature (246)..(246): n is a, c, g, or t
  modified_base (249)..(249): a, c, t, g, unknown or other
  misc_feature (249)..(249): n is a, c, g, or t
  modified_base (251)..(251): a, c, t, g, unknown or other
  misc_feature (251)..(251): n is a, c, g, or t
  modified_base (253)..(253): a, c, t, g, unknown or other
  misc_feature (253)..(253): n is a, c, g, or t
  modified_base (258)..(258): a, c, t, g, unknown or other
  misc_feature (258)..(258): n is a, c, g, or t
  modified_base (261)..(262): a, c, t, g, unknown or other
  misc_feature (261)..(262): n is a, c, g, or t
  modified_base (264)..(264): a, c, t, g, unknown or other
  misc_feature (264)..(264): n is a, c, g, or t
  modified_base (267)..(268): a, c, t, g, unknown or other
  misc_feature (267)..(268): n is a, c, g, or t
  modified_base (271)..(271): a, c, t, g, unknown or other
  misc_feature (271)..(271): n is a, c, g, or t
  modified_base (276)..(277): a, c, t, g, unknown or other
  misc_feature (276)..(277): n is a, c, g, or t
  modified_base (289)..(289): a, c, t, g, unknown or other
  misc_feature (289)..(289): n is a, c, g, or t
  modified_base (295)..(295): a, c, t, g, unknown or other
  misc_feature (295)..(295): n is a, c, g, or t
  modified_base (312)..(312): a, c, t, g, unknown or other
  misc_feature (312)..(312): n is a, c, g, or t
  modified_base (317)..(317): a, c, t, g, unknown or other
  misc_feature (317)..(317): n is a, c, g, or t
  modified_base (322)..(322): a, c, t, g, unknown or other
  misc_feature (322)..(322): n is a, c, g, or t
tcagacagtatatacacgaccggtgctcgatttagtagtgtagatttgggtttgggtgcccaagctgctggagggcacggtcaccaacggtcaccgtctcctcagcttccaccaagggcccatcggtctcccctggcgccctgctcaggagcacctcnggggcacagcggccctggcctgcctggtcaagggactacttcctatatacgtgtctggagcgggctggcaaggcgcatagctnnnagntangntnactangannangtnngangctannagagagcgagtnagagtnttacgcgacattccgangtganagacnacgacgacgacgtagagtcactactacgtacacacacgacgtacgacacgacacacacgtacgagtagtacgtacgacgtacgtacgacgacgtacgtacgtagtacgtagtacgtacgtagtacgtacgtagtacgtagtacgtacgtaccgtacggtaacgtacgtacgtacggtacgtacgtacgtacgtacgtacgtacgtacggtacggtacgg

SEQ ID NO: 80775 - DNA, 826 bp, Homo sapiens
  misc_feature: GYAE6OF02JA1BR.44.25.C03.1.454.CMB.1.raw
  modified_base (244)..(244): a, c, t, g, unknown or other
  misc_feature (244)..(244): n is a, c, g, or t
tcagacagtatatacacgaccggtgctcgatttagtagtgtagatttgggtttgggggcttcagctgtgggcacaagaggcagcactcaggacaatctccagcatggcctggtctcctctcctcctcactctcctcgctcactgcacagggtcctgggcccactctgtgctgacgcagccgccctcagtcgtcgtcgggggccccgggcaggacgggtccaccatccgtcctgcacgtgggacncagactccaacagtccgggacagtacttcgtagactcgtacccacgtacggtaacccaacctccgttaccgaaggaaccaccgaccccctaaactccctacacttcgttacggtaaactaactcgtccgcctcggacgggtccctgaaccgtactttccgtcgtacggtcctaccgaacgttcctacgggcctaaccctcgaaccgtccccgttacccgtcggacccctacgttacccgtaaccggttccgggtacccttaccggaacggggttcctaacgggtaaacggttacggttacgggtaacggggttaccgtttaaacgtttaaccgtttaccgttaccgggtaacccgttaaccggttttaacccgttaaaggtaaccgggttaaccgtaacgggttaccctaaaccggttcccgttaaccgggttaaggggttttaccgggggtttcggggtttaccggggtttacccgggaacggggtaaacccggggtaacccgttaaacgggttcccggttaaccgggttaccccggtttacccggggttacgggttacccgaacccgggttaaccccggg

SEQ ID NO: 80776 - DNA, 258 bp, Homo sapiens
  misc_feature: GYAE6OF02GK0TG.44.25.C03.1.454.CMB.1.raw
  modified_base (220)..(258): a, c, t, g, unknown or other
  misc_feature (220)..(258): n is a, c, g, or t
tcagacagtatatacacgaccggtgctcgatttagtagtgtagatttgggtttggggggaagaggaagactgacggtcctcccaggagttcaggtgctgggcaccttgggcacgggggaggtgtgtcacaagatttgggctctgggcacagcggccctgggctgcctggtcaaggactacttcctaatatactgtctgagcgggctggcaaggcgcatgnnnnnnnnnnnnnnnnnnnnnnnnnnnnnnnnnnnnnnn

SEQ ID NO: 80777 - DNA, 243 bp, Homo sapiens
  misc_feature: GYAE6OF02F5M47.44.25.C03.1.454.CMB.1.raw
  modified_base (238)..(243): a, c, t, g, unknown or other
  misc_feature (238)..(243): n is a, c, g, or t
tcagacagtatatacacgaccggtgctcgatttagtagtgtagatttgggtttgggtgcccaagctgctggagggcacggtcaccacggtcaccgtctcctcagcttccaccaagggcccatcggtcttcccctggcgccctgctccaggagcacctccgagagcacagcggccctgggctgcctggtcaaggactacttccacgtctactgctgagcgggctggcaaggcgcatagnnnnnn

SEQ ID NO: 80778 - DNA, 223 bp, Homo sapiens; identical to SEQ ID NO: 80562
  misc_feature: GYAE6OF02HZBOZ.44.25.C03.1.454.CMB.1.raw
  modified_base (219)..(223): a, c, t, g, unknown or other
  misc_feature (219)..(223): n is a, c, g, or t

SEQ ID NO: 80779 - DNA, 248 bp, Homo sapiens
  misc_feature: GYAE6OF02HB7PF.44.25.C03.1.454.CMB.1.raw
  modified_base (238)..(248): a, c, t, g, unknown or other
  misc_feature (238)..(248): n is a, c, g, or t
tcagacagtatatacacgaccggtgctcgatttagtagtgtagatttgggtttgggtgcccaagctgctggagggcacggtcaccacggtcaccgtctcctcagcttccaccaagggcccatcggtcttcccctggcgccctgctccaggagcacctctgggggcacagcggccctgggctgcctggtcaaggactacttccacgtctactgctgagcgggctggcaaggcgcatagnnnnnnnnnnn

SEQ ID NO: 80780 - DNA, 624 bp, Homo sapiens
  misc_feature: GYAE6OF02JECEU.44.25.C03.1.454.CMB.1.raw
  modified_base (222)..(222): a, c, t, g, unknown or other
  misc_feature (222)..(222): n is a, c, g, or t
  modified_base (438)..(438): a, c, t, g, unknown or other
  misc_feature (438)..(438): n is a, c, g, or t
tcagacagtatatacacgaccggtgctcgatttagtagtgtagatttgggtttgggggggcacaagaggcagcactcaggacaatctccagcatggcctggtctcctctcctcctcactctcctcgctcactgcacagggtcctgggcccactctgtgctgacgcagccgccctcagtgtctggggccccgggcagagggtcaccatctcctgcactgggancagatccaacagtcgggacagattctgatgtccactcggtaccaacaccttcaggaacacgacccccaaactcctctatctttaggtaaacaactatccggccctcgacgggtccctgaccgtattccgtctcggcctaccaacgttcgtcggcctacctcacgtccctcccgcggccatccacgtcgggcctccgaggctagaagagtggaggtntaattacttacgtcgtaccacgttcctagtcgaacacgactacgccttacgtacggttggggttcggttggttccgggacgggtacgggaccgtaacggtccgttacggtacccggttccggtacgggttaccgaccggtaccccgaaagggttcccctccgggtaccccccgttgggtaaccccg

SEQ ID NO: 80781 - DNA, 274 bp, Homo sapiens
  misc_feature: GYAE6OF02HUNGE.44.25.C03.1.454.CMB.1.raw
  modified_base (266)..(274): a, c, t, g, unknown or other
  misc_feature (266)..(274): n is a, c, g, or t
tcagacagtatatacacgaccggtgctcgatttagtagtgtagatttgggtttggggggaagaggaagactgacggtcctcccaggagttcaggtgctgggcaccttgggcacgggggaggtgtgtcacaagatttgggctctgggcaccgtgggcagtgggggagtgtgtcacaagatttgggctctgggcacagcggccctgggctgcctggtcaaggactacttcctatatactgtctgagcgggctggcaaggcgtcatagnnnnnnnnn

SEQ ID NO: 80782 - DNA, 228 bp, Homo sapiens
  misc_feature: GYAE6OF02GTU0U.44.25.C03.1.454.CMB.1.raw
  modified_base (163)..(163): a, c, t, g, unknown or other
  misc_feature (163)..(163): n is a, c, g, or t
  modified_base (166)..(228): a, c, t, g, unknown or other
  misc_feature (166)..(228): n is a, c, g, or t
tcagacagtatatacacgaccggtgctcgatttagtagtgtagatttgggtttgggggagggtgtgttcacaagatttgggctctgggcacagcggccctgggctgcctggtcaaggactacttccacgtctactgctgagcgggctggcaaggcgcataagncannnnnnnnnnnnnnnnnnnnnnnnnnnnnnnnnnnnnnnnnnnnnnnnnnnnnnnnnnnnnnn

SEQ ID NO: 80783 - DNA, 527 bp, Homo sapiens
  misc_feature: GYAE6OF02IT5M2.44.25.C03.1.454.CMB.1.raw
  modified_base (506)..(506): a, c, t, g, unknown or other
  misc_feature (506)..(506): n is a, c, g, or t
  modified_base (508)..(527): a, c, t, g, unknown or other
  misc_feature (508)..(527): n is a, c, g, or t
tcagacagtatatacacgaccggtgctcgatttagtagtgtagatttgggtttgggggctgttcctggaaggtgttggtaccagagggtcaccatctcctgcactgggagcagatccaacatcgggacagattctgatgtccactggtaccaacaccttccaggaacagcccccaaactcctcatctttggtaacaactatcggccctcaggggtccctgacccgattcctctggctccaagtctggcaccctcagccctcctggccatcactgggctccaggctgaagatgagggtgattattactgccagtcctatgacagcagcctcaggtggttggggtgttcgggcgggtaacgggaccaaggtccgtggaacccgtccgtgggtcacgcccgaaggcctacgccccccgtcggtccaccgtcctcgttccccgccccgtcccttcctaatacttctcgtcctcggacggtccgggcgtggcgtaacgggcgacgagtagntnnnnnnnnnnnnnnnnnnnn

SEQ ID NO: 80784 - DNA, 706 bp, Homo sapiens
  misc_feature: GYAE6OF02G0IOQ.44.25.C03.1.454.CMB.1.raw
tcagacagtatatacacgaccggtgctcgatttagtagtgtagatttgggtttgggggactcctgtgccccaccatggacactctttgctacacactcctgctgctgaccaccccttcctgggtcttgtcccaggtcaccttgaaggagtctggtcctgtgctggtgaaacccacagagaccctcacgctgacctgcaccatctctgggttctctctcaacgatattagaatgggtgtgagcgtggatccgtcacgccccgagggaaggcccctggagtggcttggcacgacatcttctcgaatgaacgaaaaatcctaacagtacatctctagaagagctaagtttaaccatactaccaaaggacacctaccaaaaggcgaaggtggttactttaagtatacgtaacccaaacgacgtacggaaccctcggaccggtaacaaccgtagggaccaactattaacttaactggtacgacgtaaaccggggttaatcgggtaaccggggaaaaagaaacgtaggtaccggttttacgggtttacttaggttaaagtttaagttaaacggttactttaaaccgagttaccggttgggtaaccggttcgggtaacgggggtaaccaaaacgggggtacccctaaccgggtccctaacccgggttccctccgttacccggaacgttccccgttaccccgaaaaccccgggg

SEQ ID NO: 80785 - DNA, 245 bp, Homo sapiens
  misc_feature: GYAE6OF02GZ4TX.44.25.C03.1.454.CMB.1.raw
  modified_base (237)..(245): a, c, t, g, unknown or other
  misc_feature (237)..(245): n is a, c, g, or t
tcagacagtatatacacgaccggtgctcgatttagtagtgtagatttgggtttgggtgcccaagctgctggagggcacggtcaccacggtcaccgtctcctcagcttccaccaaggcccatcggtcttcccctggcgccctgctccaggagcacctctgggggcacagcggccctgggctgcctggtcaaggactacttcctatatactgtctgagcgggctggcaaggcgcatagnnnnnnnnn

SEQ ID NO: 80786 - DNA, 499 bp, Homo sapiens
  misc_feature: GYAE6OF02FG612.44.25.C03.1.454.CMB.1.raw
  modified_base (219)..(219): a, c, t, g, unknown or other
  misc_feature (219)..(219): n is a, c, g, or t
  modified_base (262)..(262): a, c, t, g, unknown or other
  misc_feature (262)..(262): n is a, c, g, or t
  modified_base (264)..(264): a, c, t, g, unknown or other
  misc_feature (264)..(264): n is a, c, g, or t
  modified_base (271)..(271): a, c, t, g, unknown or other
  misc_feature (271)..(271): n is a, c, g, or t
  modified_base (279)..(279): a, c, t, g, unknown or other
  misc_feature (279)..(279): n is a, c, g, or t
  modified_base (282)..(282): a, c, t, g, unknown or other
  misc_feature (282)..(282): n is a, c, g, or t
  modified_base (289)..(289): a, c, t, g, unknown or other
  misc_feature (289)..(289): n is a, c, g, or t
  modified_base (356)..(356): a, c, t, g, unknown or other
  misc_feature (356)..(356): n is a, c, g, or t
  modified_base (360)..(360): a, c, t, g, unknown or other
  misc_feature (360)..(360): n is a, c, g, or t
  modified_base (368)..(368): a, c, t, g, unknown or other
  misc_feature (368)..(368): n is a, c, g, or t
  modified_base (380)..(380): a, c, t, g, unknown or other
  misc_feature (380)..(380): n is a, c, g, or t
  modified_base (386)..(386): a, c, t, g, unknown or other
  misc_feature (386)..(386): n is a, c, g, or t
  modified_base (391)..(391): a, c, t, g, unknown or other
  misc_feature (391)..(391): n is a, c, g, or t
  modified_base (396)..(396): a, c, t, g, unknown or other
  misc_feature (396)..(396): n is a, c, g, or t
  modified_base (403)..(403): a, c, t, g, unknown or other
  misc_feature (403)..(403): n is a, c, g, or t
  modified_base (409)..(409): a, c, t, g, unknown or other
  misc_feature (409)..(409): n is a, c, g, or t
  modified_base (417)..(417): a, c, t, g, unknown or other
  misc_feature (417)..(417): n is a, c, g, or t
  modified_base (422)..(422): a, c, t, g, unknown or other
  misc_feature (422)..(422): n is a, c, g, or t
  modified_base (427)..(427): a, c, t, g, unknown or other
  misc_feature (427)..(427): n is a, c, g, or t
  modified_base (431)..(432): a, c, t, g, unknown or other
  misc_feature (431)..(432): n is a, c, g, or t
  modified_base (454)..(454): a, c, t, g, unknown or other
  misc_feature (454)..(454): n is a, c, g, or t
  modified_base (464)..(464): a, c, t, g, unknown or other
  misc_feature (464)..(464): n is a, c, g, or t
  modified_base (467)..(467): a, c, t, g, unknown or other
  misc_feature (467)..(467): n is a, c, g, or t
  modified_base (474)..(474): a, c, t, g, unknown or other
  misc_feature (474)..(474): n is a, c, g, or t
  modified_base (486)..(486): a, c, t, g, unknown or other
  misc_feature (486)..(486): n is a, c, g, or t
  modified_base (492)..(492): a, c, t, g, unknown or other
  misc_feature (492)..(492): n is a, c, g, or t
tcagacagtatatacacgaccggtgctcgattttagtagtgtagatttgggtttgggtggcccaagctgctggagggcacggtcaccacggtccaccgtctcctcagcttccaccaagggcccatcggtcttccccctggcgccctgctccaggagcacctctgggggtcacagcggccctgggctgcctggtcaacggctacttacctatacgtactntactgagcggggcctcggccgaagggtccgtctaactagctcnanctcgtanagcacacngcncacatcntctctacgtcgtctcacgtaactgacgtacgacggacctaggttctactgctagtcgactagactcngtcncggctctntactctcacggnaacgcngactnacgtntgactcnagtacncgcactgnttacnctacnctcnntcgcgtctctctagtgtcgcgngacgtgcgcntancgcgtgngtgtgagactanctctcnctactcg

SEQ ID NO: 80787 - DNA, 231 bp, Homo sapiens
  misc_feature: GYAE6OF02I5UWR.44.25.C03.1.454.CMB.1.raw
  modified_base (183)..(183): a, c, t, g, unknown or other
  misc_feature (183)..(183): n is a, c, g, or t
  modified_base (212)..(212): a, c, t, g, unknown or other
  misc_feature (212)..(212): n is a, c, g, or t
  modified_base (219)..(231): a, c, t, g, unknown or other
  misc_feature (219)..(231): n is a, c, g, or t
tcagacagtatatacacgaccggtgctcgatttagtagtgtagatttgggtttgggggaagaggaagactgacggtcctcccaggagttcaggtgctgggcaccttgggcacgggggagtgtgtcacaagatttgggctctgggcacagcggccctgggctgcctggtcaaggactacttccncgatcgcgtctgagcggctggacaaggcnctatagnnnnnnnnnnnnn

SEQ ID NO: 80788 - DNA, 238 bp, Homo sapiens
  misc_feature: GYAE6OF02HQFUR.44.25.C03.1.454.CMB.1.raw
  modified_base (227)..(238): a, c, t, g, unknown or other
  misc_feature (227)..(238): n is a, c, g, or t
tcagacagtatatacacgaccggtgctcgatttagtagtgtagatttgggtttggggggaagaggaagactgacggtcctcccaggagttcaggtgctgggcaccgttgggcgacgggggaggtgtgtcaacaagtatttgggctcgtgggcacaggccggccctgggctgcctggtcaaggactacttccacgtctactgctgagcgggctggcaaggcgcatagnnnnnnnnnnnn

SEQ ID NO: 80789 - DNA, 683 bp, Homo sapiens
  misc_feature: GYAE6OF02IH1HR.44.25.C03.1.454.CMB.1.raw
tcagacagtatatacacgaccggtgctcgatttagtagtgtagatttgggtttggggggactcctgtgccccaccatggacactctttgctacacactcctgctgctgaccaccccttcctgggtcttgtcccaggtcaccttgaaggagtctggtcctgtgctggtgaaacccacagagaccctcacgctgacctgcaccatctctgggttctctctcaacgatattagaatgggtgtgagctggactccgtcacgccccgagggaacggcccgtggagtggcttgcacacatcttctagaatgaacgaaaactcctaacagtacatctactagaagagacctaacgtttaaccattcctaccgaaacggaaccaccctaaccaaaacgggacaacgggttcggtacttttaagtagtacgaaccaactagtacggaccctaggaccggtaacacgacggacaacatacgttactggtacgtacggtacgggtaaatcgggaacggggaaaacgaaacgtaggtaccgtttgggttttactaggtttaacttaagtttaaccggttaccttaaaccgtatttccgtagggtaccgttacggtaggggtaaccggtaaaacgggacccgtacggtaccgtacccggttaccgtcctaccgtacgtcccgttaccgaaccccgg

SEQ ID NO: 80790 - DNA, 301 bp, Homo sapiens
  misc_feature: GYAE6OF02JGNO6.44.25.C03.1.454.CMB.1.raw
  modified_base (281)..(301): a, c, t, g, unknown or other
  misc_feature (281)..(301): n is a, c, g, or t
tcagacagtatatacacgaccggtgctcgatttagtagtgtagatttgggtttgggtgcccaagctgctggagggcacggtcaccacggtcaccgtctcctcagcttccaccagggcccatcggtcttcccctggcgccctgcctccgaggagcacctcgtgggggccacgaggccggccccgtgggcctggcccgttgggtccaaagggaccttacctttcccgcgacgtccggccgttccgtggacgggccggggtctcgggcgaagggccgcataggnnnnnnnnnnnnnnnnnnnnn

SEQ ID NO: 80791 - DNA, 224 bp, Homo sapiens
  misc_feature: GYAE6OF02FV1W3.44.25.C03.1.454.CMB.1.raw
  modified_base (219)..(224): a, c, t, g, unknown or other
  misc_feature (219)..(224): n is a, c, g, or t
tcagacagtatatacacgaccggtgctcgatttagtagtgtagatttgggtttgggggaagaggaagactgacggtcctcccaggagttcaggtgctgggcaccttgggcatgggggaggtgtgtcacaagatttgggctctgggcacagcggccctgggctgcctggtcaaggactacttcctatatactgtctgagcgggctggcaaggcgcatagnnnnnn

SEQ ID NO: 80792 - DNA, 132 bp, Homo sapiens; identical to SEQ ID NO: 79945
  misc_feature: GYAE6OF02FOK0H.44.25.C03.1.454.CMB.1.raw
  modified_base (130)..(132): a, c, t, g, unknown or other
  misc_feature (130)..(132): n is a, c, g, or t

SEQ ID NO: 80793 - DNA, 869 bp, Homo sapiens
  misc_feature: GYAE6OF02HTUGS.44.25.C03.1.454.CMB.1.raw
tcagacagtatatacacgaccggtgctcgatttagtagtgtagatttgggtttgggggactcctgtgccccaccatggacactctttgctacacactcctgctgctgaccacccttcctgggtcttgtcccaggtcacttgaaggagtctggtcctgtgctggtgaaacccacagagaccctcacgctgacctgcaccatctctgggttctctctcaacgatattagaatgggtgtgagctggatccgtcacgccccgagggaacggccctggaggtggcttgcacacattcttctacgaatgaacgaaaaatcctacagtacatctctagaagacgactaagtttaaccactacctaccgaaacggaacctaacccttaaccgaaaaacgggaccgtaaggggttacggtttaacccgtttttaaggttaacttacggaaacccgtaaaccgtaaacgttaccgggtaacccccgttacgggaacccgggaaccctaaaccgtaacggggtaccaaaccgttaagtttaaacgttttaaccgttacgggttaccggtaaaccgggtaaaccggggtttaaacggttacgggggaaaaccgggggtaaaaaaggtaaaaccgttacgggtaaccgttttacggggtttttaccctttaaggttttaaacgtttttaaacgttaaaccggttttaccgtttaaacccgttaagtttacccggtttaccggggtaccggttttaccgggttaacggggggtaacccggtaaaaacggggtaccccggttaacccgggttaacccggttacccggtttacccgttacccgttacccggtaacgttacccccgtttacccgaaaacccccggg

SEQ ID NO: 80794 - DNA, 246 bp, Homo sapiens
  misc_feature: GYAE6OF02JC5SQ.44.25.C03.1.454.CMB.1.raw
  modified_base (238)..(246): a, c, t, g, unknown or other
  misc_feature (238)..(246): n is a, c, g, or t
tcagacagtatatacacgaccggtgctcgatttagtagtgtagatttgggtttgggtgcccaagctgctggagggcacggtcaccacggtcaccgtctcctcagcttccaccaagggcccatcggtcttccccctggcgccctgctccaggagcacctctgggggcacagcggccctgggctgcctggtcaaggctacttcctatatactgtctgagcgggctggcaaggcgcatagnnnnnnnnn

SEQ ID NO: 80795 - DNA, 254 bp, Homo sapiens
  misc_feature: GYAE6OF02ID3BJ.44.25.C03.1.454.CMB.1.raw
  modified_base (238)..(254): a, c, t, g, unknown or other
  misc_feature (238)..(254): n is a, c, g, or t
tcagacagtatatacacgaccggtgctcgatttagtagtgtagatttgggtttgggtgcccaagctgctggagggcacggtcaccacggtcaccgtctcctcagcttccaccaagggcccatcggtcttcccctggcgccctgctccaggagcacctctgggggcacagcggccctgggctgcctggtcaaggactacttcctatagtactgtctgagcgggctggcaggcgcatagnnnnnnnnnnnnnnnnn

SEQ ID NO: 80796 - DNA, 289 bp, Homo sapiens
  misc_feature: GYAE6OF02I74UP.44.25.C03.1.454.CMB.1.raw
  modified_base (133)..(133): a, c, t, g, unknown or other
  misc_feature (133)..(133): n is a, c, g, or t
  modified_base (194)..(194): a, c, t, g, unknown or other
  misc_feature (194)..(194): n is a, c, g, or t
  modified_base (231)..(231): a, c, t, g, unknown or other
  misc_feature (231)..(231): n is a, c, g, or t
  modified_base (233)..(233): a, c, t, g, unknown or other
  misc_feature (233)..(233): n is a, c, g, or t
  modified_base (235)..(236): a, c, t, g, unknown or other
  misc_feature (235)..(236): n is a, c, g, or t
  modified_base (238)..(238): a, c, t, g, unknown or other
  misc_feature (238)..(238): n is a, c, g, or t
  modified_base (242)..(243): a, c, t, g, unknown or other
  misc_feature (242)..(243): n is a, c, g, or t
  modified_base (245)..(289): a, c, t, g, unknown or other
  misc_feature (245)..(289): n is a, c, g, or t
tcagacagtatatacacgaccggtgctcgatttagtagtgtagatttgggtttggggtggcccaagctgctggagggcacggtcaccacggtcaccgtctcctcagcttccacaggccatcgtctcccctgcncctgctccagagcacctctggggcacagcggccctgggctgcctggtcaaggctacttccngatcgcgtctgagcgggctggacaaggcgctaagtgnananntnacgnntnnnnnnnnnnnnnnnnnnnnnnnnnnnnnnnnnnnnnnnnnnnnn

SEQ ID NO: 80797 - DNA, 245 bp, Homo sapiens
  misc_feature: GYAE6OF02GEMSX.44.25.C03.1.454.CMB.1.raw
  modified_base (241)..(245): a, c, t, g, unknown or other
  misc_feature (241)..(245): n is a, c, g, or t
tcagacagtatatacacgaccggtgctcgatttagtagtgtagatttgggtttgggtgcccaagctgctggagggcacggtcaccacggtcaccgtctcctcagcttccaccaagggcccatcggtcttccccctggcgccctgctccaggagcacctctgggggcacagcggccctgggctgcctggtcaaggactacttcctctatatactgtctgagcgggctggcaaggcgcatagnnnnn

SEQ ID NO: 80798 - DNA, 242 bp, Homo sapiens; identical to SEQ ID NO: 80017
  misc_feature: GYAE6OF02F5LD0.44.25.C03.1.454.CMB.1.raw
  modified_base (239)..(242): a, c, t, g, unknown or other
  misc_feature (239)..(242): n is a, c, g, or t

SEQ ID NO: 80799 - DNA, 635 bp, Homo sapiens
  misc_feature: GYAE6OF02IAZQW.44.25.C03.1.454.CMB.1.raw
  modified_base (589)..(589): a, c, t, g, unknown or other
  misc_feature (589)..(589): n is a, c, g, or t
  modified_base (593)..(593): a, c, t, g, unknown or other
  misc_feature (593)..(593): n is a, c, g, or t
  modified_base (629)..(629): a, c, t, g, unknown or other
  misc_feature (629)..(629): n is a, c, g, or t
  modified_base (634)..(634): a, c, t, g, unknown or other
  misc_feature (634)..(634): n is a, c, g, or t
tcagacagtatatacacgaccggtgctcgatttagtagtgtagatttgggtttgggggacgcctagttcggccgggggggcccctaagactctcctgtctcgtctctgaacccacctttagcagctactggatgcactgggtccgccaagctccaggaaagggcctgatgtgggtctcacgtattaacaccgatgggactatcactggttactcagacgccgtggaagggccgattcatcactctccagaagactaatgtacgaaaacgtacggtgttaatttaaccaaatagaacagtactaagagtacgaggacgacggctgtctatattgtgtgagtaccttatgtatttcgtagttgggggtagtttagttcggttcgggcccacgtacggtcggggtccgaagggtaccgttgggttccgtcgtcctccgtcacgtccttccgaaccgacgggccctacgtccggtttccccgttacccccgtcgggtcccgcccgttcgccgtaccgaggacgccctaccgtcggtcgggacctacgacggccggccgtcggcctcgccgttggacgaacgtctactactacncgtntcgtgcggcggtcgtggacgtaggcgacgagtacgntacgnc

SEQ ID NO: 80800 - DNA, 666 bp, Homo sapiens
  misc_feature: GYAE6OF02IFT90.44.25.C03.1.454.CMB.1.raw
  modified_base (271)..(271): a, c, t, g, unknown or other
  misc_feature (271)..(271): n is a, c, g, or t
  modified_base (298)..(298): a, c, t, g, unknown or other
  misc_feature (298)..(298): n is a, c, g, or t
tcagacagtatatacacgaccggtgctcgatttagtagtgtagatttgggtttggggggaagaggaagactgacggtcctcccaggagttcaggtgctgggcaccttgggcacgggggaggtgtgtcacaagatttgggctctgggcaccgtgggcatgggggaggtgtgtcacaagatttggactcctgtgccccacatggacactctttgctacacactcctgctgctgaccaccccttctgggtcttgtcccaggtcaccttgaaggngtctggtcctgtgctggtgaaacccanagacgaccctcacgctgacctgcaccatctctggttctctctcaacgtatatagaatgggtgtgagctggactccgtcacgccccgaggggaacgcccgtaggaggtcggcgttcggccaacgactacttcttcgtacgtaatacgaaaccgtaaaaacttccctaacgtaacgtactaactaccttacgtagaaacggtacgtaaccttaacggttttaaacccacgttaaccctaacccgaaaacgggtaaccctaacccgttaccgaaaaaccgggtccgtaacgggttacggttacgtttaacgttaagtaaccgtaacccgaacgtaacgtaccggaaccccgttacggaccggtaaacccgg

SEQ ID NO: 80801 - DNA, 495 bp, Homo sapiens
  misc_feature: GYAE6OF02F5J4F.44.25.C03.1.454.CMB.1.raw
  modified_base (201)..(201): a, c, t, g, unknown or other
  misc_feature (201)..(201): n is a, c, g, or t
  modified_base (223)..(223): a, c, t, g, unknown or other
  misc_feature (223)..(223): n is a, c, g, or t
  modified_base (229)..(229): a, c, t, g, unknown or other
  misc_feature (229)..(229): n is a, c, g, or t
  modified_base (231)..(233): a, c, t, g, unknown or other
  misc_feature (231)..(233): n is a, c, g, or t
  modified_base (235)..(235): a, c, t, g, unknown or other
  misc_feature (235)..(235): n is a, c, g, or t
  modified_base (237)..(237): a, c, t, g, unknown or other
  misc_feature (237)..(237): n is a, c, g, or t
  modified_base (239)..(239): a, c, t, g, unknown or other
  misc_feature (239)..(239): n is a, c, g, or t
  modified_base (243)..(243): a, c, t, g, unknown or other
  misc_feature (243)..(243): n is a, c, g, or t
  modified_base (247)..(249): a, c, t, g, unknown or other
  misc_feature (247)..(249): n is a, c, g, or t
  modified_base (252)..(252): a, c, t, g, unknown or other
  misc_feature (252)..(252): n is a, c, g, or t
  modified_base (254)..(255): a, c, t, g, unknown or other
  misc_feature (254)..(255): n is a, c, g, or t
  modified_base (257)..(257): a, c, t, g, unknown or other
  misc_feature (257)..(257): n is a, c, g, or t
  modified_base (261)..(261): a, c, t, g, unknown or other
  misc_feature (261)..(261): n is a, c, g, or t
  modified_base (263)..(264): a, c, t, g, unknown or other
  misc_feature (263)..(264): n is a, c, g, or t
  modified_base (266)..(269): a, c, t, g, unknown or other
  misc_feature (266)..(269): n is a, c, g, or t
  modified_base (272)..(274): a, c, t, g, unknown or other
  misc_feature (272)..(274): n is a, c, g, or t
  modified_base (282)..(282): a, c, t, g, unknown or other
  misc_feature (282)..(282): n is a, c, g, or t
  modified_base (300)..(300): a, c, t, g, unknown or other
  misc_feature (300)..(300): n is a, c, g, or t
  modified_base (307)..(307): a, c, t, g, unknown or other
  misc_feature (307)..(307): n is a, c, g, or t
  modified_base (309)..(309): a, c, t, g, unknown or other
  misc_feature (309)..(309): n is a, c, g, or t
  modified_base (311)..(312): a, c, t, g, unknown or other
  misc_feature (311)..(312): n is a, c, g, or t
  modified_base (314)..(314): a, c, t, g, unknown or other
  misc_feature (314)..(314): n is a, c, g, or t
  modified_base (319)..(319): a, c, t, g, unknown or other
  misc_feature (319)..(319): n is a, c, g, or t
  modified_base (323)..(323): a, c, t, g, unknown or other
  misc_feature (323)..(323): n is a, c, g, or t
  modified_base (326)..(326): a, c, t, g, unknown or other
  misc_feature (326)..(326): n is a, c, g, or t
  modified_base (329)..(329): a, c, t, g, unknown or other
  misc_feature (329)..(329): n is a, c, g, or t
  modified_base (331)..(331): a, c, t, g, unknown or other
  misc_feature (331)..(331): n is a, c, g, or t
  modified_base (343)..(343): a, c, t, g, unknown or other
  misc_feature (343)..(343): n is a, c, g, or t
  modified_base (440)..(440): a, c, t, g, unknown or other
  misc_feature (440)..(440): n is a, c, g, or t
  modified_base (450)..(450): a, c, t, g, unknown or other
  misc_feature (450)..(450): n is a, c, g, or t
tcagacagtatatacacgaccggtgctcgatttagtagtgtagatttgggttggggggaagaggaagaactgacggtcctcccaggagttccaggtgctgggtcaccttgggcatgggggaggtgtgtcacaagagtttggggctctgggcacagccggccctgggctgccctggtcaaggtctacttccgaggtctacgngctgagcgggactggcaaggcncatagntnnncnananatanctannnagnannanacgncnncnnnngtnnnctcgcgtncgcagctatgagcagcgngtgagangncnncncacanacanacncgngngtagagagtagngcgtacgtcgtagtcgtagtatactacgtactactacgtacgtactctcgacgtcgtcggtacgacgagtagtacgagactacgtaagacgtagcgngacactacgntacgtactctcgtactaccaccgaccgtagtacgtacgtactacg

SEQ ID NO: 80802 - DNA, 549 bp, Homo sapiens
  misc_feature: GYAE6OF02HOB48.44.25.C03.1.454.CMB.1.raw
  modified_base (338)..(338): a, c, t, g, unknown or other
  misc_feature (338)..(338): n is a, c, g, or t
  modified_base (345)..(347): a, c, t, g, unknown or other
  misc_feature (345)..(347): n is a, c, g, or t
  modified_base (349)..(349): a, c, t, g, unknown or other
  misc_feature (349)..(349): n is a, c, g, or t
  modified_base (352)..(352): a, c, t, g, unknown or other
  misc_feature (352)..(352): n is a, c, g, or t
  modified_base (364)..(364): a, c, t, g, unknown or other
  misc_feature (364)..(364): n is a, c, g, or t
  modified_base (367)..(368): a, c, t, g, unknown or other
  misc_feature (367)..(368): n is a, c, g, or t
  modified_base (382)..(382): a, c, t, g, unknown or other
  misc_feature (382)..(382): n is a, c, g, or t
  modified_base (388)..(388): a, c, t, g, unknown or other
  misc_feature (388)..(388): n is a, c, g, or t
  modified_base (393)..(393): a, c, t, g, unknown or other
  misc_feature (393)..(393): n is a, c, g, or t
  modified_base (395)..(395): a, c, t, g, unknown or other
  misc_feature (395)..(395): n is a, c, g, or t
  modified_base (397)..(397): a, c, t, g, unknown or other
  misc_feature (397)..(397): n is a, c, g, or t
  modified_base (399)..(399): a, c, t, g, unknown or other
  misc_feature (399)..(399): n is a, c, g, or t
  modified_base (405)..(405): a, c, t, g, unknown or other
  misc_feature (405)..(405): n is a, c, g, or t
  modified_base (407)..(408): a, c, t, g, unknown or other
  misc_feature (407)..(408): n is a, c, g, or t
  modified_base (420)..(420): a, c, t, g, unknown or other
  misc_feature (420)..(420): n is a, c, g, or t
  modified_base (422)..(422): a, c, t, g, unknown or other
  misc_feature (422)..(422): n is a, c, g, or t
  modified_base (426)..(426): a, c, t, g, unknown or other
  misc_feature (426)..(426): n is a, c, g, or t
  modified_base (428)..(428): a, c, t, g, unknown or other
  misc_feature (428)..(428): n is a, c, g, or t
  modified_base (434)..(434): a, c, t, g, unknown or other
  misc_feature (434)..(434): n is a, c, g, or t
tcagacagtatatacacgaccggtgctcgatttagtagtgtagatttgggtttgggggtgggtgggtaggtctccactcccgtccgttcgacgggggcgtacgctagtactcgcctccctggccatcactcggctccaggctgaagatcgagggtgacttagttactgcctagttcctatagacagcagcctctaggtggttgggtgttcggcggaggaccgagcgtgacccgtccgtcggtcacgcccgaaggcctcgccccctcggtctacgtctccgttcccgtccctcctctacgtactaacctacgtcgtcgacggccggcgtggcaacggcnctatagnnnancancgcagcgcatcncgnngtcagcgcagtgcngacgancgtcncncncncactcncnncacgtcgtcgcntntatntntatatntactcacactcgtcgcgctacgactactacgtacgtcgacgacgtacgtcgtacgtacgtacgacgtaacgtacgtacgtcgtacgcgtacgacgtaccgtactactactacgtc

SEQ ID NO: 80803 - DNA, 514 bp, Homo sapiens
  misc_feature: GYAE6OF02IT57G.44.25.C03.1.454.CMB.1.raw
  modified_base (247)..(247): a, c, t, g, unknown or other
  misc_feature (247)..(247): n is a, c, g, or t
  modified_base (291)..(291): a, c, t, g, unknown or other
  misc_feature (291)..(291): n is a, c, g, or t
  modified_base (333)..(333): a, c, t, g, unknown or other
  misc_feature (333)..(333): n is a, c, g, or t
  modified_base (428)..(428): a, c, t, g, unknown or other
  misc_feature (428)..(428): n is a, c, g, or t
  modified_base (439)..(439): a, c, t, g, unknown or other
  misc_feature (439)..(439): n is a, c, g, or t
  modified_base (450)..(450): a, c, t, g, unknown or other
  misc_feature (450)..(450): n is a, c, g, or t
  modified_base (466)..(466): a, c, t, g, unknown or other
  misc_feature (466)..(466): n is a, c, g, or t
  modified_base (483)..(483): a, c, t, g, unknown or other
  misc_feature (483)..(483): n is a, c, g, or t
  modified_base (487)..(487): a, c, t, g, unknown or other
  misc_feature (487)..(487): n is a, c, g, or t
  modified_base (492)..(514): a, c, t, g, unknown or other
  misc_feature (492)..(514): n is a, c, g, or t
tcagacagtatatacacgaccggtgctcgatttagtagtgtagatttgggtttgggggctgttcctggaaggtgttggtaccagagggtcaccatctcctgcactgggagcagatccaacatcgggacagattctgatgtccactggtaccaacaccttccaaggaacacgcccccaaatcctcatctttaggtaacaactatcggccctgacgggtccctgaccgtattctcgtggcctcaagtcnggcactacgaggcctaccgtggcctatccctttgactcctccgngtacctaggagtatggacggtctgtacttaactcgtggacanacggactagtagggatacgaacacggtaccggaacggtcggtgggtacgttcgggacggtacggacctagtcgacgtcgtagtcacgcagctccnccgtcgctacnctccgtacccncccgtctctatactcngtcagcgtgcgtgacgngcancgtannnnnnnnnnnnnnnnnnnnnnn

SEQ ID NO: 80804 - DNA, 245 bp, Homo sapiens
  misc_feature: GYAE6OF02GEFEY.44.25.C03.1.454.CMB.1.raw
  modified_base (240)..(245): a, c, t, g, unknown or other
  misc_feature (240)..(245): n is a, c, g, or t
tcagacagtatatacacgaccggtgctcgatttagtagtgtagatttgggtttgggtgcccaagctgctggagggcacggtcaccacggtcaccgtctcctcagcttccaccaagggcccatcggtcttccccctggcgccctgctccaggagcacctcgtgggggcacagcggccctgggctgcctggtcaatgactacttcctatatactgtctgagcgggctggcaaggcgcatagnnnnnn

SEQ ID NO: 80805 - DNA, 483 bp, Homo sapiens
  misc_feature: GYAE6OF02FMPCO.44.25.C03.1.454.CMB.1.raw
  modified_base (459)..(460): a, c, t, g, unknown or other
  misc_feature (459)..(460): n is a, c, g, or t
  modified_base (462)..(483): a, c, t, g, unknown or other
  misc_feature (462)..(483): n is a, c, g, or t
tcagacagtatatacacgaccggtgctcgatttagtagtgtagatttgggtttgggggctgttcctggaaggtgttggtaccagagggtcaccatctcctgcactgggagcagatccaacatcgggacagattctgatgtccactggtaccaacaccttccaggaacagcccccaaactcctcatctttggtaacaactatcggccctcaggggtccctgaccgattctctggctccaagtctggcacctcagccctccctggccatcactgggctccaggctgaagatgagggtgattattactgccagtcctatgacagcagcctcagtggttgggtgttcggcggaggaccaagctgaccgtcgtgggtcagcccaaggctgcccctggtcactctcgttccccgccctcctctatactactgtctgaggcgggtctgggctaaggccgcagtagnngnnnnnnnnnnnnnnnnnnnnnn

SEQ ID NO: 80806 - DNA, 495 bp, Homo sapiens
  misc_feature: GYAE6OF02JHQGK.44.25.C03.1.454.CMB.1.raw
  modified_base (285)..(285): a, c, t, g, unknown or other
  misc_feature (285)..(285): n is a, c, g, or t
  modified_base (292)..(292): a, c, t, g, unknown or other
  misc_feature (292)..(292): n is a, c, g, or t
  modified_base (468)..(470): a, c, t, g, unknown or other
  misc_feature (468)..(470): n is a, c, g, or t
  modified_base (473)..(495): a, c, t, g, unknown or other
  misc_feature (473)..(495): n is a, c, g, or t
tcagacagtatatacacgaccggtgctcgatttagtagtgtagatttgggtttgggggctgttcctggaaggtgttggtaccagagggtcaccatctcctgcactgggagcagatccaacatcgggacagattctgatgtccactggtaccaacaccttccaggaacagcccccaaactcctcatctttggtaacaactatcggccctcaggggtccctgaccgattctctggctccaagtctggcacctcagcctcctggccatcactggctccaggctgaagntgaggtnattattactgccagtcctatgacagcagcctcaggttggttgggtgttcggcggacggaccaagctcgacccgtccgtgggtcacgcccgaaggcctcgccccctggtccactctcgttccccgccctcctctatacttactcgtctggcgcggtctcgggcaaggcgacagtagnnngcnnnnnnnnnnnnnnnnnnnnnnn

SEQ ID NO: 80807 - DNA, 558 bp, Homo sapiens
  misc_feature: GYAE6OF02I60H4.44.25.C03.1.454.CMB.1.raw
tcagacagtatatacacgaccggtgctcgatttagtagtgtagatttgggtttgggggactcctgtgccccaccatggacactctttgctacacactcctgctgctgaccaccccttcctgggtcttgtcccaggtcaccttgaaggagtctggtcctgtgctggtgaaacccacagagaccctcacgctgacctgcaccatctctgggttctctctcaacgatattagaatgggtgtgagctggatccgtcagccccagggaagccctggagtggcttgcacacatcttctcgaatgacgaaaatcctacagtacatctctgaagagctagttaaccatactaccaagacacctaccaaaaggcaggtgtctttagtatgaccaacatcggaccctgacgacacaggcacatattactgtgacgacgggtatgacgggaaagaacgagacttggtttactagttaattattaagttcttactattcgtcggtacgtcgtgggaactaacgggacctacggtacgaccgttctcctactacgtccttaccgaacccgg

SEQ ID NO: 80808 - DNA, 271 bp, Homo sapiens
  misc_feature: GYAE6OF02IOCAY.44.25.C03.1.454.CMB.1.raw
  modified_base (226)..(226): a, c, t, g, unknown or other
  misc_feature (226)..(226): n is a, c, g, or t
  modified_base (238)..(238): a, c, t, g, unknown or other
  misc_feature (238)..(238): n is a, c, g, or t
  modified_base (240)..(271): a, c, t, g, unknown or other
  misc_feature (240)..(271): n is a, c, g, or t
tcagacagtatatacacgaccggtgctcgatttagtagtgtagatttgggtttgggtgcccaagctgctggagggcacggtcaccacggtcaccgtctcctcagcttccaccaagggcccatcggtcttccccctggcgccctgctccaggagcacctctgggggcacagcggccctgggctgcctggtcaaggactacttcctatatactgtctgagcggctggnaaggcgcatagngnnnnnnnnnnnnnnnnnnnnnnnnnnnnnnnn

SEQ ID NO: 80809 - DNA, 716 bp, Homo sapiens
  misc_feature: GYAE6OF02G1PH5.44.25.C03.1.454.CMB.1.raw
tcagacagtatatacacgaccggtgctcgatttagtagtgtagatttgggtttgggggactcctgtgccccaccatggacactctttgctacacactcctgctgctgaccaccccttcctgggtcttgtcccaggtcaccttgaaggagtctggtcctgtgctggtgaaacccacagagaccctcacgctgacctgcaccatctctgggttctctctcagcgatattagaatgggtgtgagctggatccgtcacgccccagggaacgcctggagtggcttgcacacatcttctcgaatgacgaaaatcctacagtacatctctagaagagactagttaaccattactaccaaggtaccaacctacgaaaaaggctaagggttgttacgttttaaggtattacgaaccctaaacgacgttacgggtaacccctggaccgggaacctaaccgacggaccaaactacttaacgttaacttgtacggtaccgtaaccggggttaaatcgggaaacggggtaaaacgaaacgtacggtacgtttacgggttttaccgttaaggtttaattttaaacgttaaacggtttacctttaaccttaattaccggttacggttaccggttcggttaacggggggaacgtaaaacggggaccccgttaaccgggttaccgtaacccggttcccgttacccgtaccgtacccgttacccttaaccccgg

SEQ ID NO: 80810 - DNA, 853 bp, Homo sapiens
  misc_feature: GYAE6OF02GC20R.44.25.C03.1.454.CMB.1.raw
  modified_base (211)..(211): a, c, t, g, unknown or other
  misc_feature (211)..(211): n is a, c, g, or t
tcagacagtatatacacgaccggtgctcgatttagtagtgtagatttgggtttgggggcttcagctgtgggcacaagaggcagcactcaggacaatctccagcatggcctggtctcctctcctcctcactctcctcgctcactgcacgagggtcctgggcccactctgtgctgacgcacgcccgccctcagtgtcgtcgggggccccgggnaggacgggtcacctatcctcctcgcacgtgggagcagactaccaacacgtccgggacagtacttcgtgatcgtccacgttcggtaacccaacctacccttaccgaacggtaaccaccgaacccccctaaactccctactactttaccgttttaacggtaaaacctaaccgttacggtacccgggtaccccgttaccggtacccggggtttcccctacggtaaccccgttacgtttcccgtaccggttacgggtacccttacccgtaaacgtttccggtaccgggtacctaacccgttaaccggtaaccggtaccctttaacccggtaccgggaccccttaacgttttcccggttacgtaacctttcccgttacccgtaaggtttccgtaacgggtaacgggtacttacgggtacggtacttaccgtttaacgttttacccgtacgtttcgggtacgtaaccgtacggtacgttacgggtacgggtacgttacgggaccggtaccggggtacccggggtaacggtccggggtttgggggttaccgggttacgggggaacccgggggtaacgggtaacccggttaagggttcccgggttaacccggttaccgggtaaccgggtaccgaacccggtaaccccggg

SEQ ID NO: 80811 - DNA, 707 bp, Homo sapiens
  misc_feature: GYAE6OF02I9SBT.44.25.C03.1.454.CMB.1.raw
  modified_base (199)..(199): a, c, t, g, unknown or other
  misc_feature (199)..(199): n is a, c, g, or t
  modified_base (252)..(252): a, c, t, g, unknown or other
  misc_feature (252)..(252): n is a, c, g, or t
tcagacagtatatacacgaccggtgctcgatttagtagtgtagatttgggtttgggggggcgacaagaggcagcactcaggacaatctccagcatggcctggtctcctctcctcctcactctcctcgctcactgcacagggtcctgggcccactctgtgctgacgcagcccgccctcagtgtcgtgggggcccccgggnaggagggtcaccatcctcctgcacgtgggagcagactccaacgactcgggganacgtattctgagtcgtccgacgtcggtacccaactacccttcgacggaaccacgaccccctaaacgtccctacgtacttccgtttaggtaaccaacttacgtccggtcccctcggacggggttccctacggtacccgtattccgtctacgggccttaccgaacgttcgtcggacctacctacgaccgtccccttaccgcggtccacgtcctacgttcggcctccgtaacgggtcgttaggaacgtgtagggtacgggtcgttaatttaacgttaccgtacgcccgtacgttcctaatcgaacgacctcgtaactccgttacgagggtttcggggttgggttaccgggttccggggacgggtacggaaccggtacggtcctaccggtcccgttacgggtccggtacgacccgtacccggaacggtcccgttacccgggcccccgttcggttacccg

SEQ ID NO: 80812 - DNA, 695 bp, Homo sapiens
  misc_feature: GYAE6OF02FWIRD.44.25.C03.1.454.CMB.1.raw
  modified_base (284)..(284): a, c, t, g, unknown or other
  misc_feature (284)..(284): n is a, c, g, or t
  modified_base (312)..(312): a, c, t, g, unknown or other
  misc_feature (312)..(312): n is a, c, g, or t
tcagacagtatatacacgaccggtgctcgatttagtagtgtagatttgggtttgggggactcctgtgccccaccatggacactctttgctacacactcctgctgctgaccaccccttcctgggtcttgtcccaggtcaccttgaaggagtctggtcctgtgctggtgaaacccacagagaccctcacgctgacctgcaccatctctgggttctctctcaacgatattagaatgggtgtgagctggatccgtcacgccccaggacggccctggagtggcttgcanacatcttctcgaatgacgaaaatcctanagtacatactctagaagagactagttaaacctatcctaccgaaggacctacctaccgaaaacggacgtaagggttacgggttacttttaagttaacgtaccgtaaacctaaactacgtacggtaacccgttaggacccgggtaacctaagaacgggacctaactactaattacctagtacggacctaacgggtaagtacggacggggaaaataaacgacgacgttggtttacctaggtttaactttaacgtaacgttacctttaacaacgttcgttacgggacgttacggttaacggggaacgtaaaaccggggtacccgtaacgggtccctaaccgggttcccttacccgtaccggtaaccgtccccgttaccgaaccccgg

SEQ ID NO: 80813 - DNA, 141 bp, Homo sapiens; identical to SEQ ID NO: 80460
  misc_feature: GYAE6OF02ITXRH.44.25.C03.1.454.CMB.1.raw
  modified_base (137)..(141): a, c, t, g, unknown or other
  misc_feature (137)..(141): n is a, c, g, or t

SEQ ID NO: 80814 - DNA, 311 bp, Homo sapiens
  misc_feature: GYAE6OF02GOYT2.44.25.C03.1.454.CMB.1.raw
  modified_base (286)..(311): a, c, t, g, unknown or other
  misc_feature (286)..(311): n is a, c, g, or t
tcagacagtatatacacgaccggtgctcgatttagtagtgtagatttgggtttggggggaagaggaagactgacggtcctcccaggagttcaggtgctgggcaccttgggcacgggggaggtgtgtcacaagatttgggctctgggcaccgtgggcatgggggagtgtgtcacaagatttgggctctgggcacagcggccccgtggctcgcgtcgtagaacggtacttaccttctatactacgtgttcgtggacgggcggtcggtcgacggacggcgtacagtagnnnnnnnnnnnnnnnnnnnnnnnnnn

SEQ ID NO: 80815 - DNA, 242 bp, Homo sapiens; identical to SEQ ID NO: 80340
  misc_feature: GYAE6OF02I3E4J.44.25.C03.1.454.CMB.1.raw
  modified_base (239)..(242): a, c, t, g, unknown or other
  misc_feature (239)..(242): n is a, c, g, or t

SEQ ID NO: 80816 - DNA, 180 bp, Homo sapiens
  misc_feature: GYAE6OF02FLI4E.44.25.C03.1.454.CMB.1.raw
  modified_base (135)..(180): a, c, t, g, unknown or other
  misc_feature (135)..(180): n is a, c, g, or t
tcagacagtatatacacgaccggtgctcgatttagtagtgtagatttgggtttggggcacagcggccctgggctgccctggtccaaggactactttccacgtcttactgctgagcgggctggcaaggcgcatagnnnnnnnnnnnnnnnnnnnnnnnnnnnnnnnnnnnnnnnnnnnnnn

SEQ ID NO: 80817 - DNA, 615 bp, Homo sapiens
  misc_feature: GYAE6OF02GWMVB.44.25.C03.1.454.CMB.1.raw
  modified_base (455)..(455): a, c, t, g, unknown or other
  misc_feature (455)..(455): n is a, c, g, or t
tcagacagtatatacacgaccggtgctcgatttagtagtgtagatttgggtttgggggactcctgtgccccaccatggacactctttgctacacactcctgctgctgaccaccccttcctgggtcttgtcccaggtcaccttgaaggagtctggtcctgtgctggtgaaacccacagagaccctcacgctgacctgcaccatctctgggttctctctcaacgatattagaatgggtgtgagctggatccgtcacgcccccgagggaacggcccgtggagtggcttgcacacatcttctcgaatgaacgaaaatcctaacagtacatctctagaagagctaagtttaaccatctaccgaagaccacctaccaaaacggcaggtgtactttagtatgaaccaacatcggaccctggcggacacaggacactattattactgtgacgtacgggttaanggacgggaaagaaacgaggtacgtttcggtttacttagttatttaacgttaacgttacttaaccagttcgtcggacgttacggtcggggaaccgtaacggggtacccgacggtcgtacccggttccttacctaccgtacgttcccgtacccgtaacccgg

SEQ ID NO: 80818 - DNA, 603 bp, Homo sapiens
  misc_feature: GYAE6OF02FLJC4.44.25.C03.1.454.CMB.1.raw
  modified_base (282)..(282): a, c, t, g, unknown or other
  misc_feature (282)..(282): n is a, c, g, or t
  modified_base (416)..(416): a, c, t, g, unknown or other
  misc_feature (416)..(416): n is a, c, g, or t
  modified_base (429)..(429): a, c, t, g, unknown or other
  misc_feature (429)..(429): n is a, c, g, or t
  modified_base (441)..(441): a, c, t, g, unknown or other
  misc_feature (441)..(441): n is a, c, g, or t
tcagacagtatatacacgaccggtgctcgatttagtagtgtagatttgggtttgggggggaagaggaagactgacggtcctcccaggagttcaggtgctgggcaccttgggcacgggggaggtgtgtcacaagatttgggctctgggcaccgtgggcatgggggaggtgtgtcacaagatttggactcctgtgccccacatggacactctttgctacacactcctgctgctcgaccctacccccttccgtgggtccttgtccccaggttccaccttgaaggngtctggtcctgtgctggtgaaacccgacagagaccctcacgctgacctgccaccatctctcggtttctctctcgaacgatattagaactgggttgtgagcgtggatccgtcaccgccccgagggacggcctggngtggctgcacacntcttcacgtaanagaacgtaaaactccgaactaagtactatcctactagaaggacgacttaacgttaaccacttctaaccaaacggacctaacccgtacaaacggtcgtaacgggttagttcgtttaagtactaggaaccctaacgagtacccggaaccctcgggactaaccgg

SEQ ID NO: 80819 - DNA, 666 bp, Homo sapiens
  misc_feature: GYAE6OF02G45KA.44.25.C03.1.454.CMB.1.raw
  modified_base (239)..(239): a, c, t, g, unknown or other
  misc_feature (239)..(239): n is a, c, g, or t
  modified_base (266)..(266): a, c, t, g, unknown or other
  misc_feature (266)..(266): n is a, c, g, or t
tcagacagtatatacacgaccggtgctcgatttagtagtgtagatttgggtttgggggaagaggaagactgacggtcctcccaggagttcaggtgctgggcaccttgggcacggggagtgtgtcacaagatttgggctctgggcaccgtggcatgggggagtgtgtcacaagatttggactcctgtgccccacatggacactctttgctacacactcctgctgcctgaccaccccttcngggtcttgcccaggtcaccttgaaggntctggtcctgtgctggtcgaaaccccacgagacgacccctcgacgctcgacctgcaccatctctggttctctctcaacgatattagaacgttgggtgtgacgcgtcggactccgtcaccgcccccgaaggggaacggtccccgtagggacggttcgggtccgtttcggcctacacctacgttcctttaccgtaccgtaaacgtacggaaaccgtaaaaacttaccctaacgtaacgtaacctacttcctcgttagaagacggtaccttaacgtttaacctacttaccctaaccgaacgtaaccctaaccctaccgaaacggtccgtaagggtcgtttaccgtttaagtacttacgtaaccctaacgtacggttacggacccgttacggacccggtaaccg

SEQ ID NO: 80820 - DNA, 224 bp, Homo sapiens
  misc_feature: GYAE6OF02GQHNE.44.25.C03.1.454.CMB.1.raw
  modified_base (220)..(224): a, c, t, g, unknown or other
  misc_feature (220)..(224): n is a, c, g, or t
tcagacagtatatacacgaccggtgctcgatttagtagtgtagatttgggtttggggggaagaggaagactgacggtcctcccaggagttcaggtgctgggcaccttgggcacgggggaggtgtgtcacaagatttgggctctgggcacagcggccctgggctgcctggtcaaggactacttcctcgatcgcgtctgagcgggctggcaaggcgcatagnnnnn

SEQ ID NO: 80821 - DNA, 180 bp, Homo sapiens
  misc_feature: GYAE6OF02JFPWL.44.25.C03.1.454.CMB.1.raw
  modified_base (141)..(141): a, c, t, g, unknown or other
  misc_feature (141)..(141): n is a, c, g, or t
  modified_base (171)..(180): a, c, t, g, unknown or other
  misc_feature (171)..(180): n is a, c, g, or t
tcagacagtatatacacgaccggtgctcgatttagtagtgtagatttgggtttgggggaagaggaagactgacggtcctcccaggagttcaggtgctgggcaccttgggcatgggggaggtgtgtcacaagatttgggctntgggcacagcggccctgggctgcctggcannnnnnnnnn

SEQ ID NO: 80822 - DNA, 306 bp, Homo sapiens
  misc_feature: GYAE6OF02FTYPM.44.25.C03.1.454.CMB.1.raw
  modified_base (268)..(268): a, c, t, g, unknown or other
  misc_feature (268)..(268): n is a, c, g, or t
  modified_base (270)..(271): a, c, t, g, unknown or other
  misc_feature (270)..(271): n is a, c, g, or t
  modified_base (273)..(306): a, c, t, g, unknown or other
  misc_feature (273)..(306): n is a, c, g, or t
tcagacagtatatacacgaccggtgctcgatttagtagtgtagatttgggtttgggggggaagaggaagactgacggtcctcccaggagttcaggtgctgggcaccttgggcacgggggaggtgtgtcaacaagatttgggctctgggcaccgtgggcatgggggagtgtgtcacaagatttgggctctgggcacagcggccctgggctgcctggtcaagggactacttcctaatatactgtctgagcgggctggcaaggcgcatagnanntnnnnnnnnnnnnnnnnnnnnnnnnnnnnnnnnnn

SEQ ID NO: 80823 - DNA, 820 bp, Homo sapiens
  misc_feature: GYAE6OF02GBJOC.44.25.C03.1.454.CMB.1.raw
  modified_base (196)..(196): a, c, t, g, unknown or other
  misc_feature (196)..(196): n is a, c, g, or t
  modified_base (229)..(229): a, c, t, g, unknown or other
  misc_feature (229)..(229): n is a, c, g, or t
tcagacagtatatacacgaccggtgctcgatttagtagtgtagatttgggtttggggggcacaagaggcagcactcaggacaatctccagcatggcctggtctcctctcctcctcactctcctcgctcactgcacagggtcctgggcccactctgtgctgacgcagcccgccctcagtgtcgtggggcccccgggnaggagggtccaccgatcctcctgcacgtgggancagactccaacagtcgggacagattctgatgtccacgtggtaaccaacacccttccaaggtaaccacgaccccccaaactccctactacttcgtttacggtaaacaaccttagtcccggccctacgacggggtcccctaggaacccgtattccgtcgtcgggccttacccgaacggttccttcgggcctaacccttccgaacgtccccttccccgtcgggacccctacgtcccgtaaccggttcgggtacccgttacccgaacgggtccttacgggaaaccgtaggttaccgggtaaggggtacgttaacttttaaacgttacgttaccggtacccgaacgtttaccccttaaggtcgaaaccggacgtacccgacgttacccgtacgttaacggggtttcgggtttcggggttacgggttttcccggggaccgggggtaccggggtaaacccgtaacgggttcccggttaaccgggtaacccccgggtttcggttacccgggggttaacccgtaaccggggtaccccccgtaaaggggttcccccgttacccccgggttaccccccccggttacccgggttaacccccgg

SEQ ID NO: 80824 - DNA, 785 bp, Homo sapiens
  misc_feature: GYAE6OF02FG4HL.44.25.C03.1.454.CMB.1.raw
  modified_base (780)..(780): a, c, t, g, unknown or other
  misc_feature (780)..(780): n is a, c, g, or t
tcagacagtatatacacgaccggtgctcgatttagtagtgtagatttgggtttgggggacgcctagttcggccgggggggcccctaagactctcctgtctcgtctctgaacccacctttagcagctactggatgcactgggtccgccaagctccaggaaagggcctgatgtgggtctcacgtattaacaccgatgggactatcactggttactcagacgccgtgaagggccgattcatcatctccagagacaatgtacgaaaacacggtgtaatttacaaatgaacagtctaagagtcgaggacacggctgtctactattgtgtgagtaccttatgtatttcgacgtttaggggggagtttagttccggttttcggggccctacgtaaccgtggggggaccctaagggggtaaccctttggggtccgttcggttccttcccgtctacggtcctttacccgaacccgtaacggggtccccaacgttcccgggtccctttccccccgtggggccccgtccccgtcggcccttacccggaacgggaccgtccgtacccggtttcccgggtacggggggacctaacccgggcgggtccccgggtaccccgggttacggggccgttaccgggtccccgggtttagggttacccgaaaacggggttaccctttaaacccgtttacccgttaagttacctttaccggttccggttaccgttcgggaaggggacccgggggttaccgtacggggtacgtaaaccgggcccggtaacgtaggttacggncgtcg

SEQ ID NO: 80825 - DNA, 264 bp, Homo sapiens
  misc_feature: GYAE6OF02I5GRM.44.25.C03.1.454.CMB.1.raw
  modified_base (204)..(204): a, c, t, g, unknown or other
  misc_feature (204)..(204): n is a, c, g, or t
  modified_base (223)..(223): a, c, t, g, unknown or other
  misc_feature (223)..(223): n is a, c, g, or t
  modified_base (234)..(234): a, c, t, g, unknown or other
  misc_feature (234)..(234): n is a, c, g, or t
  modified_base (237)..(264): a, c, t, g, unknown or other
  misc_feature (237)..(264): n is a, c, g, or t
tcagacagtatatacacgaccggtgctcgatttagtagtgtagatttgggtttgggtgcccaagctgctggagggcacggtcaccacggtcaccgtctcctcagcttccaccaagggcccatcggtcttcccctgcgcctgctccaggagcacctctgggggcacagcggccctgggctgcctggtcaaggactacttcctatntactgtctgagcggctggngaacggcgcanagnnnnnnnnnnnnnnnnnnnnnnnnnnnn

SEQ ID NO: 80826 - DNA, 671 bp, Homo sapiens
  misc_feature: GYAE6OF02FLDRV.44.25.C03.1.454.CMB.1.raw
tcagacagtatatacacgaccggtgctcgatttagtagtgtagatttgggtttgggggactcctgtgccccaccatggacactctttgctacacactcctgctgctgaccaccccttcctgggtcttgtcccaggtcaccttgaaggagtctggtcctgtgctggtgaaacccacagagaccctcacgctgacctgcaccatctctggttctctctcaacgatattagagtgggtgtgagcgtggactccgtcacgccccgagggaacggccctggagtggcgttgacgacacactccttctacgtaatacgaacgtaaaaacttcctaacaacgtacacttctacgtacgaaggaagtactaacgtttaaaccgactcctaaccgaaacggtacctaacccgtaacgaaaacggacgtaacgggttcggttaactttacgtagtaacgacctaaacgaccgtacgggaaccctcggacgggaacacgacggtacaacattaacgttacgtggcggacgtaacgggtaacgagggaccggaaaagacgagtcgtttacggttatagttaattagttaaacttacttactagttacgtgtacggttggaacgggaacgaacgggtaactccggtaccacccggttctacccgtgtaccgtctaacccgacgg

SEQ ID NO: 80827 - DNA, 728 bp, Homo sapiens
  misc_feature: GYAE6OF02FZL6O.44.25.C03.1.454.CMB.1.raw
  modified_base (236)..(236): a, c, t, g, unknown or other
  misc_feature (236)..(236): n is a, c, g, or t
tcagacagtatatacacgaccggtgctcgatttagtagtgtagatttgggtttgggggactcctgtgccccaccatggacactctttgctacacactcctgctgctgaccaccccttcctgggtcttgtcccaggtcaccttgaaggagtctggtcctgtgctggtgaaacccacagagaccctcacgctgacctgcaccatctctgggttctctctcaacgatatagaatgggtntgagctggactccgtcacggaccccgagggaacggccctggagtggcttgcacactatcttctacgaatacggaacgaaaaactcctaatagtaactatctctaggaactaggactaagttaaccactcctacgaacggaccacctaacgaaacggcgtaggtcgttacgtttaagtactacggaacctaacgtgtaccggtaccctacggaccggaactacgacggaccaacgtaattaacttacgtggttacgtaacgtaacgggtaaacgtacgggaaacgggaaaagtaacgaacggttacggtttacgggttttacctaaggtttaacgtttaacgttaaaccgttaccgttaaccgtagttaccggttaggtaccgggttacggtaaggggggaacccgtaaaacggggtaacccgttaccggtaacccggttacccgttacccgtacccgttacgtaccggttacccttacccggaaaccccggg

SEQ ID NO: 80828 - DNA, 730 bp, Homo sapiens
  misc_feature: GYAE6OF02IIL8D.44.25.C03.1.454.CMB.1.raw
  modified_base (197)..(197): a, c, t, g, unknown or other
  misc_feature (197)..(197): n is a, c, g, or t
  modified_base (305)..(305): a, c, t, g, unknown or other
  misc_feature (305)..(305): n is a, c, g, or t
  modified_base (317)..(317): a, c, t, g, unknown or other
  misc_feature (317)..(317): n is a, c, g, or t
tcagacagtatatacacgaccggtgctcgatttagtagtgtagatttgggtttggggggggcacaagaggcagcactcaggacaatctccagcatggccggcttccctctcctcctcaccctcctcactcactgtgcagggtcctgggcccagtctgtgctgactcagccatcctcagcgtctcgggacccccgggnagacggtcacgattctttttgttctggaagtacggtccaacagtacggaagttaattacgtatacgtggtatcggacaattcacgaggagccggtccccagacccctnatctagtagganaatcgacgcggccctcgacgggtccctgaccgtattctctcgcctccgaagtctcggccacctcgacgtcccttcccgtggccctaagtccgtacgggttccgggccgtttccccggggtaccggaacgggtacgttacggacgggtccgtaggttacgttttaacgttttcgttggttcgggtccgggttccggtttacggggtacgttcggtaacctaacgttcccgtagggtacgggttacgggtacgttacggtaccgtttacgggttccggggtaccggggaaacggggtacccgtaacggtccgttaccggtacccgttaaccggtacgtaccgaccgtacccgaacggtcccgtaccggtcccccgtacggttccctaccgttccgttcccgttaccccgtacccc

SEQ ID NO: 80829 - DNA, 916 bp, Homo sapiens
  misc_feature: GYAE6OF02HFLKH.44.25.C03.1.454.CMB.1.raw
  modified_base (259)..(259): a, c, t, g, unknown or other
  misc_feature (259)..(259): n is a, c, g, or t
tcagacagtatatacacgaccggtgctcgatttagtagtgtagatttgggtttgggggcttcagctgtgggcacaagaggcagcactcaggacaatctccagcatggcctggtctcctctcctcctcactctcctcgctcactgcacagggtcctgggcccactctgtgctgacgcagcccgccctcagtgtctcgggggccccgggcaggagggtcaccatctcctgcacgtgggagcagactccaacagtccggganagattcgtgaatcgtaccactacggtaaccctaaccaccccgttaccgaacggtaaccgaccgtacccccccaaacttcccctacctaacgtttaccgttttacggtaaaacctaaaccgttacgtccccgggtaccccttaccggtaaccgggggttcccccttacggaaccccggttacgtttccgtaccgttaccgggtacccgttacccgtaaacggtttccgttaccgggtaccctaaccccgttaccgtaccggtcccctttacccccggtcggggtacccccttaacgttacccgtaaccccgggtttacgggggaccccttaccccgggtaacggggtacccgtttacggggaaaaccggttacgggttaccggggttaacgggggtttaacggttaactttttaaaccgggttttacccgtccgggggttaaccccttaacggtttcccccgtttaaggtttaacccggaaccgtttaaacccggggccgtaaaccggtccccgttaacggttacggggtttcggggtttaccgggggtttacgggtttcccggggaacgggggttaaccgggtaaccgtaaacgggtcccggttaccggtaccccggggtcccggttaccggggtaccgtaacccgggtaaccccgg

SEQ ID NO: 80830 - DNA, 256 bp, Homo sapiens
  misc_feature: GYAE6OF02H3SY6.44.25.C03.1.454.CMB.1.raw
  modified_base (235)..(256): a, c, t, g, unknown or other
  misc_feature (235)..(256): n is a, c, g, or t
tcagacagtatatacacgaccggtgctcgatttagtagtgtagatttgggtttgggtgcccaagctgctggagggcacggtcacacggtcaccgtctcctcagcttccacaagggccatcggtcttccccctggcgccctgctccaggagcactctgggggcacagcggcctgggctgcctggtcaaggactacttcctatatactgtctgagcgggctggcaaggcgcgatagnnnnnnnnnnnnnnnnnnnnnn

SEQ ID NO: 80831 - DNA, 714 bp, Homo sapiens
  misc_feature: GYAE6OF02HDTHK.44.25.C03.1.454.CMB.1.raw
  modified_base (303)..(303): a, c, t, g, unknown or other
  misc_feature (303)..(303): n is a, c, g, or t
tcagacagtatatacacgaccggtgctcgatttagtagtgtagatttgggtttgggggaagaggaagactgacggtcctcccaggagttcaggtgctgggcaccttgggcacgggggagtgtgtcacaagatttgggctctgggcaccgtgggcagtgggggagtgtgtacacaagatttggactccgtgtcgccccacatggacacgttctttgctacacactcctgctgctcgaccctacccttcgtggtcttcgcccagtcacgtgaagtgtctcggtctgtgtcgtaggtacgaaaccncgaagacgaccctacacgtcgtcggtacctacgaccactactctcgttcggttcctctacgtacgaagtactaattaggaagtcggggtagtagtacgtcgtacggtactcccgtacgacccgtacccccgggaagggtaccggtcccgtaggacggtcggtcgtacgaccgtaacctacgtacttccgttacgtacgtaaacgtacgaaaaccgttaaaactacccgtaacgtaacgttactaactctacgtagtaaacgtcgtaacgttaaccttaacgtacttaccgtaaccgaaacggttacctaacccgtaacgaaaccggtacggtaacgggttcgtttaacggttaacgtaacgttaccgaacctaacggtaccgttaacggcccgttacggacccggtaaccg

SEQ ID NO: 80832 - DNA, 317 bp, Homo sapiens
  misc_feature: GYAE6OF02I5TUF.44.25.C03.1.454.CMB.1.raw
  modified_base (237)..(243): a, c, t, g, unknown or other
  misc_feature (237)..(243): n is a, c, g, or t
  modified_base (246)..(246): a, c, t, g, unknown or other
  misc_feature (246)..(246): n is a, c, g, or t
  modified_base (259)..(259): a, c, t, g, unknown or other
  misc_feature (259)..(259): n is a, c, g, or t
  modified_base (263)..(317): a, c, t, g, unknown or other
  misc_feature (263)..(317): n is a, c, g, or t
tcagacagtatatacacgaccggtgctcgatttagtagtgtagatttgggtttgggtgcccaagctgctggagggcacggtcaccacggtcaccgtctcctcagcttccaccaagggcccatcggtcttccccctggcgccctgctccaggagcacctctgggggcacagcggccctgggctgcctggtcaaggctacttcctagtatactgtctgagcgggctgcaggcgcatagnnnnnnnagncagctagctagcnagcnnnnnnnnnnnnnnnnnnnnnnnnnnnnnnnnnnnnnnnnnnnnnnnnnnnnnnn

SEQ ID NO: 80833 - DNA, 805 bp, Homo sapiens
  misc_feature: GYAE6OF02ISD5A.44.25.C03.1.454.CMB.1.raw
  modified_base (305)..(305): a, c, t, g, unknown or other
  misc_feature (305)..(305): n is a, c, g, or t
tcagacagtatatacacgaccggtgctcgatttagtagtgtagatttgggtttggggggaagaggaagactgacggtcctcccaggagttcaggtgctgggcaccttgggcacgggggaggtgtgtcacaagatttgggctctgggcaccgtgggcagtgggggaggtgtgtcacaagatttggactcctgtcgccccacatggacactctttgctacacactcctgctgctgaccctacccttcgtgggtcttcgtcccaggtcaccttgaagagtctggtcctgtgctggtacaaaaccccanagaacgaccccctacgaccggtctcggaaccttcgaccacccatccttcgttgggttcctcctctacgaacgtattaacttaggtaaacgttgggggtacttagggacgtccgttaggtaccgttaccgtccgaaccggtaccccccggaaggggtaacggtccccgtagggtacggtcggtccgtttagccgtaaccgtaactacgtttcccgttaccgtaccggtaaaacgttaccggaaaaccgttaaaaaccgtttaccctaaaccgttaaccgtaaacccttacgttacccgttagtaacggtaaacggtaacgtaccgttaaacgtttaaaccctacgtttaacccgttaaccgaaaaccggtaaccctaaacccgtaaccgtaaaaacggggtaccgtaacggggttacggtttaacgtttaacggttaacgtaaccggtaaacctaaacgttaccggttaccggtaacccggttcggacccggtaaacccgg

SEQ ID NO: 80834 - DNA, 555 bp, Homo sapiens
  misc_feature: GYAE6OF02F7W70.44.25.C03.1.454.CMB.1.raw
  modified_base (237)..(240): a, c, t, g, unknown or other
  misc_feature (237)..(240): n is a, c, g, or t
  modified_base (242)..(243): a, c, t, g, unknown or other
  misc_feature (242)..(243): n is a, c, g, or t
  modified_base (245)..(246): a, c, t, g, unknown or other
  misc_feature (245)..(246): n is a, c, g, or t
  modified_base (249)..(250): a, c, t, g, unknown or other
  misc_feature (249)..(250): n is a, c, g, or t
  modified_base (264)..(264): a, c, t, g, unknown or other
  misc_feature (264)..(264): n is a, c, g, or t
  modified_base (271)..(271): a, c, t, g, unknown or other
  misc_feature (271)..(271): n is a, c, g, or t
  modified_base (276)..(276): a, c, t, g, unknown or other
  misc_feature (276)..(276): n is a, c, g, or t
  modified_base (280)..(280): a, c, t, g, unknown or other
  misc_feature (280)..(280): n is a, c, g, or t
  modified_base (292)..(292): a, c, t, g, unknown or other
  misc_feature (292)..(292): n is a, c, g, or t
  modified_base (305)..(305): a, c, t, g, unknown or other
  misc_feature (305)..(305): n is a, c, g, or t
  modified_base (309)..(309): a, c, t, g, unknown or other
  misc_feature (309)..(309): n is a, c, g, or t
  modified_base (313)..(313): a, c, t, g, unknown or other
  misc_feature (313)..(313): n is a, c, g, or t
  modified_base (320)..(320): a, c, t, g, unknown or other
  misc_feature (320)..(320): n is a, c, g, or t
  modified_base (333)..(333): a, c, t, g, unknown or other
  misc_feature (333)..(333): n is a, c, g, or t
  modified_base (345)..(345): a, c, t, g, unknown or other
  misc_feature (345)..(345): n is a, c, g, or t
  modified_base (363)..(363): a, c, t, g, unknown or other
  misc_feature (363)..(363): n is a, c, g, or t
  modified_base (378)..(378): a, c, t, g, unknown or other
  misc_feature (378)..(378): n is a, c, g, or t
tcagacagtatatacacgaccggtgctcgatttagtagtgtagatttgggtttggggtgcccaagctgctggagggcacggtcaccacggtcaccgtctctcagcttccaccaagggcccatcggtcttcccctggcgccctgctccaggacgcactctggggcactagcgcctgggctgctggtcaaggtctacgttcctatatactgtctgagcggactggcaaggcgacatagnnnntnnanntcnnctcagtcatcgagntacgcanctagntcgnagtctagcagtnaacgctgcacgtnttanagtnacggtcngttagcgctaggntacctagatccntactaccgggattaacgnaacgcgtttaacganacgtacgtacgtactacgtacgtacgtacgttacgtactagtacgtacgtacgtacgttagtacgtagtacgtacgtacgtacgtacgtacgtacgtacgtagtacgtacgtaacgtacgtaacgtacgtacggtagtacgtacggtacgtacgtacgtactacgtacgtacgtacg

SEQ ID NO: 80835 - DNA, 248 bp, Homo sapiens
  misc_feature: GYAE6OF02FNO7O.44.25.C03.1.454.CMB.1.raw
  modified_base (241)..(248): a, c, t, g, unknown or other
  misc_feature (241)..(248): n is a, c, g, or t
tcagacagtatatacacgaccggtgctcgatttagtagtgtagatttgggtttgggtgcccaagctgctggagggcacggtcaccacggtcaccgtctcctcagcttccaccaagggcccatcggtcttccccctggcgcccctgctccaggagcacctctgggggcacagcggcccctgggctgcctggtcaaggactacttcctatatactgtctgagcgggctggcaaggcgcatagnnnnnnnn

SEQ ID NO: 80836 - DNA, 761 bp, Homo sapiens
  misc_feature: GYAE6OF02JP4WH.44.25.C03.1.454.CMB.1.raw
  modified_base (194)..(194): a, c, t, g, unknown or other
  misc_feature (194)..(194): n is a, c, g, or t
  modified_base (220)..(220): a, c, t, g, unknown or other
  misc_feature (220)..(220): n is a, c, g, or t
  modified_base (302)..(302): a, c, t, g, unknown or other
  misc_feature (302)..(302): n is a, c, g, or t
  modified_base (610)..(610): a, c, t, g, unknown or other
  misc_feature (610)..(610): n is a, c, g, or t
  modified_base (663)..(663): a, c, t, g, unknown or other
  misc_feature (663)..(663): n is a, c, g, or t
  modified_base (756)..(756): a, c, t, g, unknown or other
  misc_feature (756)..(756): n is a, c, g, or t
  modified_base (759)..(759): a, c, t, g, unknown or other
  misc_feature (759)..(759): n is a, c, g, or t
  modified_base (761)..(761): a, c, t, g, unknown or other
  misc_feature (761)..(761): n is a, c, g, or t
tcagacagtatatacacgaccggtgctcgatttagtagtgtagatttgggtttgggggacgcctagttcggccggggggcccctaagactctcctgtctcgtctctgaaacccacctttagcagctactggatgcacgtgggtccgccaagcctccgaagggaaaggcctgatcgtggtctcacgtacttaacnccgatgggactatcacttcggttacncagaccgccgtaggaacgggcctattccatcaagttcctaccgagaacgaactaagttggtaaaccgaaaaacgttacggtntttaaacttaacaaaagtgaaactagtactaaaggtacggtacgtaaggaccgtacggacctacggttcttaaaccgttagtttaggtacgttacgaaacggttaaccctttaagttacgtaacttttacgtaacgggtttacgggggtttaagtttacgtttccggtttacgggtacccgtaccgtacgggttcggggtaacccgtaagggttaacccgtttgggttcccggttacgttccgttcctacgacgttccgttacccaaccgggacggtcccgtacgtccgggtttccctttaccccggnggtcccgtccgtcgtccgtaccgaacggccgaccttccgtacgggtcggaccncggacgccgggtccgtcggcttcggctaggtcgaacgtctaccgtcttatactcgtctcgtcgaggtccgacgtcgaacgtcgctaccggtangtngn

SEQ ID NO: 80837 - DNA, 133 bp, Homo sapiens
  misc_feature: GYAE6OF02IGCJ0.44.25.C03.1.454.CMB.1.raw
  modified_base (130)..(133): a, c, t, g, unknown or other
  misc_feature (130)..(133): n is a, c, g, or t
tcagacagtatatacacgaccggtgctcgatttagtagtgtagatttgggtttgggcacagcggccctgggctgcctggtcaaggactacttccacgtctactgctgagcgggctggcaaggcgcatagnnnn

SEQ ID NO: 80838 - DNA, 782 bp, Homo sapiens
  misc_feature: GYAE6OF02IWAA1.44.25.C03.1.454.CMB.1.raw
  modified_base (134)..(134): a, c, t, g, unknown or other
  misc_feature (134)..(134): n is a, c, g, or t
  modified_base (199)..(199): a, c, t, g, unknown or other
  misc_feature (199)..(199): n is a, c, g, or t
tcagacagtatatacacgaccggtgctcgatttagtagtgtagatttgggtttggggggaagaggaagactgacggtcctcccaggagttcaggtgctgggcaccttgggcacgggggaggtgtgtcacgaagntttgggctctgggcaccgtgggcatgggggagtcgtgtcacagatttggactctgtcgccccacntggacactcttgctacacactcctgctgcctgaccctacccgttcgtgggtccttcggtccccaagggtccaccgttaggaaacggtcgtacgttcgggtcctggtcgtcgtcgggtacgaaaccctagtacggacgtacccctcgacgcttaggaccctcgaccaacccgtacttcgtacggtttcggggttacctaccttccgtacgtaaacgtatttaaccggttaagaacgttcgggggttagttacggacgttcggttacgggactttaccggtcctaaccggacccccgggtaaagggggtaaccgtcccggtaggggtaccgtacgggtacctttcggacccgtaaccgacgttaccgtttaccgttaccgtacggtaaagtaccgtaaaccggtaaaacttccgtaactaacgttactactacgtactacggaactacgtccttaacgttaacctcgtaccgtaacgtaaacggacctacccgaaccgtaaacggaccgttacgggttaacgttaccgttaaggtaccgtacgtaaccgtacgtaacgtaccggtaccgttaggaccggtaaccg

SEQ ID NO: 80839 - DNA, 635 bp, Homo sapiens
  misc_feature: GYAE6OF02JFZCS.44.25.C03.1.454.CMB.1.raw
  modified_base (232)..(232): a, c, t, g, unknown or other
  misc_feature (232)..(232): n is a, c, g, or t
  modified_base (258)..(258): a, c, t, g, unknown or other
  misc_feature (258)..(258): n is a, c, g, or t
  modified_base (378)..(378): a, c, t, g, unknown or other
  misc_feature (378)..(378): n is a, c, g, or t
  modified_base (401)..(401): a, c, t, g, unknown or other
  misc_feature (401)..(401): n is a, c, g, or t
  modified_base (591)..(591): a, c, t, g, unknown or other
  misc_feature (591)..(591): n is a, c, g, or t
  modified_base (616)..(616): a, c, t, g, unknown or other
  misc_feature (616)..(616): n is a, c, g, or t
  modified_base (620)..(621): a, c, t, g, unknown or other
  misc_feature (620)..(621): n is a, c, g, or t
  modified_base (626)..(626): a, c, t, g, unknown or other
  misc_feature (626)..(626): n is a, c, g, or t
  modified_base (629)..(629): a, c, t, g, unknown or other
  misc_feature (629)..(629): n is a, c, g, or t
  modified_base (634)..(635): a, c, t, g, unknown or other
  misc_feature (634)..(635): n is a, c, g, or t
tcagacagtatatacacgaccggtgctcgatttagtagtgtagatttgggtttgggctggatccgtcagccccagggaaggcctggagtggcttgcacacatcttctcgaatgacgaaaaatcctacagtacatctctgaagagcagtttaaccatctccaaggacacctaccaaaaggcaggtggtcttagtatgacaacatggaccctgcggacacaggcacatattacngtgcgaacgggtaatggacgggaaanaacagctggtttctgtactataagtcttaccatctggtaccgtcgtggggtcaacgggaccacggtctaccgtctcctcagtccttccaccaacgggcccatcggtccttcccctggccnccctggaccttccgaggacgccnccgtacgtcggggggaccaccgtacgggcccggtcccggtagggtcctaccggtcccggttcgggtaccgaaaccgggtaccttaccgtttaccccgttaagtaaccttaaccgttcggtacgttacgacgggtccgggtaccttacggggaccgaaacgggtccgtaccgaagttaacgggctacgcgngacgtcgcgcgcgacgtcgtcgtancgcnncgacncgncgtcnn

SEQ ID NO: 80840 - DNA, 726 bp, Homo sapiens
  misc_feature: GYAE6OF02JBKT4.44.25.C03.1.454.CMB.1.raw
  modified_base (110)..(110): a, c, t, g, unknown or other
  misc_feature (110)..(110): n is a, c, g, or t
  modified_base (181)..(181): a, c, t, g, unknown or other
  misc_feature (181)..(181): n is a, c, g, or t
  modified_base (231)..(231): a, c, t, g, unknown or other
  misc_feature (231)..(231): n is a, c, g, or t
  modified_base (676)..(676): a, c, t, g, unknown or other
  misc_feature (676)..(676): n is a, c, g, or t
  modified_base (683)..(683): a, c, t, g, unknown or other
  misc_feature (683)..(683): n is a, c, g, or t
  modified_base (689)..(689): a, c, t, g, unknown or other
  misc_feature (689)..(689): n is a, c, g, or t
  modified_base (703)..(703): a, c, t, g, unknown or other
  misc_feature (703)..(703): n is a, c, g, or t
  modified_base (709)..(709): a, c, t, g, unknown or other
  misc_feature (709)..(709): n is a, c, g, or t
  modified_base (712)..(713): a, c, t, g, unknown or other
  misc_feature (712)..(713): n is a, c, g, or t
tcagacagtatatacacgaccggtgctcgatttagtagtgtagatttgggtttgggggctgttcctggaaggtgttggtaccagagggtcaccatctcctgcactgggancagatccaacatcgggacagattctgatgtccatggtaccaacaccttccaggaacagcccccaaatcctnatcctttggaacaactatcggaccctgaggggtccctggaaccgattctnggctcctaagctggcctaccgtcagtccctacccgtggccctaagtcacgttcgggacctccgaaggtcctaggaagtacgtagtaggggtactaactttagttaacccgtcgtaccgtaacggttacccttaagtacggtaaacgtacggtaccgaacgtacccgttaccgtaagggttgggttttacgggggtcggttttacgggaccggggtaaacgggtaacccgtaaacgggtccttacgggaacccggttccgtacggggtacctaacggaccccgtaaagggcccttacccgaccccccgttgggtaccaaccgtttcctcccggtacccccgtcccctcccgttacttactaacgttaccctacgttacgtcggtaccgggtaccgggtacgttccgggaacgtaacgggacggaccgtattacggacgtacacgtnacgtacngtccgntagtacgcagtacngtcacngannctgacgcacgctc

SEQ ID NO: 80841 - DNA, 510 bp, Homo sapiens
  misc_feature: GYAE6OF02GH2BA.44.25.C03.1.454.CMB.1.raw
  modified_base (482)..(490): a, c, t, g, unknown or other
  misc_feature (482)..(490): n is a, c, g, or t
  modified_base (492)..(510): a, c, t, g, unknown or other
  misc_feature (492)..(510): n is a, c, g, or t
tcagacagtatatacacgaccggtgctcgatttagtagtgtagatttgggtttggggggggcagagggtcaccatctcctgcactgggagcagatccaacatcgggacagattctgatgtccactggtaccaacaccttccaggaacagcccccaaactcctcatctttaggtaacaactatccggccctcaggggtccctgacccgattcctctcggctccaagtctggcacctcagcctcctggccatcacgtggctccgaggctgaagatggacgggtgtattaacttactgcctagtccctatacgacagcacgcctcagtgggtttgggtgttcgggcggagggaccaagctgaccgtccgtggtcacgcccgaaggcctcgcccccgtggtcctacgtccgtcgttccccgcccttccctcttactacgtccttgtcgtggtcggccgggtcgtcgggcgaacggcgacagtacgnnnnnnnnncnnnnnnnnnnnnnnnnnnn

SEQ ID NO: 80842 - DNA, 246 bp, Homo sapiens
  misc_feature: GYAE6OF02HQ5X4.44.25.C03.1.454.CMB.1.raw
  modified_base (239)..(246): a, c, t, g, unknown or other
  misc_feature (239)..(246): n is a, c, g, or t
tcagacagtatatacacgaccggtgctcgatttagtagtgtagatttgggtttgggtgcccaagctgctggagggcacggtcaccacggtcaccgtctcctcagcttccaccaagggcccatcggtcttccccctggcgccctgctccaggagcacctctgggggcacagcggccctgggctgcctggtcaaggactacttcctatatactgtctgagcgggctggcaaggcgcatagnnnnnnnn

SEQ ID NO: 80843 - DNA, 641 bp, Homo sapiens
  misc_feature: GYAE6OF02I247A.44.25.C03.1.454.CMB.1.raw
  modified_base (334)..(334): a, c, t, g, unknown or other
  misc_feature (334)..(334): n is a, c, g, or t
tcagacagtatatacacgaccggtgctcgatttagtagtgtagatttgggtttgggggactcctgtgccccaccatggacactctttgctacacactcctgctgctgaccaccccttcctgggtcttgtcccaggtcaccttgaaggagtctggtcctgtgctggtgaaacccacagagaccctcacgctgacctgcaccatctctgggttctctctcaacgatattagaagtgggtgtgagctggatccgtcacgccccgagggacgccctggagtggctgcacacatcttctcgaatgaacgaaaactcctacagtacatctactagaaganactacgttaacatctacgaacgacacctacaaagcgtaggtgttactttagtatacgaccaacagtcgacctgacgacacgagacactattaattacgtagttacgacgtaacgggtagtacgggaacgggaaacgaacgaggtaccgtttagggtttactaggtttaattaagttaacgtaccttaaacgtacgttaccgtaggtaccggttacggtaacggggtaaccgaaacggggtaacccgtaccggtaccgtacccggttccttacccggctaaccggtcccttaccccggtaaacccggg

SEQ ID NO: 80844 - DNA, 248 bp, Homo sapiens
  misc_feature: GYAE6OF02ISZZR.44.25.C03.1.454.CMB.1.raw
  modified_base (239)..(248): a, c, t, g, unknown or other
  misc_feature (239)..(248): n is a, c, g, or t
tcagacagtatatacacgaccggtgctcgatttagtagtgtagatttgggtttgggtgcccaagctgctggagggcacggtcaccacggtcaccgtctcctcagcttccaccaagggcccatcggtcttccccctggcgccctgctccaggagcacctctgggggcacagcggccctgggctgcctggtcaaggactacttcctatatactgtctgagcgggctggcaaggcgcatagnnnnnnnnnn

SEQ ID NO: 80845 - DNA, 570 bp, Homo sapiens
  misc_feature: GYAE6OF02GA8S0.44.25.C03.1.454.CMB.1.raw
  modified_base (174)..(174): a, c, t, g, unknown or other
  misc_feature (174)..(174): n is a, c, g, or t
  modified_base (483)..(483): a, c, t, g, unknown or other
  misc_feature (483)..(483): n is a, c, g, or t
  modified_base (520)..(520): a, c, t, g, unknown or other
  misc_feature (520)..(520): n is a, c, g, or t
  modified_base (548)..(548): a, c, t, g, unknown or other
  misc_feature (548)..(548): n is a, c, g, or t
  modified_base (556)..(556): a, c, t, g, unknown or other
  misc_feature (556)..(556): n is a, c, g, or t
tcagacagtatatacacgaccggtgctcgatttagtagtgtagatttgggtttgggggactcctgtgccccaccatggacactctttgctacacactcctgctgctgaccaccccttcctgggtcttgtcccaggtcaccttgaaggagtctggtcctgtgctggtgaaacccncagagaccctcacgctgacctgcaccatctctgggttctctctcaacgatattagaatgggtgtgagctggactccgtcacgccccagggaaggccctgggagtcggtcttgcacacgatccttcgtcgtaatgaacgaaaaactcctaacagtaccatctctagaagtactacagtttaaccatcctaccgaaggaccacctacaaaggctaaggtgtacgtttagtactaggaccaaacgtagtacgtaccctggaccgaacacgacggacacattaactactgtacgcgtaggaatcggaaggaanaacagtacttggtacttgtattagtactctacatcgngtactcggtaggcaaaggcctacgtacnctctaccnacgtccttcaaccg

SEQ ID NO: 80846 - DNA, 616 bp, Homo sapiens
  misc_feature: GYAE6OF02GNU9V.44.25.C03.1.454.CMB.1.raw
  modified_base (178)..(178): a, c, t, g, unknown or other
  misc_feature (178)..(178): n is a, c, g, or t
  modified_base (241)..(241): a, c, t, g, unknown or other
  misc_feature (241)..(241): n is a, c, g, or t
  modified_base (317)..(317): a, c, t, g, unknown or other
  misc_feature (317)..(317): n is a, c, g, or t
  modified_base (502)..(502): a, c, t, g, unknown or other
  misc_feature (502)..(502): n is a, c, g, or t
  modified_base (592)..(593): a, c, t, g, unknown or other
  misc_feature (592)..(593): n is a, c, g, or t
  modified_base (595)..(616): a, c, t, g, unknown or other
  misc_feature (595)..(616): n is a, c, g, or t
tcagacagtatatacacgaccggtgctcgatttagtagtgtagatttgggtttgggggctgttcctggaaggtgttggtaccagagggtcaccatctcctgcactgggagcagatccaacatcgggacagattctgatgtccatggtaccaacaccttcagaacagcccccaaatccnatcgtttgtaacaactagtcggcctcgacgggtccctgaccgattctctaggcctccaagtcncggcaacctcacgcccttcccgtcggacctatccgtaaccgtcggggccttaccgaaggcctagggtaaaacggtnttaggggtagggggtagttaattttaacgtttaaccgttcgggaccctacggttacccttaaggtacaacgaacgtcacggtcccttagagggttgggttaaggggtcgttcgggaggacgggtaacagccgtcgaccggtcgtagggtcaacgacccgtaaggcctacgccccccgtggtaccnctccgttccggtcccgtccctcccttacgttacttacttacgttcggtagtacggcggccggcgttacggaccgaaggcacgtagactgnncnnnnnnnnnnnnnnnnnnnnnn

SEQ ID NO: 80847 - DNA, 722 bp, Homo sapiens
  misc_feature: GYAE6OF02IAIQV.44.25.C03.1.454.CMB.1.raw
  modified_base (174)..(174): a, c, t, g, unknown or other
  misc_feature (174)..(174): n is a, c, g, or t
  modified_base (308)..(308): a, c, t, g, unknown or other
  misc_feature (308)..(308): n is a, c, g, or t
  modified_base (320)..(320): a, c, t, g, unknown or other
  misc_feature (320)..(320): n is a, c, g, or t
  modified_base (338)..(338): a, c, t, g, unknown or other
  misc_feature (338)..(338): n is a, c, g, or t
  modified_base (578)..(578): a, c, t, g, unknown or other
  misc_feature (578)..(578): n is a, c, g, or t
tcagacagtatatacacgaccggtgctcgatttagtagtgtagatttgggttgggggaagaggaagactgacggtcctcccaggagttcaggtgcgtgggcaccgttgggcgacgggggaggtgtgtcacaagagtttgggctcgtgggcaccggtgggcagtgggggagttgngtcacgaaggatttggaccttccgtgaccgccccacagtggacctattccgtttgcctaacactacgtcctgcttgcctacgacccctaccctttcgtagggttcttacgcctaggttccaacgtttgaaggtntcgtcggtctgngtcgtgggacctaaccanagaccgacctcacgactcgtacctgacctactagttccgtgtttacgggttcctccgtacgttaacgtaaccgtgttaagtttaagaacggttcgggtaagtacggtacgtacgtcggtacgtccgtaccggaaccgtcccgaacggggaccgtaccgtagggtacggtcggtcttacggcctactacgtacgttcgtacgtacgtagtacgaaactaaacgtccgtaagtataaccgtnaccgttgaacgtaaacgtcgtaccgttaaacgttaaccctcgtacgtaaactaccggtaacctaaccgaacgtaacggtcgtaacggtactttacgtaagtctacggtaactaacgtcgtaccggtacgaccgggtagaacccg

SEQ ID NO: 80848 - DNA, 684 bp, Homo sapiens
  misc_feature: GYAE6OF02I3SXQ.44.25.C03.1.454.CMB.1.raw
  modified_base (617)..(617): a, c, t, g, unknown or other
  misc_feature (617)..(617): n is a, c, g, or t
  modified_base (627)..(627): a, c, t, g, unknown or other
  misc_feature (627)..(627): n is a, c, g, or t
  modified_base (637)..(637): a, c, t, g, unknown or other
  misc_feature (637)..(637): n is a, c, g, or t
  modified_base (675)..(676): a, c, t, g, unknown or other
  misc_feature (675)..(676): n is a, c, g, or t
  modified_base (681)..(681): a, c, t, g, unknown or other
  misc_feature (681)..(681): n is a, c, g, or t
tcagacagtatatacacgaccggtgctcgatttagtagtgtagatttgggtttgggggctgttcctggaaggtgttggtaccagagggtcaccatctcctgcactgggagcagatccaacatcgggacagattctgatgtccactggtaccaacaccttccaggaacacgcccccaaactcctcatctttggtaacaactatccggccctcgacgggtccctgacccgtattctctggcctcaagtctggcctacctcacgcccttccctggccatccacgtgggcctccggaggtcctaggaagtcgtgggagggtagtactttacttaacgtcgcctacggttcctagtacgacaagccacgtccctacgaggtttcggggttggggttccggttcgggaccggggtacgggtaaccaacgggtcctaccggtacccggttccggtgggtaccaccggtaccgaaggtccgtacgtcccgtaccgtccgggtcctaacctttcccgtacccggtttccccgacccctttacttacgttaacttacgttaccggttcgttccgtaggaccgggtccggtacggtacggaaccggaccgggcaaccgttaagccggngtagtcgacntacgtactcncgctcgtacgtcacgtacgactcgtcgtactcgtactnntacgngtc

SEQ ID NO: 80849 - DNA, 659 bp, Homo sapiens
  misc_feature: GYAE6OF02IVYAJ.44.25.C03.1.454.CMB.1.raw
  modified_base (271)..(271): a, c, t, g, unknown or other
  misc_feature (271)..(271): n is a, c, g, or t
  modified_base (296)..(296): a, c, t, g, unknown or other
  misc_feature (296)..(296): n is a, c, g, or t
tcagacagtatatacacgaccggtgctcgatttagtagtgtagatttgggtttggggggaagaggaagactgacggtcctcccaggagttcaggtgctgggcaccttgggcacgggggaggtgtgtcacaagatttgggctctgggcaccgtgggcagtgggggagtgtgtcacaagatttggactcctgtgccccaccatggacactctttgctacacactcctgctgctcgaccctaccccttctggtcttcgtccaggtcacttgagngtctgtctgtgctggtacaacccanagacgaccctcgacgctacgacctgaccacctatctcgttcggttcctctactacgaacgtattaactaagaagttcgggtgtacgagtcgtggtactccgtcaccgtcccccgaaggggtaaccgcccgtgggaggtcggtcgttacgaccactacgtacttccgttacgtacgtaagtacgaaaccgtaaaactacctaacgtaacgtactactccttacgtaacggaagtacgtacttaacgtttaaccacttaccgtaccgaaacgtacctaacctaccgaaacggtcgtaacggttacggttaccgttaacgtactacgtaaccaacgtaccgtaccggtaccgtacggaccggaacg

SEQ ID NO: 80850 - DNA, 254 bp, Homo sapiens
  misc_feature: GYAE6OF02IKDI3.44.25.C03.1.454.CMB.1.raw
  modified_base (239)..(254): a, c, t, g, unknown or other
  misc_feature (239)..(254): n is a, c, g, or t
tcagacagtatatacacgaccggtgctcgatttagtagtgtagatttgggtttgggtgcccaagctgctggagggcacggtcaccacggtcaccgtctcctcagcttccaccaagggcccatcggtcttccccctggcgccctgctccaggagcacctctgggggcacagcggccctgggctgcctggtcaaggactacttccacgtctactgctgagcgggctggcaaggcgcatagnnnnnnnnnnnnnnnn

SEQ ID NO: 80851 - DNA, 828 bp, Homo sapiens
  misc_feature: GYAE6OF02FOXU5.44.25.C03.1.454.CMB.1.raw
  modified_base (227)..(227): a, c, t, g, unknown or other
  misc_feature (227)..(227): n is a, c, g, or t
  modified_base (239)..(239): a, c, t, g, unknown or other
  misc_feature (239)..(239): n is a, c, g, or t
tcagacagtatatacacgaccggtgctcgatttagtagtgtagatttgggtttggggggggcacaagaggcagcactcaggacaatctccagcatggcctggtctcctctcctcctcactctcctcgctcactgcacaggtcctggcccactctgtgctgacgcagcccgccctcagtgtcgtcgggggccccgggcaggacggtcaccatcctctgcacgtgggancagtactccaanagtcgggacacgtattctagatcgtccagtcgtaaccactaccttacaggacctacgtacccctaaactcctactacttcgttaggtaaacctaacctacgtacccgggtcccttaggtaaccggggttccccgtcggaccccgttacgtttcctccggtcggtcccttaacccgtaaggttccgtagggtaccctactaacggaccgttaccctaacccggtggaccctaacgtttccgttacgtacctccttaccgtaccgttcggtaacggtacggtaacgtacgggtaacggtccgttaaggttaacctttaccgttaacggtttcggtaccggtactaccgggttacttacgggttaacggggttacgtaaccgggtaacccggtaccggggtaaacccggggtaccgggttaccgggttcggggggttaccgggtttacccgggggtaaccggggtacgggtaaccggttaaaccgggttaccggtaacccccgggttaaccgggttaccggtaaccggtacccggtacccgtaaaccggttccccggttaaccccggtaccccggttcccggttaaccccgg

SEQ ID NO: 80852 - DNA, 471 bp, Homo sapiens
  misc_feature: GYAE6OF02HC30F.44.25.C03.1.454.CMB.1.raw
  modified_base (327)..(327): a, c, t, g, unknown or other
  misc_feature (327)..(327): n is a, c, g, or t
  modified_base (457)..(457): a, c, t, g, unknown or other
  misc_feature (457)..(457): n is a, c, g, or t
  modified_base (460)..(460): a, c, t, g, unknown or other
  misc_feature (460)..(460): n is a, c, g, or t
  modified_base (462)..(471): a, c, t, g, unknown or other
  misc_feature (462)..(471): n is a, c, g, or t
tcagacagtatatacacgaccggtgctcgatttagtagtgtagatttgggtttgggggctgttcctggaaggtgttggtaccagagggtcaccatctcctgcactgggagcagatccaacatcgggacagattctgatgtccactggtaccaacaccttccaggaacagcccccaaactcctcatctttggtaacaactatcggccctcagggtccctgaccgattctctggctccaagtctggcacctcagcctcctggccatcactgggctccagcctgaggacgaggctgactattactgcagctcaatataaaagagccaaanacgtgttatattcggcggagggaccaagctgacccgtctaggtcagcccaagctacgcccccttcgggtctactccgtctcccccgcccttcctctactatacctgtctgacggtcggcgtggcaaggcncangnnnnnnnnnn

SEQ ID NO: 80853 - DNA, 273 bp, Homo sapiens
  misc_feature: GYAE6OF02JQHUA.44.25.C03.1.454.CMB.1.raw
  modified_base (171)..(171): a, c, t, g, unknown or other
  misc_feature (171)..(171): n is a, c, g, or t
  modified_base (245)..(273): a, c, t, g, unknown or other
  misc_feature (245)..(273): n is a, c, g, or t
tcagacagtatatacacgaccggtgctcgatttagtagtgtagatttgggtttgggtgcccaagctgctggagggcacggtcaccacggtcaccgtctcctcagcttccaccaagggcccatcggtccttcccctggcgccctgctccaggagcacctcgtgggggcacgngccggcccgtgggctgcctggtcaaggactacttcctatatactgtctgaggcgggtctggcaaggcgcatagnnnnnnnnnnnnnnnnnnnnnnnnnnnnn

SEQ ID NO: 80854 - DNA, 709 bp, Homo sapiens
  misc_feature: GYAE6OF02FXMLM.44.25.C03.1.454.CMB.1.raw
  modified_base (201)..(201): a, c, t, g, unknown or other
  misc_feature (201)..(201): n is a, c, g, or t
  modified_base (234)..(234): a, c, t, g, unknown or other
  misc_feature (234)..(234): n is a, c, g, or t
tcagacagtatatacacgaccggtgctcgatttagtagtgtagatttgggtttgggggggggcacaagaggcagcactcaggacaatctccagcatggcctggtctcctctcctcctcactctcctcgctcactgcacagggtcctgggcccactctgtgctgacgcacgcccgccctcagtgtcgtcgggggccccgggnaggagggtcaccatcctcctcgcacgtggggancagactaccaacgagtccgggaacagtattctgatcgtcctacgtacggtaaccaacctaccttaccgaacggaaccaccgtaccccctaaactccgtactacgtttacctttaacggtaaacctaacttaacgtcccggacccgttaccggtaccgggggttcccctacggtaacccgttactttcccgtcggtacggtcccttaccgaacgttccgtacggaccctaccgtcctaccgtcccgtcccgtcgacctacgtccaccggtcggcctaccgacggtctaggaagtacggtacgggtaggtacgttacgttacgttacgtcgtaccgtcgttactacgtagaaccaggtcctaccgtcttcgtgggttcgggttcggtcgggtcggaacgggtcgacgtacgtccggtacgtccggtacgtcggtacgaccggtaccgtaccggtccgtcccggtcccggtgttaccc

SEQ ID NO: 80855 - DNA, 624 bp, Homo sapiens
  misc_feature: GYAE6OF02HJKY6.44.25.C03.1.454.CMB.1.raw
  modified_base (278)..(278): a, c, t, g, unknown or other
  misc_feature (278)..(278): n is a, c, g, or t
  modified_base (289)..(289): a, c, t, g, unknown or other
  misc_feature (289)..(289): n is a, c, g, or t
  modified_base (321)..(321): a, c, t, g, unknown or other
  misc_feature (321)..(321): n is a, c, g, or t
tcagacagtatatacacgaccggtgctcgatttagtagtgtagatttgggtttgggggctgttcctggaaggtgttggtaccagtggacatcagaatctgtcccgatgttggatctgctcccagtgcaggagatggtgaccctctgccccggggccccagacactgagggcggctgcgtcagcacagagtgggcccaggaccctgtgcagtgagcgaggagagtgaggaggagaggagaccaggccagtgctggagtattcgtcctgagtgctgcctnttagcgcccanagtctgaagcagacgccctaccaaactcctanattcgtttagaactaactacgtccggtccctggaccggggtccctaggacctatttcctcgtcgtcctaccgaagtttccgtacggcctaccctcgacgtcccctcccgtcggcctactccgacgtcggtcctcgacggtctacgaagtagtaggagggttactaacgttacgttacgtcgtaccttaacgtccttaacgtacgaccgacgtccgacgtaccgtacgtgggttcgggttacgggttccggttcgggaccggggtacggaaccgtaacggtcgtaccggtacccgttacccggg

SEQ ID NO: 80856 - DNA, 807 bp, Homo sapiens
  misc_feature: GYAE6OF02J1EBM.44.25.C03.1.454.CMB.1.raw
  modified_base (398)..(398): a, c, t, g, unknown or other
  misc_feature (398)..(398): n is a, c, g, or t
tcagacagtatatacacgaccggtgctcgatttagtagtgtagatttgggtttgggggaagaggaagactgacggtcctcccaggagttcaggtgctgggcaccttgggcacggggaggtgtgtcacaagtatttgggctctgggcaccggtgggcatggggggagtgtgtcacgaagatttggactcctgtgccccacatggacctctctttgctacacactcctgctgccttgacccctaccccgtttctgggtacctttggtacccccagggttcctaaccgtttggaaacgggtcgttccgttggttaccctggttcggcgttcggggtcgaaaaacccccacgtagggaaccaaccccgttcaccgggccttacggaaccttcggaccaaccncgtttcctccgttacgggtttccttctccgtaccaaaccggttattaaagttacgaagtttgggggttcgtagtaccgtgttacgggacttcccgggtcaacccgggaccccccgaaggggaacccgggtaccccgtttgggggtacggttcggtcccggtttcgaccggtaacctaaccgtattcccgttttacgacgtaaagtaccgaaacgtaaaaacgttcccgtaaacgtaacgtttaacctacttacggttacctaagtaaccggtaacgtaccgtaacgtttaaccctaacgttacccgaccttaacggaaccttaaccgtaccgaaaggtaccgtaaggtacgtttacgttaacgtttagcgaaaccgttacgtaacgttccggaaccgtcgaccggtaac

SEQ ID NO: 80857 - DNA, 720 bp, Homo sapiens
  misc_feature: GYAE6OF02ISPA6.44.25.C03.1.454.CMB.1.raw
  modified_base (274)..(274): a, c, t, g, unknown or other
  misc_feature (274)..(274): n is a, c, g, or t
  modified_base (300)..(300): a, c, t, g, unknown or other
  misc_feature (300)..(300): n is a, c, g, or t
tcagacagtatatacacgaccggtgctcgatttagtagtgtagatttgggtttggggggaagaggaagactgacggtcctcccaggagttcaggtgctgggcaccttgggcacggggggaggtgtgtcacaagatttgggctctgggcaccgtgggcagtggggggagtgtgtcacaagtatttggactcctgtcgcccccacatggacactctttgctacacactcctgctgctgaccctacccttctgggtcttgtcccaggtcacttgagntctggtctgtgctggtacaaaccccnagacgaccctcacgctcgacctgccaccatcctcgtggttctctctacaacgtattagttagaagttgggtagtgagtcgtaggactccgtacaccgtcccccggaaggggacggcccgtagggtacggtcgggtcgttacggaccgtaaccgaaccgtacttccgtttaccgtaccgtaaagtaccggtaaaaccggttaaaaaccttacccgtaaacgtaacgttacctaacttaccgttacgtaacggtaaacgacgtacgttaaaccgtttaaccgtaacgttacccgtaaacgaaaccggaccctaaccgtaaccggtaaaacggtcggtaaacggttccggttaactttaacggtaacgtacgtaacccgtaaacgtaccggttaacccggtacccgtacggtaccggtaaccg

SEQ ID NO: 80858 - DNA, 280 bp, Homo sapiens
  misc_feature: GYAE6OF02H0ONC.44.25.C03.1.454.CMB.1.raw
  modified_base (207)..(207): a, c, t, g, unknown or other
  misc_feature (207)..(207): n is a, c, g, or t
  modified_base (237)..(280): a, c, t, g, unknown or other
  misc_feature (237)..(280): n is a, c, g, or t
tcagacagtatatacacgaccggtgctcgatttagtagtgtagatttgggtttgggtgcccaagctgctggagggcacggtcaccacggtcaccgtctcctcagcttccaccaagggcccatcggtcttccccctggcgccctgctccagagcacctctgggggcacagcggccctgggctgcctggtcaaggactacttccacgtntactgctgagcggctggcaaggcgcatagnnnnnnnnnnnnnnnnnnnnnnnnnnnnnnnnnnnnnnnnnnnn

SEQ ID NO: 80859 - DNA, 763 bp, Homo sapiens
  misc_feature: GYAE6OF02H2YXK.44.25.C03.1.454.CMB.1.raw
  modified_base (146)..(146): a, c, t, g, unknown or other
  misc_feature (146)..(146): n is a, c, g, or t
tcagacagtatatacacgaccggtgctcgatttagtagtgtagatttgggtttgggggactcctgtgccccaccatggacactctttgctacacactcctgctgctgacccacccttcctgggtcttgtcccaggtcacttgaagngtctggtctgtgctggtgaaacccacagacgaccctcacgctcgacctgccaccatcctcgttgggttctctctcaacgtatattagagtgggtgtgagcgtggactccgtaccgaccgaccccgagggaacggccgtggggtagtcggtcttgaccgacacgtacttccgttactacggtaataacgaaacgtaaaaactcctaactacgtaacactcgtacgtaggaaagtacgtaacgtaaccgtttaacctattacctacccgtaaacggtacctaaacccgtaaacggaaaacggtacggtaaggttacggttacgtttaaagtactacgtaaccgaaaccgtacgttaaccggacccgttaggaacccgggtaaccaacggacgtaaccgaacttaacttattaacggtcgtaggtaaccgtaaggttacgtaagggaaacggtaaaaacgacgtacggtacgtttcggttaagttaacgttaatttaacgtaacgttactaacttacgttccgtacggttaccggtcggtacggggaaaccgtaacgggacccgttaaccgtcccgtaccggttacctccgtaacgtacttcccgtaacccgtaaccggg

SEQ ID NO: 80860 - DNA, 769 bp, Homo sapiens
  misc_feature: GYAE6OF02GOXK5.44.25.C03.1.454.CMB.1.raw
  modified_base (199)..(199): a, c, t, g, unknown or other
  misc_feature (199)..(199): n is a, c, g, or t
  modified_base (238)..(238): a, c, t, g, unknown or other
  misc_feature (238)..(238): n is a, c, g, or t
tcagacagtatatacacgaccggtgctcgatttagtagtgtagatttgggtttgggggggcacaagaggcagcactcaggacaatctccagcatggcctggtctcctctcctcctcactctcctcgctcactgcacagggtcctgggcccactctgtgctgacgcagcccgcctcagtgtccgtcggggcccccggggnaggacgggtccacctagtcctccgtgccacgtggggacncagactaccaaacgacgtcggggacaggtacttctgactgtcccaacttcggtaaccaacgtacccttaccgaaggtaaccaccgaccccctaaacgtcctacactttccgtttaggtaaccaacgttacgtccggtccctacggacggggtccctacggtacccgtagttaccgtcgtcggtacctaccgtaacggttccgtacggcctaccgtccgtaaccgtcccgttccccgtcggaccctaacgtccgtaaccggttcgggtacccttacccggaggtacgtagtaaacggaggttacgggacgggttattaacgttaagtccgttcgtacccgttagttacccgttagtacgaccgaggtaccgtaccgttcccgttagtaacgggtttggggttttccgggtacggtccgggggtaaccggacgggaacccgtgggtacccgtacccgggtcccggttacgttacggggaccgtaccggacccggtaacggtcccgttacccggtcccccggtggttaacccgg

SEQ ID NO: 80861 - DNA, 768 bp, Homo sapiens
  misc_feature: GYAE6OF02IT5E0.44.25.C03.1.454.CMB.1.raw
tcagacagtatatacacgaccggtgctcgatttagtagtgtagatttgggtttggggggaagaggaagactgacggtcctcccaggagttcaggtgctgggcaccttggtcacgggggaggtgtgtcacaagatttgggctctgggcaccgtgggcatgggggaggtgtgtcacaagatttggactcctgtgccccaccatggacactctttgctacacactcctgctgctcgaccaccccttcctggtcttgtcccagtcaccttgagcgtctggcctgtgctcggtgaaacccacagacgaccctcacgctgacctgcaccatcgttacctgggttctcctcttacaaccgtattattacgaagttcggggagttggagtcgtggtacgttccgtacgtaccgaccccccgtaaggggaaaccgggtaccccggtgggtaacgggttcgggtcccgtttacggtaccaaccctaaccgtaacgtttcccgtttaccgttaccggttaaaccgtaccgggtaaaaccggtaaaaaactttaacccccgtaacgtaacgttaaaccctaacgtttacctaccgttacggtaacggtaacggtaaccgttaacgttttaaaccctacgtttacccgtaacccgtaaaacggtaccctaaccccgttaacccgaaaacggtaccggtaacgggttacggtttaccgtttaaaggtaccgttacgaacccgtaactacggtaacggtacccctaccgggaccgtaacccgg

SEQ ID NO: 80862 - DNA, 321 bp, Homo sapiens
  misc_feature: GYAE6OF02F0GTB.44.25.C03.1.454.CMB.1.raw
  modified_base (300)..(321): a, c, t, g, unknown or other
  misc_feature (300)..(321): n is a, c, g, or t
tcagacagtatatacacgaccggtgctcgatttagtagtgtagatttgggtttggggggtgtggtggtctccactcccgccttgacggggctgctatctgcctccctggccatcactgggctccaggctgaagatgagggtgattattactgccagtcctatgacagcagcctcagtggttgggtgttcggcggagggaccaagctgaccgtcctgggtcagcccaaggctgccccctggtcactctcgttcccgccctcctctatactactgtctgagcgggctggcaaggcgcatagnnnnnnnnnnnnnnnnnnnnnn

SEQ ID NO: 80863 - DNA, 500 bp, Homo sapiens
  misc_feature: GYAE6OF02FV3ZQ.44.25.C03.1.454.CMB.1.raw
  modified_base (134)..(134): a, c, t, g, unknown or other
  misc_feature (134)..(134): n is a, c, g, or t
  modified_base (317)..(317): a, c, t, g, unknown or other
  misc_feature (317)..(317): n is a, c, g, or t
  modified_base (333)..(333): a, c, t, g, unknown or other
  misc_feature (333)..(333): n is a, c, g, or t
  modified_base (458)..(458): a, c, t, g, unknown or other
  misc_feature (458)..(458): n is a, c, g, or t
  modified_base (462)..(462): a, c, t, g, unknown or other
  misc_feature (462)..(462): n is a, c, g, or t
  modified_base (468)..(468): a, c, t, g, unknown or other
  misc_feature (468)..(468): n is a, c, g, or t
  modified_base (472)..(472): a, c, t, g, unknown or other
  misc_feature (472)..(472): n is a, c, g, or t
  modified_base (475)..(478): a, c, t, g, unknown or other
  misc_feature (475)..(478): n is a, c, g, or t
  modified_base (480)..(480): a, c, t, g, unknown or other
  misc_feature (480)..(480): n is a, c, g, or t
  modified_base (482)..(495): a, c, t, g, unknown or other
  misc_feature (482)..(495): n is a, c, g, or t
  modified_base (497)..(497): a, c, t, g, unknown or other
  misc_feature (497)..(497): n is a, c, g, or t
  modified_base (499)..(500): a, c, t, g, unknown or other
  misc_feature (499)..(500): n is a, c, g, or t
tcagacagtatatacacgaccggtgctcgatttagtagtgtagatttgggtttggggggggcagagggtcaccatctcctgcactgggagcagatccaacatcgggacagattctgatgtccactggtaccaanaccttccaggaacagcccccaaactcctcatctttggtaacaactatcggccctcaggggtccctgaccgattctctggctccaagtctggcacctcagcctccctggcccatcactgggcctccgaggctagaacgatggagggtagatttaattacctgccagtcctatgacagcagcctnagttggtggtgtcggnggagggaccaagctgaccgtcgtggtcacgcccgaaggctcgccccgtgtcactctcgttccccgccctcgtctactactactcgtctgacggtcggtcgtcggcaacggtccgtactagtacgntcangcagtnactnagnnnnangnnnnnnnnnnnnnncntnn

SEQ ID NO: 80864 - DNA, 268 bp, Homo sapiens
  misc_feature: GYAE6OF02INOKV.44.25.C03.1.454.CMB.1.raw
  modified_base (245)..(268): a, c, t, g, unknown or other
  misc_feature (245)..(268): n is a, c, g, or t
tcagacagtatatacacgaccggtgctcgatttagtagtgtagatttgggtttgggtgcccaagctgctggagggcacggtcaccacggtcaccgtctcctcagcttccaccaagggcccatcggtcttcccctggcgccctgctccaggagcacctcgtggggcacagccggccctgggctcgcctggtcaaggactactcctcgatcgcgtctgaggccgggctggaccaaggcgctagtagnnnnnnnnnnnnnnnnnnnnnnnn

SEQ ID NO: 80865 - DNA, 673 bp, Homo sapiens
  misc_feature: GYAE6OF02HBQ3B.44.25.C03.1.454.CMB.1.raw
  modified_base (174)..(174): a, c, t, g, unknown or other
  misc_feature (174)..(174): n is a, c, g, or t
  modified_base (201)..(201): a, c, t, g, unknown or other
  misc_feature (201)..(201): n is a, c, g, or t
  modified_base (238)..(238): a, c, t, g, unknown or other
  misc_feature (238)..(238): n is a, c, g, or t
  modified_base (241)..(241): a, c, t, g, unknown or other
  misc_feature (241)..(241): n is a, c, g, or t
tcagacagtatatacacgaccggtgctcgatttagtagtgtagatttggggtttgggggactcctgtgccccaccatggacactctttgctacacactcctgctgctgaccacccttcctggtcttgtcccaggtcacttgaaggagtctggtcctgtgctggtcgaaacccanagacgaccctcacgctcgacctgcacntctcgtggttctctctacacgtatattagagtgggtngancgtggtactccgtacaccgaccccgtagggacggccgtggagtcggtctcgcacactacttcttactacgagtacgtaaaccgtaaaactaccgtacacgtactactacgtacgtagaacgacgtacttaacgttaacctactacctacgaaccggacctaacccgtaacgaaaggtaccgtagggtacgtttaacgtttaagtacgtaccgaacctacgtaacgtacgtacccgtaggaccggactacgacgagtaacgtacttaagttctagtacgacgtaaggtacggtaacggaacggtaaacgaactcggtcgtttagtacgttaagttactaagttaacttcgtaactacgtcgtagtacggtacgtaggaacgtaccggtcgtaaccgtcctacggtcctacgcctactacccgtagtaacccgg

SEQ ID NO: 80866 - DNA, 552 bp, Homo sapiens
  misc_feature: GYAE6OF02FGILS.44.25.C03.1.454.CMB.1.raw
  modified_base (264)..(264): a, c, t, g, unknown or other
  misc_feature (264)..(264): n is a, c, g, or t
  modified_base (518)..(518): a, c, t, g, unknown or other
  misc_feature (518)..(518): n is a, c, g, or t
  modified_base (521)..(523): a, c, t, g, unknown or other
  misc_feature (521)..(523): n is a, c, g, or t
  modified_base (525)..(552): a, c, t, g, unknown or other
  misc_feature (525)..(552): n is a, c, g, or t
tcagacagtatatacacgaccggtgctcgatttagtagtgtagatttgggtttgggggggggcagagggtcaccatctcctgcactgggagcagatccaacatcgggacagattctgatgtccactggtaccaacaccttccaggaacagcccccaaactcctcatcttggtaacaactatcggccctcaggggtccctgaccgattctctggctcaagtctggtacctcacgtccctccctggcccatccacgtgggctaccnggcctgaagatggagggtgatttatacttgccagtcctatagacaggcagcctcaggttggttggtgttcgggcgggacgggaccaaggctcggtacccgtcgtggggtcacggccccgaaggccgtccggcccccccgtggtccacgttccgtaccggttccccgtccccttccctacgtacttacgttactcggtctacggtacgggtccggggtcttcgggaccggaaacgggcgaccggaagtaacgcancgnnntnnnnnnnnnnnnnnnnnnnnnnnnnnnn

SEQ ID NO: 80867 - DNA, 656 bp, Homo sapiens
  misc_feature: GYAE6OF02GJTWS.44.25.C03.1.454.CMB.1.raw
  modified_base (207)..(207): a, c, t, g, unknown or other
  misc_feature (207)..(207): n is a, c, g, or t
  modified_base (235)..(235): a, c, t, g, unknown or other
  misc_feature (235)..(235): n is a, c, g, or t
  modified_base (299)..(299): a, c, t, g, unknown or other
  misc_feature (299)..(299): n is a, c, g, or t
  modified_base (303)..(303): a, c, t, g, unknown or other
  misc_feature (303)..(303): n is a, c, g, or t
  modified_base (336)..(336): a, c, t, g, unknown or other
  misc_feature (336)..(336): n is a, c, g, or t
  modified_base (442)..(442): a, c, t, g, unknown or other
  misc_feature (442)..(442): n is a, c, g, or t
tcagacagtatatacacgaccggtgctcgatttagtagtgtagatttgggtttgggggcttcagctgtgggcacaagaggcagcactcaggacaatctccagcatggcctggtctcctctcctcctcactctcctcgctcactgcacagggtcctgggcccactctgtgctgacgcagccgccctcagtgtcgtcggggccccgggnagagggtcaccatctcctgcactgggancagactccaacatcggacagattctgatgccatcgtaccaacaccttccagacacgccccaacncctnatcttagtaacactatcgcctcgacgggtcccngaccgtattctcgtgcctacctaagtctcgggacaccctcacgcccttcccgcggctactccacgtcggaccttccgaggtcgtaggaactacgtggtaacgggtntaagttttactacgtcgtacccgtacggttaccttaacgtcgtaaacgacgtaccgtccggtacccttaccggtaagggttttcgggggtttacggggttacggggtttcccgggggtaacggggtaaacgggtaaccccggaaacgggttccgttaccggttaaccccggggttcccggttaccgggggtcccggtaacggtaaccccccggg

SEQ ID NO: 80868 - DNA, 815 bp, Homo sapiens
  misc_feature: GYAE6OF02HWA42.44.25.C03.1.454.CMB.1.raw
tcagacagtatatacacgaccggtgctcgatttagtagtgtagatttgggtttggggggaagaggaagactgacggtcctcccaggagttcaggtgctgggcaccttgggcacgggggaggtgtgtcacaagatttgggctctgggcaccgtgggcagtgggggagtgtgtcacaagtatttggactcctgtgccccacatggacactctttgactacacactcctgctgctcgaccctaccccttcgtggtcttcgtcccgaggtccaccgttggaaggtagttctcggtccttgtggtcgttaggtacgaaacccctacgacgaccgtaccctaccgtaacgcctacggaccttcgaccaaccctattccgtccgttacgggtttcctcttaccgttacgaaaccgttattaaacgttaaggtaacgttggggttacgtacgggtacgtccggttacggaccgttcccgtacggaaccccggacccccggtaagggggtaacccggcccgttaggggtacggttcgggtccgtttacgacctaacgtaaccttacgttaccttaccgtaacgtaaacgtaaccggtaaaaccgtaaaaccgtttacccgtaaacgtaacgttaacgtaccgtaaccgttacgtaacgtaaacggtacgtaaaccttaacgttaaccgttaactccgtaaccgaaccgtaacccgtacccgtaaacggtaaccggtaccggtaaagggttaccggtttaacgttaacgttaaccgtacgaaccccgttaagtaccgtaccgggtaccgtacgtaccggtaaccg

SEQ ID NO: 80869 - DNA, 776 bp, Homo sapiens
  misc_feature: GYAE6OF02G0E2B.44.25.C03.1.454.CMB.1.raw
  modified_base (220)..(220): a, c, t, g, unknown or other
  misc_feature (220)..(220): n is a, c, g, or t
tcagacagtatatacacgaccggtgctcgatttagtagtgtagatttgggtttgggggaagaggaagactgacggtcctcccaggagttcaggtgctgggcaccttgggcacgggggaggtgtgtcacaagatttgggctctgggcaccgtgggcagtgggggaggtgtgtcacaagatttggactcctgtcgccccacagtgacactctttgctacacnctctgctgctacgaccctaccccttcgtcgggttccttggtccccagggtcctacccgttaggaacgtgttccgtcggttccctgttcgtcgttacgggtaaccgaaaaccccgtacgaccggacgttaacccccgtctaaccggtcttaccggaaccccttggacccaaccgtactcgttcgttcgggtttcctcctaccgtacaaatacgttattaacgaaggttcggtgtagacgtctagtacgttccggcaccggacccgagggtaaccgtcccgtaggtcggtcgtacgttccgaacgaccgacttacttcgttacgtaacctaaaggtaacgtaaaaccgtaaaactacccgttaacgaaccggttactaaccgtctttaacggtaacaaacgtacgtaaccgttaaccgtttaaccctaaaccgttctaaaccgtaaaccggtaccgtaacccgtaccgtaaacggacgttaaccgggttagtttaaccgttaaggtaacctaacgaaccggttaacacgttacccggtaaccgtcggacccgtaaccg

SEQ ID NO: 80870 - DNA, 270 bp, Homo sapiens
  misc_feature: GYAE6OF02H8RUM.44.25.C03.1.454.CMB.1.raw
  modified_base (153)..(153): a, c, t, g, unknown or other
  misc_feature (153)..(153): n is a, c, g, or t
  modified_base (244)..(270): a, c, t, g, unknown or other
  misc_feature (244)..(270): n is a, c, g, or t
tcagacagtatatacacgaccggtgctcgatttagtagtgtagatttgggtttgggtgcccaagctgctggagggcacggtcaccacggtcaccgtctcctcagcttccaccaagggcccatcggtcttccccctggcgccctgctccaggancacctcgtgggggcacagcggccctgggctgcctggtcaaggactacttccacgtctactgctgacggcgggctggcgaaggcgcagtagnnnnnnnnnnnnnnnnnnnnnnnnnnn

SEQ ID NO: 80871 - DNA, 314 bp, Homo sapiens
  misc_feature: GYAE6OF02I7TBS.44.25.C03.1.454.CMB.1.raw
  modified_base (246)..(247): a, c, t, g, unknown or other
  misc_feature (246)..(247): n is a, c, g, or t
  modified_base (250)..(314): a, c, t, g, unknown or other
  misc_feature (250)..(314): n is a, c, g, or t
tcagacagtatatacacgaccggtgctcgatttagtagtgtagatttgggtttggggtgcccaagctgctggagggcacggtcaccacggtcaccgtctcctcagcttccaccaagggcccatcggtcttccccctggcgccctgctccaggagcacctctgggggcacagcggccctgggctgcctggtcaaggactacttccatactactgtctgagcgggcgtggcgaacggcgacaatacgnngannnnnnnnnnnnnnnnnnnnnnnnnnnnnnnnnnnnnnnnnnnnnnnnnnnnnnnnnnnnnnnnn

SEQ ID NO: 80872 - DNA, 397 bp, Homo sapiens
  misc_feature: GYAE6OF02H2WUN.44.25.C03.1.454.CMB.1.raw
  modified_base (143)..(143): a, c, t, g, unknown or other
  misc_feature (143)..(143): n is a, c, g, or t
  modified_base (175)..(175): a, c, t, g, unknown or other
  misc_feature (175)..(175): n is a, c, g, or t
  modified_base (306)..(306): a, c, t, g, unknown or other
  misc_feature (306)..(306): n is a, c, g, or t
  modified_base (308)..(308): a, c, t, g, unknown or other
  misc_feature (308)..(308): n is a, c, g, or t
  modified_base (315)..(315): a, c, t, g, unknown or other
  misc_feature (315)..(315): n is a, c, g, or t
  modified_base (317)..(318): a, c, t, g, unknown or other
  misc_feature (317)..(318): n is a, c, g, or t
  modified_base (323)..(323): a, c, t, g, unknown or other
  misc_feature (323)..(323): n is a, c, g, or t
  modified_base (327)..(327): a, c, t, g, unknown or other
  misc_feature (327)..(327): n is a, c, g, or t
  modified_base (331)..(397): a, c, t, g, unknown or other
  misc_feature (331)..(397): n is a, c, g, or t
tcagacagtatatacacgaccggtgctcgatttagtagtgtagatttgggtttgggggggtgtggtggtctccactcccgccttgacggggctgctatctgcctccctggccatcactgggctccaggctgaagatgagggtnattattactgccagtcctatgacagcagcctnagtggttggtgtcggcggaggaccaagctgaccgtcctgggtcagcccaaggctcgccccctggtcactcctgttccccgccttcctctatacttactgtctgaggtcgggctggacaaggccacatagcngnttagctnanntagcnatcngcgnnnnnnnnnnnnnnnnnnnnnnnnnnnnnnnnnnnnnnnnnnnnnnnnnnnnnnnnnnnnnnnnnnn

SEQ ID NO: 80873 - DNA, 816 bp, Homo sapiens
  misc_feature: GYAE6OF02I9VIO.44.25.C03.1.454.CMB.1.raw
tcagacagtatatacacgaccggtgctcgatttagtagtgtagatttgggtttgggggcttcagctgtgggcacaagaggcagcactcaggacaatctccagcatggcctggtctcctctcctcctcactctcctcgctcactgcacagggtcctgggcccactctgtcgctcgacgcacgccgccctcagtcgtacgtcgggggcccccggggcgagggggtcaccctatccttcgtttacgttcgtagggaaacggtacgtccctaaagtacttccgggacttcttaagttcccgttagtacctaacgtacggttacgtaccgggggtaccctcccgaacgggtccaaacccgggccccccggtacttaccttacgttactacgtgaccttaactaacttcgacgcccggcctcggacggggtcccttacggcccgtactttccgtaccgttcggtacccttacccgaaggtttaccgtcgggaacctacctaaccggtacggtaccccgttaccgtccggtacccgtaacctttcccgttaccgtacgttacccgttcccgtaaccggttacgtacgggtaacggtagtcgaacggttccgtagttaactttaacgtacgttacggtcgtaccgtacgacgttacggtaacgggttattaacggaaccgtaccgggacccgggtaaacgtccgggttaccggggttacgggttaccgggaacggggtaacccgggttaaacgtacggttaaccgttaccggttaccggtacggtccggacgaaccccggtacgggtcccttacccggtacccg

SEQ ID NO: 80874 - DNA, 728 bp, Homo sapiens
  misc_feature: GYAE6OF02IXVBD.44.25.C03.1.454.CMB.1.raw
  modified_base (61)..(61): a, c, t, g, unknown or other
  misc_feature (61)..(61): n is a, c, g, or t
  modified_base (593)..(593): a, c, t, g, unknown or other
  misc_feature (593)..(593): n is a, c, g, or t
  modified_base (717)..(717): a, c, t, g, unknown or other
  misc_feature (717)..(717): n is a, c, g, or t
  modified_base (723)..(723): a, c, t, g, unknown or other
  misc_feature (723)..(723): n is a, c, g, or t
  modified_base (727)..(727): a, c, t, g, unknown or other
  misc_feature (727)..(727): n is a, c, g, or t
tcagacagtatatacacgaccggtgctcgatttagtagtgtagatttgggtttgggggacncctagttcggccgggggggcccctaagactctcctgtctcgtctctgaacccacctttagcagctactggatgcactgggtccgccaagctccaggaaaggcctgatgtgggtctcacgtattaacaccgagtgggactatcacgtggtactcacgacgccgtagaagggccgattcatcatctcagagacaatgtacgaaacgacggtgtaacttaacaatagaacacgttacgtaaggtaggtacggaggaacgacggtacgtgtactaacgttagttggttagtacggtacgtaccgttaagttcgtagttttactacggtttggggggtaactttacgttaccggttcgggacccgtaacgtacggtcggggtaccggtaacgggtaccgtttacggggttccgttacggttccttaccgtaccgttaggtacccttacccgtaacccggtaaccgggtacccgtacgttcccggttacccgtttccccgtaccgggtcccgtacccgtcgtaccgtccgacggtacnccgtaccgtcgtcgggaccacgcgccggcgtccgggctcgccgtgtaccgaggtacctacgttactaacgtacttacgtacgtcgtcggacggtccggtcggtacgtacggacggttcgaccgngtacgngtgng

SEQ ID NO: 80875 - DNA, 191 bp, Homo sapiens
  misc_feature: GYAE6OF02H5HEE.44.25.C03.1.454.CMB.1.raw
  modified_base (189)..(191): a, c, t, g, unknown or other
  misc_feature (189)..(191): n is a, c, g, or t
tcagacagtatatacacgaccggtgctcgatttagtagtgtagatttgggtttgggggaggtgtgtcacaatatttgggctctgggcaccgtgggcacgggggagtgtgtcacaagatttgggccctgggctgcctggtcaaggactacttcctatatactgtctgagcgggctggcaaggcgcatagnnn

SEQ ID NO: 80876 - DNA, 646 bp, Homo sapiens
  misc_feature: GYAE6OF02FZN69.44.25.C03.1.454.CMB.1.raw
  modified_base (296)..(296): a, c, t, g, unknown or other
  misc_feature (296)..(296): n is a, c, g, or t
  modified_base (307)..(307): a, c, t, g, unknown or other
  misc_feature (307)..(307): n is a, c, g, or t
  modified_base (608)..(608): a, c, t, g, unknown or other
  misc_feature (608)..(608): n is a, c, g, or t
  modified_base (611)..(612): a, c, t, g, unknown or other
  misc_feature (611)..(612): n is a, c, g, or t
  modified_base (615)..(616): a, c, t, g, unknown or other
  misc_feature (615)..(616): n is a, c, g, or t
  modified_base (619)..(620): a, c, t, g, unknown or other
  misc_feature (619)..(620): n is a, c, g, or t
  modified_base (622)..(629): a, c, t, g, unknown or other
  misc_feature (622)..(629): n is a, c, g, or t
  modified_base (633)..(646): a, c, t, g, unknown or other
  misc_feature (633)..(646): n is a, c, g, or t
tcagacagtatatacacgaccggtgctcgatttagtagtgtagatttgggtttggggggggcagagggtcaccatctcctgcactagggagcagactccaacatcgggacagattctgatcgtcactggtaccaacaccttacgagggaacacgacccccaaactcctcattctttaggtaactaactatcggccctcgagggggtccctaggacccgtattctacgtggccttaccaaggtctcggaccaaccgtccacgtccctcccttcggccatccacgtcgggcctaccgnggctcgaaggntcggaggtgtaactttagttacctgacccctagttccctaagtcgacctagcgacgccgtcgaggttgggtcgggttacgggtcgggagggaacggtaaccgaacggtccgttacggaccggttcggtagggtacccacgggcccgtaagggtcctcccggccccgttaggtacctacctttccgttaccccggttccccctacccttccttacctttacgtaccgttactttaccggtcgttacgggaaccgggtcgggtccggtacgggaccggtaacggtccggtactaagttcggcngcnngcnncgnncnnnnnnnngcgnnnnnnnnnnnnnn

SEQ ID NO: 80877 - DNA, 316 bp, Homo sapiens
  misc_feature: GYAE6OF02FHP1P.44.25.C03.1.454.CMB.1.raw
  modified_base (208)..(208): a, c, t, g, unknown or other
  misc_feature (208)..(208): n is a, c, g, or t
  modified_base (294)..(294): a, c, t, g, unknown or other
  misc_feature (294)..(294): n is a, c, g, or t
  modified_base (300)..(316): a, c, t, g, unknown or other
  misc_feature (300)..(316): n is a, c, g, or t
tcagacagtatatacacgaccggtgctcgatttagtagtgtagatttggggtttgggggggtgtggtggtctccactcccgccttgacggggctgctatctgcctccctggccatcactgggctccaggctgaagatgagggtgattattactgccagtcctatgacagcagcctcagtggttgggtgttcggcggagggaccaagcngaccgtctgggtcagcccaaggctgcccccctggtcactctgttcccgcccctctctatatactgtctgagcgggctggcaaggcncatagnnnnnnnnnnnnnnnnn

SEQ ID NO: 80878 - DNA, 307 bp, Homo sapiens
  misc_feature: GYAE6OF02HFMKD.44.25.C03.1.454.CMB.1.raw
  modified_base (293)..(293): a, c, t, g, unknown or other
  misc_feature (293)..(293): n is a, c, g, or t
  modified_base (298)..(307): a, c, t, g, unknown or other
  misc_feature (298)..(307): n is a, c, g, or t
tcagacagtatatacacgaccggtgctcgatttagtagtgtagatttgggtttggggggtgtggtggtctccactcccgccttgacggggctgctatctgcctccctggccatcactgggctccaggctgaagatgaggtgattattactgccagtcctatgacagcagcctcgagttggttgggtgttcggcggagggaccaagctgaccgtctgggtcagcccaggctcgccccctggtcactctcgttccccgcctctctatactactgtctggagcggctggcaaggcncatgnnnnnnnnnn

SEQ ID NO: 80879 - DNA, 746 bp, Homo sapiens
  misc_feature: GYAE6OF02JZMRS.44.25.C03.1.454.CMB.1.raw
  modified_base (408)..(408): a, c, t, g, unknown or other
  misc_feature (408)..(408): n is a, c, g, or t
tcagacagtatatacacgaccggtgctcgatttagtagtgtagatttgggtttgggggactcctgtgccccaccatggacactctttgctacacactcctgctgctgaccacccttcctggtcttgtccaggtcaccttgaaggagtctggtcctgtgctggtacgaaacccacagacgaccctcacgctgacctgcaccatctcgtggttctctctacaacgtattattacgaagtgggtgtagagcgtaggtacgtccgtccaccggaccccggagggtaaccggtcccgtggtacggtgtccgttggacaaccgactacttccttacctacgtaacgtacgaaaacgtaaacgtacctaacgacgtaactacgttactacgtacgaagacgtactaacgttaacnctacgtaccgaacgtacaccgtaacgaaggtacgtaggttacgttagttaacgtaacgtacgtaaccgacgttacgtaccggtaacctccgggaacgtaacgaacgtacggaactaacgttaagttaaccgttcgtacggtacggtacgttaaacgggtacgtaaacgggacgtaaaacggtaccgtagttcggttaggtttaacgtagtttaacgttacgttaacttacctaacgttagtacggttacgtaacggttacggggaaccggtaacgtaacgggaaccggtacgtacctaccggttaccgcgttaccgacggttacccctaacgtaccgg

SEQ ID NO: 80880 - DNA, 247 bp, Homo sapiens
  misc_feature: GYAE6OF02H100M.44.25.C03.1.454.CMB.1.raw
  modified_base (186)..(186): a, c, t, g, unknown or other
  misc_feature (186)..(186): n is a, c, g, or t
  modified_base (212)..(212): a, c, t, g, unknown or other
  misc_feature (212)..(212): n is a, c, g, or t
  modified_base (217)..(219): a, c, t, g, unknown or other
  misc_feature (217)..(219): n is a, c, g, or t
  modified_base (221)..(247): a, c, t, g, unknown or other
  misc_feature (221)..(247): n is a, c, g, or t
tcagacagtatatacacgaccggtgctcgatttagtagtgtagatttgggtttgggggaagaggaagactgacggtcctcccaggagttcaggtgctgggcaccttgggcatgggggaggtgtgtcacaagatttgggctctgggcacagcggccctgggctgcctggtcaaggctacttcctatntactgtctgagcggctggcaaggcgnatagnnnannnnnnnnnnnnnnnnnnnnnnnnnnn

SEQ ID NO: 80881 - DNA, 663 bp, Homo sapiens
  misc_feature: GYAE6OF02H2WV8.44.25.C03.1.454.CMB.1.raw
  modified_base (220)..(220): a, c, t, g, unknown or other
  misc_feature (220)..(220): n is a, c, g, or t
  modified_base (312)..(312): a, c, t, g, unknown or other
  misc_feature (312)..(312): n is a, c, g, or t
  modified_base (328)..(328): a, c, t, g, unknown or other
  misc_feature (328)..(328): n is a, c, g, or t
tcagacagtatatacacgaccggtgctcgatttagtagtgtagatttgggtttggggggaagaggaagactgacggtcctcccaggagttcaggtgctgggcaccttgggcacgggggagtgtgtcacaagatttgggctctgggcaccgtgggcagtgggggagtgtgtcacaagtatttggactcctgtcgccccacatggacacttcttgctacacnctcctgctgctgaccctcccttcgtgggtccttcgtcccaggttccaccgttaggaaggtcgtctcggtccttgtgcgttggacgaacccanacgacgaccctacacnctagacctcgccaccattctcgttcggttctctctacaacgtactaattagtagtgggttcgtaggacgtcgtcggtactccgtacgtaccgacccccggaaggggacgcccggtagggacggtcgtcgttcgaccacacttacttctacgtacgaacgtagtaaaacctaaacgtaccttaacgaacgttactactacttacgtacgaacgtacgtaccttaagttaacctacttacgaaccgtacgaacctaccgtaaccgaacgtcgtaacggttcgtttacgttaagtactacgtaacctacgtacgtacccggtacgtacggacgaaccg

SEQ ID NO: 80882 - DNA, 652 bp, Homo sapiens
  misc_feature: GYAE6OF02F3BZ3.44.25.C03.1.454.CMB.1.raw
  modified_base (241)..(241): a, c, t, g, unknown or other
  misc_feature (241)..(241): n is a, c, g, or t
  modified_base (310)..(310): a, c, t, g, unknown or other
  misc_feature (310)..(310): n is a, c, g, or t
  modified_base (591)..(591): a, c, t, g, unknown or other
  misc_feature (591)..(591): n is a, c, g, or t
tcagacagtatatacacgaccggtgctcgatttagtagtgtagatttgggtttgggggggcagagggtcaccatctcctgcactgggagcagatccaacatcgggacagattctgatgtccactggtaccaacaccttcaggaacacgcccccaaactcctcatctttaggaacaactatccggccctgacgggtccctgaccgattctctggcctacagtctggccactcacgtcctccngccatcacgtggcctaccgaggtctagaagagtggagggtactattattccgtcgcctagttacctagngacagaccacgtcctaggaggttcgggttacgggtagttcggggaccggtacggtaccgtaagtccgtaccgaccgttccggagggtacccacggaccccgtaaggtcccgtcccgtacccccggttcggtacccacccgtttcccgttacccgttcccccgtaccccttccgttaccttaactaccgtttccgtacgttccgtacggtaccgggtccggtaccggtacggaccggaaccggtaccgtaccgagttacgtcgacgcacgtcaatgtgtgcncgtcgactggaactgccaattccgcgtacgatactacactacgctcactactcgactctcg

SEQ ID NO: 80883 - DNA, 829 bp, Homo sapiens
  misc_feature: GYAE6OF02JY6IL.44.25.C03.1.454.CMB.1.raw
  modified_base (292)..(292): a, c, t, g, unknown or other
  misc_feature (292)..(292): n is a, c, g, or t
tcagacagtatatacacgaccggtgctcgatttagtagtgtagatttgggtttgggggggggcacaagaggcagcactcaggacaatctccagcagtggctggtctcctctcctcctcactctcctcgctcactgaccacgagggtccgtcgggcccacgttctggtcgtctagaccgcgacggccccgtcccgtcgtaggtcggttccgggtccggggggaccccggggcgaagggacggggtaccaaccgtacctccgtccgtcggacctacgggagggacgacggtaanaaccgtaccgaacgtaggtaccgggactaggtacttcgtagtacgtccgtcctacgtacgtaaccaaccttaccttacgaacggaacctacccgaacccctaacgtacctaccttaagttccgttaaacgtaacgtaaacctccgtaacccgtccggtaccgggtaccggttccgttaccggacgttcttaccgtcgtacgtaccgtacgtacgtcgtacgacccgttctacctaccgtcccgtacttaccggcctaacggtccgtaaccggtccggacctaccggtacggtcgtaacggtaacgttacgggttaacggttacggtaagtttcttaaccggttacggtacgtccctttaacggtacctaaggttcgacgtacgtacgtccgtacgttacggttcgggttttaacgggtcgggttaccggtacgggaacggggtaccaacggtaacggttcccgggtacggttcccggtggtaaccgtacgggacctaccggtccggtaccccggtacgtccccggttaacgtacccg

SEQ ID NO: 80884 - DNA, 253 bp, Homo sapiens
  misc_feature: GYAE6OF02G4019.44.25.C03.1.454.CMB.1.raw
  modified_base (239)..(253): a, c, t, g, unknown or other
  misc_feature (239)..(253): n is a, c, g, or t
tcagacagtatatacacgaccggtgctcgatttagtagtgtagatttgggtttgggtgcccaagctgctggagggcacggtcaccacggtcaccgtctcctcagcttccaccaagggcccatcggtcttccccctggcgccctgctccaggagcacctctgggggcacagcggccctgggctgcctggtcaaggactacttcctatatactgtctgagcgggctggcaaggcgcatagnnnnnnnnnnnnnnn

SEQ ID NO: 80885 - DNA, 259 bp, Homo sapiens
  misc_feature: GYAE6OF02JWMPL.44.25.C03.1.454.CMB.1.raw
  modified_base (241)..(259): a, c, t, g, unknown or other
  misc_feature (241)..(259): n is a, c, g, or t
tcagacagtatatacacgaccggtgctcgatttagtagtgtagatttgggtttgggtgcccaagctgctggagggcacggtcaccacggtcaccgtctcctcagcttccaccaaggggcccatcggtcttcccctggcgccctgctccaggagcacctctgggggcacagcggccctgggctgcctggtcaaggactacgttccacgtctactgctgagcgggctggcaaggcgcataggnnnnnnnnnnnnnnnnnnn

SEQ ID NO: 80886 - DNA, 254 bp, Homo sapiens
  misc_feature: GYAE6OF02FGIVV.44.25.C03.1.454.CMB.1.raw
  modified_base (241)..(254): a, c, t, g, unknown or other
  misc_feature (241)..(254): n is a, c, g, or t
tcagacagtatatacacgaccggtgctcgatttagtagtgtagatttgggtttgggtgcccaagctgctggagggcacggtcaccacggtcaccgtctcctcagcttccaccaagggcccatcggtcttccccctggcgccctgctccaggagcacctccgagagcacagcggccctgggctgcctggtcaaggactacttccacgtctactgctgagcgggctcgggcaaggcgcatagnnnnnnnnnnnnnn

SEQ ID NO: 80887 - DNA, 759 bp, Homo sapiens
  misc_feature: GYAE6OF02I16CF.44.25.C03.1.454.CMB.1.raw
  modified_base (681)..(681): a, c, t, g, unknown or other
  misc_feature (681)..(681): n is a, c, g, or t
  modified_base (698)..(698): a, c, t, g, unknown or other
  misc_feature (698)..(698): n is a, c, g, or t
  modified_base (703)..(703): a, c, t, g, unknown or other
  misc_feature (703)..(703): n is a, c, g, or t
  modified_base (750)..(750): a, c, t, g, unknown or other
  misc_feature (750)..(750): n is a, c, g, or t
tcagacagtatatacacgaccggtgctcgatttagtagtgtagatttgggtttggggggcagagggtcaccatctcctgcactggagcagatccaacatcgggacagattctgatgtccactggtaccaacaccttccaggacacgccccaaactcctcatcgtttaggtaacaactatccggccctcgacggggtccctaggaccgtacttctctggcctccgaagtctcggccactcacgcctcccgtggaccctatccaacgtcgggccaccgagcgtagaacgtgtcgggtagggtactaagtttacttacgaccgtcaacgttccgtaagtacgacgtacgcccgacgtcccgtcgttaggttcggggttttcggtcggtttcggggaacgggtacgggaacctaagggtccgtcgggttaaccccggtccggttacgggtaccgtaaccgtacccggtaaccgggtcgtttaccccggaaccccccggtttcgtaccgtaccccgttttacccgtcccgggttttacccccctaaccccgttcccgtttaacgttaacctttaaccgttcccggttaacggttcccgttaacgggtcgggtacccggttcggtaaccggggttaccgaaccggtacggttaccggtaaacgttacggcaacgggtccagtttacncgtaggcctgaaccgtnacgtntacgacgtacgcgacgtgtcgcgacgtcgtacacgtgtacgtacgcncgcacgtgc

SEQ ID NO: 80888 - DNA, 592 bp, Homo sapiens
  misc_feature: GYAE6OF02G9WZ3.44.25.C03.1.454.CMB.1.raw
  modified_base (124)..(124): a, c, t, g, unknown or other
  misc_feature (124)..(124): n is a, c, g, or t
  modified_base (138)..(138): a, c, t, g, unknown or other
  misc_feature (138)..(138): n is a, c, g, or t
  modified_base (267)..(267): a, c, t, g, unknown or other
  misc_feature (267)..(267): n is a, c, g, or t
  modified_base (309)..(309): a, c, t, g, unknown or other
  misc_feature (309)..(309): n is a, c, g, or t
  modified_base (343)..(343): a, c, t, g, unknown or other
  misc_feature (343)..(343): n is a, c, g, or t
  modified_base (350)..(350): a, c, t, g, unknown or other
  misc_feature (350)..(350): n is a, c, g, or t
  modified_base (376)..(376): a, c, t, g, unknown or other
  misc_feature (376)..(376): n is a, c, g, or t
  modified_base (386)..(386): a, c, t, g, unknown or other
  misc_feature (386)..(386): n is a, c, g, or t
  modified_base (430)..(430): a, c, t, g, unknown or other
  misc_feature (430)..(430): n is a, c, g, or t
  modified_base (527)..(527): a, c, t, g, unknown or other
  misc_feature (527)..(527): n is a, c, g, or t
  modified_base (564)..(564): a, c, t, g, unknown or other
  misc_feature (564)..(564): n is a, c, g, or t
  modified_base (570)..(592): a, c, t, g, unknown or other
  misc_feature (570)..(592): n is a, c, g, or t
tcagacagtatatacacgaccggtgctcgatttagtagtgtagatttgggtttgggggctgttcctggaaggtgttggtaccaggagggtcaccatctcctcgcactgggagcagaatccaacntcgggacagattcngatgtccactggtaccaacaccgttccaggaacacgcccccaaactcctcattctttggaacaactatcggccctcgaggggttccctgaccgtattctcgtgctccagtctggcacctcagcctccgngccatcacgtcggctccgaggctagaacgtaagtggagggtntaacttagttactcgacccgtagtcctagtcgancggaccngtcccctagtaggttggggtttcggngggttccggngggaaccggaactacgcgtagtacccggtcgtacgggtcaaccnccccgggtaagtcccgtaccccgttccccgtaacggtcctaccgttcccggtttctccccccgtccccttcgtccttaactacgttctcggttaccnggtcgggtaccggcgtaggccgtaagggcctaagtancgtgcnnnnnnnnnnnnnnnnnnnnnnn

SEQ ID NO: 80889 - DNA, 749 bp, Homo sapiens
  misc_feature: GYAE6OF02GXJ9F.44.25.C03.1.454.CMB.1.raw
  modified_base (349)..(349): a, c, t, g, unknown or other
  misc_feature (349)..(349): n is a, c, g, or t
tcagacagtatatacacgaccggtgctcgatttagtagtgtagatttgggtttggggggaagaggaagactgacggtcctcccaggagttcaggtgctgggcacgggttcactcaacaaccacatctgtcctctagagaaaaccctgtagagcacagctcctcaccatggactggacctgggaggatcgtcttcgttggtggcagcagctacaaggacgccactcccaggtaccagctggtgctaggtcgtggggctaggacggtagaagaggtccgtggggcctacagtgactagtctacctgccgacggtcttcgacgtataccgtacgtacgtactactaattacnggtacttagttaacgtgggtacgtacgacgaacggtccgtacgtaagggaccgaacggggtcggtagggtaagggtaggtaggttaggggtagtcgggtaaaggtacggaacgtacccgttaacgtaaggtcgggaaactaaacgggtacgggttccgttaacggaaccccgtaagttaaccgggtacccggtaaggaccgtaaagggttagggttaacaacggtagaccggaagggtaccaccgacccgttacccgtaaggttaccctaacggttacgtaaaccgttggacccgggtaactacgggtaacgaccgtaacgtacccggttaagaacggttaccgttacgggaccggtaagggtaacccgtacgggtttacccggtaggttttaaacccgg

SEQ ID NO: 80890 - DNA, 286 bp, Homo sapiens
  misc_feature: GYAE6OF02JZCL7.44.25.C03.1.454.CMB.1.raw
  modified_base (151)..(151): a, c, t, g, unknown or other
  misc_feature (151)..(151): n is a, c, g, or t
  modified_base (226)..(226): a, c, t, g, unknown or other
  misc_feature (226)..(226): n is a, c, g, or t
  modified_base (250)..(250): a, c, t, g, unknown or other
  misc_feature (250)..(250): n is a, c, g, or t
  modified_base (252)..(286): a, c, t, g, unknown or other
  misc_feature (252)..(286): n is a, c, g, or t
tcagacagtatatacacgaccggtgctcgatttagtagtgtagatttgggtttgggtgcccaagctgctggagggcacggtcaccacggtcaccgtctcctcagcttccaccaagggcccatcggtcttcccctggcgccctgctccaggngcacctctgggggcacaggccggcccgtgggcctgccctggtcaaggctacgttcctaatatacctgtactggancggggctgggcaagggcgcatagntnnnnnnnnnnnnnnnnnnnnnnnnnnnnnnnnnnn

SEQ ID NO: 80891 - DNA, 254 bp, Homo sapiens
  misc_feature: GYAE6OF02I7FWB.44.25.C03.1.454.CMB.1.raw
  modified_base (242)..(254): a, c, t, g, unknown or other
  misc_feature (242)..(254): n is a, c, g, or t
tcagacagtatatacacgaccggtgctcgatttagtagtgtagatttgggtttgggtgcccaagctgctggagggcacggtcaccacggtcaccgtctcctcagcttccaccaagggcccatcggtcttcccctggcgccctgctccaggagcacctctgggggcacagccggccctgggctgcctggtccaaggactacttcctatatactgtctgagcgggctggacaaggcgacatagnnnnnnnnnnnnn

SEQ ID NO: 80892 - DNA, 274 bp, Homo sapiens
  misc_feature: GYAE6OF02FQM6P.44.25.C03.1.454.CMB.1.raw
  modified_base (243)..(274): a, c, t, g, unknown or other
  misc_feature (243)..(274): n is a, c, g, or t
tcagacagtatatacacgaccggtgctcgatttagtagtgtagatttgggtttgggtgcccaagctgctggagggcacggtcaccacggtcaccgtctcctcagcttccaccaagggcccatcggtcttccccctggcgccctgactccaggagcacctctgggggcacagccggccctgggctgcctggtcaaggactacttcctatatactgtctgagtcgggctggacaggcgcatagcnnnnnnnnnnnnnnnnnnnnnnnnnnnnnnnn

SEQ ID NO: 80893 - DNA, 1155 bp, Homo sapiens
  misc_feature: GYAE6OF02IR9VQ.44.25.C03.1.454.CMB.1.raw
tcagacagtatatacacgaccggtgctcgatttagtagtgtagatttggggtttgggggggggcacaagaggcagcactcaggacaatctccagcatggcctggtctcctctcctcctcactctcctcgctcactgcacgacgggtctcgggccctacttctgtcgcgtacgacggcacggtccccgtccctcgtaggttcggtccgggtccggggggcccccggggacgaacgggtaccgggtacccaacccgtacttcccgttccgtacggaccgtacgggtacggggacacggaacgtaccgtaacccgtaaacgtaacgggtaccggggaactaggtaacctttcgtaaggtacgttaccgtacccgtaacgtttaacccggtaaaccctaaccgttaccccgtaaccgaaaccggaacccctaacccccgaacccccttaacccgttcctacgttaccgttttaaccggttaacggtaaaaccctacgttccggtacccggtcccgtaccgggttacccgggtcccgtaaccggtacccgtttacgttaccgttccggttacccggtacctttaacccggtaccggtttccgggtacccgaaccccttacccggtaaccctacccggtttaccccccgttacccggttaccggaaccccgttttaccgtacccggttaccccggggttaccggggttaccccttaaacggggccggttaaacgggttaaagggttaaccgggttaacgggttcgggggtttaaaccggggttttactttaaccggtttttaaacccggttccggtaacccgggtttacccgtttaaaacccggttccgtttaaaccgggaaacgtaaccccgggttttacgaaccccggtttaccgggtttaaccggttacggggtttttacgggggggtttttcgggggttaaccgggggtttccgggggttaaccccggggggtacggaaacccggggtttaaccggttacccgggttaccgggggtttaacccccggggttttacccggtacccggggggtttaaccgggaaaccccgtttaccccggggaaccccggggtttacccggttaacccccccgggggttccccgttaccccccggggttttccgtttaacccccccggg

SEQ ID NO: 80894 - DNA, 287 bp, Homo sapiens
  misc_feature: GYAE6OF02HSF4Z.44.25.C03.1.454.CMB.1.raw
  modified_base (140)..(140): a, c, t, g, unknown or other
  misc_feature (140)..(140): n is a, c, g, or t
  modified_base (238)..(238): a, c, t, g, unknown or other
  misc_feature (238)..(238): n is a, c, g, or t
  modified_base (244)..(244): a, c, t, g, unknown or other
  misc_feature (244)..(244): n is a, c, g, or t
  modified_base (246)..(246): a, c, t, g, unknown or other
  misc_feature (246)..(246): n is a, c, g, or t
  modified_base (248)..(287): a, c, t, g, unknown or other
  misc_feature (248)..(287): n is a, c, g, or t
tcagacagtatatacacgaccggtgctcgatttagtagtgtagatttgggtttgggtgcccaagctgctggagggcacggtcaccacgatcaccgtctccgtcagcttccaccaagggcccatcggtcttccccctggcnccctgactccaggagcacctctgggggcacagcggccctgggctgcctggtcaaggactacttcctatacgtactgtctgagcgggctggcaagggcncatagnancnnnnnnnnnnnnnnnnnnnnnnnnnnnnnnnnnnnnnnnn

SEQ ID NO: 80895 - DNA, 273 bp, Homo sapiens
  misc_feature: GYAE6OF02F8QO0.44.25.C03.1.454.CMB.1.raw
  modified_base (216)..(221): a, c, t, g, unknown or other
  misc_feature (216)..(221): n is a, c, g, or t
  modified_base (225)..(273): a, c, t, g, unknown or other
  misc_feature (225)..(273): n is a, c, g, or t
tcagacagtatatacacgaccggtgctcgatttagtagtgtagatttgggtttggggggaagaggaagactgacggtcctcccaggagttcaggtgctgggcaccttgggcatgggggagtgtgtcacaagatttgggctctgggcacagcggccctgggctgcctggtcaaggctacttcatatactgtctgagcgggctggcaaggcgcatagnnnnnnctgnnnnnnnnnnnnnnnnnnnnnnnnnnnnnnnnnnnnnnnnnnnnnnnnn

SEQ ID NO: 80896 - DNA, 813 bp, Homo sapiens
  misc_feature: GYAE6OF02HAFLA.44.25.C03.1.454.CMB.1.raw
tcagacagtatatacacgaccggtgctcgatttagtagtgtagatttgggtttgggggaagaggaagactgacggtcctcccaggagttcaggtgctgggcaccttgggcacgggggaggtgtgtcacaagatttgggctctgggcaccgtgggcagtgggggagtgtgtacacaagatttggactcctgtcgccccacatcggactactctttagctacacacttcctgctgactcgaccctcccttcgtgggtccttcgcccaggtcctacgttgaaggtcgtcgtggtacctggtcgtcgttacggtacgtaaaccccacgtacggtaacgtaccccttacgtaaccggtccgttacggtaacccgttcgaccgtaacccttaccgtttccgttccggtttccggggttttcctacccgtttaccttaacccggtaaacgttaacgttttaaacggtttaaacggttaaacggttgggggttacggttacggtaacggttacgttaacggggtaccttcccggttacgacccggtacccccgggaaggggtaccggtcccggtagggtacgtcggtacgttcgaccgtactacgtacgttacgttacgtaacgtaacttaacggtaaaaccgttaaaaccgttacccgttaaacgtaaccggttaacctacgttaccgttaacgtaggaacgttacgtacgttaaaccgttaaccgtactaccgtaaccgaacgacctaaccgtacgaagtcgtacggttcgttacttagtacgtacaaccgtacgaccgtacggacgtcggacgtaccg

SEQ ID NO: 80897 - DNA, 427 bp, Homo sapiens
  misc_feature: GYAE6OF01ELC07.16.21.B10.1.454.CMB.1.raw
  modified_base (422)..(427): a, c, t, g, unknown or other
  misc_feature (422)..(427): n is a, c, g, or t
tcagtgtactactccacgaccggtgctcgatttagtgtcgtcgcaagagagaaggggctggaatgggtctcaggtattactggtggtggttataccacatactacgcagactccgtgaagggccggttcaccatctccagagacaattccaagaacacactgtatctgcaaatgaacagcctgagagccgacgacacggccatatattactgtgcgaaagcaccggcagttagtcacccatactactttgactactgggccagggaaccctggtcaccgtctcctcagcctccaccaagggcccatcggtcttccccctggcaccctcctccagagcacctctggggcacagcggccctgggctgcctggtcaaggactacttcccgagtagtacactgagcgggctggcaaggcgcatagnnnnnn

SEQ ID NO: 80898 - DNA, 653 bp, Homo sapiens
  misc_feature: GYAE6OF01CMTV9.16.21.B10.1.454.CMB.1.raw
  modified_base (296)..(296): a, c, t, g, unknown or other
  misc_feature (296)..(296): n is a, c, g, or t
tcagtgtactactccacgaccggtgctcgatttagtgtcgtcgcagagagaggagcccagccctgggattttcaggtgttttcatttggtgatcaggactgaacagagagaactcaccatggagtctgggctgagctggtctttttcttgtggcttaattttaaaaggtgtccagtgtgaggtgcagctgttggagtcgtgggggaggcttggcacagccgtggggggtccctgagactctcctgtgcagcctctggattccgaccttttgacagctatgccatgacctgggtccnccaggcctccgaggggaagggctaggaatgggtctcgaggtattacgtgggtggttggttaactaccaacatacctacgcaagacctccggtagaaacggggtccggttcacccatctacccagacgacaacttccaaacgaacacaactgtactctagaacaaaagtcgaaacacgacctaggaacgaacgacccgtaaccggaacccaaccgggacccaagttaactacttaacgttgtacggaaccgaaaaacgcccgaaacccggtactaacggtttacgtaccccgaaacccctaagtttaacccttaaccgtttttagaacccgttaaccgggttcgggggaaacccccgg

SEQ ID NO: 80899 - DNA, 657 bp, Homo sapiens
  misc_feature: GYAE6OF01CTD7D.16.21.B10.1.454.CMB.1.raw
  modified_base (171)..(171): a, c, t, g, unknown or other
  misc_feature (171)..(171): n is a, c, g, or t
  modified_base (250)..(250): a, c, t, g, unknown or other
  misc_feature (250)..(250): n is a, c, g, or t
  modified_base (451)..(451): a, c, t, g, unknown or other
  misc_feature (451)..(451): n is a, c, g, or t
tcagtgtactactccacgaccggtgctcgatttagtgtcgtcgcaggagagaggagcccagccctgggattttcaggtgttttcatttggtgatcaggactgaacagagagaactcaccatggagtctgggctgagcggtgtcgttttctaggtggctaattttaaaaggngtcagtgtgaggtgcagctgttggagtcgtgggggaggcttggcacagccgtggggggtccctgagactctcctgtgcngcctcgtggattcacctttgacagctatcgcctatgccgtcgggtcccgaccaggctccgaggggaaggggctagggaagtgggtctacgtaggttaagttcgtgggtggttggttaactaccactatactacgcacgtactcgtaggaacgggtccggttacacgtactcctaccgagaacgaacctacttaaccgaaanaacctacacttagtactctacgtaacaaactaggaaccagccctaagacgacgacccggaacgacccgacggtacccaattaatactttacgagtcggaaaccgtaacgaccgtaacccggtagtaacggtttaaccgacctaaacccgtaacgtttaaacctttaccgtttagggaaacccttcggggtcggggtaaacccccgg

SEQ ID NO: 80900 - DNA, 624 bp, Homo sapiens
  misc_feature: GYAE6OF01DZW52.16.21.B10.1.454.CMB.1.raw
  modified_base (211)..(211): a, c, t, g, unknown or other
  misc_feature (211)..(211): n is a, c, g, or t
  modified_base (328)..(328): a, c, t, g, unknown or other
  misc_feature (328)..(328): n is a, c, g, or t
  modified_base (481)..(481): a, c, t, g, unknown or other
  misc_feature (481)..(481): n is a, c, g, or t
  modified_base (492)..(492): a, c, t, g, unknown or other
  misc_feature (492)..(492): n is a, c, g, or t
  modified_base (539)..(539): a, c, t, g, unknown or other
  misc_feature (539)..(539): n is a, c, g, or t
tcagtgtactactccacgaccggtgctcgatttagtgtcgtcgcagagagaggagcccagccctgggattttcaggtgttttcatttggtgatcaggactgaacagagagaactcaccatggagtctgggctgagcggtgtcgtttctaggtcgctaatttaaaaggtgtcagtgtgaggtgcagctgtggagtcgtggggagcttggcanagcgtgggggtcctgagctcctccgtgtgcacgcctcgtggatttccacctttagactagcttagtcgaccatcgaccgttcgggtcccgcgacggcctccggaaggggaccggggntaggaaggttcgggtacctggaaggttaagttcggtgggtggttagttaactaccactaacttacgacggtacagtaccgtacgggtaggaaccgggtccgttacacctattccacagaacactaactaccaaagtacactactgtatcgtanaacaagagacngtacgagacgacgaccgagaaccgacgtctaagttaactacttacgnggtacgaccgaacgccgacggtattaacgtaccaaccctaacgttaacttacttacgttaccggaacgtccggacgggtacccgg

SEQ ID NO: 80901 - DNA, 605 bp, Homo sapiens
  misc_feature: GYAE6OF01COG0S.16.21.B10.1.454.CMB.1.raw
  modified_base (298)..(298): a, c, t, g, unknown or other
  misc_feature (298)..(298): n is a, c, g, or t
  modified_base (501)..(501): a, c, t, g, unknown or other
  misc_feature (501)..(501): n is a, c, g, or t
  modified_base (536)..(536): a, c, t, g, unknown or other
  misc_feature (536)..(536): n is a, c, g, or t
tcagtgtactactccacgaccggtgctcgatttagtgtcgtcgcaggagagaggagcccagccctgggattttcaggtgttttcatttggtgatcaggactgaacagagagaactcaccatggagtctgggctgagctggtctttttcttgtggcttattttaaaaggtgtccagtgtgaggtgcagctgttggagtcgtgggggagcttggcacagccgtggggggtccctgacgactctcctgtgcagcctctggattctacctttgacagctatcgccatcgaccgtgggtcccnccgaggcctccgaggggaaggggctagggaagtgggtctacgaggttattacgtgggtggttagttactaccacactactacgcagtactccggtaggacgggtccgttacacctactacctccgagtacgaacctaacttaccaaaagaaaccactaacgtgtaactctacgaactaaacgtagaacctagacctagggaanaccggaccgacgacgacgacctaatactattacgngtacgacgaaagccgaccgtatacggtacgaccaacctatacttacttgacgtacggtcgggaacccgg

SEQ ID NO: 80902 - DNA, 619 bp, Homo sapiens
  misc_feature: GYAE6OF01C3HZ6.16.21.B10.1.454.CMB.1.raw
  modified_base (204)..(204): a, c, t, g, unknown or other
  misc_feature (204)..(204): n is a, c, g, or t
tcagtgtactactccacgaccggtgctcgatttagtgtcgtcgcaagagaggagggggagagctgctcagttaggacccagagggaaccatggaaaccccagcgcagcttctcttcctcctgctactctggctcccagatacccaccggagaaattgtgttgacgcagtctccaggccaccctgtctttgctccgaggggaaangcccacctctcctgcagggccagtcagagtgttaccagcaggtacttagcctggtaccagcagaaacctggcctggcctcccaggctcctcatctagtggtcgcatccagcgacgggccacgtggcactccccgagaccgtaggttccaggtcggacgtaggtcgggtcgtagggacaggtaccttcactcctaccaccctgacgacgacgtacgtcggacgtccgtagtaagttacgttttaggacgtagttagttacttacgtgtactagtcgtaaggtaggttagggtacgggtacctaccgtttacgttacgtttacgggaccggtacggggaaccaaggtcgtagggagtacgtaacgaaaccgtacgtggtacggtccgtacgacctactacttacttgttccttaccg

SEQ ID NO: 80903 - DNA, 777 bp, Homo sapiens
  misc_feature: GYAE6OF01DGIOE.16.21.B10.1.454.CMB.1.raw
tcagtgtactactccacgaccggtgctcgatttagtgtcgtcgcaggagagaggagcccagccctgggattttcaggtgttttcatttggtgatcaggactgaacagagagaactcaccatggagtctgggctgagctggtctttttctgtggctaattttaaaggtgtccagtgtgaggtgcagctgttggagtcgtgggggagcttggcacagccgtggggggtccctgagactctcctgtgcagcctctggattcacctttgacagctatgccagtcgaccgtcgggtccgccgaggcctccgaggggaacgggctagggaagtgggtctcgtaaggttacttacgtgggttggttggttaacaccctaatacttactacggcaagaccgtcggtaggaacggggtcccgttacaccgtactccgtaccgaagtaaccgtaacctaactttacccgaaaacggtaaaccctaacctaaccgttagttaaacctccgttacggaaacctaaaagttacgaaaaccgtacgacccgtaagggaacggtaaccgggaccccggaaaccggaacccggtaacccggaaccgtaaatttaacgttacgtttaaacccgttagggttaccggaaaccgggaaaaccggtacccggtaaaccccggggtacttaacgggttttaacccgtaccccgtaaaaccccgttaaacgtttaaaccccgtttaaccgttttaacgggaaccccgtttaaccgggttccgggggggaaaacccccgg

SEQ ID NO: 80904 - DNA, 430 bp, Homo sapiens
  misc_feature: GYAE6OF01EE45M.16.21.B10.1.454.CMB.1.raw
  modified_base (421)..(430): a, c, t, g, unknown or other
  misc_feature (421)..(430): n is a, c, g, or t
tcagtgtactactccacgaccggtgctcgatttagtgtcgtcgcaagagagaaggggctggaatgggtctcaggtattactggtggtggttataccacatactacgcagactccgtgaagggccggttcaccatctccagagacaattccaagaacacactgtatctgcaaatgaacagcctgagagccgacgacacggccatatattactgtgcgaaagcaccggcagttagtcacccatactactttgactactgggccagggaaccctggtcaccgtctcctcagcctccaccaaggcccatcggtcttccccctggcaccctcctccagagcacctctgggggcacagcggccctgggctcgcctggtcaaggactactccgagtagtacactgagcgggctggcaaggcgcatagnnnnnnnnnn

SEQ ID NO: 80905 - DNA, 572 bp, Homo sapiens
  misc_feature: GYAE6OF01DSHCR.16.21.B10.1.454.CMB.1.raw
  modified_base (294)..(294): a, c, t, g, unknown or other
  misc_feature (294)..(294): n is a, c, g, or t
  modified_base (343)..(343): a, c, t, g, unknown or other
  misc_feature (343)..(343): n is a, c, g, or t
  modified_base (361)..(361): a, c, t, g, unknown or other
  misc_feature (361)..(361): n is a, c, g, or t
  modified_base (454)..(454): a, c, t, g, unknown or other
  misc_feature (454)..(454): n is a, c, g, or t
  modified_base (501)..(501): a, c, t, g, unknown or other
  misc_feature (501)..(501): n is a, c, g, or t
tcagtgtactactccacgaccggtgctcgatttagtgtcgtcgcaggagagaggagcccagccctgggattttcaggtgttttcatttggtgatcaggactgaacagagagaactcaccatggagtctgggctgagctggtctttttcttgtggcttaattttaaaaggtgtccagtgtgaggtgcagctgttggagtcgtgggggaggcttggcacagccgtggggggtccctgagactctcctgtgcagcctctggattcacctttgacagctatgccatgacctgggtccnccaggcctccgaggggaagggctgggaatggggtctcgaggtattacgngggtggtggttataccanatacacgcagtactccgtaggaacgggtccgttacaccatcctaccagacgacaacttccaaagaacacactagtatctagacaaatgaaccngacctagagacgacccgacgaaccgacggacctaataactattacgngtagaccgaaagccgaccgggataggttacgaccaaccattacttacttagaccttggtcggggtaacccg

SEQ ID NO: 80906 - DNA, 682 bp, Homo sapiens
  misc_feature: GYAE6OF01BP7O3.16.21.B10.1.454.CMB.1.raw
  modified_base (196)..(196): a, c, t, g, unknown or other
  misc_feature (196)..(196): n is a, c, g, or t
  modified_base (235)..(235): a, c, t, g, unknown or other
  misc_feature (235)..(235): n is a, c, g, or t
tcagtgtactactccacgaccggtgctcgatttagtgtcgtcgcaagagaggagggggagagctgctcagttaggacccagagggaaccatggaaacccagcgcagcttctcttcctcctgctactctggctccagataccaccggagaattgtgttgacgcagtctcagcaccctgtctttgtctccgagggaangccacctctcctgcgagggccagtcagtagtgttaccgngcgaggtactagccgttggtaccagcaacgaaccgtggcctggcctcccgaggtcctaccgactactccgtagtggtcgacacgtccgaagccgacggccctacgtcggacacctacccgaagtaccgtaacggttccgaaggttggaccgtagggttcgggtcgtaggggaactacggtacttcgaccgttcctacccgacccgttacgaacgtcgtaacgtacgtacgggacctaccggttaacggtaaagttacgttttacgacgttaagggtttcttaacgtttaccgttagtaccgtagtacgttaggtaacggttaggtaacggtacctacgttacgttaccgtttacgggaccgtacgggacgtacggtagtaggaacgtagtaacgtaaacgtacgttggacggtcgtacgtccctactacgttacttcgtacttaccg

SEQ ID NO: 80907 - DNA, 793 bp, Homo sapiens
  misc_feature: GYAE6OF01DKERS.16.21.B10.1.454.CMB.1.raw
  modified_base (165)..(165): a, c, t, g, unknown or other
  misc_feature (165)..(165): n is a, c, g, or t
  modified_base (180)..(180): a, c, t, g, unknown or other
  misc_feature (180)..(180): n is a, c, g, or t
tcagtgtactactccacgaccggtgctcgatttagtgtcgtcgcaggagagaggagcccagccctgggattttcaggtgtttcatttggtgatcaggactgaacagagagaactcaccatggagtctgggctgagcggtgtgtttctaggtggctatttaaaggntcagtgtgaggtgcngctaggtgagtcgtggggagctggcacgcgcgtcgggggcctgacgctctcctgtcgcagcctgtggattcgacttgacagctatcaccagtcgtaccgtggttcccgacgaggtacctacggaacgggggaacgggttccgagggtaaaggttcggggtaccttacggtaacggggttaacttacggtaggggttgggttacgggttaaacgttccaaacgtacggtttacccctaaggactaacggtacgtcccggttaaggggaacccgggttcccgggttaacaccccggtaattccgttacccgtaaggtaccggaaacctaaccgttaactaaaccggaaactaccgtaaccttaggactttccggaataaacccgaaagttcggaaaacttcggtacccgtaagggtaggaacccgacccgggtaacggacccgttaacgggacctaacgttaaccgtagtttaccggagttaacggactaaacccggggcgtaacccggggtagttaaaccgggttcttaaaccccaacccgttaaccggttttaacccgtttacctttaacccgggtaaaaccctttccggggtacccgggttaaaaccccggg

SEQ ID NO: 80908 - DNA, 677 bp, Homo sapiens
  misc_feature: GYAE6OF01EM1H2.16.21.B10.1.454.CMB.1.raw
tcagtgtactactccacgaccggtgctcgatttagtgtcgtcgcaggagagaggagcccagccctgggattttcaggtgtttttcatttggtgatcaggactgaacagagagaactcaccatggagtctgggctgagctggtctttttcttgtggctaattttaaaggtgtccagtgtgaggtgcagctgttggagtcgtgggggaggcttggcacgagccgtggggggtccctgagtactctcctgtcgcagcctcgtggtacttcacctttgaccagctatgaccatcgaccgtgggtcccgcgacggccgtccggaaggggacggggcgtggaagttgggtctcgaggttagttacgtgggttggttggttactaaccctacgtactacgtacgctacgaccgttcggacggaacggggtccgttacaccgtactccgaccgagacgactaactaccaaagtaccacactgtatactgaaccaaagtcgaactcgacctagacgaccgaccgtaacggacgtaaccggacctaagttaacgttacttacgtcggtaacgaccggtaaaacggcccgtaaccgggtacttaaacggttacctaccccaaaccccttaagtttaaccccgttaacgtttacggaacccggttacgggtcccgggggtaaaccccgg

SEQ ID NO: 80909 - DNA, 740 bp, Homo sapiens
  misc_feature: GYAE6OF01DVW1F.16.21.B10.1.454.CMB.1.raw
  modified_base (294)..(294): a, c, t, g, unknown or other
  misc_feature (294)..(294): n is a, c, g, or t
  modified_base (601)..(601): a, c, t, g, unknown or other
  misc_feature (601)..(601): n is a, c, g, or t
tcagtgtactactccacgaccggtgctcgatttagtgtcgtcgcagagagaggagcccagccctgggattttcaggtgttttcatttggtgatcaggactgaacagagagaactcaccatggagtctgggctgagctggctttttcttgtggcttattttaaaaggtgtccagtgtgaggtgcagctgttggagtcgtgggggagcttggcacagccgtggggggtccctgagactctcctgtgcagcctctggattcacctttgacagctatcgccatcgaccgtgggtcccnccgaggcctaccgaagggggaacggggcgtagggaagtgggtctacgaggttattacgtgggtggtaggttaactaccgaactactaacgtacgcgaacgtaccgtccggtaggacggggtcccgttacaacccgtataccgtaccgaaggaacgaaccgtaaactttacccgaaaagtaaacccaacgtaacttacgtaacttccgtagaaccgtaaaattcggaaaacctacggtacccgtaggaacggaaccggccccggaaaccgaaccgaccggtaacccaagttaaccgttagtttaacgnggttaaccggaaaccggtaaaacggcccgtaacccgggtaattaaccgggtttaaccaccccgtaaaacccttaacgtttaacctttaaacccggttttcgaaacccggtttaccggggtcccgggggtaaaccccggg

SEQ ID NO: 80910 - DNA, 642 bp, Homo sapiens
  misc_feature: GYAE6OF01B38GO.16.21.B10.1.454.CMB.1.raw
  modified_base (196)..(196): a, c, t, g, unknown or other
  misc_feature (196)..(196): n is a, c, g, or t
  modified_base (635)..(635): a, c, t, g, unknown or other
  misc_feature (635)..(635): n is a, c, g, or t
tcagtgtactactccacgaccggtgctcgatttagtgtcgtcgcaagagaggagggggagagctgctcagttaggacccagagggaaccatggaaacccagcgcagcttctcttcctcctgctactctggctccagataccaccggagaaattgtgttgacgcagtctccagcacctgtctttgctcgaggggaancgccacctctctgcgagggccagtcagagtgttaccagcgaggtacttagccgtagtaccagacaagaaacctgacctgactccgaggctcctcacgtctatggtcacactccgagcgacggccacgtcggactactacccgaaggtaccgtaggttaccaaggtcggcgtaagggtcgggtttacgacggggaactaacggtacctttacgacccttactaacccgtacccgtcaacgtcgaacgacggttacggacgaccgttagaacgttacgtttacgctacgtttagtacttacgtgtaccgtagtactagtacgtaggtacgttactaccgttacgtacgtttcgggaccgtacggggtaaccaggtacggtaggaacgacggttaaacaaaggtacgttaggacgtacagtaccaacgttatacgtacgttnttaaccg

SEQ ID NO: 80911 - DNA, 797 bp, Homo sapiens
  misc_feature: GYAE6OF01C0WQP.16.21.B10.1.454.CMB.1.raw
  modified_base (620)..(620): a, c, t, g, unknown or other
  misc_feature (620)..(620): n is a, c, g, or t
  modified_base (654)..(654): a, c, t, g, unknown or other
  misc_feature (654)..(654): n is a, c, g, or t
tcagtgtactactccacgaccggtgctcgatttagtgtcgtcgcaggagagaggagcccagccctgggattttcaggtgttttcatttggtgatcaggactgaacagagagaactcaccatggagtcgtgggctgagcgtggtctttttcttggtggtcttattttaaaaggtgtcaatgtgaggtgcggtactagtggacgcggtgggggagtaattgggtacacggtccggttcgggggggtccctggaacggtaccttccgttccgtggtcgccgacgtcccgttcgtggtacttccgaccgttcgggtctaaggtttacgtcgaccgtaagtcggtaccggttccggggtacccgaccgacgggtccgtacccggggaaaggggggtaacgggtcgtaagggtaagggttcggggtaccttacggtagggtttaatttagggttggtttaagggtggggtggtacgactaacgttaactaaccggtacgtacgaaccggttacgtcccggggtaaggaaccggggtcccctttaccgaaacctacgttccaccggaagtaacgtaaccgtaataacccgaaaggaacctatacggttacttaagttctaccggtanccgttaataccgtataccgaacgtaacgtggaanaacgaacgtaacgccgaacgctatacttactacgtcgacgtccggacgtcccggtcccccgtacggacctaccgggtcgtaacccgtttaggggttaacggaccggtttaacgtaaccccgggttaagtttccgggtttaacg

SEQ ID NO: 80912 - DNA, 767 bp, Homo sapiens
  misc_feature: GYAE6OF01EUBV5.16.21.B10.1.454.CMB.1.raw
tcagtgtactactccacgaccggtgctcgatttagtgtcgtcgcaggagagaggagcccagccctgggattttcaggtgttttcatttggtgatcaggactgaacagagagaactcaccatggagtctgggctgagctggtctttttcttgtggctattttaaaggtgtcagtgtgaggtgcagctggttggaggtcggtgggggaggtcgttggcacgaggccggtggggggtccctggacgtaccttctccgtgtcgcgacgtcctcgtggtactttcctaccgtttgactagctatcgacctagtcggtacccgtcggggtccccgaccgacggccgtaccgggaaggggggaacggggtcgttagggaacggtcggggttaccgtacggtaagggttagtttacggttggggttaggttacggttaactaacccgtacgtaattaaccgtaccgactaacggtacccgttaccggtagggtaacccggggtcccgtttaccaacccgtacgttacccgtaccgaaggaactaacctaaacgttacccaaaacgtaacccaaccgtacgttagtaactcgtacgaaacctaaagtacgaactcgtacgtagacgacgaccgacgaccgaccgtacctaattaattacttacgtaggtacgaaccgaaacgcccggtaacggtacgttaacggttaccaccctaaaccgttattaaacccgtttacgtttaacggaacccggttacgggcggggtaaacccccgg

SEQ ID NO: 80913 - DNA, 510 bp, Homo sapiens
  misc_feature: GYAE6OF01CMLHE.16.21.B10.1.454.CMB.1.raw
  modified_base (473)..(473): a, c, t, g, unknown or other
  misc_feature (473)..(473): n is a, c, g, or t
  modified_base (476)..(510): a, c, t, g, unknown or other
  misc_feature (476)..(510): n is a, c, g, or t
tcagtgtactactccacgaccggtgctcgatttagtgtcgtcgcaagagagaaggggctggaatgggtctcaggtattactggtggtggttataccacatactacgcagactccgtgaagggccggttcaccatctccagagacaattccaagaacacactgtatctgcaaatgaacagcctgagagccgacgacacggccatatattactgtgacgaaagcaccggcagttagtcacccatacttacttgactacgtgggccacgggaaccctggtcaccgtctcctcagcctccaccaacgggcccagtccgtccttcccccgtggcccaccctcctaccaacgacgccaccgtcgtcgggggaccacgacggcggcccgtgggcgtcgccgtggtacgaacggactaccttaccggaagtacgtacacgtggacggtcgggcgtcgggacgaacggcgacaacgtagcancgnnnnnnnnnnnnnnnnnnnnnnnnnnnnnnnnnnn

SEQ ID NO: 80914 - DNA, 809 bp, Homo sapiens
  misc_feature: GYAE6OF01CSOBC.16.21.B10.1.454.CMB.1.raw
  modified_base (204)..(204): a, c, t, g, unknown or other
  misc_feature (204)..(204): n is a, c, g, or t
  modified_base (781)..(781): a, c, t, g, unknown or other
  misc_feature (781)..(781): n is a, c, g, or t
tcagtgtactactccacgaccggtgctcgatttagtgtcgtcgcaagaggtaggagggggggagagctgctcagttaggacccaggagggaccatggaaaccccagcgcagcttctcttcctcctgctactctggctccagataccaccggagaattgtgttcgacgcagtctccaggcaccctgtctttgctccgaggggaancgccacctctcctgcagggccagtcagagtcgttaccagcgaggtacttagccgttggtaccagcaacgaaaccgtggcctacggcctcccgaggcctacctactattaccgttaagttcgggtacgtacctaacgttcccgaacgggtcccggtaacgggggtaccctaacgttacggtaaccctacccgtacccgaaacggttaacccgtaacgggttttaccgaagggtttcggggaaccgtaacggggtttccggggttacctaacgggggtaacctaacggttaaacccctttccgaacccgtttcccggttacccctaaccccggttacgaaccggtaacccggtaaacgggtaccgttaacgggggtaacgttacccggtttaagggttaaaccgttttagttttccggaaccgtttaggtttaccggttaactttacggtacgttacgtaacggtacgtaacggtttggttacgggttaagggtaccctttaaccggtttacgttacggtttacgggaccgtacggggtacctaaggtcgtaaggacgtacgtaacgaacggtctcggntacgtcgcctacttcgtctcgttctacg

SEQ ID NO: 80915 - DNA, 684 bp, Homo sapiens
  misc_feature: GYAE6OF01CH5SZ.16.21.B10.1.454.CMB.1.raw
  modified_base (240)..(240): a, c, t, g, unknown or other
  misc_feature (240)..(240): n is a, c, g, or t
  modified_base (244)..(244): a, c, t, g, unknown or other
  misc_feature (244)..(244): n is a, c, g, or t
  modified_base (246)..(246): a, c, t, g, unknown or other
  misc_feature (246)..(246): n is a, c, g, or t
  modified_base (297)..(297): a, c, t, g, unknown or other
  misc_feature (297)..(297): n is a, c, g, or t
  modified_base (604)..(604): a, c, t, g, unknown or other
  misc_feature (604)..(604): n is a, c, g, or t
tcagtgtactactccacgaccggtgctcgatttagtgtcgtcgcagagagaggagcccagccctgggattttcaggtgttttcatttggtgatcaggactgaacagagagaactcaccatggagtctgggctgagctggtctttttcttgtggcttaattttaaaggtgtccagtgtgaggtgcagctgttggagtcgtggggagctggcacagccgtgggggtccctgacgactctccngtcncngcctgtgattctaccttgacagctatcgacctagtcgaccgtcgggtcccnccgaggcctccggaggggaaggggctagggtaagtcgggtactacgtaggttacttacgtgggtaggttaggttactacctaactaacttaccgtacgcgtaagacccgttaccggtagggtaccggggtacccgtactacctacgtccgtaccgtaacggaacgtacctaccgttaaccggaacgtaacccacggtactacgtaacttccgagtacgtaaatacgaacgacgcctagggaacgtacggacggtaacggaacctaccggactaaattacttacgtaccgttggtaagaacgtaaacncgttcccgtaggacccggttaaccctacgtaacccctaccgtacgtacgtaccgaacgttcggtacccggtacccccggg

SEQ ID NO: 80916 - DNA, 711 bp, Homo sapiens
  misc_feature: GYAE6OF01DOO8D.16.21.B10.1.454.CMB.1.raw
  modified_base (213)..(213): a, c, t, g, unknown or other
  misc_feature (213)..(213): n is a, c, g, or t
  modified_base (226)..(226): a, c, t, g, unknown or other
  misc_feature (226)..(226): n is a, c, g, or t
  modified_base (355)..(355): a, c, t, g, unknown or other
  misc_feature (355)..(355): n is a, c, g, or t
  modified_base (473)..(473): a, c, t, g, unknown or other
  misc_feature (473)..(473): n is a, c, g, or t
  modified_base (522)..(522): a, c, t, g, unknown or other
  misc_feature (522)..(522): n is a, c, g, or t
  modified_base (546)..(546): a, c, t, g, unknown or other
  misc_feature (546)..(546): n is a, c, g, or t
tcagtgtactactccacgaccggtgctcgatttagtgtcgtcgcaagagaggagggggagagctgctcagttaggacccagagggaaccatacggaaaccccagcgcagcttctcttcctcctgctactctggctccagactaccgacggagtaattcgtagttgacgcgtagtctccaggcctaccttgttctttgcctaccgaaggggaancgtccacctctcngcgacggtcagtcaggtagtcgtaccagcgtacggttacttcggcctacggtaccaagaccaacgtaaccgtcggccttcggaccttacccggaagtcccttcctactacttaccgttagttcggtacncctaacgtcgacggccggacggtacctacgtgacctaacgtacccgaagtaccggttagtccgagggtacgtacgtacgggttgggctaacgggacactttacgtcccacgttaaccncccaccgttagacgacgtacgacgtaggactacgagttaagtcgtttanacgttattgttactacgtgtaacngtacgtaagtggtacggtacgtacgttaaccgtttacgttacggtttaccggaacggtacggtaacgtaacgacgttaagaaccgttaacgtaaacggtaacttaacgggtacggtaccgtacgttaccgtaacttaacgacgtttccttaagttccgttaaccg

SEQ ID NO: 80917 - DNA, 720 bp, Homo sapiens
  misc_feature: GYAE6OF01BUSQC.16.21.B10.1.454.CMB.1.raw
tcagtgtactactccacgaccggtgctcgatttagtgtcgtcgcagagagaggagcccagccctgggattttcaggtgttttcatttggtgatcaggactgaacagagagaactcaccatggagtctgggctgagctggtcttttttcttgtggtacttaattttaaaaggtgtccagtgtgaggtgcagctggttggagtcgtgggggagtcgttggcacgagccggtggggggtccctgagactctccgtgtcgcacgcctcgtgtacttctacttagacacgctatcgcctagtcgtaccggtcgggtcccgccgaggccgtaccggaggggaacgggtcgtaggaggtcgggtctacgtaggttacttcggtgggttgggttagttaacacctactaacgtacgtacgactacgtaccgtccggtagggtaaccgggtccgttacgacccgtactacgtaccgaagaacgtaaacccttaacgttaacccaaaagtaaccctaacctaacgttagttaaccgttccgtaacgaaaccgtaaacgtggaaaaccctcccggtagtaacgggaacacccggaacccgggaccgtaaaccgccggaacttaagtttacttaacggttacgtcggaagaacccgaaacggtcccgaaccgtagttacgtccaacccgtacctatttaacctagttacggaccgttacgggcggtaacccg

SEQ ID NO: 80918 - DNA, 885 bp, Homo sapiens
  misc_feature: GYAE6OF01CJX1B.16.21.B10.1.454.CMB.1.raw
tcagtgtactactccacgaccggtgctcgatttagtgtcgtcgcaagagaggagggggagctctgagagaggagcccagccctgggatttcaggtgtttcattggtgatcaggactgaacagagagaactcaccagtggagtcgtgggctgagcgtggtcttttcgtgtggtacttaagtttaaaaggtcgtccgagtgtggaggtgcagtcgtggtggagtcggtggggaggtcgttggacacgaggtccggtcgggggtccctaggacgtaccgttcgtccgtggtcgaccgtaacgtccgtcgtacggtacctttaccgtaaccgttttcgaaccgtacgtctaacgtccggtaccgtacgtaccggtaacccggtccggggtaccccgacccggtaccgggtaccgtacccgggtaagggggtaaacggggtccgtaggggtaacggttcgggtacgttacggtaacggttaacgttaacgggttggggttacggttacggttaaaccgtaaccgtaactaacggttaaccgtaaccggtaccgtaaccggtaacccggttaccgggtaacgggtaaacccggggttcccgttaaccgaacccgttacgtacccgtaacggtaaacgtaaacgtaaaccttaaccgttaaccgaaagtaaccctacgtaacttagtaaccttgaaaccgtaactaaacgtacgaaacgtaccggtacgtaaggaccgaaccggacccgtaaacggacccgtaaaccggacttaaacgttaccggttaaacgttaacggtacggtaacccggaaaccgggtaaaccggttaccccggaacccgggttaacttaacccgggtttaaccctaaccccgtaccccgtttaaaccg

SEQ ID NO: 80919 - DNA, 845 bp, Homo sapiens
  misc_feature: GYAE6OF01CLR43.16.21.B10.1.454.CMB.1.raw
  modified_base (220)..(220): a, c, t, g, unknown or other
  misc_feature (220)..(220): n is a, c, g, or t
  modified_base (235)..(235): a, c, t, g, unknown or other
  misc_feature (235)..(235): n is a, c, g, or t
  modified_base (260)..(260): a, c, t, g, unknown or other
  misc_feature (260)..(260): n is a, c, g, or t
  modified_base (267)..(267): a, c, t, g, unknown or other
  misc_feature (267)..(267): n is a, c, g, or t
  modified_base (828)..(828): a, c, t, g, unknown or other
  misc_feature (828)..(828): n is a, c, g, or t
tcagtgtactactccacgaccggtgctcgatttagtgtcgtcgcaagagaggaggggggagagctgctcagttaggacccaggagggaaccatcggaaaccccagcgcagccttctccttcctcctgtctactcgtggcctaccagactacccaccggagtaattgtgttgacgcagtctacacggcctaccctgttcttgtccgtacggaaggggaacncgccctacctctcgngcgacgggccagtcgagtacggttntaaccgngtacgtaaggtactacggcgtacggtaccaacgacgaacgtaaccgcggtaccgtacggcctacccgacgtcctacctacgtacttacgtaggttcggcctactcgtaccgacgcggtacggaccgtacgtacggacctaacctacccgaacggtaccggtaggttccgaagggtaccgtacggtcggggtggttaccggtacgggtaacctacggtaccctttcaacccctttaccggacccaaccgagacgtaccgacggtaccgttagggaccttaggtaagttaaacggtttagtttacccgaaggttacgggttaacgttttaaccggaccgtttagtacccggtaaggttaccgttaaagggtaggggtttaacccgggtaccggttaacccgtttaaaccgttaccccggggtttaacggtttacccgggggaacccggttaacgggtaacccggaacggttccgggtaaaaccggaacgtacgtaaaacccggttaaacggtaccgggtagttcccggggaactccgttaaacccgtacgttaaccgttttcnccggttttaactacccg

SEQ ID NO: 80920 - DNA, 759 bp, Homo sapiens
  misc_feature: GYAE6OF01A859C.16.21.B10.1.454.CMB.1.raw
  modified_base (220)..(220): a, c, t, g, unknown or other
  misc_feature (220)..(220): n is a, c, g, or t
  modified_base (724)..(724): a, c, t, g, unknown or other
  misc_feature (724)..(724): n is a, c, g, or t
tcagtgtactactccacgaccggtgctcgatttagtgtcgtcgcaagagaggagggggagagctgctcagttaggacccagagggaaccatcggaaaccccagcgcagcttctcttcctcctgctactctggcctccagactacccgaccggagtaattgtgttcgacgcagtcctccgaggcctacccttgttctttcgtcctaccggaaggggaaacncgcccaccgtcctccgtcgaccgacgggccagtacgtagtacgttgtaccagacgtacggttacgtacgtccgtacggtaccacgaccgaacgtaaccgtcgtcccgtacggtccctacccggaggtaccccttcctactaccgttacgttaacgtcgggtaccacctaccggtccgacggaccggtaaccgggcctaacgtcggacctacccgtcccgaaaggtaccttagggtaccgtacgtccgggtacgtaacgggtccgggtacgtcgggaactacggttaccctacgtacccttaccggtaccctacccgttacgaccgttaacgaacgggtttaccgaggtaaccgttaccgttaaaggtacgttacgtttacgaccgttaagttacgttacgtacttcggaccttagtacggttagtacgggttacggaccgtacttaccggttacgtacggttcgaccgaggtacagtgtacggactaacgacggtatagtcggntacccacggtacctacgtactccttcgtccgtacc

SEQ ID NO: 80921 - DNA, 733 bp, Homo sapiens
  misc_feature: GYAE6OF01A3JLF.16.21.B10.1.454.CMB.1.raw
  modified_base (153)..(153): a, c, t, g, unknown or other
  misc_feature (153)..(153): n is a, c, g, or t
  modified_base (188)..(188): a, c, t, g, unknown or other
  misc_feature (188)..(188): n is a, c, g, or t
  modified_base (284)..(284): a, c, t, g, unknown or other
  misc_feature (284)..(284): n is a, c, g, or t
  modified_base (395)..(395): a, c, t, g, unknown or other
  misc_feature (395)..(395): n is a, c, g, or t
  modified_base (426)..(426): a, c, t, g, unknown or other
  misc_feature (426)..(426): n is a, c, g, or t
tcagtgtactactccacgaccggtgctcgatttagtgtcgtcgcaggagagaggagcccagccctgggattttcaggtgttttcatttggtgatcaggactgaacagagagaactcaaccatggagtctgggctgagcgtgtcgtttctaggnggctaatttaaaggtgtcctagtgtgagtgcagtntgttggagtgtggggagcttggcacgagccggtgggggtccctggagctctccgtgtgcgacgtctcgtggtacttcctactttcgaactgcttancgtcctagtcgaccgtcggtcccgacgaggccgtccgggaaggggtacgggcgtagggtaacgtcgggttctacgtaggttacttacggtgggttaggtcgttacgactanaacgtacgtacctagaccgtaccgtaccggnggtaaccggtccgtacaccgtactccacgtgaacgaacttaactaccgaaaagaccctaagtaccgtacgttaactcggtaactaacgtaaacgtacctaacgaacctcgggtaacgaacggtaccggaccgtaacccgacggtaaccggaaccttataaacgttcgttaaacggtttccaaagggacccggtaaaacggtccccgttaagggtaacccgttagtacccccgttaaacccgtccccttaaagtttaacccgtttacgtttaccggaacggttacccggtacccggggtaaaccccgg

SEQ ID NO: 80922 - DNA, 840 bp, Homo sapiens
  misc_feature: GYAE6OF01CFZTK.16.21.B10.1.454.CMB.1.raw
tcagtgtactactccacgaccggtgctcgatttagtgtcgtcgcaagagaggagggggagagctgctcagttaggacccagagggaaccatacggaaaccccagcgcagtcttctcttcctctgactactcgtcggcctccagactacccacggaagtaaattggtgtgacgcgtacgtctacgacggacctacccgttgttcgttcgtaccgtaccgggaaaggggtaaacgccgaccctacccgttccgtccgacggacgaccggggacctaggtacgtaacggtaacgttccgttaaccgacggtacgttaacgggttaccttacggaccgttacgggtaaccaaggtaccgaaaccgtaaccgtcggtacccgtcggtaccgtacccggtacggtcccttaccctacgtacggttaacttcgggttacgggactaccgtacgtccgaacggaccggtaccggccgtaacgtccggacctaccgtacccgtaaacggtcggtaacggttacggacggtaccggggacgtttacgggggttaccggtaccggtaacggggtaacctaccgttacccgggtaccttacccgttaccccggtaccctaaacccggtcgaaaccggtaccggttaacggaccgttaacgggaccgtaaggttacgttaacgttacgttaggacgtttagttaccgttaattaccgtagtacgtacttaaggtagtacgggtacgtaccgtacttacgttaacgtcggtacgcggaacgacggtgtacgcgtaacgaacgtaacggtagtacgtaggtacgctacacgttactgtcccttagtcttaacccg

SEQ ID NO: 80923 - DNA, 1009 bp, Homo sapiens
  misc_feature: GYAE6OF01EWGMO.16.21.B10.1.454.CMB.1.raw
tcagtgtactactccacgaccggtgctcgatttagtgtcgtcgcaggagagaggagcccagccctgggattttcaggtgttttcatttggtgatcaggactgaacagagagaactcaccatggagtctgggctgagctggtctttttcgttggtggtcttaagttttaaaaggtgtccagtgtggaggtgcagtcgttggttggaggtcggtggggggaggtcgttggcgacgacggtccggttcgggggggtccctaggacgtaccgttccttcccgttggtcgtaccgacgtcccttcgtacgggtaactttcccgttacccgttttcggaaccgtacggtaccgttaacgtccgtaccgtaagtccggtaaccccggttcggggtcccccggccggaacggtcccggtaccggggaacggggggaaacgggggtccgtaacggggtaacggttcggggttaccgttaccttaacggttttaaggtttagggttacggggttaggttagggttaacgttaaacctacgtaacgttaacgtaccggacgtaacggtacccgttaccgggtaaggggtaaccccggggttacccggtttaacccgacccttaacgtcccgtaaccggaacgtaaccgaaaaccgtaaccgtaacccccggtaaaagaacccgtaccggtacccgttaggttaacccgttccgtaaacggaaccctaaaaagggttcccggtaaacccggtacgttaacgggaaccgggtaaccgggaacccgggtaaccgggaaccccggtaaccgggttacccttttaaagttaccggtttaacccggtagggttacccgggttaaccgggggttaaacggggttttaccggttttaacgtaaacgtttacgggttaaattttaaccggttaaacgggtttaaaacgggtaaaaaaccgtttaaaacgggttaacgttttaccgttaaacggttaaccggttaaccggggtcccgggtaaaccccggg

SEQ ID NO: 80924 - DNA, 766 bp, Homo sapiens
  misc_feature: GYAE6OF01EE5JV.16.21.B10.1.454.CMB.1.raw
  modified_base (218)..(218): a, c, t, g, unknown or other
  misc_feature (218)..(218): n is a, c, g, or t
  modified_base (248)..(248): a, c, t, g, unknown or other
  misc_feature (248)..(248): n is a, c, g, or t
  modified_base (259)..(259): a, c, t, g, unknown or other
  misc_feature (259)..(259): n is a, c, g, or t
  modified_base (280)..(280): a, c, t, g, unknown or other
  misc_feature (280)..(280): n is a, c, g, or t
  modified_base (312)..(312): a, c, t, g, unknown or other
  misc_feature (312)..(312): n is a, c, g, or t
  modified_base (716)..(716): a, c, t, g, unknown or other
  misc_feature (716)..(716): n is a, c, g, or t
tcagtgtactactccacgaccggtgctcgatttagtgtcgtcgcaagaggaggagggggagagctgctcagttaggacccagagggaaccatcggaaaccccagcgcagccttctcttcctcctgctactctggcctccagatacccgacggaagtaattggtgttagacgtcagtcctacaggccacccttgttcttgtcctacggaaggggtaaanccgcccaccctcctctggacgacggcagtnacgtgtctacngtcgtagtactgcgtaggacngacaacgaaccgcgtccgtacggtcctcccgngtacccgtcctactacgtaccgttagtcggtcgaccgttacgtaccgagtccggtacggcctaacgtagaaccctacgtaccagggtaaccgtggtaccgtaggtcgggacgtcgggttacgggtacgtacggggtaacctccggttaacttccccgacgtttaccccgtaccccgacccgtacgtaacccggtacggtacccggtaaccggtaacgggtaccgtaccggtttaacgtaaaacggtttcgtttcgggaaacttacgggttttaattaccggtacttagggtaacctggtaacgtaggtacggttccggacgttaccgttacttaaccggtttggttacgtacgggtaccggtaacgtcggttaggtaacgacgttaaaccgtaggtaaacccgngggtactacggtacctcgtaaccttacgtacgtccgttcttacgtacccg

SEQ ID NO: 80925 - DNA, 824 bp, Homo sapiens
  misc_feature: GYAE6OF01E1WAI.16.21.B10.1.454.CMB.1.raw
  modified_base (168)..(168): a, c, t, g, unknown or other
  misc_feature (168)..(168): n is a, c, g, or t
  modified_base (735)..(735): a, c, t, g, unknown or other
  misc_feature (735)..(735): n is a, c, g, or t
tcagtgtactactccacgaccggtgctcgatttagtgtcgtcgcaggagaggaggagcccagccctgggattttcaggtgttttcatttggtgatcaggactgaacagagagaactcaccatggagtctggctgagctggtctttttctgtggtctaattttaaaggngtccagtgtgagtgcagtctggttggagtcgtgggggagtcgttggcacacggcccgtgggggtccctggacgtaccttccgtcctggtacgtccgacgtcccttaccggtaggttaactttccctaaccgttttacgaacccgtaagtaccttaacgtccgtacctaacgttccggtaaccggtccggggtacccccgtacccggtaacggttcccgtaaccggaaaggggggttaaaccggggtccgttaagggtaacggttcggggttccttaaccggtaaggtttaacgttacggttcgggttaggttacggttaactaaccgactaacgtacccgtacgcgtaacgtacccgtcggtaagggtaaccccgggtccggtttaccaaccgttacgtaccctacggaacgaacgtaaccttaacttaaccgaaaccgtactaacgtacgttagtaccgtcctaagtaacaaacggttcaaacgtccgtacgacggaacgtaccgaaccgtacgaaccgtacggtacctaaagttctaacgttcgtaggtaccaaccggttaaccnccgggtaacccgtagtaacgtttcccgacccgtaaaccttaccgtaacgtttacctaacgggccctttaaacgggcccgggtaacccgg

SEQ ID NO: 80926 - DNA, 537 bp, Homo sapiens
  misc_feature: GYAE6OF02G8VVF.16.21.B10.1.454.CMB.1.raw
  modified_base (164)..(164): a, c, t, g, unknown or other
  misc_feature (164)..(164): n is a, c, g, or t
  modified_base (177)..(177): a, c, t, g, unknown or other
  misc_feature (177)..(177): n is a, c, g, or t
  modified_base (425)..(425): a, c, t, g, unknown or other
  misc_feature (425)..(425): n is a, c, g, or t
tcagtgtactactccacgaccggtgctcgatttagtgtcgtcgcagagagaggagcccagccctgggattttcaggtgttttcatttggtgatcaggactgaacagagagaactcaccatggagtctgggctgagcggtgtgttctaggcggctatttaaaggntcagtgtgagtgnagctgtgagtctgggagctggcacagcctgggggtcctgagctctcctgtgcagcctctggattcacctttgacagctatgccatgactcggtccgccaggctccgacgggaagggcgtcgggaagtgggtcgtccgaggtaagttacgtggtggtgggttattactacatactacgacagaactccgtagaagggtccggttcaccactctccacgagacaacttacaagaacaacactatatactnacaaatagacacgctacgagacgacgacgacgacgacactatactatgtagacgacgacgacgacgtacgtacgtaccacctactacttacttacgtacgtacgtacggacg

SEQ ID NO: 80927 - DNA, 475 bp, Homo sapiens
  misc_feature: GYAE6OF02JUCSY.16.21.B10.1.454.CMB.1.raw
  modified_base (441)..(475): a, c, t, g, unknown or other
  misc_feature (441)..(475): n is a, c, g, or t
tcagtgtactactccacgaccggtgctcgatttagtgtcgtcgcaagagagaaggggctggaatgggtctcaggtattactggtggtggttataccacatactacgcagactccgtgaaggccggttcaccatctccagagacaattccaagaacacactgtatctgcaaatgaacagcctgagagccgacgacacggccatatattactgtgcgaaagcaccggcagttagtcacccatactactttgacctactgggccaggaccctggtcaccgtctcctcagcctccaccaggcccatcggtcttccccctggccaccctcctccaagacgcacctctgggggcacacgcggccctggggctgccctggtccaagggtacctaacttcccggagtagtaacacgtcggagtcgggcctggcaaggcgcaataggacnnnnnnnnnnnnnnnnnnnnnnnnnnnnnnnnnnn

SEQ ID NO: 80928 - DNA, 569 bp, Homo sapiens
  misc_feature: GYAE6OF02HKCTH.16.21.B10.1.454.CMB.1.raw
  modified_base (349)..(349): a, c, t, g, unknown or other
  misc_feature (349)..(349): n is a, c, g, or t
tcagtgtactactccacgaccggtgctcgatttagtgtcgtcgcaggagagaggagcccagccctgggattttcaggtgttttcatttggtgatcaggactgaacagagagaactcaccatggagtctgggctgagctggctttttcttgtggctattttaaaaggtgtccagtgtgaggtgcagctgttggagtctgggggaggcttggcacagcctggggggtccctgagactctcctgtgcagcctctggattcacctttgacagctatgccatgacctgggtccgccaggcctccgaggggaaggggctggaatgggtctcgaggtattacgtggtggtggttanaccacatactacgcagactccgtggaacggccggttacaccatctccagacgacaattccaaagaacacactgtaatctagacaaatgaaacagcctagacgagacccgacgaccacggaccaataactatacgtgtagacgaaagccgaaccggctaaggttactaccaaccctagttaaccttaaccgtttagaaccgttaccgtcggggtaacccgg

SEQ ID NO: 80929 - DNA, 623 bp, Homo sapiens
  misc_feature: GYAE6OF02HR8J9.16.21.B10.1.454.CMB.1.raw
  modified_base (293)..(293): a, c, t, g, unknown or other
  misc_feature (293)..(293): n is a, c, g, or t
tcagtgtactactccacgaccggtgctcgatttagtgtcgtcgcaggagagaggagcccagccctgggattttcaggtgttttcatttggtgatcaggactgaacagagagaactcaccatggagtctgggctgagctggctttttcttgtggctattttaaaaggtgtccagtgtgaggtgcagctgttggagtcgtgggggaggcttggcacagccgtggggggtccctgagactctcctgtgcagcctctggattcacctttgacagctatgccatgaccgtgggtcccnccgaggcctccgaagggggaaggggctgggaagttggggtctcgtaaggtatttacgtggggttgggttagggtttaactaacccgactacgttaacctacggcaaggtactccggtagaacgggggtcccggttacacccgtactccgtacccagacgactaaacttcccaaagaaccacaacttgtactctagactaaatcgaaactagcctaggacgacgccgacgacgacggccaatatattacgtgtgacgaaacgccgaaccggagtacgttacgtaccaacccgtattaaccttactttcgaaccttcggtacgggtaacccg

SEQ ID NO: 80930 - DNA, 542 bp, Homo sapiens
  misc_feature: GYAE6OF02HRORD.16.21.B10.1.454.CMB.1.raw
tcagtgtactactccacgaccggtgctcgatttagtgtcgtcgcaggagagaggagcccagccctgggattttcaggtgttttcatttggtgatcaggactgaacagagagaactcaccatggagtctgggctgagctggtctttttcttgtggcttattttaaaaggtgtccagtgtgaggtgcagctgttggagtctgggggaggcttggcacagccgtggggggtccctgagactctcctgtgcagcctctggattcacctttgacagctatgccatgacctgggtccgccaggctccgaggggaaggggctggaagtgggtctcgaggttattacgtggtggtggttataccacatactacgcagactccgtagaacgggccgttcaccatcctccagacgacaattccaaagaacacactgtatcagacaaatgaacagcctgagagccacgacacggcaatatatacgtgtgacgaagcccgacggtcagttaacgcacccgtataccttactttcgaacctacgtcggggacccg

SEQ ID NO: 80931 - DNA, 433 bp, Homo sapiens
  misc_feature: GYAE6OF02GWBPL.16.21.B10.1.454.CMB.1.raw
  modified_base (424)..(433): a, c, t, g, unknown or other
  misc_feature (424)..(433): n is a, c, g, or t
tcagtgtactactccacgaccggtgctcgatttagtgtcgtcgcaagagagaagggggctggaatgggtctcaggtattactggtggtggttataccacatactacgcagactccgtgaagggccggttcaccatctccagagacaattccaagaacacactgtatctgcaaatgaacagcctgagagccgacgacacggccatatattactgtgcgaaagcaccggcagttagtcacccatactactttgactactgggccagggaaccctggtcaccgtctcctcagcctccaccaagggcccatcggtcttccccctggcaccctcctccagagcacctctgggggcacagcggccctgggctgcctggtcaaggactacttccgagtagtacactgagcgggctggcaaggcgcatagcnnnnnnnnnn

SEQ ID NO: 80932 - DNA, 551 bp, Homo sapiens
  misc_feature: GYAE6OF02HJSJO.16.21.B10.1.454.CMB.1.raw
  modified_base (288)..(288): a, c, t, g, unknown or other
  misc_feature (288)..(288): n is a, c, g, or t
tcagtgtactactccacgaccggtgctcgatttagtgtcgtcgcagagagaggagcccagccctgggattttcaggtgttttcatttggtgatcaggactgaacagagagaactcaccatggagtctgggctgagctggctttttcttgtggctattttaaaaggtgtccagtgtgaggtgcagctgttggagtctgggggaggcttggcacagcctggggggtccctgagactctcctgtgcagcctctggattcacctttgacagctatgccatgacctgggtccncaggctccgagggaagggctggaatgggtctcaggtattacgtggtggtggttataccacatactacgcagactccgtagaacgggtccgttcaccatcctaccagacgacaattccaaagaaccacactgtactctagacaaatgaacagcctgagagcccgacgacacggaccatatatactgtagacgaaacgccgaaccggctaggttaacgccaacccattaccttactttacggaaccttacggtcggggtaacccg

SEQ ID NO: 80933 - DNA, 592 bp, Homo sapiens
  misc_feature: GYAE6OF02GZIH2.16.21.B10.1.454.CMB.1.raw
tcagtgtactactccacgaccggtgctcgatttagtgtcgtcgcaggagagaggagcccagccctgggattttcaggtgttttcatttggtgatcaggactgaacagagagaactcaccatggagtctgggctgagctggctttttcttgtggctattttaaaaggtgtccagtgtgaggtgcagctgttggagtcgtggggggaggcttggcacagccgtgggggggtccctgagactctcctgtgcagcctctggattcacctttgacagctatgccatgacctgggtccgccaggcctccgaggggaaggggctgggaagtgggtctcgaggtattacgtggtggtgttactaccacatactacgcagactcgtagaacggggtccgttcaccgtatcctccagacgacaacttaccaaagaaccacactagtactctgacaaagtgaacacgcctagacgacgacccgacgaccgacggctaatactattacgtgtacgacgaaacgccgaaccggtactaacggttacgacccgtaaccctaacttaccttaccttttacggaacctttacggcggggtaaccccgg

SEQ ID NO: 80934 - DNA, 695 bp, Homo sapiens
  misc_feature: GYAE6OF02J1TVX.16.21.B10.1.454.CMB.1.raw
  modified_base (168)..(168): a, c, t, g, unknown or other
  misc_feature (168)..(168): n is a, c, g, or t
tcagtgtactactccacgaccggtgctcgatttagtgtcgtcgcaggagagaggagcccagcccctgggattttcaggtgttttctatttggtgatcaggactgaacagagagaactcaccatggagtctgggctgagctggcttttcttgtggctattttaaaaggntccatgtgaggtgcagctgttggagtcgtgggggaggcgttggcacagcctggggggtcccctggagactctcctgtgcagcctcgtggattcacctttgacagctatcgcctatgaccttgggtcccgccacgggctcccggaagggaacgggccgtaggaagttcggggtacctcgaaggttacttccgtggttggtgttactaccgactactactacgcaggtacctccgtgaacggggtccgttaccaccgactacctcccgaagacgaacctaacgttacccaaacggtaaacaccgtaactagtaactctaagtacaaacgttacgaaaccagaccgtcgaagacgacccgaacgaccgacggacccaagttaactacgttaacgtcgttaacggaccgtaacggaccggtaccccggtaacgtaaccggttaacgttacccgaaaccccgtaagttttaaccccgttaaccggtttttaccggtaaccgttaacccgggtttccggggtaaacccccggg

SEQ ID NO: 80935 - DNA, 763 bp, Homo sapiens
  misc_feature: GYAE6OF02IM1U9.16.21.B10.1.454.CMB.1.raw
  modified_base (728)..(728): a, c, t, g, unknown or other
  misc_feature (728)..(728): n is a, c, g, or t
tcagtgtactactccacgaccggtgctcgatttagtgtcgtcgcaggagagaggagcccagccctgggattttcaggtgttttcatttggtgatcaggactgaacagagagaactcaccatggagtctgggctgagcgtggtctttttctggtggcttatttaaaaggtgtccagtgtgaggtgcagctgttggagtcgtgggggaggcttggcacagccgtggggggtccctggagactctcctgtcgcagcctctggtacttcctacctttgacagtctatcgcctatcgtacccgtcgggtcccgccgacggtcctccggaagggggtaacggggcgtagggaagttcgggtctacgtaaggttactttacggtggggttaggttacggttactaacctacgtaactaccgtacgacgacgtaccgttccggtaggggtaaccgggtcccggttaccaacccttacgtacctaccgaagaaccgtaaacctaaacgttaaccccgaaaacgaaaccctaaccgtaaaccgttgttaacctacccgtaaggtaaactaaaagttaccgaaaactacggtaccctaagggtaacgaaccggtaccccggaaacgacccgaaccggtaccttaaagttaaacctaaattttaccgcggttacggaacgtaacgtacccgaacgggtaacctacggttaccgaaccctaacccgttattaacccgtttntttaacggaaccgttaccgggccgggtaacccggg

SEQ ID NO: 80936 - DNA, 720 bp, Homo sapiens
  misc_feature: GYAE6OF02ICIOW.16.21.B10.1.454.CMB.1.raw
  modified_base (291)..(291): a, c, t, g, unknown or other
  misc_feature (291)..(291): n is a, c, g, or t
tcagtgtactactccacgaccggtgctcgatttagtgtcgtcgcaggagagaggagcccagccctgggattttcaggtgttttcatttggtgatcaggactgaacagagagaactcaccatggagtctgggctgagcgtgtcgttttctaggtggctatttaaaaggtgtccagtgtgaggtgcagctgttggagtcgtgggggaggcttggcacagcctggggggtccctgagactctcctgtgcagcctcgtggattcacctttgacagctatgccatgacctggtccncaggctccgagggagggctaggacgtggtctcgaggttattacgtgggtggttggttactaaccgtactagttacctacgacacgtacgtccggtacggaagggtcccggttacaacccgtattccgtaccaggacgtaactaacgttccccgaaaagaacctaacacttacggtaactcgttaacggaactaaaaggtcgaaacacgtccgtaagacggaaccgacccggaacggaaccgaacccgggtacaaacgttttacttaaacgttttaaccgtgggttaacgaaccgggtaaacgtacccgtaaccccgggggtacttaaacggttttaaccggaacccttaacccccgtaaagttttaacccgtttaacccgttttaacgggaacccggttttaacccgggttacgggggtaacccccggg

SEQ ID NO: 80937 - DNA, 584 bp, Homo sapiens
  misc_feature: GYAE6OF02JDGFY.16.21.B10.1.454.CMB.1.raw
  modified_base (199)..(199): a, c, t, g, unknown or other
  misc_feature (199)..(199): n is a, c, g, or t
  modified_base (230)..(230): a, c, t, g, unknown or other
  misc_feature (230)..(230): n is a, c, g, or t
  modified_base (363)..(363): a, c, t, g, unknown or other
  misc_feature (363)..(363): n is a, c, g, or t
  modified_base (391)..(391): a, c, t, g, unknown or other
  misc_feature (391)..(391): n is a, c, g, or t
  modified_base (429)..(429): a, c, t, g, unknown or other
  misc_feature (429)..(429): n is a, c, g, or t
tcagtgtactactccacgaccggtgctcgatttagtgtcgtcgcaagagaggagggggagagctgctcagttaggacccagagggaaccatggaaaccccagcgcagcttctcttcctcctgctactctggctcccagataccaccggagaaattgtgttgacgcagtctccaggcacctgtcttgctccaggggaaangccaccctctcctgcagggccagtcagagtntaccagcaggtactagcctaggtaccagcagaacctggcctggcctccaggcctccgtcatcctagtggtcgctactccaggcacgggccacgtggcactcccaagcaggttccaggtcggcagggtcggtcngggtacacggtactcactcaccaccctnacgcacgacgtaggacgtccgtagaatgttagctagtnttattacgtgtacagtctagtacgtaggtacggtctaccgttacttaccgttttcgggaccgtaacgggaccgaagtcgtacgggacgtaacgtaacgtaaacgtacgtacggtacggtacctaaccaccgtactcttacgtacttacttacccg

SEQ ID NO: 80938 - DNA, 626 bp, Homo sapiens
  misc_feature: GYAE6OF02GF12L.16.21.B10.1.454.CMB.1.raw
  modified_base (472)..(472): a, c, t, g, unknown or other
  misc_feature (472)..(472): n is a, c, g, or t
  modified_base (527)..(527): a, c, t, g, unknown or other
  misc_feature (527)..(527): n is a, c, g, or t
tcagtgtactactccacgaccggtgctcgatttagtgtcgtcgcaggagagaggagcccagccctgggattttcaggtgttttcatttggtgatcaggactgaacagagagaactcaccatggagtctgggctgagctggctttttcttgtggctattttaaaaggtgtccagtgtgaggtgcagctgttggagtcgtgggggaggcttggcacaggccgtgggggggtccctggagactctcctgtgcagcctctggattcacctttgacagctatgccatgacctgggtccgcaggctccgaggggaaggggctgggaagtgggtctcgaggttattacgtgggtggtaggttactaccactatactacgacagactccggtagaacggggcccggttcaacctatacctccgagacgaactaaacttcccaaagaaaccacaacttgtaatctagacaaaatcgaaacncgacctaggaacgacgacccgaacgaaccaccgggaccaattactaactttacgngtacgaccgtaaagcccgtaaccgggactaacggttaacgaccctaaccctacttaaccgtttacctttaggaacccttacgggtcgggggtaaccccg

SEQ ID NO: 80939 - DNA, 655 bp, Homo sapiens
  misc_feature: GYAE6OF02IIXMH.16.21.B10.1.454.CMB.1.raw
  modified_base (267)..(267): a, c, t, g, unknown or other
  misc_feature (267)..(267): n is a, c, g, or t
  modified_base (385)..(385): a, c, t, g, unknown or other
  misc_feature (385)..(385): n is a, c, g, or t
  modified_base (393)..(393): a, c, t, g, unknown or other
  misc_feature (393)..(393): n is a, c, g, or t
  modified_base (439)..(439): a, c, t, g, unknown or other
  misc_feature (439)..(439): n is a, c, g, or t
  modified_base (588)..(588): a, c, t, g, unknown or other
  misc_feature (588)..(588): n is a, c, g, or t
tcagtgtactactccacgaccggtgctcgatttagtgtcgtcgcagagagaggagcccagccctgggattttcaggtgttttctatttggtgatcaggactgaacagagagaactcaccatggagtctgggctgagcgtggtctttttcttggtggcttaagttttaaaaggtgtccagtgtgaggtgcagctgttggagtcgtgggggaggcttggcacagccgtgggggtccctggaacgctctccgtgtgcacgcctcgtaggnttcctaccttgacagctatgccatcgtaccgtgggtcccgccgacggcctaccggaagggaaccggggtctgggtaacgtcgggtcttacgaaggttattcgtgggttggtacgttanaacccganacgtactaacgcaagacgtccggtagaacgggtccgttacacccgnttaccgtaccgaagtacgaactaaacttacccgaaaagaacaacgacttagtactcctaggaacaaatacgaacgactccgtaggacgcggaacccgtcgaaaccgacgaccagttaaagtacttaccgtgacgacgtaaacggacccncggtaaccgtagttaccaaccgaccctaattaccgttacttacggaacttaccggcgggtaaacccg

SEQ ID NO: 80940 - DNA, 609 bp, Homo sapiens
  misc_feature: GYAE6OF02GOMMY.16.21.B10.1.454.CMB.1.raw
  modified_base (298)..(298): a, c, t, g, unknown or other
  misc_feature (298)..(298): n is a, c, g, or t
  modified_base (532)..(532): a, c, t, g, unknown or other
  misc_feature (532)..(532): n is a, c, g, or t
tcagtgtactactccacgaccggtgctcgatttagtgtcgtcgcaggagagaggagcccagccctgggattttcaggtgttttcatttggtgatcaggactgaacagagagaactcaccatggagtctgggctgagctggtctttttcttgtggctaattttaaaaggtgtccagtgtgaggtgcagctgttggagtcgtgggggaggcttggcacagccgtggggggtccctgagactctcctgtgcagcctcgtggattcacctttgacagctatcgccatcgaccgtgggtcccnccaggcctccgaggggaaggggctaggaagtgggtctcgaggttattacgtggtggtgttactaccatatactacgcagtacgtccggtaggaacgggtcccgttacaccctatccgtaccgagaacgactaaacgttaccaaacgaaaccaccactagttactcgtacgaactaaagttacgaacacgtccgtagacgacgaccgaacgacgaccggactaatactattacgngtacgacgtaacgcgaaccggactacgtacgtaccaacctattaccttacgtttacgacttacggcgggtaacccgg

SEQ ID NO: 80941 - DNA, 586 bp, Homo sapiens
  misc_feature: GYAE6OF02GTL6Q.16.21.B10.1.454.CMB.1.raw
  modified_base (295)..(295): a, c, t, g, unknown or other
  misc_feature (295)..(295): n is a, c, g, or t
  modified_base (361)..(361): a, c, t, g, unknown or other
  misc_feature (361)..(361): n is a, c, g, or t
  modified_base (503)..(503): a, c, t, g, unknown or other
  misc_feature (503)..(503): n is a, c, g, or t
  modified_base (513)..(513): a, c, t, g, unknown or other
  misc_feature (513)..(513): n is a, c, g, or t
  modified_base (524)..(524): a, c, t, g, unknown or other
  misc_feature (524)..(524): n is a, c, g, or t
tcagtgtactactccacgaccggtgctcgatttagtgtcgtcgcagagagaggagcccagccctgggattttcaggtgttttcatttggtgatcaggactgaacagagagaactcaccatggagtctgggctgagctggctttttcttgtggctattttaaaaggtgtccagtgtgaggtgcagctgttggagtcgtgggggaggcttgggcacgagccgtgggggggtccctgagactctcctgtgcagcctctggattccacctttgacagctatgccatgacctgggtcccncgaggcctccgaggggacggggctaggaagtgggtctcgaggtattacgtggtggtgttataccanatactacgacagactccgtaggaacgggtccggttacacctatccctacgagacgaactaacttccaaagaaccacactgtaactctagacaaagttcgaacagcctagacgacgaccgacgacacggactaatatacttangtgacgaaanccgaaccggtntaacggttacgcccaaccgtattaaccttaccgtttagaaccgttacggtcggggtaacccg

SEQ ID NO: 80942 - DNA, 727 bp, Homo sapiens
  misc_feature: GYAE6OF02JIOJM.16.21.B10.1.454.CMB.1.raw
  modified_base (245)..(245): a, c, t, g, unknown or other
  misc_feature (245)..(245): n is a, c, g, or t
  modified_base (296)..(296): a, c, t, g, unknown or other
  misc_feature (296)..(296): n is a, c, g, or t
tcagtgtactactccacgaccggtgctcgatttagtgtcgtcgcaggagagaggagcccagccctgggattttcaggtgttttcatttggtgatcaggactgaacagagagaactcaccatggagtctgggctgagctggcttttcttgtggctatttaaaggtgtccagtgtgaggtgcagctgttggagtcgtgggggaggcttggcacagccgtggggggtccctgagactctcctgtgacngcctgtgagttctacctttgacagctatgccatgacctgggtcccgaccgnggccgtccgaggggacggcgtacggaagtcgggtctacgaggttattacgtcgggtggttacggttactaacccgtaacgaacttaaccgtaccgacgaagtacccgtaccggtacggtaaccggggtaccccggttacgacccgtagtccgtaccgaaaggtacgtaaacctaacggttacccaaaaggaacccacgtaaccgtggttaaaacctcgtaccgaacgtaaaacgtacgaaacccgagtcccgtaaacgggacgtaccgggaaccccgaaacggacccgaaccggtaaccaaacgttaacgtactttaagtccgggtacgtacggtaaaacggcccgtaaccggaattaacggttaccgaacccgtaaccaacggttaactaaccggttttacgaacggttttccggacgggtaaaccccgg

SEQ ID NO: 80943 - DNA, 739 bp, Homo sapiens
  misc_feature: GYAE6OF02H0798.16.21.B10.1.454.CMB.1.raw
  modified_base (204)..(204): a, c, t, g, unknown or other
  misc_feature (204)..(204): n is a, c, g, or t
  modified_base (320)..(320): a, c, t, g, unknown or other
  misc_feature (320)..(320): n is a, c, g, or t
tcagtgtactactccacgaccggtgctcgatttagtgtcgtcgcaagagaggagggggagagctgctcagttaggacccagagggaaccatggaaccccagcgcagcttctcttcctcctgctactctggctccagataccacggagaattggtgttgacgcagtcctccaggccaccctgttctttgtcctccgaggggaaancgcccacctctcctgccagggccagtcagagttgttaccagtccaaggttacttagaccgttggtaaccagcaacgtaaaccgttggaccttacggacctcccgaaggccttcccnctatacctagtcggtcgactacgttaccgaggtcctacggggaccctaacgttcgggaccgaccttaccccggaagtacgtacggtttcgaggtcgggactagggtgggtccgagggactagaccttacacgttcctccgaccttacgacgtacgacgtacggtacgaccgacgttaggaaagttacgtttacgtacgttaacgttaggtttaaccgttttacgttcgtaacgtaacggtacctaaggtttaacggttcgggttaccgggtaccttaaccgttttaccgttacggttttaccgggacccgggtaaacgggtacccaagggtacgtacgtaacggtaacgtaaaccggtaacggtacgttacggtacggtcgtacgacctacccgttacgtacgttcggttaccttaccg

SEQ ID NO: 80944 - DNA, 749 bp, Homo sapiens
  misc_feature: GYAE6OF02J03Q4.16.21.B10.1.454.CMB.1.raw
  modified_base (134)..(134): a, c, t, g, unknown or other
  misc_feature (134)..(134): n is a, c, g, or t
  modified_base (163)..(163): a, c, t, g, unknown or other
  misc_feature (163)..(163): n is a, c, g, or t
  modified_base (240)..(240): a, c, t, g, unknown or other
  misc_feature (240)..(240): n is a, c, g, or t
  modified_base (640)..(640): a, c, t, g, unknown or other
  misc_feature (640)..(640): n is a, c, g, or t
tcagtgtactactccacgaccggtgctcgatttagtgtcgtcgcagagagaggagcccagccctgggattttcaggtgtttcatttggtgatcaggactgaacagagagaactcaccatggagtctgggctganctggtcttttctgtggctattttaaaagngtccagtgtgaggtgcagctggtggagtcgtggggagctggcacgagccgtcgggggtcctgacgacctctacgtgngacagccctgtcggtacttccgtaccttgaacctgtctacgtcgacctaagtccgtaccgtcgggtaccccgaccgtacggtccgtacccggaaggggtaacgggtcgtaaggtaaccggttgggtaccttacggtaaagggtttcgttaaccggttggggtaagggtttaccgttaacctaaccgaccgtaagtacccggtaacgacgtacggtaaccgccggttaggaaccggggttacccttaccgaaccgtacgtaccgtaccggaagtaccaacccttaagtaacccaaaggtaacctaaccgacgtttaacgactacgaacgaaactaacgtaacgaacgtacgccggtaagaacggaccgtcccgaaacgtacccgaaccggtactaaacgtnttaaaccgtgtacgtacgaaccggtacaccggtaaacccgtgaaccgttaaccgtacccaccgttaattccttaaccggttacgaacggttaccggtacggtaacccgg

SEQ ID NO: 80945 - DNA, 787 bp, Homo sapiens
  misc_feature: GYAE6OF02GV5GL.16.21.B10.1.454.CMB.1.raw
  modified_base (591)..(591): a, c, t, g, unknown or other
  misc_feature (591)..(591): n is a, c, g, or t
tcagtgtactactccacgaccggtgctcgatttagtgtcgtcgcaggagagaggagcccagccctgggattttcaggtgttttcatttggtgatcaggactgaacagagagaactcaccatggagtctggctgagcgtgtcttttctgtgctatttaaaggtgtcagtgtgaggtgcagctgttggagtcgtgggggagcttggcacgacgccgtggggggtccctggacgacctctccgtgtgacgacgcctcgtggtacttcctaccgtttgacacgtactagtcgaccaagtccgaaccgtcgggtcccgccgaacggtccgtaccggaacggggtacggggctagggtaagtcgggtcgtacgtaacggttgttaccggttggggttaggttacggtttaacaacccggtaactaacgttaacccgtaacggacctaacggtaccgttcggtacggggtaagggttcccggttaccaacccgtacttacccggtaccaaggtaccgtaaacgtaaaccttaccccggaaaagaaccctaaaccgtacgttacgtaacctccggttagaacctaaagtaccgaaccgngtacccgtaaggacgaccggtaacccgacgggaacccgacgtacgtaaactttaaattacgtaacggtttcgaacggtacccggaaagtccccggtaaccgggtatttaaacgggttacccaacccgtaacccgttaacgttacccttttaacggttaacggtaacccggtttcccgggaacggggtaacccccgg

SEQ ID NO: 80946 - DNA, 614 bp, Homo sapiens
  misc_feature: GYAE6OF02HZRVO.16.21.B10.1.454.CMB.1.raw
  modified_base (472)..(472): a, c, t, g, unknown or other
  misc_feature (472)..(472): n is a, c, g, or t
tcagtgtactactccacgaccggtgctcgatttagtgtcgtcgcaggagagaggagcccagccctgggattttcaggtgttttcatttggtgatcaggactgaacagagagaactcaccatggagtctgggctgagctggcttttttcttgtggctaattttaaaaggtgtccagtgtgaggtgcagctgttggagtcgtgggggagcttggcacagccgtggggggccctggagctctcctgtcgcagcctctggacttctaacctttgacagcttatgccagtgaccgtcgggtccgccgtagcctaccgaggggaagggctaggaactgggtactcgaggttattacgtgggtggttggtactaccactatacgtacgcaagactcggtagacggtccggttacacatcctacagaacgactaaacgtacaaagaccacacttgaactcgtagaccaaagtagaaaccngacctaggacgtacgaccgacgacaccgggacaattactattacctggtacgacgaacgccggaccgggacttaacggttaccgaccctaacccgtaagttaaccttaccgtttaagacccgttaccggcgggtaaaccccg

SEQ ID NO: 80947 - DNA, 735 bp, Homo sapiens
  misc_feature: GYAE6OF02ILEFN.16.21.B10.1.454.CMB.1.raw
  modified_base (222)..(222): a, c, t, g, unknown or other
  misc_feature (222)..(222): n is a, c, g, or t
tcagtgtactactccacgaccggtgctcgatttagtgtcgtcgcaggagagaggagcccagccctgggattttcaggtgttttcatttggtgatcaggactgaacagagagaactcaccatggagtcgtgggctgagctggtcttttcttgtggtacttattttaaaggtcgtccagtgtgaggtgcagtctggttggagtcggtggggagtgttggcacgnggccggtggggggtccctggacgtccttcgtccgtgtacgcgacgtctcgtaggtacttactaccgtttagactagtctacgtcgcctagtcgtaccggtcggtcccgcgacggtccgtaccggaaggggaacgggtcgtaggtaagttcgggtccttaggtaaggtttaacgtttcggtaggggttaggttacgttaactaaccgacttaactacgtacgacgtacgaccgttacggtacgggtacggtacccgttccaccgtactcctaccgaacggagtaaacctaacgtaaaccaaacgtactaacgtacttacggtaacttactacgaaactaacgtaacgacctaacggcgtaacggcgaccgaaccgtacgaccgaacggtaccttagtacgtacgttacgacgtacggaaccgtacggtcccgtaaaccggtcgttaaacgtaacctaacccgttaaccgtaactacctttacggtaacgtccggtaccggtacgggtaacccgg

SEQ ID NO: 80948 - DNA, 658 bp, Homo sapiens
  misc_feature: GYAE6OF02GLLQ9.16.21.B10.1.454.CMB.1.raw
  modified_base (166)..(166): a, c, t, g, unknown or other
  misc_feature (166)..(166): n is a, c, g, or t
  modified_base (562)..(562): a, c, t, g, unknown or other
  misc_feature (562)..(562): n is a, c, g, or t
tcagtgtactactccacgaccggtgctcgatttagtgtcgtcgcaggagagaggagcccagccctgggattttcaggtgttttcatttggtgatcaggactgaacagagagaactcaccatggagtctgggctgagctggctttttcttgtgctattttaaaggtntccagtgtgaggtgcagctgttggagtcgtgggggagtcttggcacaggccgttggggggtccctggagactcgtcctagtcgcacgtcctcgtaggtacttcctaccgtttgacctagcctatcgaccattcgaccgtgggtcccgaccgacggccgtccggaaggggaacggggtctgggaagttcgggtctacggaagttgttacgtggggttcggttaggttaactaccaacgtacgttaacctaccggacgacgaacgttccggtagggtaaccgggtcccgttaccacctacgttcctccgaagtacgtaaccgtaatcccgtaaaagaaccacgttactagttactgtacactaaatacggaactcggactaggacacgcgtaaccganccgacctattacctagtgtagcgactacgaccgtaggactacgttaccacccgtaactataccggtttacctaagtaccgttagccggtaacccgg

SEQ ID NO: 80949 - DNA, 773 bp, Homo sapiens
  misc_feature: GYAE6OF02F7U40.16.21.B10.1.454.CMB.1.raw
tcagtgtactactccacgaccggtgctcgatttagtgtcgtcgcaggagagaggagcccagccctgggattttcaggtgttttcatttggtgatcaggactgaacagagagaactcaccatggagtctgggctgagctggtctttttctgtggctaatttaaaaggtgtccagtgtgaggtgcagctgttggagtcgtggggagcttggcacaggccgtgggggtccctgacgactcctcctgtgcagtcctcgtggtacttcctaccgttttggactagtctagtcggacctagtcgaccgttcgggtcccgaccgtacggccgtaccggaggggaacgggtcgtaggaacgtcgggtactacgtacggtattacgtgggtaggttagttaactaccgactacgttaccgtacgtcgaacgtaaccgttccggtaaggaacggggttccgttaccaaccgtactaccgtaccgaacggtacgtaaacctaacgtttaacccgaaagtaacccaacgtacgttcgtaaccttacgtacgtaacaaacgtacgaaacgtacgtcctaaggacgaccggacgtaacccgacgaccggtacctaaagttaccgttaatttaccgtagggtaacgtaacccgggtaaacgtaccccggtaaaccgggtacgttaaacccgggtttaaccgtacccgttaaaccccttaacgtttaacccggtttaaccgttttacccggaaaccggttttaccgggtaccggggtaaaccccccggg

SEQ ID NO: 80950 - DNA, 786 bp, Homo sapiens
  misc_feature: GYAE6OF02FFS3H.16.21.B10.1.454.CMB.1.raw
tcagtgtactactccacgaccggtgctcgatttagtgtcgtcgcaagaggagagggggagctctgagagaggagcccagccctgggattttcaggtgtttcatttggtgatcaggactgaacagagagaactcaccatggagtctgggctgagccgtggctttttctacgtggctaattttaaaaggtgtccagtgtgaggtgcagctgttggagtcgtgggggaggcttgggcacagccgtggggggtccctggacggactctccgtgtcgcagcctcgtggactttcacctttagaccgtagcctaatcggacccaagtcgaccgtgggtacccgaccgaagggcctaccggaagggggtaaacgggggccgttagggaaacgtggggttacctaccggtaaggttagttttaaccgtggggttacgggtttacgggtttaaactacccgtaactaaacgttaacccgttaaccggacgtacgtaaaccgttccggtaacgggggtaaaccggggttcccgggtaccgtaaccccaacgggttacccttacccgaaacggtaaacggtaaaccctaaacgtttaaccgtaaaacggaaacctaaacctaacgttaccggttaatacgtaccggaaacttaaacgaaccggaaacgtaccgtaccgttaggaacggaccgacccggacgaacccgttacggacaacgttactaacgttacgtacggtaacgaccggttaacaccggtaccggaaccgtacggttacgtacccgtaacttaaccgg

SEQ ID NO: 80951 - DNA, 660 bp, Homo sapiens
  misc_feature: GYAE6OF02JGIXP.16.21.B10.1.454.CMB.1.raw
  modified_base (314)..(314): a, c, t, g, unknown or other
  misc_feature (314)..(314): n is a, c, g, or t
  modified_base (490)..(490): a, c, t, g, unknown or other
  misc_feature (490)..(490): n is a, c, g, or t
  modified_base (499)..(499): a, c, t, g, unknown or other
  misc_feature (499)..(499): n is a, c, g, or t
  modified_base (507)..(507): a, c, t, g, unknown or other
  misc_feature (507)..(507): n is a, c, g, or t
  modified_base (515)..(515): a, c, t, g, unknown or other
  misc_feature (515)..(515): n is a, c, g, or t
tcagtgtactactccacgaccggtgctcgatttagtgtcgtcgcaggagagaggagcccagccctgggattttcaggtgttttcatttggtgatcaggactgaacagagagaactcaccatggagtctgggctgagctggtcttttctgtggctattttaaaggtgtccagtgtgaggtgcagctgttgagtcgtgggggagcgttggcagagccgtggggggtccctgagtacctctcctgtcgcagccctgtgactttccgaccttttggaccagtactacgtcgaccgtagtcgacccgttggggtccccncccggtaaggcccgtcggaagggggtacggggctagggtaacggtgggtacctacgtaaggttattacgtggggtcggttagttaactaccgactacttaacacgactacgtaccgtcgtaggaaccgggtccgtacactactcaccgagacactaacgtccaaagacactacgtntactccgtnaacttaanacggaacncgtcctaagggctaccgggaacccgacgaccgttccgaactaacgttataacgttacgagttacgacgtaacgccggacgtacgtaacttcccgacaacccgtagtttaaccttaccgtttagaccgttacggtcgggaacccgg

SEQ ID NO: 80952 - DNA, 652 bp, Homo sapiens
  misc_feature: GYAE6OF02I3ACE.16.21.B10.1.454.CMB.1.raw
  modified_base (197)..(197): a, c, t, g, unknown or other
  misc_feature (197)..(197): n is a, c, g, or t
tcagtgtactactccacgaccggtgctcgatttagtgtcgtcgcaagagaggagggggagagctgctcagttaggacccagagggaaccatggaaaccccagcgcagcttctcttcctcctgctactctggctccagataccacggagaaattgtgttgacgctagtctccaggcacctgtcttgtctcgagggaangccacctctcctgcgaggccagtcagcgtgtaccagcaggtacttagcctggtaccagcaagaacctggacctcggcctccgaggcctcctcactcgtagtggtacgctactccgaggcgacggccacgtagacctactccagtacgtaggtcgaggtcgctagggttcggtacgtagggactacgtacttacacctccgtacccacccgtcgaacgtaccgacggtaaccgtagggtaccgtccgtaaggtaacgtttacgtttacgacgtagttacgttaagttaccgttcgtacgacgtagtaacgtggtacggtacggtacctaaccgtttacgttacggtttaccggaccggtacgggtaacctaaggtcggtacgaacggtaacgtaaaccgtaaacggtacgttaggacgtcgtacggacctaacgtacgttcgttaccgtcttaccg

SEQ ID NO: 80953 - DNA, 853 bp, Homo sapiens
  misc_feature: GYAE6OF02ICBIE.16.21.B10.1.454.CMB.1.raw
  modified_base (261)..(261): a, c, t, g, unknown or other
  misc_feature (261)..(261): n is a, c, g, or t
tcagtgtactactccacgaccggtgctcgatttagtgtcgtcgcaagagaggagggggagctctgagagaggagcccagccctgggattttcaggtgttttcatttggtgatcaggactgaacagagagaactcaccagtggagtcgtagggctgagcgtggtcttttttcgtggtggtactttaaagttttaaaaggtcgttaccgaggttggtggacggtgcgagtcgtggttggagtcggtgggggagtcgttggacncgacggtccggtgggggtaccctggaacgtactcctaccgtgtgaccgtacgtccgtacgtggtacttacctacgtttacggaactaggtacctaacgtacgtaccctaaacgttccggtaacccggtttccggggaccccgaccggttagggacccgttacccggggaaaggggtaaccgggtacggttaacggtaaggttcggggttaccttaaggtaaacggtttacgttacgggttagggtacgggttacggttttaacaaccgtaactacgtaactacgtacgaacgtccgtacggtacggaacggtaccgttacaaccttagtcgaaccgtaagaaccgtaaactacgttaacccgaaacgttaaccgacgttaaccgttagtaacctaccgtaagtaaaccgtaaaagtacccggtaaactaccgggtaactacgggaaaccggtacggaaacccgtaaacgaacccgaaccgtaaccgtaaagtttaaagttaccgttaaaaccggttggaacccggtaaaaaggtacccggtacgtaaccccgggtaatttaaccgggtaacctaaccccgtaaccttaaccg

SEQ ID NO: 80954 - DNA, 817 bp, Homo sapiens
  misc_feature: GYAE6OF02G8N9R.16.21.B10.1.454.CMB.1.raw
tcagtgtactactccacgaccggtgctcgatttagtgtcgtcgcaggagagaggagcccagccctgggattttcaggtgttttcatttggtgatcaggactgaacagagagaactcaccatggagtcgtggctgagcgtggtctttttcgttgtcggacttaagtttttaaaagggtcgtccgtaaggttgttggaggttgccaaggtccttggttgggtaggttcggtgggggtacggtcgttggcgacgacggtccggtcggggggtccttggacgtaccttcgtcgttcggtagccgtacggtcctcgtaggtaccttcctaccgttagacgtacgtctagtccgtaccagtcggtaccgtcgggtccgccgtacggtccgtaccggacggggtaaggggccgtaggtaaggttcggggtactaccggtaaggttagttacggtcgggttagggttcggttaacgtaccgtaacgtaaccgttacgaccggtacgtaacgtaccggtttacgggaacgggttacccggggttccgttaacccgtacccggtacttacccgtaacggtaacgtacctaaacggtaaaccgttaacgaaacgtaccgtaattaccggtatacgtacgtaaccggtaactaaacgaacgacgtaacgtgtaccggaacgtaccgggacctaccgacgtacgtaaccgcttaagtaccttcggaagtacgtaccggaacgtccgtaacggtaccgttaacgtaaccgttaccctaaccgacttttaacccggttacgtttaacacccggtttacgtcggtaaccccgg

SEQ ID NO: 80955 - DNA, 920 bp, Homo sapiens
  misc_feature: GYAE6OF02IUYSG.16.21.B10.1.454.CMB.1.raw
tcagtgtactactccacgaccggtgctcgatttagtgtcgtcgcaggagagaggagcccagccctgggattttcgaggtgttttcatttggtgatcaggactgaacagagagaactcaccatggagtcgtggctcgagctggtcttttcttgtggcttatttaaaggtgtccagtgtgagtgcagctgttcggagtcgtagggggacgtcgttggacaccgaggtccgtggggggtccctgacgtaccgtcgtccgtgtcgtccgagtcctcgtcggtacttcctaccgtttgacctaacggtactacgtaacgtcctaagttccgaacccgtttgggaccccgtacgacggttaccctaccggaacggggtaacggtccgtaggaacgttcgggtctacggaggttactaccgaacaacgtcgtaagtaacggttacgtaaccggactaggttaccgggtaacgtacgaacgggttacctacccgggtaaggtaacccgggtttacccgttttacccgaaacccgttaacgccccgtttaaacccgggtacgaaaccggttaaccctaaaacgggtttcccccgaaaaaaggtaacccggttaccggaaccgtttttaaccgttaaggtttaacccggaaactaaacgggtttaccgtaaacccgtggggtttaccctaaggggaacccgtaacggttaacccgaaaccgggtaaccggtaacccgtacccgttaaaaaggttacgttaaaccggttaaccgtcgttaacggggaaccccggtttaaggtaacgggggggttaaaaccttttacgggggggacccttaccccggggtttaaggtaaacccgttcgggtaaacccgtttttaaccgggttaccccggttaaaaggccccgggggtttaaaacccgggggg

SEQ ID NO: 80956 - DNA, 650 bp, Homo sapiens
  misc_feature: GYAE6OF02IL2TZ.16.21.B10.1.454.CMB.1.raw
  modified_base (214)..(214): a, c, t, g, unknown or other
  misc_feature (214)..(214): n is a, c, g, or t
  modified_base (395)..(395): a, c, t, g, unknown or other
  misc_feature (395)..(395): n is a, c, g, or t
  modified_base (428)..(428): a, c, t, g, unknown or other
  misc_feature (428)..(428): n is a, c, g, or t
tcagtgtactactccacgaccggtgctcgatttagtgtcgtcgcagagagaggagcccagccctgggattttcaggtgttttcatttggtgatcaggactgaacagagagaactccaccatggagtctgggctgagcgtggtctttttctgtggcttaattttaaaaggtgtccagtgtgaggtgcagctgtgagtcgtggggagcttggcacngccgtcgggggtccctggacgactccgtcctgtgcacgcctctggattccactttgacagcctatcgccagtcgaccgtcgggcccgtccagggcctccggaaggggacggggtcgttagggaacgttcgggtcctgtacgggttattacgtgggtggtagttacaccgacacttacacgnacgactccgtagaagggtcccgttacacctacnccctacgaaggtacgtaacctaacgttaccgaaacgtaaccacgtacctagttactcgtactacaaattcgaaacaccgtccgtaggacgtacgaccgacggactaccggacctagttactacgttacgtgacgacgaacgccgtaaccggtactaggtttaacccgccgaaccgttaacgttaccttaaccgttaacgtaccgttaccggagggtaacccg

SEQ ID NO: 80957 - DNA, 889 bp, Homo sapiens
  misc_feature: GYAE6OF02JFJQ0.16.21.B10.1.454.CMB.1.raw
tcagtgtactactccacgaccggtgctcgatttagtgtcgtcgcaagagaggagggggggagctgctcagttaggacccagagggaaccatcggaaaccccagcgcagcttctcttcctcctgctactctggctcccagactaccaccggagaaattgtgttgacgcagtctccaggccaccctgttctttgtctaccgaaggggaacacgccaccctctcctgaccgacgggccagtcaggtagttcgttaccagacgtaggttacttacgccgttaggtaccagtaccaacgtaaaccgtcggtaccgtcggtcccttacccgacggtcctacccgtactacgttacgttaacgttcgggtcgaacctaccgttaccggacggaccggaccggggtaccctaacgggttccgggtacctaacccgttaccccggaaacggttaccggttaaccggttaccgggaacggtttccgggacggttaacggggtttcggggtaccggttaacggggtaaccgttaaccgggttaaccctttccgtaacccgtttcccgttaccccgtaccccggtacgtacggacccgttaacggtacccggtacggaaccggttaccggtaagtaacggtttacgtttacggaccgttaggttacttaacttacgttcgtaccgtacgtacggttacggttacggtacgggttaaccggtacctttaaccggtttacgtttaccgggttaccgggaaccggggttaaacggtaccgtaacggtcggtaaacggttacggtaaccgttaaccggtaaacggttccggttacggttaccggtacgtacccgttaaccgttcgttaccgtttaccggtttacgttaccttaaccgttccccgg

SEQ ID NO: 80958 - DNA, 835 bp, Homo sapiens
  misc_feature: GYAE6OF02GIKI6.16.21.B10.1.454.CMB.1.raw
  modified_base (101)..(101): a, c, t, g, unknown or other
  misc_feature (101)..(101): n is a, c, g, or t
  modified_base (112)..(112): a, c, t, g, unknown or other
  misc_feature (112)..(112): n is a, c, g, or t
  modified_base (193)..(193): a, c, t, g, unknown or other
  misc_feature (193)..(193): n is a, c, g, or t
tcagtgtactactccacgaccggtgctcgatttagtgtcgtcgcaagagagacgggggagagctgctcagttaggacccagagggaaccatggaaaccccngcgcagcttcncttacctcctgctactctggccccagatacaccgacggaattatggttgacgacgactactccacgacggcccttaccgtntttaccgtttcacccgtaggggaaaggagccctacccgtaccttcgtcgagaccgggtacgacccttaggacgaggttacggtttaccccgaaggaccgaggttaaccgtttcgtacccgtcggtaacgtaccgagtaccgaaaccgtaccggtcgtacccggtacgtaccccgtaccggtacgttacccttcgtaacgttacttaccgtagggttacggactaaccttccgaccggaaccggtcgggaaccctcacggttaaccgaccttaccctaccggaaacggttaccgggttactaaccggtcgggtaacggtcgggtttacggggttaccggttaggtaaaccggtacgtaccgttaaccctaccgttcccggtaccccttaaacccgccgttaaccggacgtaaccggacgttacggaccggtacgtaacggtaacgttacgttttaacggtacgttacggtaacggtttacgttaaccgttacgtaccgtacggtaacgtacggtacggttacggtacggtaccgttacgttaccgttaccgttcggtacggacggtaccgaacgtcgtacgagtacacgaacgttaacgtcggtacgtcgtacgactacgtactacggtcttacctcttaccg

SEQ ID NO: 80959 - DNA, 923 bp, Homo sapiens
  misc_feature: GYAE6OF02G63EW.16.21.B10.1.454.CMB.1.raw
tcagtgtactactccacgaccggtgctcgatttagtgtcgtcgcagagagaggagcccagccctgggattttcaggtgttttcatttggtgatcaggactgaacagagagaactcaccatggagtctgggctgagctggtctttttcttgtggctaagttttaaaggtgtccagtgtggaggtgcagtctgttggagttcggtgggggaggtcgttggcacgacggtccggttcgggggggttccctggacggtaccttctccgttggtcgtacgacggtcctcgtggtactttaccgtaccgtttgaaccgtagtccttatcgacctagtcggtaccggtcgggtcccgccgtacggtccgtaccggagggggtaacggggtccgtaggggtaaacgttcgggggttccctacgtaagggtttaacgtttaaccgggtttgggggttacgggttaacggttttaacctaacccgtaacgttaaacgttaaccggtaaccggtacgtaaccggttaaccggttaccgggttaacggggtaaacccggggttcccggttttaccaaaccgttacgtcctaaccggaagtaaccggtaaaccttaaacgtaaccctaaaacggaaacccggtactaacggtttacgtacttaccggtaacggtaaacctaaaacggtttccgaaaaaccgtaccgttaaccggtacggtaaacggaacccggtaaaccccgggaaccgtaacccgaaacccgggtaacctttaaggttaaactttaacccgttttaagggaccgttaccgggtaaaccgaacccgggtacccgtaaaaccgggttccgttaaacggttacccgttaaccccgaacccttaacgttaaccgttaaccgtttaccggaaccctttacgggtaccggggtaaccccgg

SEQ ID NO: 80960 - DNA, 739 bp, Homo sapiens
  misc_feature: GYAE6OF02FSSCC.16.21.B10.1.454.CMB.1.raw
  modified_base (142)..(142): a, c, t, g, unknown or other
  misc_feature (142)..(142): n is a, c, g, or t
  modified_base (203)..(203): a, c, t, g, unknown or other
  misc_feature (203)..(203): n is a, c, g, or t
  modified_base (249)..(249): a, c, t, g, unknown or other
  misc_feature (249)..(249): n is a, c, g, or t
  modified_base (279)..(279): a, c, t, g, unknown or other
  misc_feature (279)..(279): n is a, c, g, or t
  modified_base (700)..(700): a, c, t, g, unknown or other
  misc_feature (700)..(700): n is a, c, g, or t
tcagtgtactactccacgaccggtgctcgatttagtgtcgtcgcaagagaggagggggagagctgctcagttaggacccagagggaaccatggaaaccccagcgcagcttctcttcctcctgctactctcggctcccagtanaccaaccggataaattgtgtgacgcagtctccgaggcacctgtctttgtctcgaagggaancgccctacctcgctgcacgggccaagtcagtacgtacgttaaccgngacgtaggttaccttacgccgtaggtaccngaccgaagaaaccgtcggtacctcggtcctacccggaggtaccctccctataacgttacgttacggttaggtgtaccgtacgtccgaacgccggtaacggacctacggtacggcctaaccgacccgaaggaccgttaacggtcggtaacgttcgggacgtttacggggtcggtacggttccgggaaataaccgttaccgttacctaacggtcccgtaaccctacccggtacacgggtccaacggtacgtcggaaccgtccgttaaagtaacggttattcgacgttacgttagttacgttgttacgacacgtacgtagtaggttcggaacttaccttacgttaacgttccgtttacggaccgtaacgggtaccaacgggtcgtacgaagtaacgttaaacggaaccgtacgtcggttaccgngtaccgaacgttacgtacgtcgttaccgtaccttaaccg

SEQ ID NO: 80961 - DNA, 798 bp, Homo sapiens
  misc_feature: GYAE6OF02J0CXQ.16.21.B10.1.454.CMB.1.raw
  modified_base (198)..(198): a, c, t, g, unknown or other
  misc_feature (198)..(198): n is a, c, g, or t
  modified_base (580)..(580): a, c, t, g, unknown or other
  misc_feature (580)..(580): n is a, c, g, or t
  modified_base (695)..(695): a, c, t, g, unknown or other
  misc_feature (695)..(695): n is a, c, g, or t
  modified_base (735)..(735): a, c, t, g, unknown or other
  misc_feature (735)..(735): n is a, c, g, or t
tcagtgtactactccacgaccggtgctcgatttagtgtcgtcgcagagagaggagcccagccctgggattttcaggtgttttcatttggtgatcaggactgaacagagagaactcaccatggagtcgtgggctgagcgtggtctttttctgtggcttaagttttaaaggtgtccagtgtgaggtgcagtctggttggngtcggtgggggtagcttgggacacgaggtccgggtcgggggggtcccctaggtaacgtccttccgtccggtagtcgtccgacgtccgttacgttcggactttccgtaccgtttgaaccgtaggtcttatcgaccgtagtccgtaacggtcggtacccgccggtaggtccgaccggtaaggggacggtaggtaggtacggttcgggtactacgggtaacgtaggttacggtgggtttacgggtagtttaaccgaccgttagtaactaaccggtacggtacctaacgggtacgtaacggggttacggaaccggggttaccctaaccgtaccgtaccgtaacgtccgtaaggaaacctacgtaaacctacccgtaaaaccggaanaaacccgttacgttaataaccttcggaactaactaaacgaccggaaccaacccgttggaaagaacggccggtaccgaaccggttaaccggaacgttacccgtaattaaccggttnacgggtaaggacgtacgtaccggggtatacccggttaagnggtaaaggcggtaactccgggtaaaccggtaagggtcccggaaggttccggaaccgttaccgg

SEQ ID NO: 80962 - DNA, 654 bp, Homo sapiens
  misc_feature: GYAE6OF01COLBL.35.42.D09.1.454.CMB.1.raw
  modified_base (586)..(586): a, c, t, g, unknown or other
  misc_feature (586)..(586): n is a, c, g, or t
  modified_base (633)..(654): a, c, t, g, unknown or other
  misc_feature (633)..(654): n is a, c, g, or t
tcagtacagatcgtcacgaccggtgctcgatttagacacatacgcagggaaagggactggagtggattggcgatatctctcatagtgggagcaccaactaccaaccccctccctcaagagtcgagtcatcatatcagttgacacgtcccaagaaccacttcctccctgggattgaacagtgtgaccgctgcggacaccggtcgttttatactggtcgacgagggacggtacgaaggtacggtaccgttttagaacgttaacgggttaaaccgtccgggacttaaccgtactacgtacgtcgtagtcggaccgttcgcgggggaccgaaacgggggacccaacgggtacccgtaccccggttcctcccctacgaccggttccccctacccgaacccgaaccggggtcccccctacggttccccgggttacccttttcccccccggtcgggccccgtcccccgtcggtcccgtacccgacgggacgccgtaaccccgtcggggttcgggggaccaccgacggccccgggcccgttcgggccttccggcccgtaggtaccgtaaacggtacccttacctaccgaccgtntccgttagtacgtgacgcgggtacgtggacgaggtccgacagtacgnnnnnnnnnnnnnnnnnnnnnn

SEQ ID NO: 80963 - DNA, 647 bp, Homo sapiens
  misc_feature: GYAE6OF02JPYVO.35.42.D09.1.454.CMB.1.raw
  modified_base (614)..(614): a, c, t, g, unknown or other
  misc_feature (614)..(614): n is a, c, g, or t
  modified_base (617)..(617): a, c, t, g, unknown or other
  misc_feature (617)..(617): n is a, c, g, or t
  modified_base (629)..(629): a, c, t, g, unknown or other
  misc_feature (629)..(629): n is a, c, g, or t
  modified_base (632)..(633): a, c, t, g, unknown or other
  misc_feature (632)..(633): n is a, c, g, or t
  modified_base (635)..(635): a, c, t, g, unknown or other
  misc_feature (635)..(635): n is a, c, g, or t
  modified_base (638)..(638): a, c, t, g, unknown or other
  misc_feature (638)..(638): n is a, c, g, or t
  modified_base (640)..(642): a, c, t, g, unknown or other
  misc_feature (640)..(642): n is a, c, g, or t
  modified_base (644)..(646): a, c, t, g, unknown or other
  misc_feature (644)..(646): n is a, c, g, or t
tcagtacagatcgtcacgaccggtgctcgatttagacacatacgcagggaaagggactggagtggattggcgatatctctcatagtgggagcaccaactacaacccctccctcaagagtcgagtcatcatatcagttgacacgtccaaagaaccacttctccctggagttgaacagtgtgaccgctgcggacacggccgtttatactgtgcgagaggtcgagaggtactttgacgtaggttaaacgtcgggacttactactacgtcgactatggacgtcgtggggtccaagggaccgacggtcaccgtctcctcgaacgcctccaccgaacggcccacgtccgtccttccccgtcggcctacccctcctccgtaacgacgccaaccgtcgtcggggggtaccaccgacggacccggtcccggtacggggtccgtcggtcccgttaccggggttccggaaacggtacccgtttaaccgtttacccgaaccggtaacgttccgttacggttaccctagggtaccggtaccggggtccgttacgggaccggaacgggtccggaccgtaacgttaacggcgtaacggtcacgtcgcgagcgacgcgtcgcgcgcgcgngcncgcgtacgcgcncgnngngcncnnncnnnc

SEQ ID NO: 80964 - DNA, 567 bp, Homo sapiens
  misc_feature: GYAE6OF02GORS8.35.42.D09.1.454.CMB.1.raw
  modified_base (193)..(193): a, c, t, g, unknown or other
  misc_feature (193)..(193): n is a, c, g, or t
  modified_base (218)..(218): a, c, t, g, unknown or other
  misc_feature (218)..(218): n is a, c, g, or t
  modified_base (305)..(305): a, c, t, g, unknown or other
  misc_feature (305)..(305): n is a, c, g, or t
  modified_base (485)..(485): a, c, t, g, unknown or other
  misc_feature (485)..(485): n is a, c, g, or t
  modified_base (487)..(487): a, c, t, g, unknown or other
  misc_feature (487)..(487): n is a, c, g, or t
  modified_base (490)..(491): a, c, t, g, unknown or other
  misc_feature (490)..(491): n is a, c, g, or t
  modified_base (494)..(494): a, c, t, g, unknown or other
  misc_feature (494)..(494): n is a, c, g, or t
  modified_base (514)..(514): a, c, t, g, unknown or other
  misc_feature (514)..(514): n is a, c, g, or t
  modified_base (546)..(546): a, c, t, g, unknown or other
  misc_feature (546)..(546): n is a, c, g, or t
tcagtacagatcgtcacgaccggtgctcgatttagacacatacgcagggaaagggactggagtggattggcgatatctcctcatagtgggagcaccaactacaacccctccctcaagagtcgagtcatcatatcagttgacacgtccaagaaccacttcctccctggagttgaacagtgtgaccgctgcgganacggtccgtttattactgtgcgagnggtcgagaggactttgactaggttaaacctgggcctactactactacgctatggacgtcgtgggccaagggaccacggtcaccgtcncctcagccctcgaccaacgggccatcggtccttccccgtggccaccctcctaccgaagacgcacctcgtggggcctacgagcggtccctagggctcgcctgtaccgaaggacctactaccgaccgtatccgtagtactacgacggtacgggacgttgggacgtaaggccgacgagtacgnantannagngacagtcagtgagcaggtangacgtgacgtcgagtaccgtacgtactcgacnccgacgtacgacgtactagta

SEQ ID NO: 80965 - DNA, 309 bp, Homo sapiens
  misc_feature: GYAE6OF01BYWWT.39.2.A02.1.454.CMB.1.raw
  modified_base (303)..(309): a, c, t, g, unknown or other
  misc_feature (303)..(309): n is a, c, g, or t
tcagtcgcactagtcacgaccggtgctcgatttagactcatctacagcacaaacattcgctcctctggggtccctcatcgcttctctggctccattcttgggaacaaagctgccctcaccatcacgggggcccaggcagaggatgaatgtgattattactgtgtgctgtatatgggtagtggcatttcgctattcggcggagggaccaagctgaccgtctaggtcagcccaaggctgccccctggtcactctgttcccaccctcctcactagtgcgactgagcgggctggcaaggcgcatagnnnnnnn

SEQ ID NO: 80966 - DNA, 672 bp, Homo sapiens
  misc_feature: GYAE6OF01CX4XW.39.2.A02.1.454.CMB.1.raw
  modified_base (115)..(115): a, c, t, g, unknown or other
  misc_feature (115)..(115): n is a, c, g, or t
  modified_base (194)..(194): a, c, t, g, unknown or other
  misc_feature (194)..(194): n is a, c, g, or t
  modified_base (211)..(211): a, c, t, g, unknown or other
  misc_feature (211)..(211): n is a, c, g, or t
  modified_base (664)..(664): a, c, t, g, unknown or other
  misc_feature (664)..(664): n is a, c, g, or t
tcagtcgcactagtcacgaccggtgctcgatttagactcatctacaggggtccctgagactctcctgtgcagcctctggattcaccttcagagacttctggatgcactgggtccnccaaactccagggcaggggctggtgtgggtctcacgttattaattttgagtgggatagcacaagctacgcggactccgngaggccattcaccatcncagagacaacgccaagaacacgctagtatctgacaaaatcgaacagtcagagagccgagtacacggtctgtcgtattacgtgtgacaaagagatcgactccaatagtaacgcagtcctacgtacaactttacttagtttacgaccgttaggcggggggtaccccggtaaccttcggtaccacccggttcctacctaccgacgtccccttacccgaaaccggaaccgggaccccctacggttccccggttaccccctttccccgacggacccctacccccgtactaaccgaacgacccgtccgtaaccccggttgggacccggggtaccacgggtccgccccgggtacccgtgggtcctcggtccgtaacggtacgtaacgtacccttaccgttaccgacgtacgggccgtaacggacgtcgggacggtcccgggactacggagtaaccgggcngtaagtcg

SEQ ID NO: 80967 - DNA, 738 bp, Homo sapiens
  misc_feature: GYAE6OF01EROWZ.39.2.A02.1.454.CMB.1.raw
  modified_base (146)..(146): a, c, t, g, unknown or other
  misc_feature (146)..(146): n is a, c, g, or t
  modified_base (296)..(296): a, c, t, g, unknown or other
  misc_feature (296)..(296): n is a, c, g, or t
tcagtcgcactagtcacgaccggtgctcgatttagactcatctacgagggggaaaaggccctgaggaaagcaaaccccagctggggaagccctgagaacacttagccttcatgagtcgtccccaccatggcctggatgatgcttcncctcggactccttgcttagtggatcgaggagtgtattctcgagtacttggtgtacgacccgaggtcgtccccttgttcctcaggttccgtacccgtggggaggacctagtaccaccgacttcctacggtttggaggtcttggacgtcttntacggtacctcacggttctcgtttaacttaaccctttaccctacccgtcgtcgtaccggtacacggaccaacccggacccccgacggaccccgtacggtcccctacccggaacccgcgtaaccggtcccttactaccgtacaacccgacgtacccaaacgtaaactccgttacccgtactcccggttccggtcggtccctactacgtcctcttcgtactgtccctacgttacgttcgtaacggtaaacaccggtctccgaccctaccgacctcggtacccgggccggtaccggacggctaggtacgagtagactcgtaagttattagtgttacgtcgtagtcgttatacggttagggttccgggttagggtccttcgtttaccgttggttaccggtttacgggtacgggaccgggtaaacggtacccgaagtttaacccggg

SEQ ID NO: 80968 - DNA, 307 bp, Homo sapiens
  misc_feature: GYAE6OF02GRYC6.39.2.A02.1.454.CMB.1.raw
  modified_base (303)..(307): a, c, t, g, unknown or other
  misc_feature (303)..(307): n is a, c, g, or t
tcagtcgcactagtcacgaccggtgctcgatttagactcatctacagcacaaacattcgctcctctggggtccctcatcgcttctctggctccattcttgggaacaaagctgccctcaccatcacggggcccaggcagaggatgaatgtgattattactgtgtgctgtatatgggtagtggcatttcgctattcggcggagggaccaagctgaccgtcctaggtcagcccaaggctgccccctggtcactctgttcccaccctcctcactagtgcgactgagcgggctggcaaggcgcatagnnnnn

SEQ ID NO: 80969 - DNA, 579 bp, Homo sapiens
  misc_feature: GYAE6OF02HUQHC.39.2.A02.1.454.CMB.1.raw
tcagtcgcactagtcacgaccggtgctcgatttagactcatctacaggggtccctgagactctcctgtgcagcctctggattcaccttcagagacttctggatgcactgggtccgccaaactccagggcaggggctggtgtgggtctcacgtattaattttgatgggagtagcacaagctacgcggactccgtgaagggccgattcaccatctccagagacaacgccaaagaacacgctgtatctgcaaaatgaacagtctgagagccgaggacacggctgtgtattactgtgcaagagatgcgccatatagcagctcgtcatactattttgactacgtgggaccgggaaccctggtcaccgtctcctcagcctccaccacgggccccatccggttccttcccctcggcctacccctcctaccgaaacgacgccaccctcgtcggggccaacgacgccggtcccgtggggcctcggcccttcgggtaccgaaacgggtccttaaccgttcccaacgttacggtcgaccggtaacgtcggacggccgggcgttcgggaccgaacggggccgacgagtacg

SEQ ID NO: 80970 - DNA, 545 bp, Homo sapiens
  misc_feature: GYAE6OF02ISQRE.39.2.A02.1.454.CMB.1.raw
  modified_base (397)..(397): a, c, t, g, unknown or other
  misc_feature (397)..(397): n is a, c, g, or t
tcagtcgcactagtcacgaccggtgctcgatttagactcatctacaggggtccctgagactctcctgtgcagcctctggattcaccttcagagacttctggatgcactgggtccgccaaactccagggcaggggctggtgtgggtctcacgtattaattttgatgggagtagcacaagctacgcggactccgtgaagggccgattcaccatctccagagacaacgccaaagaacacgctgtatctgcaaatgaacagtctgagagccgaggacacggctgtgtattactgtgcaagagatgcgcatatagcagctcgcatactattttgactacgtgggccgggaacctggtcaccgtctcctcagcctccaccaacgggccatcggtccttccccngccaccctcctccaagcgcacctcgtcggggcacgacgccggcctgggcctcggccgttggtaccaaaggtccttaacgttccacgtacggtcggccgacgttcggacgggtccgggcgttacgggccgtaacgggcgtaccagtagg

SEQ ID NO: 80971 - DNA, 617 bp, Homo sapiens
  misc_feature: GYAE6OF02F3I53.39.2.A02.1.454.CMB.1.raw
  modified_base (336)..(336): a, c, t, g, unknown or other
  misc_feature (336)..(336): n is a, c, g, or t
  modified_base (499)..(499): a, c, t, g, unknown or other
  misc_feature (499)..(499): n is a, c, g, or t
tcagtcgcactagtcacgaccggtgctcgatttagactcatctacaggggtccctgacgactctcctgttgcagcctctagggaaggttcaccgttccagagtactttctggtactcgcctactgggtccgaccaaactccagggcgagggggctgggtgtgggtctcacgtattaattttgatgggagtagcacaagctacgcggactccgtgaacgggccgattccaccatctccagagacaacgccaagaacacgctgtatctgacaaatgaacagtctgagagccgaggacacggctgtgtattacgtgtgacaaggagatcgacgcaatanagcagcttcgtacattacttagttttcaacgtttacggtcgggggaccccggggtaaccttcgggtacctacccgttcctacccgtccgacgtcccctacccgaacccgaacgggaccctacgtccgtcccttccccgtcggccctaccctccctacaacgcnccaccgtcggtcggcacgacggccgtcccgtcggctcggccgtcggtacaacggtactaccgttaccagtacgtcgccgtagcgacggccgggctcgggaccgtaggcgacgtatacg

SEQ ID NO: 80972 - DNA, 658 bp, Homo sapiens
  misc_feature: GYAE6OF02HSFOR.39.2.A02.1.454.CMB.1.raw
  modified_base (205)..(205): a, c, t, g, unknown or other
  misc_feature (205)..(205): n is a, c, g, or t
  modified_base (250)..(250): a, c, t, g, unknown or other
  misc_feature (250)..(250): n is a, c, g, or t
  modified_base (311)..(311): a, c, t, g, unknown or other
  misc_feature (311)..(311): n is a, c, g, or t
tcagtcgcactagtcacgaccggtgctcgatttagactcatctacaggggtccctgagactctcctgtgcagcctctggattcaccttcagagacttctggatgcactgggtccgccaaactccagggcaggggctggtgtgggtctcacgtattaatttgatgggagtagcacaagctacgcgactcgtgaggccatcacatcncagagacaacgccaagaacacgctagtactctgacaaatcgaacngtctagagacgccgaggacacggtctagtgtattactgtgacgaagagatcgcgaccatanagacagtctcgtactattacttattttcgaacgtacgggtcggggacccgggtaaccgtcggtacctacccgttcctacccgtcgaccgtaccctaccgaacccgtacgggcccctacgttcccggttcccttccccgacggcccctacccgtcctacccgaacgtacctccgtaacccgtcgggtagggacccacggtaccggacccggtcccggtgggtcccgttcgtaccggttacggtaccgaaacgttacccttaccgttacccgtacgttaccggtcgtaacccggtacgtacgggaccggtcgggtaccggtgggaacccgtacggggcctacgagtacg

SEQ ID NO: 80973 - DNA, 697 bp, Homo sapiens
  misc_feature: GYAE6OF02IBR4U.39.2.A02.1.454.CMB.1.raw
  modified_base (269)..(269): a, c, t, g, unknown or other
  misc_feature (269)..(269): n is a, c, g, or t
  modified_base (405)..(405): a, c, t, g, unknown or other
  misc_feature (405)..(405): n is a, c, g, or t
tcagtcgcactagtcacgaccggtgctcgatttagactcatctacgagggggaaaaggccctgaggaaagcaaacccagctgggaagcctgagaacacttagccttcatgagtgtccccaccatggcctggatgatgtcttcgtcctcggacctccttgcttagtggatcaggtgtgtattctcagactgtggtcgaccgaggaccgtcctcgttcacgtacgtcgtaccgtagggacggactagtacactacgtcacgttgtacggtnttagacgtctgtcggctacacgtcctacgtacgtaccttaacccacccgtagtcgtacgtaccgaggaccaccggtaccgacgacgtacgcctacgaccggcaccgctctacgtactactacgacaacgaaacctntccggtacctacgttccggtcggtaccctctacgttcctcgtttccgtcgtcggtcttacctacgtttcgaacggtaacaccgtcgtacccgaccctactaccgtagtacccgggaccgggtaccgacggtacgagggtaacgtaaggtagtacttagttacggtatttaacgttcggtagtaccgttgtacgtagttaagtttaggtgggttagggttcctagtttaccgtttacggttaccggttacgggtacccggttacggggtaacgaaccgggttgtaaccccggg

SEQ ID NO: 80974 - DNA, 785 bp, Homo sapiens
  misc_feature: GYAE6OF02JDOCX.39.2.A02.1.454.CMB.1.raw
  modified_base (74)..(74): a, c, t, g, unknown or other
  misc_feature (74)..(74): n is a, c, g, or t
tcagtcgcactagtcacgaccggtgctcgatttagactcatctacagggggaaagccctgaggaaagcaacccngctgggaagcctgagaacacttagccttcatgagtcgtccccacatcggcctggatgatgcttctcctcggactccttgcttatggactcgaggtagtggtattctcgaagtcttgtggtacgacccagggtacctccccgttcggtttacaccgtaggttccggtttacccgaggggcgggtaaacctggttaccacctactccgtagtttggcggttacgttgacgtcgtcgtcggtcgttcgtacgttcgttacttacgttaccttaaccctcctaacgtccgtacggtaccacgccacccggaccccgacggtaccgaccgacccgacccgaccgtaccgaccgtacgtactaccgtaccgttaccacggtaccaacgtaaactaccgtccgcttcccgtcggttaccgggtcccttacgtacgtccgttcttcttccggtccgtccgttactttacgttaccgggttaaacgtaaccgtaaacgtccgtaccgttccccgtaccgtaaccgtccggtacccgggacgggcccgaccggtaccgagggtactaacggtacggtacgttaagtaccctttagtttaacgttcctttggtacgttcgttaaccggtagttacggtagttcgggttacgttcgtccgttaacgtttcggtacggttttacgggaccgggtcgggtaaacccggttcggtaacgttcccgg

SEQ ID NO: 80975 - DNA, 541 bp, Homo sapiens
  misc_feature: GYAE6OF01C6C1F.23.12.B01.1.454.CMB.1.raw
  modified_base (290)..(290): a, c, t, g, unknown or other
  misc_feature (290)..(290): n is a, c, g, or t
  modified_base (293)..(293): a, c, t, g, unknown or other
  misc_feature (293)..(293): n is a, c, g, or t
  modified_base (308)..(308): a, c, t, g, unknown or other
  misc_feature (308)..(308): n is a, c, g, or t
  modified_base (310)..(310): a, c, t, g, unknown or other
  misc_feature (310)..(310): n is a, c, g, or t
  modified_base (313)..(313): a, c, t, g, unknown or other
  misc_feature (313)..(313): n is a, c, g, or t
  modified_base (315)..(315): a, c, t, g, unknown or other
  misc_feature (315)..(315): n is a, c, g, or t
  modified_base (317)..(317): a, c, t, g, unknown or other
  misc_feature (317)..(317): n is a, c, g, or t
  modified_base (329)..(329): a, c, t, g, unknown or other
  misc_feature (329)..(329): n is a, c, g, or t
  modified_base (331)..(331): a, c, t, g, unknown or other
  misc_feature (331)..(331): n is a, c, g, or t
  modified_base (333)..(333): a, c, t, g, unknown or other
  misc_feature (333)..(333): n is a, c, g, or t
  modified_base (335)..(335): a, c, t, g, unknown or other
  misc_feature (335)..(335): n is a, c, g, or t
  modified_base (338)..(338): a, c, t, g, unknown or other
  misc_feature (338)..(338): n is a, c, g, or t
  modified_base (342)..(343): a, c, t, g, unknown or other
  misc_feature (342)..(343): n is a, c, g, or t
  modified_base (345)..(345): a, c, t, g, unknown or other
  misc_feature (345)..(345): n is a, c, g, or t
  modified_base (347)..(348): a, c, t, g, unknown or other
  misc_feature (347)..(348): n is a, c, g, or t
  modified_base (350)..(350): a, c, t, g, unknown or other
  misc_feature (350)..(350): n is a, c, g, or t
  modified_base (352)..(352): a, c, t, g, unknown or other
  misc_feature (352)..(352): n is a, c, g, or t
  modified_base (360)..(360): a, c, t, g, unknown or other
  misc_feature (360)..(360): n is a, c, g, or t
  modified_base (368)..(368): a, c, t, g, unknown or other
  misc_feature (368)..(368): n is a, c, g, or t
  modified_base (373)..(373): a, c, t, g, unknown or other
  misc_feature (373)..(373): n is a, c, g, or t
  modified_base (377)..(377): a, c, t, g, unknown or other
  misc_feature (377)..(377): n is a, c, g, or t
  modified_base (388)..(388): a, c, t, g, unknown or other
  misc_feature (388)..(388): n is a, c, g, or t
tcagacgcgagtatcacgaccggtgctcgatttagtagtgtagattcggcgggcttccaattctgggaaccacggccgaccctgaccactcgggcggagtcgaagccgggatcgaggccggactagttactggtcaggtgtgggatagtgtcaggtggccattgggtgttcggacggtgggaccagggctgaccgtcctgacgtcagcccaaggctggccccctgggtcactctcgttccgcctcctcatactcgcgtcgtggacgcgggctggccaaggcgcaatacgntgngcagcagcagtgtgngngcngngngcgcgcgcgcgngngngngcncgcnncngnngngngtgcgcgngcgcgcgngcgcncgcncgcgacgtagngtcgcgacgacgacgacggacgacgacgcgcgacgtacgtacgtacgacgacgacgacgacgtcgacgcgtcgcgacgtacgtcggtcggacggtacggtacgaccggacgacgccgccgtcccgtaccgtaccgtacctccgttcccgtccg

SEQ ID NO: 80976 - DNA, 309 bp, Homo sapiens
  misc_feature: GYAE6OF01BT1M7.23.12.B01.1.454.CMB.1.raw
  modified_base (264)..(265): a, c, t, g, unknown or other
  misc_feature (264)..(265): n is a, c, g, or t
  modified_base (267)..(267): a, c, t, g, unknown or other
  misc_feature (267)..(267): n is a, c, g, or t
  modified_base (269)..(309): a, c, t, g, unknown or other
  misc_feature (269)..(309): n is a, c, g, or t
tcagacgcgagtatcacgaccggtgctcgatttagtagtgtagattacggcggggaacacggccaccctggaccatcggcggagtcgaagccgggatgaggccgactattactcgtcaggtgtcgggatagtgtcagtggccattgggtgttcggcggtgggacccaggctgaccgtcctgagtcagcccaaggctgccccctggtcactctgttccaccctcctcatacctcgcgtctgagcgggctggcaaggcgcaatagnncntnnnnnnnnnnnnnnnnnnnnnnnnnnnnnnnnnnnnnnnnn

SEQ ID NO: 80977 - DNA, 273 bp, Homo sapiens
  misc_feature: GYAE6OF01C7MQ4.23.12.B01.1.454.CMB.1.raw
  modified_base (273)..(273): a, c, t, g, unknown or other
  misc_feature (273)..(273): n is a, c, g, or t
tcagacgcgagtatcacgaccggtgctcgatttagtagtgtagattcgacgggctccaattctgggaacacggccaaccctgaccatcggcggagtcgaagccggggatgaggccgactattactgtcaggtgtggatagtgtcagtggccagttgggtgttcggcggtgggaccaggctgaccgtcctgagtcagcccaaggctgccccctcggtcactctcgttcccgccctcctcatactcgcgtctgagcgggctggcaggcgcatagn

SEQ ID NO: 80978 - DNA, 188 bp, Homo sapiens
  misc_feature: GYAE6OF01A5WPV.9.37.D04.1.454.CMB.1.raw
  modified_base (188)..(188): a, c, t, g, unknown or other
  misc_feature (188)..(188): n is a, c, g, or t
tcagtgatacgtctcacgaccggtgctcgatttagtagcatactgttggttggatagtggtactgatcattgggtgttcggcggagggaccaagctgaccgtcctaggtcagcccaaggctgcccctcggtcactctgttcccgccctcctcagacgtatcactgagcgggctggcaaggcgcatagn

SEQ ID NO: 80979 - DNA, 208 bp, Homo sapiens
  misc_feature: GYAE6OF01CHRXP.9.37.D04.1.454.CMB.1.raw
  modified_base (192)..(208): a, c, t, g, unknown or other
  misc_feature (192)..(208): n is a, c, g, or t
tcagtgatacgtctcacgaccggtgctcgatttagtagcatactgttgggtttgggatagtggtactgatcattgggtgttcggcggagggaccaagctgaccgtcctaggtcagcccaaggctgccccctcggtcactctgttcccgccctcctcagacgtatcactgagcgggctggcaaggcgcatagnnnnnnnnnnnnnnnnn

SEQ ID NO: 80980 - DNA, 192 bp, Homo sapiens
  misc_feature: GYAE6OF01EHOFQ.9.37.D04.1.454.CMB.1.raw
  modified_base (191)..(192): a, c, t, g, unknown or other
  misc_feature (191)..(192): n is a, c, g, or t
tcagtgatacgtctcacgaccggtgctcgatttagtagcatactgttgggtttgggatagtggtactgatcattgggtgttcggcggagggaccaagctgaccgtcctaggtcagcccaaggctgcccctcggtcactctgttcccaccctcctcagacgtatcactgagcgggctggcaaggcgcatagnn

SEQ ID NO: 80981 - DNA, 192 bp, Homo sapiens
  misc_feature: GYAE6OF01BPZB1.9.37.D04.1.454.CMB.1.raw
  modified_base (192)..(192): a, c, t, g, unknown or other
  misc_feature (192)..(192): n is a, c, g, or t
tcagtgatacgtctcacgaccggtgctcgatttagtagcatactgttgggtttgggatagtggtactgatcattgggtgttcggcggagggaccaagctgaccgtcctaggtcagcccaaggctgccccctcggtaactctgttcccgccctcctcagacgtatcactgagcgggctggcaaggcgcatagn

SEQ ID NO: 80982 - DNA, 192 bp, Homo sapiens
  misc_feature: GYAE6OF01BQ27V.9.37.D04.1.454.CMB.1.raw
  modified_base (192)..(192): a, c, t, g, unknown or other
  misc_feature (192)..(192): n is a, c, g, or t
tcagtgatacgtctcacgaccggtgctcgatttagtagcatactgttgggtttgggatagtggtactgatcattgggtgttcggcggagggaccaagctgaccgtcctaggtcagcccaaggctgccccctcggtcactctgttcccaccctcctcagacgtatcactgagcgggctggcaaggcgcatagn

SEQ ID NO: 80983 - DNA, 189 bp, Homo sapiens
  misc_feature: GYAE6OF01BH2PY.9.37.D04.1.454.CMB.1.raw
  modified_base (189)..(189): a, c, t, g, unknown or other
  misc_feature (189)..(189): n is a, c, g, or t
tcagtgatacgtctcacgaccggtgctcgatttagtagcatactgttgggttggatagtggtactgatcattgggtgttcggcggagggaccaagctgaccgtcctaggtcagcccaaggctgcccctcggtcactctgttcccgccctcctcagacgtatcactgagcgggctggcaaggcgcatagn

SEQ ID NO: 80984 - DNA, 193 bp, Homo sapiens
  misc_feature: GYAE6OF01DVCJO.9.37.D04.1.454.CMB.1.raw
  modified_base (192)..(193): a, c, t, g, unknown or other
  misc_feature (192)..(193): n is a, c, g, or t
tcagtgatacgtctcacgaccggtgctcgatttagtagcatactgttgggtttgggatagtggtactgatcattgggtgttcggcggagggaccaagctgaccgtcctaggtcagcccaaggctgccccctcggtcactctgttcccaccctcctcagacgtatcactgagcgggctggcaaggcgcatagnn

SEQ ID NO: 80985 - DNA, 192 bp, Homo sapiens; identical to SEQ ID NO: 80980
  misc_feature: GYAE6OF01CWW76.9.37.D04.1.454.CMB.1.raw
  modified_base (191)..(192): a, c, t, g, unknown or other
  misc_feature (191)..(192): n is a, c, g, or t

SEQ ID NO: 80986 - DNA, 193 bp, Homo sapiens
  misc_feature: GYAE6OF01D39HY.9.37.D04.1.454.CMB.1.raw
  modified_base (192)..(193): a, c, t, g, unknown or other
  misc_feature (192)..(193): n is a, c, g, or t
tcagtgatacgtctcacgaccggtgctcgatttagtagcatactgttgggtttgggatagtggtactgatcattgggtgttcggcggagggaccaagctgaccgtcctaggtcagcccaaggctgccccctcggtcactctgttcccgccctcctcagacgtatcactgagcgggctggcaaggcgcatagnn

SEQ ID NO: 80987 - DNA, 200 bp, Homo sapiens
  misc_feature: GYAE6OF01AZOR1.9.37.D04.1.454.CMB.1.raw
  modified_base (192)..(200): a, c, t, g, unknown or other
  misc_feature (192)..(200): n is a, c, g, or t
tcagtgatacgtctcacgaccggtgctcgatttagtagcatactgttgggtttgggatagtggtactgatcattgggtgttcggcggagggaccaagctgaccgtcctaggtcagcccaaggctgccccctcggtcactctgttcccaccctcctcagacgtatcactgagcgggctggcaaggcgcatagnnnnnnnnn

SEQ ID NO: 80988 - DNA, 212 bp, Homo sapiens
  misc_feature: GYAE6OF01C967U.9.37.D04.1.454.CMB.1.raw
  modified_base (193)..(212): a, c, t, g, unknown or other
  misc_feature (193)..(212): n is a, c, g, or t
tcagtgatacgtctcacgaccggtgctcgatttagtagcatactgttaggtttgggatagtggtactgatcattgggtgttcggcggagggaccaagctgaccgtcctaggtcacgcccaaggctgccccctcggtcactctgttcccgccctcctcagacgtatcactgagcgggctggcaaggcgcatagnnnnnnnnnnnnnnnnnnnn

SEQ ID NO: 80989 - DNA, 567 bp, Homo sapiens
  misc_feature: GYAE6OF01AD4DH.9.37.D04.1.454.CMB.1.raw
tcagtgatacgtctcacgaccggtgctcgatttagtagcatactgttgggtttgggggctctgagagaggagcccagccctgggattttcaggtgttttcatttggtgatcaggactgaacagagagaactcaccatggagtctgggctgagcgtggcgttcttacgttgtggctattttaaaaggtgtccagtgtgaggtgcatctattggagtctggggagccctggtacagccgggggggtccctgacactctcctgtacagcctctggattcacctttaacacctatgcattgagctgggtccgccaggccccaggggaaggggctgggactgggtcgcagccattaggtggcaagtggacgaaaacacatattacgcacgactccggtagaacgggccgttacacctatttccagagactaatttacaagaacacgctagtatctgcagatgaacagcctagagacgccgaggacgacggcctagtataccgacgtgtcgaccaaagcgtacgaaggaacgggtacgggttacggggtaagttaactaaagttaattaaccg

SEQ ID NO: 80990 - DNA, 560 bp, Homo sapiens
  misc_feature: GYAE6OF01C9SFY.9.37.D04.1.454.CMB.1.raw
  modified_base (362)..(362): a, c, t, g, unknown or other
  misc_feature (362)..(362): n is a, c, g, or t
  modified_base (380)..(380): a, c, t, g, unknown or other
  misc_feature (380)..(380): n is a, c, g, or t
  modified_base (432)..(432): a, c, t, g, unknown or other
  misc_feature (432)..(432): n is a, c, g, or t
  modified_base (501)..(501): a, c, t, g, unknown or other
  misc_feature (501)..(501): n is a, c, g, or t
  modified_base (504)..(504): a, c, t, g, unknown or other
  misc_feature (504)..(504): n is a, c, g, or t
  modified_base (518)..(518): a, c, t, g, unknown or other
  misc_feature (518)..(518): n is a, c, g, or t
tcagtgatacgtctcacgaccggtgctcgatttagtagcatactgttgggtttgggggctctgagagaggagcccagccctgggattttcaggtgttttcatttggtgatcaggactgaacagagagaactcaccatggagtctgggctgagctggcttcttcttgtggcttaattttaaaaggtgtccagtgtgaggtgcatctattggagtcgtgggggagccctggtacgaggccgggggggtcctgacactctcctgtacagcctctggattcacctttaacacctatgcattgagctggggtcccgccgacgggcccccgaggggaaggggctggacgtgggtcgcagccagttagnggcaagtggacgaaaacncaatatacgcagacctccggtagaacgggccggttcaccgtacttaccaganaactaatttacaagaacacgctagtatctgcagatagaacagcctagagagaccgaggacacggcgtanacncatgacgacaaganacgaagaagggtacgggttacgggattaacgaaattattaac

SEQ ID NO: 80991 - DNA, 193 bp, Homo sapiens; identical to SEQ ID NO: 80984
  misc_feature: GYAE6OF01DDRAQ.9.37.D04.1.454.CMB.1.raw
  modified_base (192)..(193): a, c, t, g, unknown or other
  misc_feature (192)..(193): n is a, c, g, or t

SEQ ID NO: 80992 - DNA, 194 bp, Homo sapiens
  misc_feature: GYAE6OF01ADQKN.9.37.D04.1.454.CMB.1.raw
  modified_base (192)..(194): a, c, t, g, unknown or other
  misc_feature (192)..(194): n is a, c, g, or t
tcagtgatacgtctcacgaccggtgctcgatttagtagcatactgttgggtttgggatagtggtactgatcattgggtgttcggcggagggaccaagctgaccgtcctaggtcagcccaaggctgccccctcggtcactctgttcccaccctcctcagacgtatcactgagcgggctggcaaggcgcatagnnn

SEQ ID NO: 80993 - DNA, 192 bp, Homo sapiens
  misc_feature: GYAE6OF01DVWFH.9.37.D04.1.454.CMB.1.raw
  modified_base (192)..(192): a, c, t, g, unknown or other
  misc_feature (192)..(192): n is a, c, g, or t
tcagtgatacgtctcacgaccggtgctcgatttagtagcatactgttgggtttgggatagtggtactgatcattgggtgttcggcggagggaccaagctgaccgtcctaggtcagcccaaggctgccccctcggtcactctgttcccgccctcctcagacgtatcactgagcgggctggcaaggcgcatagn

SEQ ID NO: 80994 - DNA, 194 bp, Homo sapiens; identical to SEQ ID NO: 80992
  misc_feature: GYAE6OF01B1Y6F.9.37.D04.1.454.CMB.1.raw
  modified_base (192)..(194): a, c, t, g, unknown or other
  misc_feature (192)..(194): n is a, c, g, or t

SEQ ID NO: 80995 - DNA, 587 bp, Homo sapiens
  misc_feature: GYAE6OF01APL8P.9.37.D04.1.454.CMB.1.raw
  modified_base (397)..(397): a, c, t, g, unknown or other
  misc_feature (397)..(397): n is a, c, g, or t
  modified_base (519)..(519): a, c, t, g, unknown or other
  misc_feature (519)..(519): n is a, c, g, or t
  modified_base (536)..(536): a, c, t, g, unknown or other
  misc_feature (536)..(536): n is a, c, g, or t
tcagtgatacgtctcacgaccggtgctcgatttagtagcatactgttgggtttgggtgtacacctgtggttctcggggctgccctttggctttggagatggttttctcgatgggggctgggagggctttgttggagaccttgcacttgtactccttgccattcagccagccctggtacagccggggggtccctgacactctcctgtacagcctctggattcacctttaacacctatgcattgagctgggtccgccaggccccgagggaaggggctggactgggtcgcagccattagtggcaagtggacgaaaacacatattacgcagactccgtgaagggccgttcaccatttccagagactaatttcaagaacacgctagtatctgcagatgaacngcctagagacgcgagacacggcgtatatacactgtcgaccaaagatacgaaggaaggtacgggttacgggaattaacaaattacttaactacttactaactagtacggaatggaacgtcggnggggccgaggggacccncgggttaccacccgttctacccgtacgaccgccctccgaaccgtaaccggg

SEQ ID NO: 80996 - DNA, 193 bp, Homo sapiens; identical to SEQ ID NO: 80984
  misc_feature: GYAE6OF01EVQYP.9.37.D04.1.454.CMB.1.raw
  modified_base (192)..(193): a, c, t, g, unknown or other
  misc_feature (192)..(193): n is a, c, g, or t

SEQ ID NO: 80997 - DNA, 801 bp, Homo sapiens
  misc_feature: GYAE6OF01D7C9U.9.37.D04.1.454.CMB.1.raw
  modified_base (180)..(180): a, c, t, g, unknown or other
  misc_feature (180)..(180): n is a, c, g, or t
  modified_base (218)..(218): a, c, t, g, unknown or other
  misc_feature (218)..(218): n is a, c, g, or t
tcagtgatacgtctcacgaccggtgctcgatttagtagcatactgttgggtttggggctctgagagaggagcccagccctgggattttcaggtgttttcatttggtgatcaggactgaacagagagaactcaccatggagtctgggctgagcggtgcgtctacgtgtcgatagttaaggntcagtgtgagtgcatctaattggagtcgtgggggaacncccgttggtaaccgaggtcccgggggggtcccctaggaccgtacctccgttacccttggtaccgacgtcccgttccttagggacttccaaccctttttaaacaacccttagttggtccgaaatttaggacgcgtttcgggtcccggacccgaccggccccggaacccggggtaaagggacccggttagggacccggttggggtcggtacccgtacgggtccccaacgttaaacggtttcgggtacgtaaacgtagggggaacgtaaaaacccgtaaaaacgtaacgttaacgtaacgtaacgtacgtacgtacggtacggtacgggtaccggtaccgtaccgtacttacgtaacgtaacgtaacgtaacgttaacgtaaacgtaaccgtaaccgtacgtacgttacgtacgtacgtacgtacgtaacgtacgtaacgtacgtacgtacgtacggtacggaccggaacggaaccgacgtaccgtacgtacgtaccgtacgtacgtacgtaacgaacgtaacgtaacgtaacggtaacgggtaacgggtacgggtaacgttaacgttaaacgttaacgttaaccg

SEQ ID NO: 80998 - DNA, 574 bp, Homo sapiens
  misc_feature: GYAE6OF01DWI0I.9.37.D04.1.454.CMB.1.raw
  modified_base (386)..(386): a, c, t, g, unknown or other
  misc_feature (386)..(386): n is a, c, g, or t
tcagtgatacgtctcacgaccggtgctcgatttagtagcatactgttgggtttgggggctctgagagaggagcccagccctgggattttcaggtgttttcatttggtgatcaggactgaacagagagaactcaccatggagtctgggctgagcgtggcttcttcgttgtggcttaattttaaaaggtgtccagtgtgaggtgcatctattggagtcgtggggggagccctggtaccaggcccgggggggtccctggaccactctcctgtacagcctctggattcacctttaacacctatgcattgagctggggtcccgccgacggccccgaggggaacggggctgggacctggggtcgcagccattagtggcaatggacgaaaacncatactacgcagactccgtagaacggggccggttcacctatttccagagacaatttcaaagaacacgctgtatctgcagatagaacagcctgagagcgagacgacggaccgtatactcacgtgtacgaccaaagactacgaggaagggtacgggttacggggaagtttaacgaaagttagttaaaccg

SEQ ID NO: 80999 - DNA, 193 bp, Homo sapiens; identical to SEQ ID NO: 80984
  misc_feature: GYAE6OF01AM5MF.9.37.D04.1.454.CMB.1.raw
  modified_base (192)..(193): a, c, t, g, unknown or other
  misc_feature (192)..(193): n is a, c, g, or t

SEQ ID NO: 81000 - DNA, 214 bp, Homo sapiens
  misc_feature: GYAE6OF01EAV1W.9.37.D04.1.454.CMB.1.raw
  modified_base (194)..(214): a, c, t, g, unknown or other
  misc_feature (194)..(214): n is a, c, g, or t
tcagtgatacgtctcacgaccggtgctcgatttagtagcatactggttgggtttgggatagtggtactgatcagttgggtgttcggcggagggaccaagctgaccgtcctaggtcagccctaaggctgccccctggtcactctgttcccaccctcctcagacgtatcactgagcgggctggcaaggcgcatagnnnnnnnnnnnnnnnnnnnnn

SEQ ID NO: 81001 - DNA, 192 bp, Homo sapiens
  misc_feature: GYAE6OF01DCB1C.9.37.D04.1.454.CMB.1.raw
  modified_base (192)..(192): a, c, t, g, unknown or other
  misc_feature (192)..(192): n is a, c, g, or t
tcagtgatacgtctcacgaccggtgctcgatttagtagcatactgttgggtttgggatagtggtactgatcattgggtgttcggcggagggaccaagctgaccgtcctaggtcagcccaaggctgccccctcggtcactctgttcccgctctcctcagacgtatcactgagcgggctggcaaggcgcatagn

SEQ ID NO: 81002 - DNA, 728 bp, Homo sapiens
  misc_feature: GYAE6OF01DT7SA.9.37.D04.1.454.CMB.1.raw
  modified_base (285)..(285): a, c, t, g, unknown or other
  misc_feature (285)..(285): n is a, c, g, or t
  modified_base (390)..(390): a, c, t, g, unknown or other
  misc_feature (390)..(390): n is a, c, g, or t
  modified_base (558)..(558): a, c, t, g, unknown or other
  misc_feature (558)..(558): n is a, c, g, or t
tcagtgatacgtctcacgaccggtgctcgatttagtagcatactgttgggtttgggggctctgagagaggagcccagccctgggattttcaggtgttttcatttggtgatcaggactgaacagagagaactcaccatggagtcgtgggctgagcgtggtcttcttcgttgtggtacttaagttttaaaaggtgtccagtgtgaggtgcatctagttggagtcgtgggggacgcccgtgggtacgagggcccgggggggtccctgaccactctcctgtacagcctntggtacttcctaacctttaaccacctatgctattggagcgtcgggtcccgccgacggccccggaggggacgggcgtgggacgtgggtcgcgacgcctagttaggnggacgtaagtcgggaaacgaaaaacactaattaacgttaccgacaacggtaccgttaccggtacgggaaacggggtcccggttaccaacccgtactttaccgaagaacgtaacttaaatttaccgaaacgaactaacgctagttactccgtagacgagaatacgaacncggtacctaggaacgacggaccggaggaaccgacccggtacgtaatacgtaccgaacgttacggtaccgaaaccgaaaggtaacgtaccgggaaaagggtaaccggggttaaccgggggtttaacggggtaaaactttaaaccggttaaaagtttaccgtttaaaacccg

SEQ ID NO: 81003 - DNA, 760 bp, Homo sapiens
  misc_feature: GYAE6OF01DLQNG.9.37.D04.1.454.CMB.1.raw
  modified_base (257)..(257): a, c, t, g, unknown or other
  misc_feature (257)..(257): n is a, c, g, or t
tcagtgatacgtctcacgaccggtgctcgatttagtagcatactgttgggtttgggggctctgagagaggagcccagccctgggattttcaggtgttttcatttggtgatcaggactgaacagagagaactcaccatggagtctgggctgagcgtggcgttcttacgttgtggcttaagttttaaaaggtgtccagtgtgaggtgcatctattggagtcgtgggggagcccgtggtacgaggcccgggggggtcccngaccactctcctgtacagcctctggtattaccacctttaacacctatgcattgagcgtggggtccgaccgacggccccgagggggaaggggcctgggacgtggggtcgcacggcctagttaggtcggcaagtgggaaccgaaaaacacaaatacttacggacagtaactccggtagggaaacggggtcccgggtttcaacccttaactttcccgaagtacgtaacctaaattttaccgaaaacgtaaaccgaaccgtccttaggtaacttacgtacgaccgtaaggaactacggaaacacggacccggttaaggaacgggtaccggacccgggtaaggaacccgtacccggggtaacccgtaagttaacgtccgtaacgttacggttacgggaaaccctaaaaggtaacgttaaccggaagggttaaaacgggggtacccggggggtttaaacggggggtaaacgttttaaaaccgtaaaaaggttttaactttaaaaccccg

SEQ ID NO: 81004 - DNA, 782 bp, Homo sapiens
  misc_feature: GYAE6OF01AVN6G.9.37.D04.1.454.CMB.1.raw
  modified_base (156)..(156): a, c, t, g, unknown or other
  misc_feature (156)..(156): n is a, c, g, or t
  modified_base (179)..(179): a, c, t, g, unknown or other
  misc_feature (179)..(179): n is a, c, g, or t
  modified_base (216)..(216): a, c, t, g, unknown or other
  misc_feature (216)..(216): n is a, c, g, or t
  modified_base (276)..(276): a, c, t, g, unknown or other
  misc_feature (276)..(276): n is a, c, g, or t
tcagtgatacgtctcacgaccggtgctcgatttagtagcatactgttgggtttgggggctctgagagaggagcccagccctgggattttcaggtgttttcatttggtgatcaggactgaacagagagaactcaccatggagtctgggctgagcggngtgtctagtcgcgatagttaagngtcagtgtgagtgcatctattggacgtcgtggggacncccgttggtaaccgagggcccggggggtaccctggaacctacgtcctaccgttgtaaccncggccctcgtaggtaacttccaaccttttaacacctaagtcgactattggacgcgttcgggtacccacgaccgggccccgtaagggggaacggggttcctaagggaccgttgggtacggctaacggcccttaagtttacggtgggaaacctaaagtcggggaaaccgtaaaaaccgacgtaaatttaaccttaaccggacaacggtaacccgttccggtaagggaaaccgggtcccggtttaccgaaccgtacgttttacccaggtaacgtactaaaacttttaccgaaaacgggtaactacccgaacttcggttaaatttacccgggtacgaccgtaacgtaacgtaaccgtaacgtaaccgtaccgtacggaacggacggaccggaacggaaccggaccggtacgtactactacgtacgtacgtacgtaacgaacgtacgtacggtaacggtaacgggtaacgggttaacgggttaacgttaaacgttaacgttaacgttaacg

SEQ ID NO: 81005 - DNA, 777 bp, Homo sapiens
  misc_feature: GYAE6OF01EJPYL.9.37.D04.1.454.CMB.1.raw
tcagtgatacgtctcacgaccggtgctcgatttagtagcatactgttgggtttgggggctctgagagaggagcccagccctgggattttcaggtgttttcatttggtgatcaggactgaacagagagaactcaccatgggagtctgggctggagcgtcggcgttcttcgttgtggacttaagttttaaaaggtcgtccagtgtgaggtgcatctagttggacgtcgtgggggacgcccgtaggtacgacgggcccgggggggttccctggaccactaccgttcctagtacgacgtccttcgtaggtactttccctaaaccgttttaaccacccgttagtcgtacctaactttggaccggtccgttcgggggtccccgtaacccgaaccgggggaccccccggaaggggggaacggggtccttacggggtccgttcggggtcccgaccgtacggacccgtaaggtttaacggcggaccgtaagtacgggaaacccaaaaacacgtaaaggttaccttaccggacgaacggtaccttacccggggtaaggtaaccggggtccccgttactaacccgtaagtttacccgaagtaacgtaaccttaaacgttacgaaacgtaacgtacgtacgtagtactcgtcgacgtagactagaactacgaccgagacgaccggcgaacggaccgacggtccgtaatagtcctagttcgacgaccaaaggtctaaccgaagggaaaccggtcgggtaagggtaagttaacgtaaacttacgttaaacc

SEQ ID NO: 81006 - DNA, 737 bp, Homo sapiens
  misc_feature: GYAE6OF01BO3FC.9.37.D04.1.454.CMB.1.raw
  modified_base (291)..(291): a, c, t, g, unknown or other
  misc_feature (291)..(291): n is a, c, g, or t
tcagtgatacgtctcacgaccggtgctcgatttagtagcatactgttgggtttggggctctgagagaggagcccagccctgggattttcaggtgttttcatttggtgatcaggactgaacagagagaactcaccatggagtcgtgggctgagcgtcgcgtctacgtgtgactagtttaaaggtgtcagtgtgaggtgcatctattggagtcgtcggggacgcccgtggtacgacggccggggggtcctcgacactctcctgtacacggctcgtcgacttctacctttaacnccttatgacgtattggagtcggttcgggcccgaccgtaacggccccggagggaacgggctcgggtacgtcgggtcgcgacgacctagttaaggtggacgtaaaggtcggaaacgtaaaaccgagtaacttaaacgttaccggaaccgacggaccggttacccggtaggtaaaccggggtccccgtttacggaacccttaacgtttcccgaagggtaccgtaaacgttaacctttaacgaaacgtacaacggttctaggtacctgtagaccgagacgtacgaacgagcccgaggaccgaggccgaaagggacttacccgggattaacgtacgttaccgtaccgtaggtaccgtaacccaaaggttccgaaggaaaccccggggttaaggggtaacccggggttaacggggttaaacgttaaacttaaaacggttcttttaaaccccg

SEQ ID NO: 81007 - DNA, 207 bp, Homo sapiens
  misc_feature: GYAE6OF01EQQ2E.9.37.D04.1.454.CMB.1.raw
  modified_base (192)..(207): a, c, t, g, unknown or other
  misc_feature (192)..(207): n is a, c, g, or t
tcagtgatacgtctcacgaccggtgctcgatttagtagcatactgttgggtttggggatagtggtactgatcattgggtgttcggcggagggaccaagctgaccgtcctaggtcagcccaaggctgccccctggtcactctgttcccgccctctcagacgtatcactgagtcgggctggcaaggcgcatagnnnnnnnnnnnnnnnn

SEQ ID NO: 81008 - DNA, 549 bp, Homo sapiens
  misc_feature: GYAE6OF01EJWUN.9.37.D04.1.454.CMB.1.raw
  modified_base (220)..(220): a, c, t, g, unknown or other
  misc_feature (220)..(220): n is a, c, g, or t
  modified_base (452)..(452): a, c, t, g, unknown or other
  misc_feature (452)..(452): n is a, c, g, or t
tcagtgatacgtctcacgaccggtgctcgatttagtagcatactgttgggtttgggggctctgagagaggagcccagccctgggattttcaggtgttttcatttggtgatcaggactgaacagagagaactcaccatggagtctgggctgagctggcttcttcttgtggctattttaaaaggtgtccagtgtgaggtgcatctattggagtctggggganccctggtacaggccgggggggtccctggacactctcctgtacagcctctggattcacctttaacacctatgcattgagctggggtcccgccagggcccccgaaggggaacgggcgtggactggggtcgcagccattagtggcaagtggacgaaaacacatatacgcagactcgtgaagggccgttacacattccagagacattacaagacacgctgtatctgcagatgaacncgcctagagagccgaggacgacggccgtatatcactgtcgaccaaagactacgaagaacgggacgggttacgggagtttaacgaaatacgttaaacc

SEQ ID NO: 81009 - DNA, 194 bp, Homo sapiens; identical to SEQ ID NO: 80992
  misc_feature: GYAE6OF01BP25T.9.37.D04.1.454.CMB.1.raw
  modified_base (192)..(194): a, c, t, g, unknown or other
  misc_feature (192)..(194): n is a, c, g, or t

SEQ ID NO: 81010 - DNA, 725 bp, Homo sapiens
  misc_feature: GYAE6OF01A0IFA.9.37.D04.1.454.CMB.1.raw
tcagtgatacgtctcacgaccggtgctcgatttagtagcatactgttgggtttgggggctctgagagaggagcccagccctgggattttcaggttgttttcatttggtgatcaggactgaacagagagaactcaccatggagtctgggctgagctggtcttcttcttgtggtcttaattttaaaaggtgtccagtgtgaggtgcatctagttggagtcgtggggacgcccgtggtacgacgggcccggggggtccctgactacctcctcctgtacacgcctcgtggtacttcctaacctttaacacctatcgactagttggacgtcgtcgggtcccgccgaccgggccccggaaggggacgggcgtcggacgtgggtccgcgacgacctagttaggtcggacaagtcggaacgaaaacactaattaacgtaaccgcaacgtaccgttccggtaggaaccggggtcccgttacgtaccgtacttaccgtaacgtaacgtaactaacttaacgaacgaaccgacgtacgtacgttactacgtcgtacgaagtatacgaacgacgacgtacggacggaacggaccggaacggaaccggaccggtaccgtaacgtacgtaccgtacgtacgtaccgaaccgtttttttaaacgaacgtaacggaacgggtaaacgggttaacggggttaacgggttaacggttaaacgttaaacgttaaacgttaaccg

SEQ ID NO: 81011 - DNA, 682 bp, Homo sapiens
  misc_feature: GYAE6OF01BNDK0.9.37.D04.1.454.CMB.1.raw
  modified_base (207)..(207): a, c, t, g, unknown or other
  misc_feature (207)..(207): n is a, c, g, or t
  modified_base (229)..(229): a, c, t, g, unknown or other
  misc_feature (229)..(229): n is a, c, g, or t
  modified_base (397)..(397): a, c, t, g, unknown or other
  misc_feature (397)..(397): n is a, c, g, or t
tcagtgatacgtctcacgaccggtgctcgatttagtagcatactgttgggtttgggggctctgagagaggagcccagccctgggattttcaggtgttttcatttggtgatcaggactgaacagagagaactcaccatggagtctgggctgagcgtgtcgtctacgtgtcgactaagtttaaagtgtcagtgtgagtgcatctatggngtcgtggggcgccgtggtacgnggccgggggtcctcgactctctctacgtacacgtcctgtggtacttactaacctttaacaccgttatgctagttagcgcgtcgggtccgaccgacgggccccggaggggaacgggtcgtgggaacggttgggtccgcgaacggtcctagtttacggtcggacgtaagnggaaaccgaaaaccacaagttaacgttaccggacgaacgtaaccgttccggaggtaaaccgggtccgggttacctaccgtaactttaccgaacgtaacggtaacttaaacgtttacgtaaaaccggaaatacccggtacgttagttaacggtccttagaccgaaggtaactacgaacgacgtaccgtagacgacggacgagacgacgcgtatacgctacgtagaccgagaaacgagcgtaaaggtacgggtaccggttaggtaattaactaagttaccttaaacg

SEQ ID NO: 81012 - DNA, 670 bp, Homo sapiens
  misc_feature: GYAE6OF01E3FZX.9.37.D04.1.454.CMB.1.raw
  modified_base (196)..(196): a, c, t, g, unknown or other
  misc_feature (196)..(196): n is a, c, g, or t
  modified_base (200)..(200): a, c, t, g, unknown or other
  misc_feature (200)..(200): n is a, c, g, or t
  modified_base (305)..(305): a, c, t, g, unknown or other
  misc_feature (305)..(305): n is a, c, g, or t
  modified_base (529)..(529): a, c, t, g, unknown or other
  misc_feature (529)..(529): n is a, c, g, or t
tcagtgatacgtctcacgaccggtgctcgatttagtagcatactgttgggtttgggggctctgagagaggagcccagccctgggatttttcaggttgttttcatttggtgatcaggactgaacagagagaactcaccatggagtcgtgggctgagcgtgtcgtctagtgtgactaagttaagtgtcagtgtgagtncatntagtggacgtcgtaggggacgccgttggtacgacgggcccggggggtcctacgacacctctccgtctacgctcctcgtagtcttacctaacttaacacctagtcnctagttggacgtcgtccggtccgacgccgggacccggaggggacgggcgttcggacggttcggcgacgtacgtaccgtagtagtcggaccgtaagtaacgggaaacaaaacgtactaagtaccttacggaccttcgaacgtccggaggttaccgtcccgggtacaccgtacgttaccgacgtaactacgttaactaacgaacaactcgtactgccttaatcganacgctaacgtacgcgtacgacggagacgtaccgacgggaccgtacggacctagtactaccgtactaggctaacgggaaacttcgaagggtaaacggaggggtaaccggttaccggtaaataaaccggttatcgtttaaacc

SEQ ID NO: 81013 - DNA, 847 bp, Homo sapiens
  misc_feature: GYAE6OF01C5ZCR.9.37.D04.1.454.CMB.1.raw
  modified_base (237)..(237): a, c, t, g, unknown or other
  misc_feature (237)..(237): n is a, c, g, or t
tcagtgatacgtctcacgaccggtgctcgatttagtagcatactgttgggtttgggggctctgagagaggagcccagccctgggattttcaggttgttttcatttggtgatcaggactgaacagagagaactcacatggagtctgggctgagctggtctttcttcgttgtggtacttaagtttttaaaaggtgtaccagtggtggaggtgcattctagttggagtcggtgggggacncccgtaggtacgacgggccgggggggtccctggaccacttcctccgtagtaccacgtcccttcgtaggtacttacctaaccttttaaacaccttaatcgactagtttggacgtccggtcgggtccccgaccgaccgggccccggagggggaacggggcgtcgggacggtgggtccgacgacggcctaagttacggtgggaacctaaggtacgggaacccgtaaaacgtactaacgtttaacgttaccgacgtaacggtacccgttacgggtaacggggtaaccggggttacccgggttacctaacccgttacgttaccgtaaacggacgtaaactaagtttaaccgaaacggtaacccacgtaccggttatacgtaccgtagacgtaacgagtaacgaacgtaccggtaccgtaggaaccggtaacgggaccggaacgggtaacccggtaaccgggtaccgttaacttaacgtaccccgtaacggttccggtaaaccgtaacccggtaaaggtaccggttaaacgggaacggggttaaaaccggggttacccgggggttaaacggggttaaaacggtttaaccttaaaaggtttaaccttttaaacccgg

SEQ ID NO: 81014 - DNA, 617 bp, Homo sapiens
  misc_feature: GYAE6OF01COUAC.9.37.D04.1.454.CMB.1.raw
  modified_base (395)..(395): a, c, t, g, unknown or other
  misc_feature (395)..(395): n is a, c, g, or t
tcagtgatacgtctcacgaccggtgctcgatttagtagcatactgttgggtttgggggctctgagagaggagcccagccctgggattttcaggttgttttcatttggtgatcaggactgaacagagagaactcaccatggagtctgggctgagctggcttcttcttgtggcttaattttaaaggtgtccagtgtgaggtgcatctattggagtcgtgggggacgcccgtggtacgacgggccgggggggtccctgacactctcctgtacagcctctggattcacctttaacacctatgctattgagtcgtcggggtcccgccgacggccccgaaggggaacggggccgtagggacgtgggtcgcagcctagttagtggcaagtcggacgaaaacnatactacgacagacctcggtgaacgggtccgtcactattccagacgactaatttacgaagaacacgctacgtatcgtagacagatacgaacgacgcctaggacgacggacccggaaggaccgacgggtaccgttatacgtccacgtcgtacgaccgaaaggctacggaaggtaacggggtacgggttacgggaacgtttaactaaagttaacgtttaacccg

SEQ ID NO: 81015 - DNA, 854 bp, Homo sapiens
  misc_feature: GYAE6OF01ACE8F.9.37.D04.1.454.CMB.1.raw
  modified_base (237)..(237): a, c, t, g, unknown or other
  misc_feature (237)..(237): n is a, c, g, or t
  modified_base (267)..(267): a, c, t, g, unknown or other
  misc_feature (267)..(267): n is a, c, g, or t
  modified_base (322)..(322): a, c, t, g, unknown or other
  misc_feature (322)..(322): n is a, c, g, or t
tcagtgatacgtctcacgaccggtgctcgatttagtagcatactgttgggtttgggggctctgagagaggagcccagccctgggtattttcaggttgttttcatttggtgatcaggactgaacagagagaactcacagtggagtcgtgggctgagcgtggtcttcttcgttgtgtacttaagttttaaaggtcgtccagtgtggaggtgctatctagttcggagtcggtgggggacnccgtggtacggacgggtcccggggggtccngacctactctcctgtacacgctcgtgtaccttacctaaccttaacacctagtacnctagttgacgtcggtaccgggccgaccggaccgggaccccggaaggggggtaccggggtccgtacgggtaccggttcgggacccgaccggtaccgtaccgttaaggttacgggtacggtaacgtaaaccgggtacgggaaaaccgtaaaacgtacttaaacgttaacggtaccgaacgtacgtacccggttaccggtagggtaacccgggtacccgttaacctaaccgttacgttacccgaaggtaaccaacgttaaacttaaaccggaaaccgtaacgtaaccggtacgttagtaaccgttagtaccggtaagaaacggtacgtaaccgtaacggccggtaacggtaccggaaacgggtacccgggacggtaaacccgggtaccccggaacgggttaaccttaacggtacccgttaccggtacggtacgggtaaaccccgaaaggtaacggttacgaaacggggttaaccggggtaacgggttaacggggttaaccggtaacgtttaaacttaacggttacttaaacccgg

SEQ ID NO: 81016 - DNA, 646 bp, Homo sapiens
  misc_feature: GYAE6OF01EOVMR.9.37.D04.1.454.CMB.1.raw
  modified_base (306)..(306): a, c, t, g, unknown or other
  misc_feature (306)..(306): n is a, c, g, or t
  modified_base (326)..(326): a, c, t, g, unknown or other
  misc_feature (326)..(326): n is a, c, g, or t
  modified_base (346)..(346): a, c, t, g, unknown or other
  misc_feature (346)..(346): n is a, c, g, or t
  modified_base (422)..(422): a, c, t, g, unknown or other
  misc_feature (422)..(422): n is a, c, g, or t
  modified_base (453)..(453): a, c, t, g, unknown or other
  misc_feature (453)..(453): n is a, c, g, or t
  modified_base (505)..(505): a, c, t, g, unknown or other
  misc_feature (505)..(505): n is a, c, g, or t
tcagtgatacgtctcacgaccggtgctcgatttagtagcatactgttgggtttgggtgtacacctgtggttctcggggctgccctttggctttggagatggtttttctcgatgggggctgggagggcttttgttggagaccttgcacttgtactccttgccattcagccagccctggtacagccgggggggtccctgacactctcctgtacagcctctggattcaccttttaacacctatgcattgagctcgggtcccgccagggccccgaggggaaggggctggactgggtcgcgagccattagnggacaagtggacgaaaaacncaatatacgcacgactccgnggaacgggccggttcacctattccagaagactaatttacaaagaaccacgtctagtatcgtgacaagatacgaacncgacgtagagacgaccgaggaccacggctanatcactgacacgaagatacgaaggtaacgggtagggttacgggaactttaanaaacttacgttaacttacttaactacgtagtaggtaactgggtacggtcggacgggggtccggaacgggtacccgacggttacccgtacccgtaccgttcccgtacgtaacccgccccgtacccgacccggtaaacccggg

SEQ ID NO: 81017 - DNA, 195 bp, Homo sapiens
  misc_feature: GYAE6OF01ERO6H.9.37.D04.1.454.CMB.1.raw
  modified_base (193)..(195): a, c, t, g, unknown or other
  misc_feature (193)..(195): n is a, c, g, or t
tcagtgatacgtctcacgaccggtgctcgatttagtagcatactgttgggtttgggatagtggtactgatcattgggtgttcggcggagggaccaagctgaccgtcctaggtcagcccaaggctgccccctcggtcactctgttcccgccctcctcagacgtatcactgagcgggctggcaaaggcgcatagnnn

SEQ ID NO: 81018 - DNA, 195 bp, Homo sapiens
  misc_feature: GYAE6OF01DU54J.9.37.D04.1.454.CMB.1.raw
  modified_base (192)..(195): a, c, t, g, unknown or other
  misc_feature (192)..(195): n is a, c, g, or t
tcagtgatacgtctcacgaccggtgctcgatttagtagcatactgttgggtttgggatagtggtactgatcattgggtgttcggcggagggaccaagctgaccgtcctaggtcagcccaaggctgccccctggtcactctcgttcccaccctcctcagacgtatcactgagcgggctggcaaggcgcatagnnnn

SEQ ID NO: 81019 - DNA, 927 bp, Homo sapiens
  misc_feature: GYAE6OF01CLC7U.9.37.D04.1.454.CMB.1.raw
  modified_base (230)..(230): a, c, t, g, unknown or other
  misc_feature (230)..(230): n is a, c, g, or t
  modified_base (242)..(242): a, c, t, g, unknown or other
  misc_feature (242)..(242): n is a, c, g, or t
tcagtgatacgtctcacgaccggtgctcgatttagtagcatactgttgggtttgggggctctgagagaggagcccagccctgggattttcaggtgttttcatttggtgatcaggactgaacagagagaactcaccatggagtcgtgggctgagcgtggtcttcttcttgtggtacttaagttttaaaaggtcgtccagtgtgaggtgcatctagtggagtcgtggggacncccgtggtacgngggcccggggggtcctgaccacttctccgtgtacgacgtcctcgtggtacttccgtaacctttaaccgacctagtcgactaagtttcggaggtccgtcgggggtacccaccgaccgggaccccggaagggggacggggtccgttacggggaccggttcggggtacccggaccgtacggacccgttaaggtttacgggtacggaaccctaaagggttaccgggaaacccgtaaaaaaccgtaccgttaaagtttaaaccgttaacccggacgtaaccgggtaaccgtttaccccgggtaacggggtaaacccgggggttccccggtttaaccctaacccgtttaaccgtttacccgaaaggtaacgtaaaccgttaaacgtttaacgaaaacgtaaccgtacgtaccgttagtaaccttcgtacggacgtaacgtagtaaccgtaacgaacggtacccgtaagggaacggtaaccggtacccgggtaaacgggaaccccgggtaaccgttaccggttaaccgtttaaacgtcccggttaaccgttacggggtaaaccgaaaaccccggtaaaacggtacggtaacccgggtaaaaacggggttaaccggggttaaaccccggggggtttaaacgggtaaaccggtttaaaaccgttaaaagttttaacccggtttttaaaaccccg

SEQ ID NO: 81020 - DNA, 730 bp, Homo sapiens
  misc_feature: GYAE6OF01C5H1E.9.37.D04.1.454.CMB.1.raw
tcagtgatacgtctcacgaccggtgctcgatttagtagcatactgttgggtttggggagctctgagagaggagcccagcccgtgggattttcaggtgttttcatttggtgatcaggactgaacagagagaactcaccatggagtctgggctgagctggcttcttcttgtggcttaatttaaaggtgtcagtgtgaggtgcatctagtggagtcgtgggggagccgtggtacgaggccgggggggtcctagacactctcctcgtacacgcctctggacttacctaaccgtttaaccacctatcgactagttgacgtcgtcgggtccgaccgacggccccgaaggggacggggcgtagggaccgttgggtccgcgagcctagttacggcggtacaagtaggaaccgaaaacacgtaataacttacgactaagaccgtacggtaggaacgggtcccgttacaacccgtgttaaccgaaggaactaacgttaaatttacgaaaagtaccgacgtacgttgaattccgtgaccgaagatacgaacgacggtccgtaggacgggacgacccggaacggtaccgaacccggggtacccttaagtacccgtacgtaaccgttacggtaacccgaacccgtaaaaggtaacccgttaacggaaacggggttaaaccgggggttaacccggggtttacgggggtaaaacccttaaaccgttaaaacggttttaaaacccg

SEQ ID NO: 81021 - DNA, 808 bp, Homo sapiens
  misc_feature: GYAE6OF01BST1J.9.37.D04.1.454.CMB.1.raw
  modified_base (221)..(221): a, c, t, g, unknown or other
  misc_feature (221)..(221): n is a, c, g, or t
  modified_base (267)..(267): a, c, t, g, unknown or other
  misc_feature (267)..(267): n is a, c, g, or t
  modified_base (592)..(592): a, c, t, g, unknown or other
  misc_feature (592)..(592): n is a, c, g, or t
tcagtgatacgtctcacgaccggtgctcgatttagtagcatactgttgggtttgggggctctgagagaggagcccagccctgggattttcaggttgttttcatttggtgatcaggactgaacagagagaactcaccatggagtctgggctgagcgtgtcttctacgtgtgtattaagtttaaaggtgtcagtgtgaggtgcatctattggagtgtggggancccgtggtacgaggtcccggggggtcctggacctctctctcgtacncgcctctcggtacttacctaacctttaaaccaccttatgtacctaagttcggacgtcggttccggggcccggacccggtaacccgggcccccgggtaagggggaacgggggtccgtcggggtacggtcgggggtcccgacgtaacgtcccttagttaaggcggtaaccgaggtaaccggaaaccgaaaaacctagtaaacgttaacttaccggaacgaaccggtaccggttaccggtaacgggtaaaccggggtcccgtttaaccgaaccgtttaactttacccgaaggaaccgttaaacttaaagttaaccgaaacgtaaaccncggttaccttagtaaactcgtcgaaccgtaagtaacgtaacgaccggtaactcccggtaggaacggtaacccgggaccggaaacggttaaccgaaccggtcttaaacggtaccttcggtaaccggtcgtaacgaacccggaaagtaccgtaacgaaggggtaaccgggttacgggggtaacggttaaaacgtaaacttaaagttaccctttaaccg

SEQ ID NO: 81022 - DNA, 918 bp, Homo sapiens
  misc_feature: GYAE6OF01DS1GL.9.37.D04.1.454.CMB.1.raw
  modified_base (203)..(203): a, c, t, g, unknown or other
  misc_feature (203)..(203): n is a, c, g, or t
  modified_base (253)..(253): a, c, t, g, unknown or other
  misc_feature (253)..(253): n is a, c, g, or t
  modified_base (360)..(360): a, c, t, g, unknown or other
  misc_feature (360)..(360): n is a, c, g, or t
tcagtgatacgtctcacgaccggtgctcgatttagtagcatactgttgggtttgggtgtacacctgtggttctcggggctgccctttggctttggagattggttttctcgagtgggggctggggagggtctttgttggagaccttgcacttgtactccttgccattcagccagccctggtacgacggccggggggtcctgacnctctcctgtacagtcctctggattcaacctttaacacctatgacattagngctcgggtcccgccgacggccccgtaaggggacggggcgtggacgtcgggtacgcgacgacctaagtttaggcggacctaaaggtacgggaaccgaaaaacccgtanaaatttaacgttaaccggaccgaacgtaccgttacccgggtagggtaaaccgggggtccccggtttaccaaccgttaacttttacccgaaaggtaaccgtaaacctaaacgttttaaccgaaacggtaaacctaaaccggtcgttaacggtttaacttccgtacggaacgtaacgtaacgttacggtaaaacccgacggtacccgtagggaaacgaccgggacccggaaagggtacccggtaacccgggtaacccgtttaagtaaccgttccgtaacggtttacggaccgaaacccgtaaagtacgtaaccggtaaggggtaaaccgggggttacggggtttaaccggggtaaactttaaacgttaaacgtttaacgttttaaccccttaacgtttacttaacggtttaagtacggggttaagttaccggggttaccggtacgggtccggggggaacccggtaaacgggacccggtacccggttaccgtaacccgggttcccctaaccggtacctaacccggtaccccctaacccggtacccgggtaaaacccccggg

SEQ ID NO: 81023 - DNA, 681 bp, Homo sapiens
  misc_feature: GYAE6OF01DVZ5K.9.37.D04.1.454.CMB.1.raw
  modified_base (199)..(199): a, c, t, g, unknown or other
  misc_feature (199)..(199): n is a, c, g, or t
  modified_base (256)..(256): a, c, t, g, unknown or other
  misc_feature (256)..(256): n is a, c, g, or t
  modified_base (425)..(425): a, c, t, g, unknown or other
  misc_feature (425)..(425): n is a, c, g, or t
  modified_base (482)..(482): a, c, t, g, unknown or other
  misc_feature (482)..(482): n is a, c, g, or t
  modified_base (493)..(493): a, c, t, g, unknown or other
  misc_feature (493)..(493): n is a, c, g, or t
tcagtgatacgtctcacgaccggtgctcgatttagtagcatactgttgggtttgggggctctgagagaggagcccagccctgggattttcaggtgttttcatttggtgatcaggactgaacagagagaactcaccatggagtctgggctgagcgtgtcgttctacgtcgtgacttagtttaaagtgtcagtgtgaggtncatctagttggagtcgtgggggcgcccgtggtacgaggcccggggggtccctgaccnctctcctgtacactcctcgtggtacttcctaaccttttaaccaccttatgactgttgagcgtcgggtccgccgaccggccccggaaggggacgggcgtcggacgttgggcgcgaagcctattaggcgacgaagtcggaacaaacacaattactacgacagtacctcggngaacgggtccgttcaacctagttccaagacgtaacttaaattcgaaagtaaccacgngttctaacctntacgataacgagtacgaacgacgtccgtagggacgaccgaccggtaacggaccggtaccggtacgttaactacgtaccgtacgtagtaaccgaaacgaaacggtacggtaacgggaacggggttaaaccggggttaacggggtttaaaccgggttaactttaaaacttaaaccgttttaacgttaacg

SEQ ID NO: 81024 - DNA, 936 bp, Homo sapiens
  misc_feature: GYAE6OF01ENS76.9.37.D04.1.454.CMB.1.raw
tcagtgatacgtctcacgaccggtgctcgatttagtagcatactgttgggtttgggggctctgagagaggagcccagccctgggtattttcagggttgttttctatttggtgatcaggactgaacagagacgaactcaccagtggagtcgtgggctgagcgtcggtcttcttcgttggtcggtactttaaggttttaaaaggtgtccgtaggttggtggtaggtgctatcgttaaggttgggacggttcgggtacgggggtacgtcccgttacgggtaaccgggtaccggggggtaccccggggggggttccctaccggaaccgtaccttaccttccggttacgtacgtacgttccgtcgttaggtacctttaccctaaccgttaacctacgtactcgtacgttagttcgtacggtcgggtccgggtaccccggaccggaccggggaccccggggaaggggggtacgggtaccggtgggaaccggttgggtaccgccgtaacggtcgtaacggttacggagttaaccggaaggtaacggaaaccgtaaaaacttcgtaaacgttacggtaaccgcgtaaaccggtacggttaccggggtaacgggtaacccgggtacccgttaaccgtaaccgtttaacgtttaaccgaaaggttaaccggtaaacctttaaacgtaacccgtaaagtaccgtaaccggtaccgttaggttacctacgtacgtaccaaggttaaccacggtaaacgtccggtaaccgtacgggacgggtaacccggaaccggggtaacccgtacggtaacccggttaggtaaccttaaccgtaccgtaagttaccgaaacggtaaccgtaacggaccgtaaaccggggtagggaaaccccggggttacgggttaaacgggttaaacccttaagttaatttaaacccggttaaaccc

SEQ ID NO: 81025 - DNA, 692 bp, Homo sapiens
  misc_feature: GYAE6OF01DEEO9.9.37.D04.1.454.CMB.1.raw
  modified_base (263)..(263): a, c, t, g, unknown or other
  misc_feature (263)..(263): n is a, c, g, or t
  modified_base (285)..(285): a, c, t, g, unknown or other
  misc_feature (285)..(285): n is a, c, g, or t
  modified_base (341)..(341): a, c, t, g, unknown or other
  misc_feature (341)..(341): n is a, c, g, or t
tcagtgatacgtctcacgaccggtgctcgatttagtagcatactgttgggtttgggggctctgagagaggagcccagccctgggtattttcaggtgttttcatttggtgatcaggactgaacagagagaactcaccatggagtcgtgggctgagcgtggtcttcttcgttgtggtcttaagttttaaaggtgtccagtgtggaggtgcatctagtggagtcggtggggacgcccgtggtacgacggggcccggggggttcccnggacctctcctccgtacgtacncggtcctgtgtacttcctaacctttaacacctatgctattcgaggtcgtcgggccnccgtacggacccggaaggggacgggcgtacggacgtgggtaccgcgacgccgtagttacggtcggaaactagtacgggaaacaaaacgactagtaactacgacgacgacccggttcggacggtacgggtccttaccgaccgttagttacgataacggtaactaagttaaccaagaaccgtacgtacttacggtacttcgtacgaacgtacgtacgtacgaaacgtccggtacgtacggacgggaccgaccgggacggtaaccgccgtaccgtaatcgtactacgtacggtacgaaccgtaagcgtaagagggtacgggtacggtacggtaagtaacctaagtactttaacg

SEQ ID NO: 81026 - DNA, 734 bp, Homo sapiens
  misc_feature: GYAE6OF01BB88H.9.37.D04.1.454.CMB.1.raw
  modified_base (228)..(228): a, c, t, g, unknown or other
  misc_feature (228)..(228): n is a, c, g, or t
  modified_base (329)..(329): a, c, t, g, unknown or other
  misc_feature (329)..(329): n is a, c, g, or t
  modified_base (337)..(337): a, c, t, g, unknown or other
  misc_feature (337)..(337): n is a, c, g, or t
  modified_base (381)..(381): a, c, t, g, unknown or other
  misc_feature (381)..(381): n is a, c, g, or t
  modified_base (431)..(431): a, c, t, g, unknown or other
  misc_feature (431)..(431): n is a, c, g, or t
  modified_base (551)..(551): a, c, t, g, unknown or other
  misc_feature (551)..(551): n is a, c, g, or t
tcagtgatacgtctcacgaccggtgctcgatttagtagcatactgttggggtttgggggctctgagagaggagcccagccctgggtattttcaggtgttttcatttggtgatcaggactgaacagagagaactcacagtggagtcgtgggtctggagcgtggtcttcgttcgttgtggtacttaagtttaaaggtgtcctagtggtgaggtgcgtgtcttagttcggngtcgtgggggacgcccgtaggtacgagggtccggggggtccctgactctcctcctgtacgtacgccttctaggtacttccaacccgtttaacaccttatcncgattcgnggcgtcgggtccggacccgcggaccccggtaggggaagggtcgnggtcgtgggctacgagcctagttcggtggacgtaagtcggaacgaaaacntaacgttacgttacgacgacggaccgttcgggtagaaccgggtaccgttctaaccgtccttagacgtagaacctaagttacaagtaacacgtctaagtcacgtgactagagtactacggntaccctagacgacgggtacccgaaggtaccctaccgggttaccggtaattacctcggttaaaccgttcggggtacgaaaccgggttaaaacgtaccgggtacggttaaaaacccgggggtgggttaacgggggtaaaccccgggttaaagggtttaacaaaaaccgggtttaggtttaacccc

SEQ ID NO: 81027 - DNA, 805 bp, Homo sapiens
  misc_feature: GYAE6OF01C9JA5.9.37.D04.1.454.CMB.1.raw
  modified_base (276)..(276): a, c, t, g, unknown or other
  misc_feature (276)..(276): n is a, c, g, or t
  modified_base (312)..(312): a, c, t, g, unknown or other
  misc_feature (312)..(312): n is a, c, g, or t
tcagtgatacgtctcacgaccggtgctcgatttagtagcatactgttgggtttgggtctgagagaggagcccagccctggggattttcaggttgttttctatttggtgatcaggactgaacagagagaactcacatggagtcgtgggctgagtcgtgtcttcttcttggtggtacttaagtttaaaaggtgtacctagtgtggaggtgacatctagttggagtcgtgggggacgccgtggtacgacgggccggggggtcctgacactctcagtacncgtctgtggtacttacctaacctttaaccaccttancgctagtgacgtcgtcggtaccggccggaccggacccgggtaaggggcggggtaccgtgggtacgtggggcgaccgtacggccttaaggttacggtcggtaaccgtaaggtaacggggaaaccaaaaaccgtacgttaagttaacgttacccgacgtaacggaccgtttaccgggacgggtaaaccggggttacccgtaccctaacgtaaccgtttaccgaacggtaacgtaaacgttaagtaaaccgtaaaccgtaaaacgtaccgtaccggttagttaaacgtccgtaaacgcgtaaacgagttaaccggaacgaaccggtaccgttaagggaaccggtaacggaccgggaacggtaaccgcccggtaaggttactaaccggtaccgtaacgtcgggaacgtaaaccgaaagtaccggtaaggtaaacgggtaacgggttacgggtaacggggttaaacgtaacttaaaagttaacctttaacgtaaaccg

SEQ ID NO: 81028 - DNA, 254 bp, Homo sapiens
  misc_feature: GYAE6OF01ELIS6.9.37.D04.1.454.CMB.1.raw
  modified_base (208)..(254): a, c, t, g, unknown or other
  misc_feature (208)..(254): n is a, c, g, or t
tcagtgatacgtctcacgaccggtgctcgatttagtagcatactgttgggtttgggatagtggtactgatcattgggtgttcgggcggagggaccaagctgaccgtctaggtcagcccaaggcctcgccccctggtcactctcgttccccaccctcgtcagacgtatccacgtggacggcggggctagggacgaacggcgactaatgnnnnnnnnnnnnnnnnnnnnnnnnnnnnnnnnnnnnnnnnnnnnnnn

SEQ ID NO: 81029 - DNA, 975 bp, Homo sapiens
  misc_feature: GYAE6OF01BGTR1.9.37.D04.1.454.CMB.1.raw
  modified_base (881)..(881): a, c, t, g, unknown or other
  misc_feature (881)..(881): n is a, c, g, or t
tcagtgatacgtctcacgaccggtgctcgatttagtagcatactgttgggtttgggggctctgagagaggagcccagccctgggatttttcaggtgttttcatttggtgatcaggactgaacagagagaactcaccatggagtcgtgggctgagcgtggtctttcttcgttgtggtacttaagtttttaaaaggtgtacctagtggtaggaggtgactattcgttagttggagtcggtggggactccgtggtacgacgggtcccggggggtcctaggactacgttcctcgtacgtacgtacgtcctcgtaggtacttacctaaccttaacaccttatcgtactacgttggagtaccggttcggggacccgtaccggacccggggacccggtaaggggggaacgggtcgttacggggaccggttgggtccggaccgtacggtaaccgttaaggttttacgggacggggtaacgtaacggtaaccggggaaaaccgaaaaacctaggttaaaccgtttaaacgttaaccggaaccgtaaaccggtacccggttaaccgggtaacggggtaacccgggttacccggtttaccctaaacccgttacgttttaacccgggaaagtaacccggttaaaacgtttaaaccgtttaaacgaaaaccccggttaaaccggtaaccggtttaccgtttaagtttaaccggtacgtaaccccgggtaaggttaacgtaaacgtaaaacggttaaccccggaaggttaccccgggttaaagggaacccggtaaccggggaccccgggtaacgggtaacccgggtaccggttaaccgtttaacgtaaccggtttccgaaccggggttacgtaaaacccgaaacccgggttaaanaccgggtaaccccgggtaaagggtaaaccgggggggtttaccggttaaacggggttaaactttaaaacttaaacggttttaactttaaacccgg

SEQ ID NO: 81030 - DNA, 828 bp, Homo sapiens
  misc_feature: GYAE6OF01EIEKZ.9.37.D04.1.454.CMB.1.raw
tcagtgatacgtctcacgaccggtgctcgatttagtagcatactgttgggtttgggggctctgagagaggagcccagccctgggattttcaggtgttttcatttggtgatcaggactgaacagagagaactcaaccatggagtcgtgggctgagctggtctttcttcttgtggtcttaagttttaaaaggtgtccagtgtgaggtgcattctagttggagtcggtggggacgtcccgtaggtaccgacggggtcccggggggtccctacgacctaccgtccgttccgtcgtacgtaccgtccgtacgtacgttaacttaacccttaaccctttaaacctaaccgttacgtacgtacgttaaggttacggtaccggttcccgggtacccggggtccccggaccccgggtacccggggaaccccggggaagggggtacggggtccggtacgggtacgggtcgggtaccgacgtaccgtaccgttagttacggacggtaacgtaagtaacggaaacgtaaacctacgtaaacgttaacgtaccgacgtaacggtaccggtacgggtaacgggtaccgggttaccgttaccgtaaccgttaccgttaccgtaagtaacgttaaacttaacgttaacaaacgtaaccgtacgtacgttacgttatacgtacgacgtagtaagaacgacgacgacgtacggacggtaccggacggacggaaccgtacggtacgtatacgtaccgtacgtacggtaacgtaacgaaggtacgtaacggtaacgggtaacgggttaacggttaacggtaaagtttaacgtaacgttaacgttaacg

SEQ ID NO: 81031 - DNA, 857 bp, Homo sapiens
  misc_feature: GYAE6OF01ARFBB.9.37.D04.1.454.CMB.1.raw
tcagtgatacgtctcacgaccggtgctcgatttagtagcatactgttgggtttgggggctctgagagaggagcccagccctgggtattttcaggttgttttcagtttggtgatcaggactgaacagagagaactcacatggagtcgtgggctgagcgtggtcttcttcgtgtggtacttaagtttaaaggtgtaccagtgtagaggtgacattctagttggacgtcggtggggacgtcccgtggtacgtacgggcccgggggtcctggaccacgtctctacgtacacgtctcgtagtacttaccgtacctttaacaccttatcgactagttgacggtcggttccggcccggtacccgacggggaccccgggtaagggggtaaccggggtccgtacggggtaccggtgggtacccggtaccgaaccggtaccgttacggttaggtaccgggtactaaacgggttacgggaacctaaaaaccgtacgtaacgtttaaacggtaccgaccgtaacggtaaccgttcccggggtaaacgggtaaccggggttacccggttacctaccgttaccgtttaacccggaaggtaacgtaaacgtttaaccgttaacggtaaaccgtaacggtaaccgtccgtacgttacgtaccgtgtaaacccggagtaccggaaacgtaacgttacggaccttagggaaccggttacccgggaacggaccgggtaacccggtacggtaacccttaagttacccgtacggttaaccgtccggtaaacccggtaacgttaaaggtaccgtaacgggtaacgggtaaacgggtaccgggtttacggtaaactaacggttaaacgttcggttaaacc

SEQ ID NO: 81032 - DNA, 847 bp, Homo sapiens
  misc_feature: GYAE6OF01D8EFY.9.37.D04.1.454.CMB.1.raw
  modified_base (185)..(185): a, c, t, g, unknown or other
  misc_feature (185)..(185): n is a, c, g, or t
tcagtgatacgtctcacgaccggtgctcgatttagtagcatactgttgggtttggggctctgagagaggagcccagccctgggacttttcaggtgttttcatttggtgatcaggactgaacagagagaactcacagtggagtctggctgagcgtggtcttcttcgttgtgtcttaatttaaaggngtcgagtgtgagtgctatcgtagttggagtcggtaggggactcccgtaggaacggtcgggcccggggggttcctacggtccaccttcgttccgtaggtaaccgcgtcccttcggttacggttaacttaccccggttaaaccttttaaccgaaccttaggtacgacgttaacgtttcggaccggttccggttaccgggggtacccccgacccgggaaccggggtacccccgggtaaaggggggggaaacgggttcccgttagggggtaaccgttttcgggggacccctacggaaccgttaaccccggtaagttttacggacggggttaacgtaacggtacgggtaaaaccaaaaaaccgtcgtaaaacgtttacggtaaccgacgtacgggtaaccttcggggtaaaccggtaccggggtacccgttataaccgttacgttaccgtaagtacctacgttaattacgaaacgtaacgtacctgtaacgttccgtagtacgtacgtagtacgacgtaacgacgacgttaggacggtacggaccgtacggaccgacggttacgaacgtactcgacgttacggacgtaacaacggttaacaaccggaaaggtaacccggggttacggggttaacgtaacgttaacgtaaacgttacgtttaaacccg

SEQ ID NO: 81033 - DNA, 195 bp, Homo sapiens
  misc_feature: GYAE6OF02IZ2Q1.9.37.D04.1.454.CMB.1.raw
  modified_base (192)..(195): a, c, t, g, unknown or other
  misc_feature (192)..(195): n is a, c, g, or t
tcagtgatacgtctcacgaccggtgctcgatttagtagcatactgttgggtttgggatagtggtactgatcattgggtgttcggcggagggaccaagctgaccgtcctaggtcagcccaaggctgccccctcggtcactctgttcccaccctcctcagacgtatcactgagcgggctggcaaggcgcatagnnnn

SEQ ID NO: 81034 - DNA, 200 bp, Homo sapiens
  misc_feature: GYAE6OF02JBE53.9.37.D04.1.454.CMB.1.raw
  modified_base (191)..(200): a, c, t, g, unknown or other
  misc_feature (191)..(200): n is a, c, g, or t
tcagtgatacgtctcacgaccggtgctcgatttagtagcatactgttgggtttgggatagtggtactgatcattgggtgttcggcggagggaccaagctgaccgtcccaggtcagcccaaggctgcccctcggtcactctgttcccaccctcctcagacgtatcactgagcgggctggcaaggcgcatagnnnnnnnnnn

SEQ ID NO: 81035 - DNA, 209 bp, Homo sapiens
  misc_feature: GYAE6OF02G9VEX.9.37.D04.1.454.CMB.1.raw
  modified_base (192)..(209): a, c, t, g, unknown or other
  misc_feature (192)..(209): n is a, c, g, or t
tcagtgatacgtctcacgaccggtgctcgatttagtagcatactgttgggtttgggatagtggtactgatcattgggtgttcggcggagggaccaagctgaccgtcctaggtcagcccaaggctgccccctcggtcactctgttcccaccctcctcagacgtatcactgagcgggctggcaaggcgcatagnnnnnnnnnnnnnnnnnn

SEQ ID NO: 81036 - DNA, 192 bp, Homo sapiens; identical to SEQ ID NO: 80993
  misc_feature: GYAE6OF02G5SHS.9.37.D04.1.454.CMB.1.raw
  modified_base (192)..(192): a, c, t, g, unknown or other
  misc_feature (192)..(192): n is a, c, g, or t

SEQ ID NO: 81037 - DNA, 205 bp, Homo sapiens
  misc_feature: GYAE6OF02H7WUG.9.37.D04.1.454.CMB.1.raw
  modified_base (194)..(205): a, c, t, g, unknown or other
  misc_feature (194)..(205): n is a, c, g, or t
tcagtgatacgtctcacgaccggtgctcgattttagtagcatactgttgggtttgggatagtggtactgatcattgggtgttcggcggagggaccaagctgaccgtcctaggtcagcccaaggctgccccctggtcactctgtttcccaccctcctcagacgttatcactgagcgggctggcaaggcgcatagnnnnnnnnnnnn

SEQ ID NO: 81038 - DNA, 192 bp, Homo sapiens; identical to SEQ ID NO: 80993
  misc_feature: GYAE6OF02F7CNG.9.37.D04.1.454.CMB.1.raw
  modified_base (192)..(192): a, c, t, g, unknown or other
  misc_feature (192)..(192): n is a, c, g, or t

SEQ ID NO: 81039 - DNA, 194 bp, Homo sapiens; identical to SEQ ID NO: 80992
  misc_feature: GYAE6OF02IXDJ9.9.37.D04.1.454.CMB.1.raw
  modified_base (192)..(194): a, c, t, g, unknown or other
  misc_feature (192)..(194): n is a, c, g, or t

SEQ ID NO: 81040 - DNA, 620 bp, Homo sapiens
  misc_feature: GYAE6OF02GTOH2.9.37.D04.1.454.CMB.1.raw
  modified_base (289)..(289): a, c, t, g, unknown or other
  misc_feature (289)..(289): n is a, c, g, or t
  modified_base (542)..(542): a, c, t, g, unknown or other
  misc_feature (542)..(542): n is a, c, g, or t
tcagtgatacgtctcacgaccggtgctcgatttagtagcatactgttggggtttgggggctctagagagaggagcccagtcccgtcgggattttcgaacggtgttttcgaactttggtgatcaggtactgtaaccagagagaactcaccgatcggagtctgggcctgaagtctggcttcttcttgtggctatttaaaaggtcgtccagtgtgaggtgcgaatctacttcggagtcctgggggagcccgtggtacagccggggggtcctgacactctcctgtacagcctntggattcacctttaacgacctagtcgccagttcgacgctgggtccgtccgaggcccccgaggggaacggggcgtcggacgtggggtccgctacgccaattaggtcggactaagtggacgaaaacgacagtaacttacgctagactccgtgaacgggccgttcacctattccgagtagactaattcaaagtaactacgctagtaatcttgcagatagaactagcctagacgagccgagggaccgacggccgtanacgtacgagtacggacgaaccaaaggactacgaaggaacgggacgggttaccgggaagttaactaagttacttaaccg

SEQ ID NO: 81041 - DNA, 430 bp, Homo sapiens
  misc_feature: GYAE6OF02HM195.9.37.D04.1.454.CMB.1.raw
  modified_base (188)..(188): a, c, t, g, unknown or other
  misc_feature (188)..(188): n is a, c, g, or t
  modified_base (190)..(190): a, c, t, g, unknown or other
  misc_feature (190)..(190): n is a, c, g, or t
  modified_base (192)..(194): a, c, t, g, unknown or other
  misc_feature (192)..(194): n is a, c, g, or t
  modified_base (196)..(196): a, c, t, g, unknown or other
  misc_feature (196)..(196): n is a, c, g, or t
  modified_base (198)..(199): a, c, t, g, unknown or other
  misc_feature (198)..(199): n is a, c, g, or t
  modified_base (202)..(202): a, c, t, g, unknown or other
  misc_feature (202)..(202): n is a, c, g, or t
  modified_base (206)..(206): a, c, t, g, unknown or other
  misc_feature (206)..(206): n is a, c, g, or t
  modified_base (211)..(211): a, c, t, g, unknown or other
  misc_feature (211)..(211): n is a, c, g, or t
  modified_base (214)..(214): a, c, t, g, unknown or other
  misc_feature (214)..(214): n is a, c, g, or t
  modified_base (222)..(222): a, c, t, g, unknown or other
  misc_feature (222)..(222): n is a, c, g, or t
  modified_base (226)..(226): a, c, t, g, unknown or other
  misc_feature (226)..(226): n is a, c, g, or t
  modified_base (228)..(228): a, c, t, g, unknown or other
  misc_feature (228)..(228): n is a, c, g, or t
  modified_base (251)..(252): a, c, t, g, unknown or other
  misc_feature (251)..(252): n is a, c, g, or t
  modified_base (257)..(257): a, c, t, g, unknown or other
  misc_feature (257)..(257): n is a, c, g, or t
  modified_base (263)..(263): a, c, t, g, unknown or other
  misc_feature (263)..(263): n is a, c, g, or t
  modified_base (266)..(266): a, c, t, g, unknown or other
  misc_feature (266)..(266): n is a, c, g, or t
  modified_base (269)..(269): a, c, t, g, unknown or other
  misc_feature (269)..(269): n is a, c, g, or t
  modified_base (272)..(272): a, c, t, g, unknown or other
  misc_feature (272)..(272): n is a, c, g, or t
  modified_base (279)..(280): a, c, t, g, unknown or other
  misc_feature (279)..(280): n is a, c, g, or t
  modified_base (282)..(282): a, c, t, g, unknown or other
  misc_feature (282)..(282): n is a, c, g, or t
  modified_base (284)..(284): a, c, t, g, unknown or other
  misc_feature (284)..(284): n is a, c, g, or t
  modified_base (299)..(299): a, c, t, g, unknown or other
  misc_feature (299)..(299): n is a, c, g, or t
  modified_base (309)..(309): a, c, t, g, unknown or other
  misc_feature (309)..(309): n is a, c, g, or t
  modified_base (315)..(315): a, c, t, g, unknown or other
  misc_feature (315)..(315): n is a, c, g, or t
  modified_base (331)..(331): a, c, t, g, unknown or other
  misc_feature (331)..(331): n is a, c, g, or t
  modified_base (333)..(333): a, c, t, g, unknown or other
  misc_feature (333)..(333): n is a, c, g, or t
  modified_base (335)..(335): a, c, t, g, unknown or other
  misc_feature (335)..(335): n is a, c, g, or t
  modified_base (343)..(343): a, c, t, g, unknown or other
  misc_feature (343)..(343): n is a, c, g, or t
  modified_base (346)..(346): a, c, t, g, unknown or other
  misc_feature (346)..(346): n is a, c, g, or t
  modified_base (351)..(351): a, c, t, g, unknown or other
  misc_feature (351)..(351): n is a, c, g, or t
  modified_base (356)..(357): a, c, t, g, unknown or other
  misc_feature (356)..(357): n is a, c, g, or t
  modified_base (359)..(359): a, c, t, g, unknown or other
  misc_feature (359)..(359): n is a, c, g, or t
  modified_base (365)..(365): a, c, t, g, unknown or other
  misc_feature (365)..(365): n is a, c, g, or t
  modified_base (367)..(367): a, c, t, g, unknown or other
  misc_feature (367)..(367): n is a, c, g, or t
  modified_base (369)..(369): a, c, t, g, unknown or other
  misc_feature (369)..(369): n is a, c, g, or t
  modified_base (385)..(385): a, c, t, g, unknown or other
  misc_feature (385)..(385): n is a, c, g, or t
  modified_base (399)..(399): a, c, t, g, unknown or other
  misc_feature (399)..(399): n is a, c, g, or t
  modified_base (401)..(401): a, c, t, g, unknown or other
  misc_feature (401)..(401): n is a, c, g, or t
  modified_base (405)..(405): a, c, t, g, unknown or other
  misc_feature (405)..(405): n is a, c, g, or t
  modified_base (407)..(407): a, c, t, g, unknown or other
  misc_feature (407)..(407): n is a, c, g, or t
  modified_base (411)..(411): a, c, t, g, unknown or other
  misc_feature (411)..(411): n is a, c, g, or t
  modified_base (415)..(415): a, c, t, g, unknown or other
  misc_feature (415)..(415): n is a, c, g, or t
  modified_base (419)..(419): a, c, t, g, unknown or other
  misc_feature (419)..(419): n is a, c, g, or t
  modified_base (421)..(421): a, c, t, g, unknown or other
  misc_feature (421)..(421): n is a, c, g, or t
  modified_base (423)..(423): a, c, t, g, unknown or other
  misc_feature (423)..(423): n is a, c, g, or t
tcagtgatacgtctcacgaccggtgctcgatttagtagcatactgttgggtttggggatagtggtactgatcattgggtgttcggcggagggaccaagctgaccgtcctaggtcagccaaggctcgcccctggtcactctgttccacctctcagacgtatcactgagcgggctggcaaggcgcatagncnannnancnntcngcgnatgcnganctgtcatnatcngnctaagcacagcgcaactcatcannactgngacgcngcngcncgngtgtcgnntntntcgcgcactacgtcncgacgacgcncgctcncacactctcgtcgtcncncnctacaganatntactntatannanacacanananacacacacacgcgatnacgacgacactgcncncgcncncacncgcnctcncncnctctctc

SEQ ID NO: 81042 - DNA, 239 bp, Homo sapiens
  misc_feature: GYAE6OF02GS8AE.9.37.D04.1.454.CMB.1.raw
  modified_base (196)..(197): a, c, t, g, unknown or other
  misc_feature (196)..(197): n is a, c, g, or t
  modified_base (199)..(239): a, c, t, g, unknown or other
  misc_feature (199)..(239): n is a, c, g, or t
tcagtgatacgtctcacgaccggtgctcgatttagtagcatactgttgggtttggggatagtggtactgatcattgggtgttcggcggagggaccaagctgaccgtcctaggtcagcccaaggcctgccccctcggtcactctgttcccaccctcgtcagaccgtatcactgagcgggctggcaaggccgcatagnncnnnnnnnnnnnnnnnnnnnnnnnnnnnnnnnnnnnnnnnnn

SEQ ID NO: 81043 - DNA, 609 bp, Homo sapiens
  misc_feature: GYAE6OF02IPFUE.9.37.D04.1.454.CMB.1.raw
  modified_base (390)..(390): a, c, t, g, unknown or other
  misc_feature (390)..(390): n is a, c, g, or t
tcagtgatacgtctcacgaccggtgctcgatttagtagcatactgttgggtttgggggctctgagagaggagcccagccctgggattttcaggtgttttcatttggtgatcaggactgaacagagagaactcaccatggagtctgggctgagctggcttcttcttgtggctattttaaaaggtgtccagtgtgaggtgcatctattggagtctgggggagccctgggtacaggccgggggggtccctggacacgtctcctgtacagcctctggattcacctttaacacctatgcattgagctgggtccgccaggccccagggacgggactggacgtgggtcgcgagccattagtggcaagtggacaaaacgacatatacgacagactcgngaacgggcgttacacctattcagagacaatttcaaagaacacgtactgtactcgtgacagatagaacagacccgtagaacggtacgaccggacgggaaccgaccgggacccgttaatacgtaccaacgttcggtacggacccgaaagtaacgtaccgaaggaaacgggttaccggggttacgggggaaacgtttaaccgaaagtttacgtttaaacccg

SEQ ID NO: 81044 - DNA, 199 bp, Homo sapiens
  misc_feature: GYAE6OF02FQH73.9.37.D04.1.454.CMB.1.raw
  modified_base (192)..(199): a, c, t, g, unknown or other
  misc_feature (192)..(199): n is a, c, g, or t
tcagtgatacgtctcacgaccggtgctcgatttagtagcatactgttgggtttgggatagtggtactgatcattgggtgttcggcggagggaccaagctgaccgtcctaggtcagcccaaggctgccccctcggtcactctgttcccaccctcctcagacgtatcactgagcgggctggcaaggcgcatagnnnnnnnn

SEQ ID NO: 81045 - DNA, 574 bp, Homo sapiens
  misc_feature: GYAE6OF02H7UUR.9.37.D04.1.454.CMB.1.raw
  modified_base (158)..(158): a, c, t, g, unknown or other
  misc_feature (158)..(158): n is a, c, g, or t
  modified_base (167)..(167): a, c, t, g, unknown or other
  misc_feature (167)..(167): n is a, c, g, or t
  modified_base (169)..(169): a, c, t, g, unknown or other
  misc_feature (169)..(169): n is a, c, g, or t
  modified_base (224)..(224): a, c, t, g, unknown or other
  misc_feature (224)..(224): n is a, c, g, or t
  modified_base (365)..(365): a, c, t, g, unknown or other
  misc_feature (365)..(365): n is a, c, g, or t
  modified_base (382)..(382): a, c, t, g, unknown or other
  misc_feature (382)..(382): n is a, c, g, or t
  modified_base (418)..(418): a, c, t, g, unknown or other
  misc_feature (418)..(418): n is a, c, g, or t
  modified_base (490)..(490): a, c, t, g, unknown or other
  misc_feature (490)..(490): n is a, c, g, or t
tcagtgatacgtctcacgaccggtgctcgatttagtagcatactgttgggtttgggggctctgagagaggagcccagccctgggattttcaggtgttttcatttggtgatcaggactgaacagagagaactcaccatggagtctgggctgagcggtgngtctagtgngntagttaagtgtcagtgtgaggtgcatctattggagtctgggggagccctggtacnggccggggggtccctgacactctcctgacagcctctggattcacctttaacacctatgcattgagcgtgggtccgccagggacccccaggggaaggggcctggacgtgggtcgcagccattagtggcaagtgacgaaaacncatatacgcagactcgngaacgggccgttacacattccagtagaactaatttnaaagaacacgtctagtatcagcagatagaactagaccgtagagacgacgaagggaccacggccggttaactntactacgtggtacgaaccgaaagtacgtacgaaggtaacgggtaccgggttacgggtaacgtttaaacgtaagttacttaaccg

SEQ ID NO: 81046 - DNA, 547 bp, Homo sapiens
  misc_feature: GYAE6OF02G237S.9.37.D04.1.454.CMB.1.raw
  modified_base (390)..(390): a, c, t, g, unknown or other
  misc_feature (390)..(390): n is a, c, g, or t
  modified_base (411)..(411): a, c, t, g, unknown or other
  misc_feature (411)..(411): n is a, c, g, or t
  modified_base (447)..(447): a, c, t, g, unknown or other
  misc_feature (447)..(447): n is a, c, g, or t
  modified_base (455)..(455): a, c, t, g, unknown or other
  misc_feature (455)..(455): n is a, c, g, or t
tcagtgatacgtctcacgaccggtgctcgatttagtagcatactgttgggtttgggggctctgagagaggagcccagccctgggattttcaggtgttttcatttggtgatcaggactgaacagagagaactcaccatggagtctgggctgagcgtggcttcttcttgtggctattttaaaaggtgtccagtgtgaggtgcatctattggagtcgtgggggagccctggtacaggccgggggggtccctgacactctcctgtacagcctctggattcacctttaacacctatgcattgagctgggtccgccaggccccaggggaaggggctgggactgggtcgcagcccattagtggcaatggacgaaaacacaatattacgcagactcgngagggcgtcacatttccaganacaatttcaagaacacgctgtatctgcagatgaacngcctgagngccgagacacggccgtatactcactgtacgccaaagacttacgaggaacgggacgggttaccgggggaagttaacgtaagttatttaacccg

SEQ ID NO: 81047 - DNA, 227 bp, Homo sapiens
  misc_feature: GYAE6OF02JIY92.9.37.D04.1.454.CMB.1.raw
  modified_base (187)..(187): a, c, t, g, unknown or other
  misc_feature (187)..(187): n is a, c, g, or t
  modified_base (193)..(227): a, c, t, g, unknown or other
  misc_feature (193)..(227): n is a, c, g, or t
tcagtgatacgtctcacgaccggtgctcgatttagtagcatactgttgggtttggggatagtggtactgatcattgggtgttcggcggagggaccaagctgaccgtccctaggtcagcccaaggctgccccctggtcactctgttcccgccctcctcagacgtatcactgagcgggctggcaaggcncatagnnnnnnnnnnnnnnnnnnnnnnnnnnnnnnnnnnn

SEQ ID NO: 81048 - DNA, 582 bp, Homo sapiens
  misc_feature: GYAE6OF02JZP51.9.37.D04.1.454.CMB.1.raw
  modified_base (194)..(194): a, c, t, g, unknown or other
  misc_feature (194)..(194): n is a, c, g, or t
  modified_base (211)..(211): a, c, t, g, unknown or other
  misc_feature (211)..(211): n is a, c, g, or t
  modified_base (229)..(229): a, c, t, g, unknown or other
  misc_feature (229)..(229): n is a, c, g, or t
  modified_base (278)..(278): a, c, t, g, unknown or other
  misc_feature (278)..(278): n is a, c, g, or t
  modified_base (305)..(305): a, c, t, g, unknown or other
  misc_feature (305)..(305): n is a, c, g, or t
  modified_base (313)..(313): a, c, t, g, unknown or other
  misc_feature (313)..(313): n is a, c, g, or t
  modified_base (326)..(326): a, c, t, g, unknown or other
  misc_feature (326)..(326): n is a, c, g, or t
  modified_base (343)..(343): a, c, t, g, unknown or other
  misc_feature (343)..(343): n is a, c, g, or t
  modified_base (353)..(353): a, c, t, g, unknown or other
  misc_feature (353)..(353): n is a, c, g, or t
  modified_base (364)..(364): a, c, t, g, unknown or other
  misc_feature (364)..(364): n is a, c, g, or t
  modified_base (370)..(370): a, c, t, g, unknown or other
  misc_feature (370)..(370): n is a, c, g, or t
  modified_base (379)..(379): a, c, t, g, unknown or other
  misc_feature (379)..(379): n is a, c, g, or t
  modified_base (387)..(387): a, c, t, g, unknown or other
  misc_feature (387)..(387): n is a, c, g, or t
  modified_base (437)..(437): a, c, t, g, unknown or other
  misc_feature (437)..(437): n is a, c, g, or t
tcagtgatacgtctcacgaccggtgctcgatttagtagcatactgttgggtttgggggtcgttcgtgagagaggagcccagccctgggattttcgaggttgttttctatttggtgtatcaggactgaacagagagaactcaaccatggagtctgggctgagcgtggcgttcttcttgtggctattttaaaggtntccagtgtgaggtgcanctattggatcgtggggancctggtacaggccgggggggtccctaggaccactctcctagacagcctntggatttcacctttaacacctagtcgntattgganctacgggcgaccngccccagggaagggtcnggactggtcncgagtcatcgngacagngacaactanatatacanagacctcggagaacgggtccgtacacctacttaccagaacaataacttanaaacaacgactactagtactactcacgacatacgaacgatacagagacgaccgaagaccgacggtactaacgtatacgtaccgttgacgtaaccaaagactagaagtaggtacccgggtaagggtaacgtaagaaacttattaac

SEQ ID NO: 81049 - DNA, 663 bp, Homo sapiens
  misc_feature: GYAE6OF02JWGQM.9.37.D04.1.454.CMB.1.raw
  modified_base (344)..(344): a, c, t, g, unknown or other
  misc_feature (344)..(344): n is a, c, g, or t
tcagtgatacgtctcacgaccggtgctcgatttagtagcatactgttgggtttgggggctctgagagaggagcccagccctgggattttcaggtgttttcatttggtgatcaggactgaacagagagaactcaccatggagtctgggctgagctggcttcttcttgtggctattttaaaggtgtccagtgtgaggtgcatctattggagtcgtgggggagccctggtacaggccggggggtccctgacactctcctgtacagcctctggattcacctttaacacctatgcattgagtctgggtccgccgacggccccgaggggaacgggcgtgggactgggtcncgacgcctagttaggtcggactaagtcgggaaccgaaaaacacgtaataacgttaaccgcaagaccgtcccggtaggaaacggggtcccggtttacaacccgtactttacccgaggtaacgaactaaactttacgaaacgtaaaccaccgtactagttactcgtacgacgaagtactagaacgacgaccgtaggaacgtacgaccggaaggaaccgacggacccgttaatacgtccgaacgttaggacgaaccgtaaagtacgtacgaaggtaacggtacggggttacgggtaagttaacgtaagttaacgtttaaccg

SEQ ID NO: 81050 - DNA, 193 bp, Homo sapiens; identical to SEQ ID NO: 80986
  misc_feature: GYAE6OF02HLO6M.9.37.D04.1.454.CMB.1.raw
  modified_base (192)..(193): a, c, t, g, unknown or other
  misc_feature (192)..(193): n is a, c, g, or t

SEQ ID NO: 81051 - DNA, 646 bp, Homo sapiens
  misc_feature: GYAE6OF02IPW8O.9.37.D04.1.454.CMB.1.raw
  modified_base (507)..(507): a, c, t, g, unknown or other
  misc_feature (507)..(507): n is a, c, g, or t
tcagtgatacgtctcacgaccggtgctcgatttagtagcatactgttgggtttgggggctctgagagaggacgcccagccctgggattttcaggtgttttcatttggtgatcaggactgaacagagagaactcaccatggagtctgggctgagctggcttcttcttgtggcttattttaaaaggtgtccagtgtgaggtgcatctattggagtctgggggagccctggtacaggccggggggtccctggacactctcctgtacagcctctggattcctacctttaacacctactgctattgagcgtggggtcccgcccagggcccccgagggggaacggggcgtcgggacttggggtccgcaggcccaagtttaggtggacaagtcgggaacgtaaaacacaatacttaacgcaagacctcggtaggaacgggtccgttacaccgtactttaccgagagactaatttacaagtaaccacgtctacgtatcttcgacaacgatagaanacgaccgtgaagacgaccgggtaagaccggacggaccggtattacgtacacgtcgtacggtaaccaaagtaacgtacgaaggaaacggggttaccgggttacgggggtaaacgtttaacgtaaagttaccgtttaaacc

SEQ ID NO: 81052 - DNA, 576 bp, Homo sapiens
  misc_feature: GYAE6OF02H3I1Z.9.37.D04.1.454.CMB.1.raw
  modified_base (155)..(155): a, c, t, g, unknown or other
  misc_feature (155)..(155): n is a, c, g, or t
  modified_base (167)..(167): a, c, t, g, unknown or other
  misc_feature (167)..(167): n is a, c, g, or t
  modified_base (179)..(179): a, c, t, g, unknown or other
  misc_feature (179)..(179): n is a, c, g, or t
  modified_base (187)..(187): a, c, t, g, unknown or other
  misc_feature (187)..(187): n is a, c, g, or t
  modified_base (202)..(202): a, c, t, g, unknown or other
  misc_feature (202)..(202): n is a, c, g, or t
  modified_base (250)..(250): a, c, t, g, unknown or other
  misc_feature (250)..(250): n is a, c, g, or t
  modified_base (256)..(256): a, c, t, g, unknown or other
  misc_feature (256)..(256): n is a, c, g, or t
  modified_base (365)..(365): a, c, t, g, unknown or other
  misc_feature (365)..(365): n is a, c, g, or t
  modified_base (440)..(440): a, c, t, g, unknown or other
  misc_feature (440)..(440): n is a, c, g, or t
  modified_base (522)..(522): a, c, t, g, unknown or other
  misc_feature (522)..(522): n is a, c, g, or t
  modified_base (535)..(535): a, c, t, g, unknown or other
  misc_feature (535)..(535): n is a, c, g, or t
  modified_base (541)..(541): a, c, t, g, unknown or other
  misc_feature (541)..(541): n is a, c, g, or t
tcagtgatacgtctcacgaccggtgctcgatttagtagcatactgttgggtttgggggctctgagagaggagcccagccctgggattttcaggtgttttcatttggtgatcaggactgaacagagagaactcaccatggagtctggctgagcggngcgtctacgtgngactagttaagngtcagtgngaggtgcatctatgngtctgggagcctggtacaggccggggggtcctagacactctcctgacncgcctntgattcaccttaacacctatgactgttgagtcgtcggtccgcgaccggcccgaggggaacgggcctggcgtgggtcacgagccaagttggagctaagcggaaccgaaanacgtaataacgtacgacagaccctaccggtaggaacggggtcccgttccacgtacttccgaagagacctaattanaacgactactcgtattactaccgtgatagagacaaacggcacctagacggacgaccgaacgtcgaacgtcgacttgtactcngtacgaacaagtnaaccgngttaaccggagggtcgtaagttaacaattgtaacc

SEQ ID NO: 81053 - DNA, 596 bp, Homo sapiens
  misc_feature: GYAE6OF02IMBP4.9.37.D04.1.454.CMB.1.raw
  modified_base (219)..(219): a, c, t, g, unknown or other
  misc_feature (219)..(219): n is a, c, g, or t
  modified_base (351)..(351): a, c, t, g, unknown or other
  misc_feature (351)..(351): n is a, c, g, or t
  modified_base (369)..(369): a, c, t, g, unknown or other
  misc_feature (369)..(369): n is a, c, g, or t
  modified_base (388)..(388): a, c, t, g, unknown or other
  misc_feature (388)..(388): n is a, c, g, or t
  modified_base (434)..(434): a, c, t, g, unknown or other
  misc_feature (434)..(434): n is a, c, g, or t
  modified_base (459)..(459): a, c, t, g, unknown or other
  misc_feature (459)..(459): n is a, c, g, or t
tcagtgatacgtctcacgaccggtgctcgatttagtagcatactgttgggtttgggtctgagagaggagcccagccctgggattttcaggtgttttcatttggtgatcaggactgaacagagagaactcaccatggagtctgggctgagctggcttcttcttgtggcttattttaaaaggtgtccagtgtgaggtgcatctattggagtcgtggggganccgtggtacaggccgggggggtccctgaccactctcctgtacagcctctggattcacctttaacacctatgcattgagctgggtccgccacggccccaggggaggggctgggactgggtcgcagccattagnggcaatggaacgaaaacncaatattacgcagactcgngaagggtcggttcaccgtattccagagaactaatttacaaagaacncgtctagtatctgacagatcgaacncgacctgacgaggccggaacgacgaccgggtcgtaactagtacacgttggtacgaaccgaaagacttacgaaggtaaacgggggtacgggtttaccgggggaaagtttaaaccgaaagtttacgttaccctttaacc

SEQ ID NO: 81054 - DNA, 695 bp, Homo sapiens
  misc_feature: GYAE6OF02F3YLY.9.37.D04.1.454.CMB.1.raw
  modified_base (418)..(418): a, c, t, g, unknown or other
  misc_feature (418)..(418): n is a, c, g, or t
tcagtgatacgtctcacgaccggtgctcgatttagtagcatactgttgggtttgggggctctgagagaggagcccagccctgggattttcaggtgttttcatttggtgatcaggactgaacagagagaactcaccatggagtctgggctgagcgtggcttcttcttgtggcttaagttttaaaggtgtccagtgtgaggtgcatctattggagtcgtgggggacgcccgtggtacgacgggcccgggggggtccctgacactctcctgtacacgcctctggtacttctaacctttaacctacctatgctattgacgcgtcgggtcccgccgaccggccccggacggggaacggggcggtcgggacgtcgggtcgcgacgccgtagttagtcggacaaggggggggggggggggggtanaacggaaaacaacaataacgttacgacacgacgtaccgtacggaacgggtaccggttacgtacctacttaccgaacgaacgtaactaattacaacgaacacgactagtactcgtgacgagatagaacgacgacgtagacgacggaccgaacggaaccgaccggaccgtaacgtactaccgtacgtacggtacgtaaccgaaacgtaacgtacgtaacggaacgggtaacggggttaaccggggttaacggttaaacgttaaacgttaacgttaaccg

SEQ ID NO: 81055 - DNA, 719 bp, Homo sapiens
  misc_feature: GYAE6OF02JB0IQ.9.37.D04.1.454.CMB.1.raw
  modified_base (372)..(372): a, c, t, g, unknown or other
  misc_feature (372)..(372): n is a, c, g, or t
tcagtgatacgtctcacgaccggtgctcgatttagtagcatactgttgggtttgggggctctgagagaggagcccagccctgggattttcaggtgttttcatttggtgatcaggactgaacagagagaactcaccatggagtctgggctgagcgtgtcgtctacgtgtggacttagtttaaaggtgtccagtgtgaggtgcatctattggacgtcgtgggggacgccctgggtacaggccggggggtccctgacactctcctgtacagtcctcgtggtattcctaacctttaacacctatgactattggacgtcgtgggtacccgccgtacgggcccccgagggggacgggcgtacgggtacgtggggtccncgacggtccctagtttacgggtacggacgtaagtcggaaccgaaaaacactaataacgttaccggctaaacgtacccgttccggtacgaaacgggggttcccgttacgtaaccgtacttttacccgacgtaacgtaaccgtaaacgtttacgaaacgtaaccgaaccggtaccgttagttacgtacgtacgtacgaacggtactaggaaaccacggtaccgtagacggacgaccggacgaaccgaccggaacgtacgtacgtcgtacgtacgtaaccgaccgaaagtacgtacgaacgtaacgggtaccgggttacggtaacgtaacgttaacgttacgtttaaccg

SEQ ID NO: 81056 - DNA, 657 bp, Homo sapiens
  misc_feature: GYAE6OF02HHXIL.9.37.D04.1.454.CMB.1.raw
  modified_base (222)..(222): a, c, t, g, unknown or other
  misc_feature (222)..(222): n is a, c, g, or t
  modified_base (589)..(589): a, c, t, g, unknown or other
  misc_feature (589)..(589): n is a, c, g, or t
tcagtgatacgtctcacgaccggtgctcgatttagtagcatactgttgggtttggggagctctgagagaggagcccagccctgggattttcaggtgttttcatttggtgatcaggactgaacagagagaactcaccatggagtctgggctgagctggcttcttcttgtggctattttaaaaggtgtccagtgtgaggtgcatctattggagtcgtggggganccctggtacaggccggggggtcctgacactctcctgtacagcctctggattcacctttaacacctatgcattgagcgtcgggtcccgccgacggccccgaggggaacggggcgtggacgtcgggtcgcacgcctaagttacgtggacaagtcggaaccgaaaacgactataacgttacgacaacggtaccgttaccggtagggaacgggggtcccgtttaccaacccgttacgttttacccgaaggtaacgtaaccgttaaattttaccgaaaaggtaaacctaccggtacttacggttaattaccgttgacgtagaacgtacgaacagccgtagacgtacgaccgacggaccacggtactacgtanacgtacgtggtacgacaagacgtacgaaggaacgggtagggttacggtaacgtttaacgaagttaacc

SEQ ID NO: 81057 - DNA, 605 bp, Homo sapiens
  misc_feature: GYAE6OF02I85HV.9.37.D04.1.454.CMB.1.raw
tcagtgatacgtctcacgaccggtgctcgatttagtagcatactgttgggtttgggggctctgagagaggagcccagccctgggattttcaggtgttttcatttggtgatcaggactgaacagagagaactcaccatggagtctgggctgagctggcttcttcttgtggctattttaaaggtgtccagtgtgaggtgcatctattggagtcgtgggggagccctggtacaggcccgggggggtccctgacactctcctgtacagcctctggattccacctttaacacctatgctattgagctggggtcccgccgacggcccccgaggggaacggggctgggacgtggggtcgcagccattaggtcggcaagtggacgaaaacacatagttacgcagactccgtagaacgggtccgtacacctatttccagagactaattcaagaacacgtctgttatcgtcgacagatagaacagaccgtagaacggacgaccggacggaaccgaccggtaccgtaatacgtactacgtgacgaaccaaagacgttacgaaggtaacgggtacggggtttacggggtaacgttaacgtaaacgttacgtttaacc

SEQ ID NO: 81058 - DNA, 658 bp, Homo sapiens
  misc_feature: GYAE6OF02GICLV.9.37.D04.1.454.CMB.1.raw
  modified_base (180)..(180): a, c, t, g, unknown or other
  misc_feature (180)..(180): n is a, c, g, or t
  modified_base (192)..(192): a, c, t, g, unknown or other
  misc_feature (192)..(192): n is a, c, g, or t
  modified_base (202)..(202): a, c, t, g, unknown or other
  misc_feature (202)..(202): n is a, c, g, or t
  modified_base (210)..(210): a, c, t, g, unknown or other
  misc_feature (210)..(210): n is a, c, g, or t
  modified_base (218)..(218): a, c, t, g, unknown or other
  misc_feature (218)..(218): n is a, c, g, or t
  modified_base (245)..(245): a, c, t, g, unknown or other
  misc_feature (245)..(245): n is a, c, g, or t
  modified_base (378)..(378): a, c, t, g, unknown or other
  misc_feature (378)..(378): n is a, c, g, or t
tcagtgatacgtctcacgaccggtgctcgatttagtagcatactgttgggtttgggggctctgagagaggagcccagccctgggattttcaggtgttttcatttggtgatcaggactgaacagagagaactcaccatggagtctgggctgagcggtcgtgtctagtcgcgatagttaagntcagtgtgagtncatctatgangtggggancctggtanaggccggggggtcctgacactctaccngtacagcctgtggacttcacctttaacacctatgactattgagcgtcggtccgccacggacccccgtaggggaaaggggccgtaggaccgtggggtcgacagccctataggtggacaagtgggacgaaaaacnaactatacggactagaactccggtgaacggggtaccgttacaaccgttacgtttaccaagggaacgtaactaaccttttaaacgaaacgtaacgaccgtacttagttacttacgtacgtacgtaacgtagtagaacgaacgacgtacgaacgaacgacggaacgaccgaccggtacgtacgtacgtacgtacgtacgtacgaacgaaacgtaacgtaacgtaacggtaacgggttaacgggtaacgggttaacggttaaacgtaaacgttaacgttaacg

SEQ ID NO: 81059 - DNA, 808 bp, Homo sapiens
  misc_feature: GYAE6OF02GHF4X.9.37.D04.1.454.CMB.1.raw
  modified_base (324)..(324): a, c, t, g, unknown or other
  misc_feature (324)..(324): n is a, c, g, or t
  modified_base (402)..(402): a, c, t, g, unknown or other
  misc_feature (402)..(402): n is a, c, g, or t
  modified_base (555)..(555): a, c, t, g, unknown or other
  misc_feature (555)..(555): n is a, c, g, or t
tcagtgatacgtctcacgaccggtgctcgatttagtagcatactgttgggtttgggggctctgagagaggagcccagcccctgggattttcaggtgttttcatttggtgatcaggactgaacagagagaactcaccatggagtctgggctgagctggcttcttcttgtggcttaattttaaaaggtgtccagtgtgaggtgcatctattggacgtcgtgggggacgccctggtacgaggcccggggggggtccctggacctaccgtctcctggtacacgtcctctggattcctaaccctttaaccaccttatcgactagttagngtccgtgggtcccgaccgacggccccggaaggggacggggtctcgggtacgtggggtccgcgacgcctaagttacggnggtacaagtggaaccgaaaacaccgattaacgtacgacgaacgtaaccgttccggagggtaaacgggtcccgtactaacccgttattttacccaggtaaacggaaccttaagtttaaccgaaaacggtaacccgaacgtcgttaacggttacnccgttagaccgtaaggtacgttacgaaaccgtaccgtcccggttaaggaaccgggacgggacccgggaaacggaacccggtacccgggtttaccgttaaagtaacccgttcccgaaacgtttacccgggtacggaaaaccccggtaaagttaacgtaacccggaaagggttaacccggggggtaaacccgggggtttttaccggggaaaacccgggttttaaacgtaaaaccgttttaacgttttaaaccccg

SEQ ID NO: 81060 - DNA, 798 bp, Homo sapiens
  misc_feature: GYAE6OF02HYLCY.9.37.D04.1.454.CMB.1.raw
  modified_base (221)..(221): a, c, t, g, unknown or other
  misc_feature (221)..(221): n is a, c, g, or t
  modified_base (338)..(338): a, c, t, g, unknown or other
  misc_feature (338)..(338): n is a, c, g, or t
tcagtgatacgtctcacgaccggtgctcgatttagtagcatactgttgggtttgggggctctgagagaggagcccagccctgggattttcaggtgttttcatttggtgatcaggactgaacagagagaactcaccatggagtctgggctgagctggcttcttctgtgcttagttttaaaggtgtccagtgtgaggtgcatctattggagtcgtgggggacnccctaggtacgagggtcccggggggtccctaggaccactcctccgttgtacacgtcctcgtggtaacttccgaacccttttaaacaccttatcgctagttgacgtcgtcgggtcccnccggtacgggcccccggaaggggacggggtccgtagggaccgttggggttccgcgtacggacctaggttacggtggacaaggtcgggaaacctaaaaccgcttaagtaacgttaaccggaacctacggtaacccttccgggtacgggaacggggtaccccggtttacgtaaccctacgttttaccgaaggtaacgtaacttaaacgtttaaccgaaaacgtaacccgaacggttacgtaacgttacgttacctacggtaccgaacgtaactacggaaacccggtacgtacccgttaagggaacggaccgaaccgggtaacgtaccggaacccgggtaacgttaacgtacgtaccgtacgttacggaacgaacccgtaagggtaacctaacggaaagggaacgggttaaccggggttaaccgggtaaacggttaaacgttaaccggttaactttaaacccg

SEQ ID NO: 81061 - DNA, 704 bp, Homo sapiens
  misc_feature: GYAE6OF02HH8FG.9.37.D04.1.454.CMB.1.raw
  modified_base (184)..(184): a, c, t, g, unknown or other
  misc_feature (184)..(184): n is a, c, g, or t
  modified_base (261)..(261): a, c, t, g, unknown or other
  misc_feature (261)..(261): n is a, c, g, or t
  modified_base (419)..(419): a, c, t, g, unknown or other
  misc_feature (419)..(419): n is a, c, g, or t
tcagtgatacgtctcacgaccggtgctcgatttagtagcatactgttgggtttgggggctctgagagaggagcccagccctgggattttcaggtgttttcatttggtgatcaggactgaacagagagaactcaccatggagtctgggctgagcggtgtcgtctagtcgtcgattaagttaagtntcgagtgtgaggtgcatctagttggagtcgtgggggactccgttggtacgacggccggggggtccctgacctactcncctgtacacggcctctggactcctacctttaacaccttatcactattcggacgtcgttcggggtccgaccgaccggccccggaggggaacgggcgtaccgggtgtcgggtcgcgagccgtaagttcggtacggactaacgtgggaaccaaaccgtaanacgtaagttcgacgaagccgtacggtaggaacgggttcccgtactaactcggttacccaagacgtaactaaacttacgaaacgtaacacgccgtagttaactcgtcgaactcgtagtaagtactaacggccgtaggaaccggtcgaaccgggaaacccggtacggtaaccggtacgtacgttaacgtcgtaaaccggttgcccgtaaccgtaaaggtacgtaaccggaagggtacggggtaacggggttagtaaaacgggtttactaaaccggttatttaacccg

SEQ ID NO: 81062 - DNA, 788 bp, Homo sapiens
  misc_feature: GYAE6OF02HL28T.9.37.D04.1.454.CMB.1.raw
  modified_base (272)..(272): a, c, t, g, unknown or other
  misc_feature (272)..(272): n is a, c, g, or t
  modified_base (279)..(279): a, c, t, g, unknown or other
  misc_feature (279)..(279): n is a, c, g, or t
tcagtgatacgtctcacgaccggtgctcgatttagtagcatactgttgggtttggggagctctgagagaggagcccagccctgggattttcaggtgttttcatttggtgatcaggactgaacagagagaactcaccatggagtcgtgggctgagcgtggcttcttcttgtggtctatttaaaaggtgtccagtgtgagtgcatctagttggagtcgtgggggacgcccgtggtacgagggccgggggggtccctggaccactctcctgtacncgccttntggtacttcctaacctttaacacccttatgactagttgagtcgtaccggggtccccgccggaccggtacccccggaagggggaacggggtaccgttcggggaccggttgggggtaccgaccgacggtacccgtaagtttaggtacggacctaaggtacgggaaaccgaaaaacctacgtaaagtttaacgttaaccggacccgtaacgtaacccggtaccgggtaaggggtaacccggggttacccggtttaccctaacccggttacgtttacccgaacgtaaacggtaaccttaaacgtttaacgaaacgtaacctaacggtcttaacgttacgtccgtagactaggtaactacgaaaccgcggtcgtagggacgacggtacccggaacggtaaccggaccgggttcctaagtacgtaccttaggtcgaccgtaacgaaacggtcgtaacggtaacggggtaacgggttacggggttacggggtaaccttaagtaaacgttttaaccg

SEQ ID NO: 81063 - DNA, 924 bp, Homo sapiens
  misc_feature: GYAE6OF02HGAEG.9.37.D04.1.454.CMB.1.raw
tcagtgatacgtctcacgaccggtgctcgatttagtagcatactgttgggtttgggggctctgagagaggagcccagcccctgggattttcaggtgttttcatttggtgatcaggactgaacagagagaactcaccatggagtctgggctggagcgtggcttcttcttgtggcttaattttaaaggtgtccagtgtgaggtgcatctagttggagtcggtgggggacgcccgtggtaccgacgggccggggggtcctgaccgtactcctcctacgtacgacgccttcgtggtacttacctaaccctttaaaccacccttaatcgacttaagtttggacggtaccggtttccgggggacccccgtacccggaaccggggaccccccggaaggggggaacgggggtccggttacggggaaccggttacgggggtacccggaccgtacggtacccgttaaggttaagggtacgggtaaccgtaaagggttaccggggaaaaccgtaaaaaaccctaacgtaaaccgtttaaacggtttaacccggaccgtaaaaccggtacccgttacccgggttaacggggtaaacccgggggtttaccccggtttacccgtaaacccgtttaaccgttttacccgaaagggtaaccgttaaaaccgtttaaaaccgtttaaaccgaaaaccggtaaacccgtaacccgggtaccgttaaggttaaccttacgaccggtaaccgtagtaaaccgtaggaaaccgtacgtaccgtacggacgaccgggtaaccggaaccggtaaccggtaccggtaacgttaacgtacgttaccgtaacgttacggtacccgaaacgtaaagtaccgtaacggaacgggtaacgggttacggggttaaccgggttaacgttaaaccgttaagttaacctttaacccg

SEQ ID NO: 81064 - DNA, 665 bp, Homo sapiens
  misc_feature: GYAE6OF02INWLH.9.37.D04.1.454.CMB.1.raw
  modified_base (236)..(236): a, c, t, g, unknown or other
  misc_feature (236)..(236): n is a, c, g, or t
  modified_base (404)..(404): a, c, t, g, unknown or other
  misc_feature (404)..(404): n is a, c, g, or t
  modified_base (409)..(409): a, c, t, g, unknown or other
  misc_feature (409)..(409): n is a, c, g, or t
  modified_base (421)..(421): a, c, t, g, unknown or other
  misc_feature (421)..(421): n is a, c, g, or t
  modified_base (530)..(530): a, c, t, g, unknown or other
  misc_feature (530)..(530): n is a, c, g, or t
  modified_base (539)..(539): a, c, t, g, unknown or other
  misc_feature (539)..(539): n is a, c, g, or t
tcagtgatacgtctcacgaccggtgctcgatttagtagcatactgttgggtttgggggctctgagagaggagcccagccctgggattttcaggtgttttcatttggtgatcaggactgaacagagagaactcaccatggagtctgggctgagctggctttcttcgttgtggtcttaagtttttaaaaaggtgtacctagtagtgtaggtgcatcttaattggtagtcgtgggggancccgtaggtaccgagggcccggggggtccctcggactacgttcctcctagtacacgtccgttccgtggtatttccgtaaacctttaaccaccttaacgtgcctattagtacgaccgtgggtacccgccgaacgggccccgaggggaacgggctaggacgttgggtccncgacnccgtagttaggngaccaagtcggaacaaaagacattacgtacgactagactcggtacgaacggtccgttacaccgtattaccagtagaactaattaacaagtaacacgtacgtagtactancgaacaganagacacgtactacgagacgacgacgtacgacgtacgtatacgtacctagtacgtaacgacaaagtacgtaagtaaggaacggtaacgggttacgggtaacgttaaaccgtaagttaagttaacccg

SEQ ID NO: 81065 - DNA, 715 bp, Homo sapiens
  misc_feature: GYAE6OF02G7TT3.9.37.D04.1.454.CMB.1.raw
  modified_base (167)..(167): a, c, t, g, unknown or other
  misc_feature (167)..(167): n is a, c, g, or t
  modified_base (226)..(226): a, c, t, g, unknown or other
  misc_feature (226)..(226): n is a, c, g, or t
  modified_base (269)..(269): a, c, t, g, unknown or other
  misc_feature (269)..(269): n is a, c, g, or t
  modified_base (306)..(306): a, c, t, g, unknown or other
  misc_feature (306)..(306): n is a, c, g, or t
  modified_base (374)..(374): a, c, t, g, unknown or other
  misc_feature (374)..(374): n is a, c, g, or t
tcagtgatacgtctcacgaccggtgctcgatttagtagcatactgttgggtttgggggctctgagagaggagcccagccctgggattttcaggtgttttcatttggtgatcaggactgaacagagagaactcaccatggagtcgtgggctgagcgtgcgtctcgtgngatatttaagtgtcagtgtgagtgcatctattggagtcgtgggggagtccctggtacgnggcccgggggggtccctggaccactcctcgtgtacagcccgtntggtacttcctaccttttaaccaccttatgctattgngcgttcgggcccgccgacggccccgagggggacgggcgtggacgtcggtcgcagtccaattcggtagngaagtcggaacgtaaaaccactaagttaacgttaccgatacggtacgtcccggtaagggtaaccggggttacccggttaccacccttaacgttttaccccgaaagggttaaccgaaactttaaacgttttacccgaaaacgaaacccggttacggaacctttagttaaccgttccttcgggaccttaagacgtttacgaacgtaaccgcgaaggtacggacgaccggacgtaaccgacccgggtataacgttctaccctgtaccgtcgaaccaaagtacgttaacgacggtaaggggttaccggttcggggtaacttaacgttaaacgttacttttacccg

SEQ ID NO: 81066 - DNA, 777 bp, Homo sapiens
  misc_feature: GYAE6OF02F6ZNW.9.37.D04.1.454.CMB.1.raw
  modified_base (170)..(170): a, c, t, g, unknown or other
  misc_feature (170)..(170): n is a, c, g, or t
  modified_base (617)..(617): a, c, t, g, unknown or other
  misc_feature (617)..(617): n is a, c, g, or t
tcagtgatacgtctcacgaccggtgctcgatttagtagcatactgttggggtttgggggctctgagagaggagcccagccctgggattttcaggtgttttcatttggtgatcaggactgaacagagagaactcaccatggagtctgggctgagctggtccttcttcttgnggcttaagttttaaaaggtgtccagtgtgaggtgcatctattggagtcgtggggacgcctggtacgacgggcccgggggggtcctggaccactcctccgtgtacagtccctcgtgtacttcctacctttaacacctatgctagttagacgcgttcgggtccgccgacggccccggtaagggggaacggggccgttagggaccgttggggtaccgacggacgtaccgtaacgttgggtacggacgtaaagtcgggaaaccgtaaaacacgtaagttaacgttaaccgacgtaacggtaaccgttacccgggtaggggtaaccgggggtcccgttaacccgtacccttaaacgtttcccgaaaggtaccgtaaactaaacgtttacgaaaaccgtaaaccgtaccggtaccgtagtttacaccgttgaacgaaggacctacggaaaccncggtacgtagaacgggaccgtaccgggaaggaacccgtaccgggcctttaaggtcctacgaaccgttgggtaacccgaaacttaacggtacgtacggaaacgggtacgggggttaaccgggttaaccgggtaattaaacctaaacgttttccgtaaaccc

SEQ ID NO: 81067 - DNA, 781 bp, Homo sapiens
  misc_feature: GYAE6OF02I6207.9.37.D04.1.454.CMB.1.raw
tcagtgatacgtctcacgaccggtgctcgatttagtagcatactgttgggtttgggggctctgagagaggagcccagccctgggattttcaggttgttttcatttggtgatcaggactgaacagagagaactcaaccatggagtcgtgggctgagcgtggcttcttcttgtggacttaagttttaaaggtgtccagtgtgagtgcatctattggagtcggtgggggacgcccgtggtacgacgggcccggggggtacctgacctactctccgtgtacacgtcctacgtggtacttcctaaacctttaacaccttatgactagttgagtcgtcgggtcccgaccgaccggtaccccggaagggggacgggtcgtacgggaccggttcgggaccgtcgacggtcccgtaagttacggcggtaactaaggtacgggtaaaccgaaaaacctaccgtaattaacgtaacgaccgtaacggtacccgttaccgggtaacgggtaaaccgggggttcccgtttaacccgtaacccgtttaacgtttaacccgaaggtaaaccgtaacttaaacgtttaccgaaaacgtaacctaccggtcttacggtaacgttcgacgaacgtaagaacgtaacggaaacctgtacccgtaggaacgtacggaaccgtacggaaccgtaccggtaacttacgtacttacgtaacgtcgaaccgtaaaccgtaaagtaacgtaaccgaagggtaacgggtacgggttaccggtaaattaacgtaacttaacttaaccg

SEQ ID NO: 81068 - DNA, 864 bp, Homo sapiens
  misc_feature: GYAE6OF02JP7FB.9.37.D04.1.454.CMB.1.raw
  modified_base (276)..(276): a, c, t, g, unknown or other
  misc_feature (276)..(276): n is a, c, g, or t
  modified_base (484)..(484): a, c, t, g, unknown or other
  misc_feature (484)..(484): n is a, c, g, or t
tcagtgatacgtctcacgaccggtgctcgatttagtagcatactgttgggtttgggggctctgagagaggagcccagccctgggattttcaggtgttttcatttggtgatcaggactgaacagagagaactcaccatggagtctgggctgagctggtcttcttcttgtggctaattttaaaggtgtccagtgtgaggtgcatctattggtagtcgtgggggacgcccgtggtaccgacgggccgggggggtccctggaccacgtctccgtgtaacngcctacgtggacttacctacctttaaacaccctaagtcgctatttcggattccggttacgggggtccccaccgtaaccgggaccccgtaaagggggtaccgggggtacttgggtaaccggttgggggtaccccgtacggaacggtaccccgtaagtttaacggtacgggtaccgtaaagtcggggtaaaacccgtaaaaaacccgtanaaaccgttttaacgtttaacccgggaccgtaaacggttaacccttaccccggggtacggggaaaaccggggttcccccgtttaaacgtacccgttaacgttttacccggaaagtaaccgtaaacgtaaacttttaacccgaaaacggtaaacccgtaccgtacgttaacggttacgttaccgttacggaacgtaagtaaccggtaagaaacccgtacgtacccgtaggaccggtaacggaccgggtaaacgacccggtaaccggacgttaacagttaccgtacgttaccgtaaccggaccttaaaaggacccttacgaacgggtaaccgggttaacgggttaacccgggtaagtttaaaccaacgttttaaccgttaacc

SEQ ID NO: 81069 - DNA, 655 bp, Homo sapiens
  misc_feature: GYAE6OF02G34YL.9.37.D04.1.454.CMB.1.raw
  modified_base (433)..(433): a, c, t, g, unknown or other
  misc_feature (433)..(433): n is a, c, g, or t
  modified_base (448)..(448): a, c, t, g, unknown or other
  misc_feature (448)..(448): n is a, c, g, or t
tcagtgatacgtctcacgaccggtgctcgatttagtagcatactgttgggtttgggtgtacacctgtggttctcggggctgccctttggctttggagatggttttctcgatgggggctgggagggctttgttggagaccttgcacttgtactccttgccattcagccagccctggtacagccgggggggtccctgacactctcctgtacagcctctggattcacctttaacacctatgctattgagtcctgggtcccgaccgacgggcccccgagggggaacggggctgggacttgggggtccgcgaggccctagttaaggtcggactaagtgggaccggaaaaacacaattacttacgcacgacctcggagaacgggtccgtacacctattccagaacgtactaagtttacaaagtaacacgctagtatcgngacagatacgaaacngcctagagacgcgaaggacgacggcgtatacgtcgactgtcgaacaagtactcgaagacgggtacggtacgggaacgttaacaagttacttactacttactattagtaagtacgttaggtacgtacggtcggggccgtaacgggaccgtaccggtacgtacccgttcctaccgtcgtacccgtacccgtacccgaccgtaacccggg

SEQ ID NO: 81070 - DNA, 786 bp, Homo sapiens
  misc_feature: GYAE6OF02JDHOR.9.37.D04.1.454.CMB.1.raw
  modified_base (156)..(156): a, c, t, g, unknown or other
  misc_feature (156)..(156): n is a, c, g, or t
  modified_base (633)..(633): a, c, t, g, unknown or other
  misc_feature (633)..(633): n is a, c, g, or t
  modified_base (678)..(678): a, c, t, g, unknown or other
  misc_feature (678)..(678): n is a, c, g, or t
  modified_base (773)..(773): a, c, t, g, unknown or other
  misc_feature (773)..(773): n is a, c, g, or t
tcagtgatacgtctcacgaccggtgctcgatttagtagcatactgttgggtttgggggctctgagagaggagcccagccctgggatttcaggtgtttcatttggtgatcaggactgaacagagagactcacatggagtctggctgagcgtggcttntctgtgctatttaaggtgtcagtgtgaggtgctatctatggagtcgtggggagcccgtaggtacgagggtcccgggggggttcctcgacgtacctcgtaccgtgtacacggtccttcgtcggttacttaccgttaaccgtttaactaccttcgtacgtacgttacgttacgtacggtcggttcgggtccccggtaaccggtacccgggaccccgggttaaagggggaaacggggtcccgtaggggttacccggtacgggggtacgtaccggtaccggtaccgttaggttaacgggtccggtaacgtaaaggttacgggaaacaaaaccgtaataacgtacgtacgacgtaaacgtccgtacgggtacgtacggggtacgttccaacgttacgttccaacggtagaacttaaacttacgaacgaactacgtccgttatacgtcttcgacttagggacttaaccgaagtcgtaaccggngaaccggacgtaccggaacggtaaccgttacgggtaccctttaanaccgtaccgtcggtaacggtaccgtaacgtaaactaccggcggtaaagggaaccgggtttacgggttaaggtaaccgtttaaacgtaaaccgttntttaaaccccggg

SEQ ID NO: 81071 - DNA, 203 bp, Homo sapiens
  misc_feature: GYAE6OF02FRBM5.9.37.D04.1.454.CMB.1.raw
  modified_base (191)..(203): a, c, t, g, unknown or other
  misc_feature (191)..(203): n is a, c, g, or t
tcagtgatacgtctcacgaccggtgctcgatttagtagcatactgttgggtttgggatagtggtactgatcattgggtgttcggcggagggaccaagctgaccgtcctaggtcagcccaaggctgccccctggtcactctgttcccaccctcctcagacgtatcactgagcgggctggcaaggcgcatagnnnnnnnnnnnnn

SEQ ID NO: 81072 - DNA, 701 bp, Homo sapiens
  misc_feature: GYAE6OF02IENL3.9.37.D04.1.454.CMB.1.raw
  modified_base (223)..(223): a, c, t, g, unknown or other
  misc_feature (223)..(223): n is a, c, g, or t
tcagtgatacgtctcacgaccggtgctcgatttagtagcatactgttgggtttgggggctctgagagaggagcccagccctgggattttcaggtgttttcatttggtgatcaggactgaacagagagaactcaccatggagtctgggctgagctggcttcttcttgtggtcttaattttaaaggtgtcctagtgtgaggtgcatctattggagtcgtgggganccgtggtacgagggcccggggggtcctggacactcctctgtacagtcctcgtggacttcctaccttttaacaccttatgtacctagttggacgtcgttcggggtcccgaccgaccgggtccccgaagggggacgggtcgtacgggtacggtggggtaccgcgacgtccctaaggttacgggtacgacgtaagtcgggaaccggtaaaactacgtaattaacgttacgacaacgtaccgttaccgggtaggtaaccggggtccggtttaaccaccgttagtttaccgaagtacgaacttagtttacgaaacgtacacggtacttacgtaactcgtgaccagtacaacgtacacgtcgtagagtacggacgacgacggtacgccgtaagtctacgtacgttcgactaaccgtagtacgtacggtaagggtacgggtacggggttaaccgggaacgtttaacgtaacgttatttaacccgg

SEQ ID NO: 81073 - DNA, 821 bp, Homo sapiens
  misc_feature: GYAE6OF02IUG8X.9.37.D04.1.454.CMB.1.raw
  modified_base (140)..(140): a, c, t, g, unknown or other
  misc_feature (140)..(140): n is a, c, g, or t
  modified_base (187)..(187): a, c, t, g, unknown or other
  misc_feature (187)..(187): n is a, c, g, or t
  modified_base (203)..(203): a, c, t, g, unknown or other
  misc_feature (203)..(203): n is a, c, g, or t
  modified_base (225)..(225): a, c, t, g, unknown or other
  misc_feature (225)..(225): n is a, c, g, or t
tcagtgatacgtctcacgaccggtgctcgatttagtagcatactgttgggtttgggggctctgagagaggagcccagccctgggattttcaggtgttttcatttggtgatcaggactgaacagagagaactcaccatggngtctgggctgagctggcttcttcgttgtggtcttaattttaaaaggngtcctagtgtgaggtncatctatggagtcgtggggacncccgtggtacgacgggccgggggtcctagactacctctccgtcgtacacgtcctcgtggtacttcccgtaaccttttaaccgaccttagtacgactagttacggacggtccgtccggggtcccggaccgtaccggggacccccggaaggggggtaaccggggtcgtacgggtacggtcgggtaccgaccgtacgtaccgttaggttacgggtacggtacaaggtaacgggaaaccaaaacggtactaacgttaacgtaccggactaacgtacccgtcggtaaggacgggttaccgtacctacccgtctttaccgaacgtaacgtaacttaacgttaccgaaacgtaaccgtaccgtacttaccgggttaacttaccggtacgtacgtaacgtaacgtaacgaaaccgttaccggtacgtaccgggaacgggtaaccggacccggggtacgtaaacccggtaaccgggtaacgttaaccgttaacgtacccgtaacggttaccggtaacgtaaccgtaaacggtacgtaaccgggtaacggttaacggggtaccgggttaacgggttaaccgttaacttaacgttaacgttaacccg

SEQ ID NO: 81074 - DNA, 891 bp, Homo sapiens
  misc_feature: GYAE6OF02JSUW7.9.37.D04.1.454.CMB.1.raw
tcagtgatacgtctcacgaccggtgctcgatttagtagcatactgttgggtttgggggctctgagagaggagcccagccctgggattttcaggtgttttcatttggtgatcaggactgaacagagagaactcacatggagtctgggctgagctggtcttcttcttgtggtcttaagttttaaaggtgtccagtgtgaggtgctatcttagttgggagtcggtagggggcgcccgtcggtacgtacgggccgggggggtccctacgaccacttcctaccgttggtaccacgtccctcgtacggtattaccgtaacccttttaacaaccttaatcggtctagttacggtacggccggtcggggtccccgcccgaaccggggcccccggaaggggggtaacgggggtctaccggggtactcgggggtccggccgacggtcgttaacggttaggtgggtaacctaaggtacggtaaacggaaaaacctaacgtaaagttaacgtaacgtacgaacgggtaccctaccggggtacgggtaaaccgggtaccgttacccgtaaccgttacgtttaaccggaacgttaacgtaaaccgttaacgttaaaccgtaaacgggtaaaccaaccgttacgttaacggttaacgttactaccgggtaacgtaaacgtaacgttaacggaaacgtacccggtaaccgttaacgggaacgggtaacccggaccgggtaaacgggaaacccgtacccgggtaaaccgttaacgttaccgttactaaccggtttacgggtaaccgaaccggttaaaggtaacgtaacccggggtaagggttaacggggttaacccgggtaagggggtttaaaccgttaaaccggttaacggtttaaacttaaccggg

SEQ ID NO: 81075 - DNA, 727 bp, Homo sapiens
  misc_feature: GYAE6OF02G14Y1.9.37.D04.1.454.CMB.1.raw
  modified_base (200)..(200): a, c, t, g, unknown or other
  misc_feature (200)..(200): n is a, c, g, or t
  modified_base (332)..(332): a, c, t, g, unknown or other
  misc_feature (332)..(332): n is a, c, g, or t
  modified_base (373)..(373): a, c, t, g, unknown or other
  misc_feature (373)..(373): n is a, c, g, or t
tcagtgatacgtctcacgaccggtgctcgatttagtagcatactgttgggtttgggggctctgagagaggagcccagccctgggattttcaggtgttttcatttggtgatcaggactgaacagagagaactcacatggagtcgtgggctgagctggcttcttcttgtggcttagtttaaaaggtcgtccagtgtgaggtncatctagttggagtcgtgggggacgcccgtggtacgacgggtccggggggtccctaggaccactcctacctgtacacgccttgtggtattccgaacctttaacaccttatcgctattggagtcgtgggtccnccgacggccccgaggggacgggcgtcgggacgtcgggtccncgacgtcctaacgttaggtacggtacaagtacggaacgtaaaacacgtaattaacgtacgacctaggtaccgtcgggtaagggaaccgggttcccggttacctaaccgttacgtttaccgaaaggtaacgtaacttaacgtttaacgaaacgtaaccgtaacgtccgttaagtacttacgtacgtacgagtacgtaaacgaacgtacggtccgtaggaacgcgggtaaccgaccggtaaccgaccggtaccgttaagtactacgtacgtacggtaaccaacgtaaacgtcgaacggtaagggaacgggttaccgggttacgggttaaaggttaacgtaacgttaagttaacccg

SEQ ID NO: 81076 - DNA, 571 bp, Homo sapiens
  misc_feature: GYAE6OF01DHJ33.34.5.A05.1.454.CMB.1.raw
  modified_base (165)..(165): a, c, t, g, unknown or other
  misc_feature (165)..(165): n is a, c, g, or t
  modified_base (235)..(235): a, c, t, g, unknown or other
  misc_feature (235)..(235): n is a, c, g, or t
  modified_base (326)..(326): a, c, t, g, unknown or other
  misc_feature (326)..(326): n is a, c, g, or t
  modified_base (405)..(405): a, c, t, g, unknown or other
  misc_feature (405)..(405): n is a, c, g, or t
  modified_base (414)..(414): a, c, t, g, unknown or other
  misc_feature (414)..(414): n is a, c, g, or t
  modified_base (424)..(424): a, c, t, g, unknown or other
  misc_feature (424)..(424): n is a, c, g, or t
tcagtacacgtgatcacgaccggtgctcgatttagatagatagacagggggggatcagtcctggtggtagctcaggaagcagagcctggagcatctccactatggcctgggctccactacttctcaccctctcgctcactgcacaggttctgggcctagttttangctgactcacgccccatctgtgtcggagtcgtaccggggaagacggtgaaccatcctccgtgccacccgnagcagtgcagcattaccaacaactatgtgcagtcggaaccaacgacgcggcccgggcacgttacccccaatactctagatctaataaaggnactacaaacgacccgtgtcgggtccctgacttcggttctcgtggtccatcgacacgctcccgaccactctcgccctccncactactcncgtcgactanaacgtctggaaggacgaggtctagactattcgtacgcgtagtcttaacgattaggacgactaagtattcggtcggttacggtccgggacgggtaacgggaccaacggtcgtacggtacccgttggacgtccgaacgccccgtaaacg

SEQ ID NO: 81077 - DNA, 507 bp, Homo sapiens
  misc_feature: GYAE6OF01E58UM.34.5.A05.1.454.CMB.1.raw
  modified_base (457)..(457): a, c, t, g, unknown or other
  misc_feature (457)..(457): n is a, c, g, or t
  modified_base (468)..(468): a, c, t, g, unknown or other
  misc_feature (468)..(468): n is a, c, g, or t
tcagtacacgtgatcacgaccggtgctcgatttagatagatagacagggggagaagggctggtgggatcagtcctggtggtagctcaggaagcagaacctggagcatctccactatggcctgggctccactacttctcaccctcctcgctcactgcacaggttcttgggccagttttatgctgactcagccccactctgtgtcggagtctccggggaagacggtgaccatctcctgcacccgcagcagtggcagcattaccaacaactatgtgcagtggtaccaacagcgcccgggcacgttccccaatactctgatctataaaggtgatcaaagaccctctcggggtccctgatcggttctcgtgggtccatcgacagctccgccaactctcgccctccctcactatctctgactcaagctgaggacgaggctagactattactgtcagtctacgntgtagcaagtntgtggtcgttcggcggaggaccaagctcgcgtcgtacgg

SEQ ID NO: 81078 - DNA, 719 bp, Homo sapiens
  misc_feature: GYAE6OF01EXHS9.34.5.A05.1.454.CMB.1.raw
  modified_base (212)..(212): a, c, t, g, unknown or other
  misc_feature (212)..(212): n is a, c, g, or t
  modified_base (283)..(283): a, c, t, g, unknown or other
  misc_feature (283)..(283): n is a, c, g, or t
tcagtacacgtgatcacgaccggtgctcgatttagatagatagacaggggaggataacggccgtagacacgatggagaagggcctggtggatcagtcctggtggtagctcgagggaagcgagagcctggtagtcgatctccactatggacctgggctcccactacctctcaccctcctcgctcactgcactaggttcttgggccagttttangctggacctcagccccatcgtgtcgtcggagtcgtccggggaagtcggtgaccatccttcctgccacccgnagtcagtggcaggcctagttacggccggtctagtgtgcgagtggtaccagcgacgccggacccgggtactccgttcccccaacctaccgtacacgtccgtgaaacggaccaacgtagaaaccggcccttcgtacggggtcccctaggtacgttccggttcctccgtcggccttaccgactaccgacctaccgtaccctaccgtaactttcgtaccgtacccttaccccgtaacgtacttccgttcgtaccggtaaccgttacggaaccggtaccttacgggtaacgggtaccggacggtccgtacggtaaacccgttaacgtaaccgtttcgggtacctacggttttccggttttcgggaccggggtacgtaacccgttaccggtttaccgttacggggtttcggggtttccgggttccgggggtaaccccggggg

SEQ ID NO: 81079 - DNA, 552 bp, Homo sapiens
  misc_feature: GYAE6OF01EFLGM.34.5.A05.1.454.CMB.1.raw
  modified_base (243)..(243): a, c, t, g, unknown or other
  misc_feature (243)..(243): n is a, c, g, or t
  modified_base (491)..(491): a, c, t, g, unknown or other
  misc_feature (491)..(491): n is a, c, g, or t
tcagtacacgtgatcacgaccggtgctcgatttagatagatagacagggggagaagggctggtgggatcagtcctggtggtagctcaggaagcagaacctggagcatctccactatggcctgggctccactacttctcaccctcctcgctcactgcacaggttcttgggccagttttatgctgactcagccccatctgtgtcggagtctccgggggaagacggtgaccatctcctgcacccgnagcagtggcagcattaccaacaactatgtgcagtcggtaaccaacaggccggcccggggcacgttcccccaatactctgatctaagtaaaggtgaactacaaaacgccccttcgtcggggtccctgacgttcggttctcgtcgggtccatcgacacgcctccgccaactctcgccctccctcactatcctctgactcaagactgacggacgaggctagacttattactgtacagttctacgatggtanacgtaagttatggttcggtcgttcgggcgggaaggtaccaagtcgtcggtccgtcgtacgg

SEQ ID NO: 81080 - DNA, 567 bp, Homo sapiens
  misc_feature: GYAE6OF01C5IR6.34.5.A05.1.454.CMB.1.raw
  modified_base (166)..(166): a, c, t, g, unknown or other
  misc_feature (166)..(166): n is a, c, g, or t
  modified_base (205)..(205): a, c, t, g, unknown or other
  misc_feature (205)..(205): n is a, c, g, or t
  modified_base (229)..(229): a, c, t, g, unknown or other
  misc_feature (229)..(229): n is a, c, g, or t
tcagtacacgtgatcacgaccggtgctcgatttagatagatagacagggggggatcagtcctggtggtagctcaggaagcagagcctggagcatctccactatggcctgggctccactacttctcaccctcctcgctcactgcacaggttcttgggccagttttangctgactcagccccatctgtgtcggagtctccggggaanacggtgaccatctcctgccaccgnagcagtggcagcattaccaacaactatgtgcagtcggtaccaacacgccgcccgggctacgttaccccaatactctagactctaataaaggtgatacaaacgccctcgtcgggtcctgacttcggttctcgtcggtccagtcgacacgcctccgaccactcctcgccctccctacacttactctctacggactacgaagtacgtaggacgggacgaggtctaggtacctttaattaccgtgtaccgtgttacgttacgagttcggtagctaagttgtcggttcggtcgttcgggacggaggaccacgtcgcgtaccgtacgtaggtccagccctaacg

SEQ ID NO: 81081 - DNA, 677 bp, Homo sapiens
  misc_feature: GYAE6OF01DKP3X.34.5.A05.1.454.CMB.1.raw
  modified_base (293)..(293): a, c, t, g, unknown or other
  misc_feature (293)..(293): n is a, c, g, or t
tcagtacacgtgatcacgaccggtgctcgatttagatagatagacagggggaggatacgcgtgacagatgagaagggctggtgggatcagtcctggtggtagctcaggaagcagagcctggagcatctccactatggcctgggctccactacttctcaccctcctcgctcactgcacaggttcttgggcctagttttatgctgactcacgcccactctgtgtcggagtcgtccggggaagcggtcgaccatctcctcgccacccgcagcagtggcagcaataccaacaactangtgcagtcgtaaccaacacgccggcccgggctaccgttaccccaattacctctagtactaccttaaagtaaacggtcgtaactaacgaaaaccgtaccccgttacggttaccggggtccctaggtacgttccgggttctcggtcggggtccacgtccgaactacggcccttcccgaccctaaccgttccgtacccgtccccttacccgtactaaccttcctccgttccgtaacgggacccttaacggaaccgtacgtacggtaacgggtacgaacggtccgttagtaaccttacgttaacgttcggttacgtaacgtttccgttaaacggagtttacgggtaacgtaccggttaaagttccgttgggttacgggtttacccggg

SEQ ID NO: 81082 - DNA, 673 bp, Homo sapiens
  misc_feature: GYAE6OF01CHLIQ.34.5.A05.1.454.CMB.1.raw
  modified_base (251)..(251): a, c, t, g, unknown or other
  misc_feature (251)..(251): n is a, c, g, or t
tcagtacacgtgatcacgaccggtgctcgatttagatagatagacagggggggatcagtcctggtggtagctcaggaagcagagcctggagcatctccactatggcctgggctccactacttctcaccctcctcgctcactgcacaggttcttgggccagttttatgctgactcagccccatctgtgtcggagtctccggggaagacggtgaccatctcctgccacccgcagcagtggcagcattaccaanaactatgtgcagtggtaccaacagccggcccgggcaccgttcccccaatactctgacttactaagtaaaaggtgaacttaccgaaaacgtaccctcgtcgggggtacccctaggtacgttcgggttactcggtcgggtacccagtccgacacgtccttacccgacctaacttcgtacgtcccctccctactaacgttacttccgttaccgtcggtaacctacgaacgtcgttacggaacggtacgtacggtctaacgtacttaacgtttactcgtcgtaacgttcgttaaaccgtagttcggtaacgaccgttaaagtcgttagggttcggttaccggttccggggaacgggtacgggtaacccaaacgggtccgttacggaccccggttacgtacggtacctaaccggaccccgtaaacgg

SEQ ID NO: 81083 - DNA, 749 bp, Homo sapiens
  misc_feature: GYAE6OF01EKLB4.34.5.A05.1.454.CMB.1.raw
  modified_base (168)..(168): a, c, t, g, unknown or other
  misc_feature (168)..(168): n is a, c, g, or t
  modified_base (208)..(208): a, c, t, g, unknown or other
  misc_feature (208)..(208): n is a, c, g, or t
tcagtacacgtgatcacgaccggtgctcgatttagatagatagacagggggggatcagtcctggtggtagctcaggaagcagagcctggagcatctccactatggcctgggctccactacttctcaccctcctcgctcactgcacaggttcttgggcctagtttttangctgactcagccccatctgtgtcggagtcgtccggggaanacggtgaccatcctcctgccacccgcagcaggtggcagcattaccaacaactatgtgcagtcggtaaccaacgacgccgcccgggctaccggttacccccaatacctccgttagacttactaagtaaaggtgtaactaacaaaacggtccccgttacgtcggggtcccctagtacgttccggttcttcggtcggtcctaagtccgaccgacgtcctcccgtacccaacttcctccgtcccttcccctactaccttacttcgtcgtcggaccttacgaacgtacgtacggacggacggacggcgttagtaccgttaattacgtacgttacgtacgtttaccgtttaacggtaacgttgggtaaccgtacgtaaagggtttacgtttacgggtttcgggtttacccggggtttaccgggggaaccggggttaaacggggaaacccggttaaacccgggtaccggtttacccggggtaaaccccccgggtttaccggttaaacccggggtaccgtaacccgggtaacccccggtaaaacccggg

SEQ ID NO: 81084 - DNA, 529 bp, Homo sapiens
  misc_feature: GYAE6OF01BYG3T.34.5.A05.1.454.CMB.1.raw
  modified_base (165)..(165): a, c, t, g, unknown or other
  misc_feature (165)..(165): n is a, c, g, or t
  modified_base (207)..(207): a, c, t, g, unknown or other
  misc_feature (207)..(207): n is a, c, g, or t
  modified_base (233)..(233): a, c, t, g, unknown or other
  misc_feature (233)..(233): n is a, c, g, or t
  modified_base (286)..(286): a, c, t, g, unknown or other
  misc_feature (286)..(286): n is a, c, g, or t
  modified_base (413)..(413): a, c, t, g, unknown or other
  misc_feature (413)..(413): n is a, c, g, or t
  modified_base (465)..(465): a, c, t, g, unknown or other
  misc_feature (465)..(465): n is a, c, g, or t
tcagtacacgtgatcacgaccggtgctcgatttagatagatagacagggggggatcagtcctggtggtagctcaggaagcagagcctggagcatctccactatggcctgggctccactacttctcaccctctcgctcactgcacaggttcttgggccagttttangctgactcagccccatctgtgtcggagtcgtaccgggggaanacggtgaccatcctcctgccacccgnagcagtggcagcattaccaacaactatgtgcagtggtaccaacagcgcccggnacgttcccccaatactctgatctaataaaggtgaatacaaacgaccctcgtcggggtccctagtacgtcggttctcgtcgggtccatcgacagcctccgaccactctcgccctccctcactatctcngactacaagtctgagacgagctagactattacgtgtcagtcttagatggtanactaagtgtgtcggtcgtcgggcggaggaccagtcgtacgaccgttctaggtcacgccgtaacg

SEQ ID NO: 81085 - DNA, 682 bp, Homo sapiens
  misc_feature: GYAE6OF01AYSQQ.34.5.A05.1.454.CMB.1.raw
  modified_base (369)..(369): a, c, t, g, unknown or other
  misc_feature (369)..(369): n is a, c, g, or t
tcagtacacgtgatcacgaccggtgctcgatttagatagatagacagggggaggatacgcgtgacagatgagaagggctggtgggatcagtcctggtggtagctcaggaagcagagcctggagcatctccactatggcctgggctccactacttctcaccctcctcgctcactgcactaggttcttgggcctagttttatgctgactcacgccccatctgtgtcggagtcgtccggggaagcggtgaccatctcctgccaccgcagcagtgcagcataccaacaactatgtgacagtcggtaaccaacgacggccggcccggactaccgttacccccaatacctctagtactacgtaaagtaaacggtnaactacgaaaccgtcccgttacggtcggggtccctaggtacgtttaccgggtttccttccggttacggggtaccctaggtacccgaacgtaccgtcccgttaccccgaccctaacccgttccgtcccgtacccccttccctaccgtaacctttaccttcctccggtacggtaccctacgtaaacggtacttagggaacggtaccggacggtaccgtacgttacttaacgttacgtcggtacccgttacggttaccgttaagggtattacgggtaactacgtaaagggtttcgttcgggttcggttacccgggg

SEQ ID NO: 81086 - DNA, 742 bp, Homo sapiens
  misc_feature: GYAE6OF01C0Q6F.34.5.A05.1.454.CMB.1.raw
  modified_base (207)..(207): a, c, t, g, unknown or other
  misc_feature (207)..(207): n is a, c, g, or t
  modified_base (282)..(282): a, c, t, g, unknown or other
  misc_feature (282)..(282): n is a, c, g, or t
tcagtacacgtgatcacgaccggtgctcgatttagatagatagacagggggaggatacgcgtgacagatgagaagggctggtgggatcagtcctggtggtagctcaggaagcagagcctggagcatctccactatggcctgggctccactacttctccaccctcctcgctcactgcacgtaggtttcgttcgggcctaggtttttangctgactcacgcccctactctgtgtcggtagtccgtccggggaagcggtcgaccactcctcctcgccaccccggnacgacgaggtcggacacggtacctaaactttaaccccaaaaactaacgtagttcggtcgaccgtacggttacggaaacccaaacggaccggcccgggccccgggacctaacccggttaccccaaacttccgtacgtagtaacgttacgttaaaagttaaacgggtacaacgttaaccgaaaccgttcccgtccggttaccggggttaccctgttaccggtttaccgtttccgttcggttaccgggttaccgacgtacccgacgtaccgtacccgttacccggaccctaaccgttccgtcccgtacccccttcccttaccgtaacttacctttcgtccgtacgtaacccgttaccgaagtaccgtagggacggtacgacgggtactagtacccttagttacgtgtactacgttactacggtagtcggtaaacgacgttaaggtcgttgggtcggttacggg

SEQ ID NO: 81087 - DNA, 629 bp, Homo sapiens
  misc_feature: GYAE6OF01BZXJX.34.5.A05.1.454.CMB.1.raw
  modified_base (199)..(199): a, c, t, g, unknown or other
  misc_feature (199)..(199): n is a, c, g, or t
  modified_base (393)..(393): a, c, t, g, unknown or other
  misc_feature (393)..(393): n is a, c, g, or t
  modified_base (404)..(404): a, c, t, g, unknown or other
  misc_feature (404)..(404): n is a, c, g, or t
tcagtacacgtgatcacgaccggtgctcgatttagatagatagacagggggaggatacgcgtgacagatgagaagggctgggtgggatcagtcctggtggtagctcaggaagcagagcctggagcatctccactatggcctgggcctccactacttctcaccctcctcgctcactgcacaggttctgggcctagtttangctgactcacgcccatctgtagtcggagtcgtccggggaagacggtcgaccactctcctcgccaccgcacgactagtcgcacgacctaacttaaccaaactaaccgttagtcgtcgactaggtacgtaacccaacggacgccggacccgggactaccgttaccccgaattacctcgtagatactaagtaaggtnactacgaaacnccgtcgtcgggtccctgacgttcgtctacgtcggtaccatacgaactcgtacctacccgaccctaacttccgtaccgtccctaccctactacttactcctcgtacgacctactaacggtctaggaacggtacgacggtactagtaacttacgttacgtcggtactacgtttacgtaacgtacgtacggtacgtaacgtaaggttcgtgggttcgggttaaccggg

SEQ ID NO: 81088 - DNA, 698 bp, Homo sapiens
  misc_feature: GYAE6OF01B8DMK.34.5.A05.1.454.CMB.1.raw
  modified_base (111)..(111): a, c, t, g, unknown or other
  misc_feature (111)..(111): n is a, c, g, or t
  modified_base (156)..(156): a, c, t, g, unknown or other
  misc_feature (156)..(156): n is a, c, g, or t
  modified_base (201)..(201): a, c, t, g, unknown or other
  misc_feature (201)..(201): n is a, c, g, or t
  modified_base (274)..(274): a, c, t, g, unknown or other
  misc_feature (274)..(274): n is a, c, g, or t
tcagtacacgtgatcacgaccggtgctcgatttagatagatagacagggggaggatacgcgtgacagatgagaagggctggtgggatcagtcctggtggtagctcaggaancagagcctggagcatctccactatggcctgggctccactacttcnccaccctcctcgctcactgcactaggttcttgggcctagttttangctgactcacgccctatctggtcgtcggtagtccgtaccggggaagcggtcgaccatcctcctcgccacccgntagcagtcggcagctaacgttaacccaacaacttagtcggacgacgtaggtaccggtaaaccaacgacggccggtccccgggtactaacccgttaccccaaagtacctcgtagtacttaacgtaaagtaaacggtagaactaacgaaaaccggtccctaacggtccgggtcctagtacgttcggtctcggtacggtaccgtactacgaacgtctaccgtacccgaccttaaccgtcccgtaccgtaccccttacccttaactaccgttacctccgttacgtacgtacctaacgtacgacgttacggaacgggtacgacgtaccgttaacgttacttacgttaccgtgttaaccgtacggtttaaccgtacggttaaggtacggtactacgttaaaggttggttcgggttacggttaacccgggg

SEQ ID NO: 81089 - DNA, 861 bp, Homo sapiens
  misc_feature: GYAE6OF01DJYBC.34.5.A05.1.454.CMB.1.raw
  modified_base (142)..(142): a, c, t, g, unknown or other
  misc_feature (142)..(142): n is a, c, g, or t
  modified_base (173)..(173): a, c, t, g, unknown or other
  misc_feature (173)..(173): n is a, c, g, or t
  modified_base (280)..(280): a, c, t, g, unknown or other
  misc_feature (280)..(280): n is a, c, g, or t
tcagtacacgtgatcacgaccggtgctcgatttagatagatagacagggggggatcagtcctggtggtagctcaggaagcagagcctggagcatctccactatggcctggcctccactacttctcaccctcctcgctcactncacgtacggttcgttcgggccttagttttangtctagacctcgaccgcccctacttcgtcggttcggtacgggtacgtaccgggtaccgggggtaaacggtacgggtacgacctacttccttccgcgacccaaccggnacgtcgaggtacggcaagtactaaccttaaaccaactaactagtcgtacgacgtacggtaccgtaaccgaacgaccggcccgggcccgggaacccgttaccgttaccctaacgttaccgtactacgttaactaacgttaaaacggttaaggtacgtaaccgttaaaccgaaacggttaacccggttcggttacccggggttaccgtttacggtaaccggttttccgggttcccggttacggtacccgggttaccgacggtttaaccgaccgtaccgtacccgttacccgtaccctaacctttcccgtacccgttcccctacccgttaccttaaccgttccggttaccttaccggttaccgtaaccgtaaccgtaacggtacggttacgggaaccggtaaccggtacgtaccgtaacgttaccgttaagttaccgtacgttacgttacgtttacgtaacggtacgttaaggtacgtaacgttaggttacggttcggttacggttacgggtccggggtaacgacgggttaccgaacggttcgtaccggtaccgtacggtacgaccgaccgtaaccgtacccgg

SEQ ID NO: 81090 - DNA, 601 bp, Homo sapiens
  misc_feature: GYAE6OF01AU22Q.34.5.A05.1.454.CMB.1.raw
  modified_base (232)..(232): a, c, t, g, unknown or other
  misc_feature (232)..(232): n is a, c, g, or t
tcagtacacgtgatcacgaccggtgctcgatttagatagatagacagggggggatcagtcctggtggtagctcaggaagcagagcctggagcatctccactatggcctgggctccactacttctcaccctcctcgctcactgcacaggttcttgggcctagttttatgctgactcagccccatctgtgtcggagtcgtccggggaagacggtgaccatctcctgccacccgnagcagtggcagcattaccaacaactatgtgcagtggtaccaacagcgcccgggcacgttcccccaatactctgatctataaaggtgatacaaacgtaccctacgtcggggtccctgacgttcggttctcgtcgggtcctatcgacacgcctccgcaactctcgccctcctcactatcctcgtacgactcgaagtactaggagacgaggcgttgaaccttattacgttagtccgtacgttacttaacggttatagggttacgaaccgtaagttagttccggtagggttccgtttccgggaccgggaacggggtaccgaaacgtcggtacggtacccgtccggttaaggcctaacggccccgtaaaaccgg

SEQ ID NO: 81091 - DNA, 704 bp, Homo sapiens
  misc_feature: GYAE6OF01EYFH9.34.5.A05.1.454.CMB.1.raw
  modified_base (203)..(203): a, c, t, g, unknown or other
  misc_feature (203)..(203): n is a, c, g, or t
tcagtacacgtgatcacgaccggtgctcgatttagatagatagacaggggggaggatacgcgtgacagatgagaagggctggtgggatcagtcctggtggtagctcaggaagcagagcctggagcatctccactatggcctgggctccactacttctccaccctcctcgctcactgcactaggttcttcgggcctagttttangctgactcacgccccactctgtgtcggagtccgtccgggggaagacggtgaccatctcctcgccacccgcacgcaggtggcagactaacttaaccaaactaacttaatgtgactttttttttttttaggacggtaaccaacgacggccggacccgggaccgtaccgttaacccctaactaaccttactacgtaacttacttaaagttaaaacggttagtaactaacgtaaaaccgtaccccgttacggttcggggttacccgtacggtacgtttaccggtttcgttcggttacgggtacctacgtaccgaacacgtacccgtacccgtaccctaaccgtccttccgtcccttacccctacctaaccttactacgttcgttacggtacctacgtaacgtacgtacggtaacggacggacggtcgtacgtaacttaacgttacgtacgtacgtacgttacttaacgtagttacggtagtacgtaagttacgttggttggtcgg

SEQ ID NO: 81092 - DNA, 803 bp, Homo sapiens
  misc_feature: GYAE6OF01CVYAM.34.5.A05.1.454.CMB.1.raw
tcagtacacgtgatcacgaccggtgctcgatttagatagatagacgagggggagggatacgcgtgacagatgagaagggcgtggtgggatcagtcctggtggtagctcaggaagcgagagcctggagcatctccgactatcggccgtgggcctcctactacgttcctcaccctcctcgcctcactcgcactaggttcgttcgggcctagttttatgctcgtacctccacgtcccctactcgtgtcgtcggacgtcggtaccggggaaggtcggtcgacctagtcctcctcgtaccacccgcgacgcgtacggtcgacacgtaccttaacttaaacccgaaactaacgttacgtcggtaacgtacgtaacggttaacggtaacccaaaccggtaccggtccccgggtacccggtacccgttacccgttaccccgtaaacttccttacgtacgtacttaacgtaaagtaacggtacgtaacttaaccgaaaccgtacccgttcgggtccgggttacctacgtacgttccggtttccttccgggtcgggtacctacgtaccggaccgtcggtacccgtacccgaacccttaccgttcccgtaccctacccctttacccgtaccttaccttacggtccttaccgtaacggtaacctaacggtaagtcggtaacggacggtacggtaacgtccttaacggaacgtttacgttaccgttacggtaccgttaaacggtttacccgttaaggtaggttaccgggtaacttaagggtttaacgtcgggttccgggttacgggttacccgggg

SEQ ID NO: 81093 - DNA, 722 bp, Homo sapiens
  misc_feature: GYAE6OF01B7QWT.34.5.A05.1.454.CMB.1.raw
  modified_base (92)..(92): a, c, t, g, unknown or other
  misc_feature (92)..(92): n is a, c, g, or t
  modified_base (170)..(170): a, c, t, g, unknown or other
  misc_feature (170)..(170): n is a, c, g, or t
  modified_base (181)..(181): a, c, t, g, unknown or other
  misc_feature (181)..(181): n is a, c, g, or t
  modified_base (208)..(208): a, c, t, g, unknown or other
  misc_feature (208)..(208): n is a, c, g, or t
  modified_base (212)..(212): a, c, t, g, unknown or other
  misc_feature (212)..(212): n is a, c, g, or t
  modified_base (215)..(215): a, c, t, g, unknown or other
  misc_feature (215)..(215): n is a, c, g, or t
  modified_base (220)..(220): a, c, t, g, unknown or other
  misc_feature (220)..(220): n is a, c, g, or t
  modified_base (226)..(226): a, c, t, g, unknown or other
  misc_feature (226)..(226): n is a, c, g, or t
  modified_base (236)..(236): a, c, t, g, unknown or other
  misc_feature (236)..(236): n is a, c, g, or t
tcagtacacgtgatcacgaccggtgctcgatttagatagatagacgagggggggatcagtcctggtggtagctcaggaagcagagcctggancatctccactatgtcctgggcctccactacttcctcaccctcctcgctcactgcataggtttctgggcttagttttangctgactcacncccatctgtgtcgagtcgtacgggaancgtnacntctcngcaccnagctaggtgnacgactaacttaacccaactaatagtgtacgtacaaggtaccgtaacacggacggccggtacccggactaccgttaacccattaccgtctagtactacgttaaagtaacgtagtaactaaccgaaaccgtcccgttaggtaccgggttcctaagggtcccttcggttaccgtccgtttacgggacctaacggcgaaccgtacgcccgttacccgaactacgtttccctaccgtcccctaccctctacgttactccgttcgtaacgacctaacgaacgtcggtaacggtacggaccgttaggaccttaggttaaaactttgtaccgtacgttcgtaacgttaccgtaaggtaattacgggtaagtacgttaaggtacgttcgggttaccgggtacgggttaaccggggacggtaaccgggaaactacgggtaccgtacccgtaaccggttacggtaaccggtataaaccccgggtaacctaacccgg

SEQ ID NO: 81094 - DNA, 733 bp, Homo sapiens
  misc_feature: GYAE6OF01BBP8T.34.5.A05.1.454.CMB.1.raw
tcagtacacgtgatcacgaccggtgctcgatttagatagatagacagggggaggatacgcgtgacagatgagaagggctggtgggatcagtcctggtggtagctcaggaagcagagcctggagcatctccactatggcctgggctcctactacttctccaccctcctcgctcactgctacgtggttcgttcggccttagttttatgctcgactcgaccgcccctactcgtggtcggtcggtacggtccggtaccgggggaacggtacggtacgtacctactcctccgtcgacccgacccgcgacgcgaggtcggaccgacgacctaacttaaccaaactaacgtagtgtagacgtacggtacgtaaccgaacgcgcccggtcccgaccgtacccgtacccctaactacctctagtactacgtaagtaaggtacaactaacgtaaccgtaccgttcggtcggttccgtagtacgttccggttctaccggtcgtacctacgtaccgacgaccgtcctacccgtacccgtacttccgtcccgttacccttaccctacgtaccttaccgtcgttcgtaccgtactaacggtaacgttacggaacggggtaacggagtaaccggttaccgtattaacccgttaacgtttccgtacgttaccgttaacggttacgtttaaccggtaggtttacggtaactacggttaaggtttcgtttacggggtcggtttacccgggg

SEQ ID NO: 81095 - DNA, 511 bp, Homo sapiens
  misc_feature: GYAE6OF02F6XFU.34.5.A05.1.454.CMB.1.raw
  modified_base (219)..(219): a, c, t, g, unknown or other
  misc_feature (219)..(219): n is a, c, g, or t
tcagtacacgtgatcacgaccggtgctcgatttagatagatagacagggggagaagggctggtgggatcagtcctggtggtagctcaggaagcagaacctggagcatctccactatggcctgggctccactacttctcaccctcctcgctcactgcacaggttcttgggccagttttatgctgactcagccccactctgtgtcggagtctccggggaanacggtgaccatctcctgcacccgcagcagtggcagcattaccaacaactatgtgcagtggtaccaacagcgcccgggcagttccccaatactctgatctataaaggtgatcaaagaccctctggggtccctgatcggttctcgtggtccatcgacagctccgcaactctgcctccctcactatctctgactcaagactgagacgagctgactattactgtctagtcttacgtagtgtagctaagtgtgtggtcgttcgggcggacggaccaaggctcgtaccgtccgtacgg

SEQ ID NO: 81096 - DNA, 559 bp, Homo sapiens
  misc_feature: GYAE6OF02IK04W.34.5.A05.1.454.CMB.1.raw
  modified_base (179)..(179): a, c, t, g, unknown or other
  misc_feature (179)..(179): n is a, c, g, or t
tcagtacacgtgatcacgaccggtgctcgatttagatagatagacagggggagaagggctggtgggatcagtcctggtggtagctcaggaagcagaacctggagcatctccactatggcctgggctccactacttctcaccctcctcgctcactgcacaggttcttgggccagttttangctgactcagccccatctgtgtcggagtctccgggggaagacggtgacccatctcctgccacccgcagcagtggcagcattaccaaacaactatgtgcagtggtaccaacagcgccgggcacgttccccaatacctctgatctataaggtgatacaaagaccctcgtcgggtccctggacttcggttactcgtgggtcctatccgacacgcctcccgacccaactctcgccctccctcacctatcctctcggactcgaacgactgacggacgcggctagacttattactcgtctagtcttacgagtaggtagacgtaagtgttgtgggttccgtacgggaccggacgggtaccgaagtccgtcggtaccgttcctaacgg

SEQ ID NO: 81097 - DNA, 656 bp, Homo sapiens
  misc_feature: GYAE6OF02IUJDD.34.5.A05.1.454.CMB.1.raw
  modified_base (162)..(162): a, c, t, g, unknown or other
  misc_feature (162)..(162): n is a, c, g, or t
  modified_base (180)..(180): a, c, t, g, unknown or other
  misc_feature (180)..(180): n is a, c, g, or t
  modified_base (214)..(214): a, c, t, g, unknown or other
  misc_feature (214)..(214): n is a, c, g, or t
  modified_base (400)..(400): a, c, t, g, unknown or other
  misc_feature (400)..(400): n is a, c, g, or t
  modified_base (472)..(472): a, c, t, g, unknown or other
  misc_feature (472)..(472): n is a, c, g, or t
  modified_base (549)..(549): a, c, t, g, unknown or other
  misc_feature (549)..(549): n is a, c, g, or t
tcagtacacgtgatcacgaccggtgctcgatttagatagatagacagggggagtcgagtcctggtggtagctcaggaagcagagcctggagcatctccactatggcctggctccactacttctcaccctctcgctcactgcacaggttctggccagttttangctgactcagccccctanctgtcgtacggagtcgtccgggggaataccggtnaccgatcctccgtgccaccccgaggcctaggtcggcctaagcattaccaacaacctatgtgcagtcggtaccaacagccggcccgggacacgttcccccgaataccgtactgactcctaataaaggtgatacaaagacccgtcgtacggggtccctggaacttcggttcgtacgttgggtaccctntaccgactacggtcctcccgacctaactcgtcgccccttcctcacccttactcttctacggtacctacgaanaaccgtgtaacggcgtaacgggcctaggtactaaacgtttcgtacgtccgtagtttacccttaggaattcgggtaanaccgtaagttatcggtttacggttcggttccgggacgggttacgggaaaccctaagggtccgttacggtacccggtaccgttacgggcgtaaccggccccgtaacgg

SEQ ID NO: 81098 - DNA, 667 bp, Homo sapiens
  misc_feature: GYAE6OF02F5I2Q.34.5.A05.1.454.CMB.1.raw
tcagtacacgtgatcacgaccggtgctcgatttagatagatagacagggggggggatcagtcctggtggtagctcaggaagcagagcctgggacgcatctccactatgggcctgggctccactacttctcaccctcctcgctcactgcacaggttcttgggccagttttatgcctgactcagccaccactctgtgtcggagttcgtaccgggggaagaccggtgaaccatcctcctgccacccgcagcgagtggacagctattaccaacaactatgtgcagtggtaaccaacgacggccgcccgggactaccgttacccccaattacctcgtagtactactaagttaaaggtgtaactaccgaaacgtaccccgtggtacgggtccctaggtacgttccggttacgtcgtcggtacacgtacgactacgtcctcccgacctacgtcctcgtaccctcctactacttacgtcgtacgtacgtacctacgtaagactaggacggtacgtacggcttacgtaacttattacgtcgtacttacgttaccgttaacgtagttcggtaacgacgttaagttcgtacggttacggtcggttacgggaccggggtaacggtaccgtaggtccgttaccggtaccggttacctacgggtaccgacccgtaacccgg

SEQ ID NO: 81099 - DNA, 502 bp, Homo sapiens
  misc_feature: GYAE6OF02GZOUQ.34.5.A05.1.454.CMB.1.raw
  modified_base (205)..(205): a, c, t, g, unknown or other
  misc_feature (205)..(205): n is a, c, g, or t
  modified_base (445)..(445): a, c, t, g, unknown or other
  misc_feature (445)..(445): n is a, c, g, or t
tcagtacacgtgatcacgaccggtgctcgatttagatagatagacaggggggatcagtcctggtggtagctcaggaagcagagcctggagcatctccactatggcctgggctccactacttctcaccctcctcgctcactgcacaggttcttgggccagttttatgctgactcagccccactctgtgtcggagtctccggggaanacggtgaccatctcctgcacccgcagcagtggcagcattaccaacaactatgtgcagtggtaccaacagcgcccgggcagttcccccaatactctgatctataaaggtcgatcaaagaccctctggggtccctgatcggttctctggtcatcgacagctccgccaactctgcctccctcactatctctcggactcaagactgaggacgagctgactatactgtcagtcttacgatggtancaagtatgtggtcttcggcggtagggaccaagctgaccgtcctaggtcacgccaacg

SEQ ID NO: 81100 - DNA, 538 bp, Homo sapiens
  misc_feature: GYAE6OF02GH487.34.5.A05.1.454.CMB.1.raw
  modified_base (230)..(230): a, c, t, g, unknown or other
  misc_feature (230)..(230): n is a, c, g, or t
  modified_base (404)..(404): a, c, t, g, unknown or other
  misc_feature (404)..(404): n is a, c, g, or t
  modified_base (472)..(472): a, c, t, g, unknown or other
  misc_feature (472)..(472): n is a, c, g, or t
tcagtacacgtgatcacgaccggtgctcgatttagatagatagacagggggggatcagtcctggtggtagctcaggaagcagagcctggagcatctccactatggcctgggctccactacttctcaccctcctcgctcactgcacaggttcttgggcctagttttatgctgactcagccccatctgtgtcggagtctccggggaagcggtgaccatctcctgccacccgnagcagtcggcagcattaccaaacaactatgtgcagtcggtaccaacgacgcgcccgggcacgttcccccaatactctgatctaataaaggtgaactacaaacgacccttcgtcggggtccctgactcggttctcgtggtccatcgacagcctccgccaactctcgccctccctnactactctctcgactcaacgctagaggacgaggctagacttattactgtactagttcttagatggtanataagtatgtggtcgttcggacggaacggaccagtcgtacgaccgttcgtaggcacgaccgtaacg

SEQ ID NO: 81101 - DNA, 711 bp, Homo sapiens
  misc_feature: GYAE6OF02G02DQ.34.5.A05.1.454.CMB.1.raw
  modified_base (179)..(179): a, c, t, g, unknown or other
  misc_feature (179)..(179): n is a, c, g, or t
tcagtacacgtgatcacgaccggtgctcgatttagatagatagacagggggagaagggctggtgggatcagtcctggtggtagctcaggaagcagaacctggagcatctccactatggcctgggctccactacttctcaccctcctcgctcactgcacaggttcttgggccagttttangctgactcagccccatctgtgtcggagtcgtccggggaagcggtcgaccatctcctgccaccgcagcagtgcagcataaccaacaactatgtgctagtcggtaaccaacgcgaccggcccgggtactaccgttacccccaagtacctctacgacttactaaagtaaacggtgtaactaaccgaaacggtacccttccggttaccggggtccctaggtacgttccgggtttaccgttcggtacggggttacccagttaccgaacctacggtccctacccgaccctaacttccgtaccgtccccttaccctctaactcttcctccgtaggtacctacgtaacgtacgtcggaacggtaacggtacggtaccgtacgttaacgttacgtttaccgtaggttaccttaacggttacgttaaaccggtagttaacgggtagtaacgtaaaggttgttacgggttacggttccggtaccgggggaacggacccgggtaacaacggtcccggttaacggtacccggttcgtaacccggg

SEQ ID NO: 81102 - DNA, 637 bp, Homo sapiens
  misc_feature: GYAE6OF02IYUST.34.5.A05.1.454.CMB.1.raw
  modified_base (208)..(208): a, c, t, g, unknown or other
  misc_feature (208)..(208): n is a, c, g, or t
  modified_base (327)..(327): a, c, t, g, unknown or other
  misc_feature (327)..(327): n is a, c, g, or t
tcagtacacgtgatcacgaccggtgctcgatttagatagatagacagggggaggatacgcgtgacagatgagaagggctggtgggatcagtcctggtggtagctcaggaagcagagcctggagcatctccactatggcctgggctccactacttctcaccctcctcgctcactgcacaggttcttgggcctagttttatgctgactcncgccccactctgtggtcggacgtcgtaccggggaagacggtcgaccattcctaccgtcgccgacccgcagcaggtggcagcacttaaccaacaactagtgtgcaggtcgtaaccaacgnggccgcccgggactaccgttacccccaaatacctctagactacgttaagtaaacggtgtaactaacaaacgtacccttacggtccgggtacccttgtacgtttccggtttctcggttcgggtaccctagtccgacgccgtcctcccgacctaactcgtaccgtccctaccctacctactcttctcgtacgacctacgaacgtcgacgaacgacgtagcttacacgtttacttacgtacgttacctacggtttaccgttaaggtacgtttaggtacgtaagtaacggtttagttcggttggttacccgggg

SEQ ID NO: 81103 - DNA, 656 bp, Homo sapiens
  misc_feature: GYAE6OF02IN1M1.34.5.A05.1.454.CMB.1.raw
  modified_base (264)..(264): a, c, t, g, unknown or other
  misc_feature (264)..(264): n is a, c, g, or t
tcagtacacgtgatcacgaccggtgctcgatttagatagatagacagggggaggatacgcgtgacagatgagaagggctggtgggatcagtcctggtggtagctcaggaagcagagcctggagcatctccactatggcctgggctccactacttctcaccctcctcgctcactgcacaggttcttgggcctagttttatgctgactcacgccccactctgtgtcggagtcgtccggggagacggtgaccatctcctgcacccgnacgcgagtcggcacgcacttaaccaactaactagtcggtagctacggtcggtaacccaacgacggccggaccccgggactaaccggttacccccctaaatacccgttactacgtaacgttactaacgtaaaagggttacgaacgttaaccgtaaaaccggtaccccgttacgggtcccggggttaccctacggttaacgttcccgggtttcgtaccgtttcggggtaccctacgttccgacgtaccggccttaccccggacctaaccgttccgtaccgtccccgtccctactacgtactcgttacgtcggactacgagacgtagaccggagacgctgtacttatcgtcgtcagttctacggtatggtacgacgtaagtgttcggtgtccggg

SEQ ID NO: 81104 - DNA, 673 bp, Homo sapiens
  misc_feature: GYAE6OF02JKNUW.34.5.A05.1.454.CMB.1.raw
  modified_base (332)..(332): a, c, t, g, unknown or other
  misc_feature (332)..(332): n is a, c, g, or t
tcagtacacgtgatcacgaccggtgctcgatttagatagatagacagggggggatcagtcctggtggtagctcaggaagcagagcctggagcatctccactatggcctgggctccactacttctcaccctctcgctcactgcacaggttcttgggcctagtttttatgctgactcacgccccactctgtgtcggagtctaccggggaagcggtgaccatctcctagccacccgcaggcaggtcggcagtcctaataccaacaactatgtagcagtcggacaacgacgtacgcccggcacgttccccaagtcgtctatagtctaataacggtnactagaaacaccgtgtcggtcctgtacttcggttactcgtcgggtacatccgtacgacgccgtcccgaccctaacctcgtaccgccctaccctacctaccttacgttcctcgtacggacctacaacggtaccgtacggaagggacggacggtacccgtagttaccgttaacgtttaccttacgggtacctttacggttacgttttaccgtaagttgggttaaacgtaccgtaagttcggtcggttttcgggtaccggttccgggggtaacgggttaagggaaccgtaacggtcgtaacggttaacccggtcgttaccggtacgtacccggtaccgaaccgg

SEQ ID NO: 81105 - DNA, 772 bp, Homo sapiens
  misc_feature: GYAE6OF02HSRAL.34.5.A05.1.454.CMB.1.raw
  modified_base (545)..(545): a, c, t, g, unknown or other
  misc_feature (545)..(545): n is a, c, g, or t
  modified_base (606)..(606): a, c, t, g, unknown or other
  misc_feature (606)..(606): n is a, c, g, or t
tcagtacacgtgatcacgaccggtgctcgatttagatagatagacagggggagaagggctggtgggatcagtcctggtggtagctcaggaagcagaacctggagcatctccactatcggcctgggctccacttacttctccaccctcctcgctcactgcactaggtttcttgggcctagttttatgctgactcacgcccccattcgtaggttcggtcggtacggttccggtaccgggggaacgtacgggtcgaacctagtcccttccctacgccgaccccgtcgacggccgtaggtcggcaaggacctaaacgtttaacccaaaacctaaacctttagttacggtcgaccgttaacggttaccggaacccgtaaccacggggaccccgggtcccccggggacttaaccccggtttacccccgtaaataccgttcctacgactttacgtaacgttaaaaggtcgaaccgttaacgaaacgttcccgtcggttaccggggttcctcggttacgttcggttacgttcggttcggtctacgtccggacnccgtcctacccgaccttactccgtccccgtcccttaccgtacctaactccgttcccgtacnccttaacgagtacggacgtaggacggacggtcgttacgtacgttacgtcgttcgacttacgttgttaacgtgttacggtagttacgacgttaggtcggttacgttcgggtaccggaaggtccggaacggtaaccgtcggtcccgttacggttaccggattaccggg

SEQ ID NO: 81106 - DNA, 698 bp, Homo sapiens
  misc_feature: GYAE6OF02F90G5.34.5.A05.1.454.CMB.1.raw
  modified_base (202)..(202): a, c, t, g, unknown or other
  misc_feature (202)..(202): n is a, c, g, or t
  modified_base (229)..(229): a, c, t, g, unknown or other
  misc_feature (229)..(229): n is a, c, g, or t
  modified_base (262)..(262): a, c, t, g, unknown or other
  misc_feature (262)..(262): n is a, c, g, or t
tcagtacacgtgatcacgaccggtgctcgatttagatagatagacagggggaggatacgcgtgacagatgagaagggctggtgggatcagtcctggtggtagctcaggaagcagagccctggagcatctccactatggcctgggcctccgactacttctccaccctcctcgctcactgcacaggttctcggcctagttttangctgactcacgcccactctgtgtacgngtcgtacgggacgacggtcgactactctcctcnccaccgcagcagtgcacgactaacttaaccaacgtaacttagtagtcgacgaggttaccgtaaccagaccggccggtacccgggccttaaccgttacccccaattaaccctgtagacttactaaaacgtaacggtacgactaaaccgtaacccgtacccgtcgggttaccgggttcccaaggttccgtttccggttcgtaccggttcggtaacctagtacccgaacggtaccgtcccgtaacccgaacccgtaccgttccgcccgttccccgttccctaactaaccgttcttacccgtcgggtacaccgttagaacgtacgtacggaacgaccgggttgaccttacgttattacgttcgtacgtcggttaacgttccgttaggtaacggttacgtaacgttaaccgtaagttcgtttacgggtcggttacccgggg

SEQ ID NO: 81107 - DNA, 784 bp, Homo sapiens
  misc_feature: GYAE6OF02HJPO5.34.5.A05.1.454.CMB.1.raw
  modified_base (166)..(166): a, c, t, g, unknown or other
  misc_feature (166)..(166): n is a, c, g, or t
  modified_base (314)..(314): a, c, t, g, unknown or other
  misc_feature (314)..(314): n is a, c, g, or t
tcagtacacgtgatcacgaccggtgctcgatttagatagatagacaggggggggatcagtcctggtggtagctcaggaagcagagcctggagcatctccactatggcctgggctccactacttctcaccctctcgctcactgcacaggttctgggcctagttttangctgactcgacgccccactctggtcgtcggtacggtccggtaccgggggaaggtacgggtacgaaccgtacttccgtccgtcgacccgaaccccgcgacggacgtacggtacgggcacgtacctaaacttaacccaaactaaacgttntcggtacgacgtaacggtacggtaaacccaaggccgggtcccggacccgggtacctaaccccggttacccctaaataccgtacgtacgtaacttaccggtaaagttaaggacgtaactaacgaaacccgttcccgtcgggtaccgggttacctaggttaccgttcggtccgttacggtcggtctaacgaccgaccgtcgtccctacccggtacctaccttccgtccgtccctaccctactactactaccgttcgtacgtactacgtacgacggtacggacggacgtacgtacgtactacggggttacttacgtacgttacgtacttcgtaacgtaggttacggtacgtaacgttagttacggttcggttacggttacgggttacggggaccgggtaacgggtaaccggtaacgtaccgttaccggttacccggtaccggtaccggtaccggtaccggtaccgtaacccgg

SEQ ID NO: 81108 - DNA, 162 bp, Homo sapiens
  misc_feature: GYAE6OF01DCIIN.25.38.D05.1.454.CMB.1.raw
  modified_base (160)..(162): a, c, t, g, unknown or other
  misc_feature (160)..(162): n is a, c, g, or t
tcagactgtacagtcacgaccggtgctcgatttagtatctgatagttgggtttgggctgaccaaggtcaccgtcctaggtcagcccaaggccaaccccactgtcactctgttcccgccctcctcactgtacagtctgagcgggctggcaaggcgcatagnnn

SEQ ID NO: 81109 - DNA, 520 bp, Homo sapiens
  misc_feature: GYAE6OF01D7UN9.25.38.D05.1.454.CMB.1.raw
tcagactgtacagtcacgaccggtgctcgatttagtatctgatagttgggtttgggggactgatcaggactcctcagttcaccttctcactatgaggctccctgctcagctcttggggctgctaatgctctgggtccctggtaaggacagaaggagatgagggaggagaatggggtgggaaggatccagtgcagagattgtgatgacccagactccactctccttgtctatcacccctggagagcaggcctccatctcctgcaggtctagtcagagcctcctgcatagtgatggatacaccttatttgtattggtttctgcagaaagccaggccagtctccacgctcctgatctatgtaacgtttccaaccggtttctctggagttcgccagataggttcaggtggcaggcgggtcagggacagtatttcaactactagaaaatcgaaggtccgggtaggaggctggaggtagtttttgggagttttattacgtgctatgacaaagattgacaacgaaag

SEQ ID NO: 81110 - DNA, 160 bp, Homo sapiens
  misc_feature: GYAE6OF01CLW37.25.38.D05.1.454.CMB.1.raw
  modified_base (160)..(160): a, c, t, g, unknown or other
  misc_feature (160)..(160): n is a, c, g, or t
tcagactgtacagtcacgaccggtgctcgatttagtatctgatagttgggtttgggctgaccaaggtcaccgtcctaggtcagcccaaggccaaccccactgtcactctgttcccgccctcctcactgtacagtctgagcgggctggcaaggcgcatagn

SEQ ID NO: 81111 - DNA, 161 bp, Homo sapiens
  misc_feature: GYAE6OF01BLAU4.25.38.D05.1.454.CMB.1.raw
  modified_base (160)..(161): a, c, t, g, unknown or other
  misc_feature (160)..(161): n is a, c, g, or t
tcagactgtacagtcacgaccggtgctcgatttagtatctgatagttgggtttgggctgaccaaggtcaccgtcctaggtcagcccaaggccaaccccactgtcactctgttcccaccctcctcactgtacagtctgagcgggctggcaaggcgcatagnn

SEQ ID NO: 81112 - DNA, 168 bp, Homo sapiens
  misc_feature: GYAE6OF01CUB0I.25.38.D05.1.454.CMB.1.raw
  modified_base (159)..(168): a, c, t, g, unknown or other
  misc_feature (159)..(168): n is a, c, g, or t
tcagactgtacagtcacgaccggtgctcgatttagtatctgatagttgggtttgggctgaccaaggtcaccgtcctaggtcagcccaaggccaacccactgtcactctgttcccaccctcctcactgtacagtctgagcgggctggcaaggcgcatagnnnnnnnnnn

SEQ ID NO: 81113 - DNA, 605 bp, Homo sapiens
  misc_feature: GYAE6OF01CPNCO.25.38.D05.1.454.CMB.1.raw
  modified_base (258)..(258): a, c, t, g, unknown or other
  misc_feature (258)..(258): n is a, c, g, or t
  modified_base (291)..(291): a, c, t, g, unknown or other
  misc_feature (291)..(291): n is a, c, g, or t
tcagactgtacagtcacgaccggtgctcgatttagtatctgatagttgggtttggggactgatcaggactcctcagttcaccttctcactatgaggctccctgctcagctcttggggctgctaatgctctgggtccctggtaaggacagaaggagatggagggaggagaagtggggtgggaaggatccagtgcagagattgtgatgaccagactccactctccttgtctatccaccctggagagcaggcctccatccncctgcaggtctagtcagacgcctcctgcatagnatgatacactatttgtacttggttctgcagaaacgccaaggccagtctaccacgtctacctgacttctatacgtaacgtttcccgtaaccggttcctcgtacggtagttcgacccgtaagtacgttacggttacacgggttcggacgacggtccgggtacgtacgggaactagtactttaccaacgtaaccgttaagaaaacgttcgaacgggtaccgggtaggtaacggcgtaggtaacgggttagttttagggtaacgttttagttacgtcgtaccgtatacggtactaagtagtacgacgtaacgtaaacg

SEQ ID NO: 81114 - DNA, 747 bp, Homo sapiens
  misc_feature: GYAE6OF01AGLL0.25.38.D05.1.454.CMB.1.raw
tcagactgtacagtcacgaccggtgctcgatttagtatctgatagttgggtttgggggactgatcaggactcctcagttcaccttctcactatgaggctccctgctcagctcttggggctgctaatgctcgtgggtccctggtaaggacagaaggagatggagggaggagaagtggggtgggaaggatccagtgcagagtattgtgatcgacccagacctccactctccttgtctactccacccgtggagacgccgacggtccctccattcctccgtgcgtacggttctacgtcagtacgcctccgtgactagtagtagattcggtaacttaccttaccttttagttttagttagttttcggtttactaggaccgaacggaaaccgtccgtacggtccctacgttccctaccgtaccgtccttacgttagtacttacgttaacgttaccggtttaaccgtttaccccgtaaccgggtttctacggttacggggtactcggtaacccgtaagttacggttacgggttacgacgggtcggtacggacggggtaccgggtacgaacgggtactacggttaacctttacgaaccgtacgtaaacggtaaacgtcgggtacggggtacgggtaggaccggttaggttacgggttaaggttttacggtttagggtttaacttttaagtaccgttggtaccgttaagtacgtaaccggtaagtacgtaaccgtaacgtaaaccggttaaaccgg

SEQ ID NO: 81115 - DNA, 1055 bp, Homo sapiens
  misc_feature: GYAE6OF01DCA1M.25.38.D05.1.454.CMB.1.raw
tcagactgtacagtcacgaccggtgctcgatttagtatctgatagttgggtttgggggaggagcccagcactagaagtcggcggtgtctccattcggtgatcagcactgaacacagaggactcaccatggagtttgggctgagcgttgggtttttccctcgttgcttcgttttaaagaggtgtccagtgtcaggtgcagctggtggagtcggtgggggaggcggtggtccaggccgtggggaacgtcccgtggacgaccttcctccgttggtcgacaaacctagttccgtagggtactttcccggtacccttttacgtaacgtttaaccgtttttcgggcctaacgttccccgtaccggttccgggggttaccccggccccgtaacgggtccccgttacccggaaacggggtaccggaaaacgggggtaaccgttaagggtacgggtttaggggggtttacgtttaaaccgttttttttaaggttcgggggactaaggttggtaaacggtttggggaccgtaagggttaaggtaaacgttaaaaacggtccgttaaagttcggaaccgaacggtaaccccgttacccgggttaaccggaaaccgggggtccccgttacccgttttacccgtaacccgttaacctttaccccgttaacccggtaaacgggtaaacccggtaaaccccgtaaaacccgggtaacccgaaaaacggggttaaaacccggggtttaaccccgggtttttaaccccgttttttaacgggaaaccccgttaaaaaaggtttaaaccgggaaaaaaccggtccccggttaaacgggaaaccccggggaacccccgggaaacggggtaaacccggtaaccgggtaaccgtttaaacgtttacggtttaaaccgttttaaccgggtacgggttaccgggaaacgggtaaacgggtaaccgggtaacccggttaagggttacgggtaaacgggttaacggggttaaccgggtaccggttaacggggtcgggttaccccgggtttaccgggggtaacccgggtttaacccgggggg

SEQ ID NO: 81116 - DNA, 544 bp, Homo sapiens
  misc_feature: GYAE6OF01D35JE.25.38.D05.1.454.CMB.1.raw
  modified_base (258)..(258): a, c, t, g, unknown or other
  misc_feature (258)..(258): n is a, c, g, or t
  modified_base (300)..(300): a, c, t, g, unknown or other
  misc_feature (300)..(300): n is a, c, g, or t
tcagactgtacagtcacgaccggtgctcgatttagtatctgatagttgggtttgggggaggagcccagcactagaagtcggcggtgtctccattcggtgatcagcactgaacacagaggactcaccatggagtttgggctgagctgggttttcctcgttgctctttttaagaggtgtccagtgtcaggtgcagctggtggagtctggggggagcgtggtccagcctggggaacgtccctgagactctcctgtgcaacntctggattcgccttcagttaactttggcatccactgggtccnccaggcctccaggccaaggggactagaggtgggtgtacttttagtgggctagtgagtggctagtgaataaagcctatgcagactcgtacaagggtcccgcttctccatctcagagacaacgacaagaacgtacgtcctttagacaaatagaaagcagacgaccgaggacgacgctagtgtatacgtgtgacgagacgccaggtagaggaggtcggacgtacggtaggccggtggaccggtcggg

SEQ ID NO: 81117 - DNA, 532 bp, Homo sapiens
  misc_feature: GYAE6OF01C7BLO.25.38.D05.1.454.CMB.1.raw
  modified_base (334)..(334): a, c, t, g, unknown or other
  misc_feature (334)..(334): n is a, c, g, or t
  modified_base (471)..(471): a, c, t, g, unknown or other
  misc_feature (471)..(471): n is a, c, g, or t
  modified_base (484)..(484): a, c, t, g, unknown or other
  misc_feature (484)..(484): n is a, c, g, or t
  modified_base (508)..(508): a, c, t, g, unknown or other
  misc_feature (508)..(508): n is a, c, g, or t
tcagactgtacagtcacgaccggtgctcgatttagtatctgatagttgggtttgggggaggagcccagcactagaagtcggcggtgtctccattcggtgatcagcactgaacacagaggactcaccatggagtttgggctgagctgggttttcctcgttgctcttttaagaggtgtccagtgtcaggtgcagctgggtggagtcgtggggggaggcgtggtccagcctgggaagtccctgagactctcctgtgcaacatctggattcgccttcagttaactttggcatccacgtgggtccgccaggctccgaggcaagggactaggagtgggtnacttttagtgggcatgatggcagtgataaagcctatgcagactcgtacgacggccgcttcctccatctccagacgacaacgacaagaacgcggttcctttgactaaatagaaagtcctagacgaccgagacgacggntagtgtatctagngacgagagaccgaggtgaggtagnggacaggtggccgtgggcgtcggg

SEQ ID NO: 81118 - DNA, 679 bp, Homo sapiens
  misc_feature: GYAE6OF01DAJT0.25.38.D05.1.454.CMB.1.raw
  modified_base (668)..(668): a, c, t, g, unknown or other
  misc_feature (668)..(668): n is a, c, g, or t
tcagactgtacagtcacgaccggtgctcgatttagtatctgatagttgggtttgggggactgatcaggactcctcagttcaccttctcactatgaggctccctgctcagctcttggggctgctaatgctcgtgggtccctggtaaggacagaaggagagtggagggaggagaagtggggtagggaaggatcgagtgcaggagtattggtgatcgaacccagtacctcctacttccttccttgtcctactccaccccgtgggacgacgcgacggtccctccatcctccgtgacgtacggtctagtcagctcctctgctagtagtgagtggacttacctactttagtttgttagtttcgttctggaacaacggtaaacgccgtaacgtcccgtagttccctacccgaccgtcctacgtagtacttacgttacgttacggttaacccgtttaccgtaccggtttcctacggtgggtacgttaccgacgttaggtacgttacgggtttcgaagggttcgggaccgtacgggtccggtacgggaacggactacgttacttcgaaactacgtaaagtaaacgtccggaacgggttcggggtagaacggtcgtaagggttacggtttgtttagggttactttaagtcgttgagtagtacgtacgaacagtcgtanaacggttaacg

SEQ ID NO: 81119 - DNA, 577 bp, Homo sapiens
  misc_feature: GYAE6OF01AODLT.25.38.D05.1.454.CMB.1.raw
  modified_base (347)..(347): a, c, t, g, unknown or other
  misc_feature (347)..(347): n is a, c, g, or t
tcagactgtacagtcacgaccggtgctcgatttagtatctgatagttgggtttgggggactgatcaggactcctcagttcaccttctcactatgaggctccctgctcagctcttggggctgctaatgctctgggtccctggtaaggacagaaggagatgagggaggagaagtggggtgggaaggatccagtgcagagattgtgatgacccagactccactctccttgtctatccacccctggagagcaggcctccatctcctgcaggtctagtcagacgcctcctgcatagtgagtggatacacttatttgtatttggtttctgacagaaacgccgaggccagtccnccacgtctcctgactctatgtaacgtttcccaaccggttctcgtggtagtcgacctagtattaggttcaggtggacgagggtcggtacgagggactagtactttacaactacgtaacgaaaacgttcgaacgggtccggggtagacgggtcgtaggtaaggttagtttttagggtacgtttttaagtacgtgtacgtagttacgacgtaagtatacgactaacgtaaacg

SEQ ID NO: 81120 - DNA, 160 bp, Homo sapiens; identical to SEQ ID NO: 81110
  misc_feature: GYAE6OF01BVXQH.25.38.D05.1.454.CMB.1.raw
  modified_base (160)..(160): a, c, t, g, unknown or other
  misc_feature (160)..(160): n is a, c, g, or t

SEQ ID NO: 81121 - DNA, 596 bp, Homo sapiens
  misc_feature: GYAE6OF01D92OX.25.38.D05.1.454.CMB.1.raw
tcagactgtacagtcacgaccggtgctcgatttagtatctgatagttgggtttgggggactgatcaggactcctcagttcaccttctcactatgaggctccctgctcagctcttggggctgctaatgctctgggtccctggtaaggacagaaggagatgagggaggagaagtggggtgggaaggatccagtgcagagattgtgatgacccagactccactctccttgtctatccaccctggagagcaggcctccatctcctgcaggtctagtcagacgcccttcctgcagtaggtgagtggactacaccttatttgttatttggtttctgcaagaaacgccaggcctagtcctccacgtcctctgattctatgtaacgtttccgtaaccgttctcgtggtagtcgcctagtagttagggttacagggtcggcgaggtcgggtacgagggactagtactttacactaacgtaagtaaacgtcgaacgggtccgggtagggacggtcgttagggtagggtttaagttttagggttaacgtttttagttacgtcggtaactagtacgtaacgtaaaggtagtacgacgaacgtaaacgg

SEQ ID NO: 81122 - DNA, 649 bp, Homo sapiens
  misc_feature: GYAE6OF01CVWHO.25.38.D05.1.454.CMB.1.raw
  modified_base (296)..(296): a, c, t, g, unknown or other
  misc_feature (296)..(296): n is a, c, g, or t
  modified_base (305)..(305): a, c, t, g, unknown or other
  misc_feature (305)..(305): n is a, c, g, or t
  modified_base (339)..(339): a, c, t, g, unknown or other
  misc_feature (339)..(339): n is a, c, g, or t
  modified_base (632)..(632): a, c, t, g, unknown or other
  misc_feature (632)..(632): n is a, c, g, or t
tcagactgtacagtcacgaccggtgctcgatttagtatctgatagttgggtttgggggactgatcaggactcctcagttcaccttctcactatgaggctccctgctcagctcttggggctgctaatgctctgggtccctggtaaggacagaaggagatggagggaggagaagtgggggtagggaaggatccagtgacagagattgtgatcgaccagactccactctccttgtctactccacccgtggagagccacgccctccattcctcctgctaggtctagtcagacgccttccngacagtagngagtagacttactactttatttgtagtttgttcngacaagaacgccgaggcctacgtcctaccgcgtcctccgtagtattacgttaagttacgttaaaccgttttcccgtaaccgggttttctacgttaggtacgtccgaccgtaagttaacgtttaacgggttcagggtcggtaccgagggtccgggtacgaacgggtaactagttacgtttaccaacgtaagtaacgtaaacgtccggtaacgggtccggggtaggaacggtacgttagggtaacggtttaggttttaggtacgttttaactacgtgaacttagtcggaataagnttacgactaaagtaacg

SEQ ID NO: 81123 - DNA, 502 bp, Homo sapiens
  misc_feature: GYAE6OF01A1FI4.25.38.D05.1.454.CMB.1.raw
  modified_base (294)..(294): a, c, t, g, unknown or other
  misc_feature (294)..(294): n is a, c, g, or t
  modified_base (323)..(323): a, c, t, g, unknown or other
  misc_feature (323)..(323): n is a, c, g, or t
  modified_base (356)..(356): a, c, t, g, unknown or other
  misc_feature (356)..(356): n is a, c, g, or t
  modified_base (367)..(367): a, c, t, g, unknown or other
  misc_feature (367)..(367): n is a, c, g, or t
  modified_base (373)..(373): a, c, t, g, unknown or other
  misc_feature (373)..(373): n is a, c, g, or t
tcagactgtacagtcacgaccggtgctcgatttagtatctgatagttgggtttgggggaggagcccagcactagaagtcggcggtgtctccattcggtgatcagcactgaacacagaggactcaccatggagtttgggctgagctgggttttcctcgttgctcttttaagaggtgtccagtgtcaggtgcagctggtggagtctgggggagcgtggtccagcctgggaatccctgagactctcctgtgcaacatctggattcgccttcagtaactttggcatccactgggtccncaggctccaggcaagggctagagtgggtnacttttatgggcatgatggcagtgataagctangcagactcgtnaggccnctctcatctcagagacaacgcaagacgtacggtcctttgacaatagaaacgctagacgaccgaggacacggctatgtattacgtgtcgacgagcgactagtgagagtggacaggtgccgtggacgtcgg

SEQ ID NO: 81124 - DNA, 674 bp, Homo sapiens
  misc_feature: GYAE6OF01CGMND.25.38.D05.1.454.CMB.1.raw
  modified_base (253)..(253): a, c, t, g, unknown or other
  misc_feature (253)..(253): n is a, c, g, or t
  modified_base (259)..(259): a, c, t, g, unknown or other
  misc_feature (259)..(259): n is a, c, g, or t
  modified_base (351)..(351): a, c, t, g, unknown or other
  misc_feature (351)..(351): n is a, c, g, or t
tcagactgtacagtcacgaccggtgctcgatttagtatctgatagttgggtttgggggaggagcccagcactagaagtcggcggtgtctccattcggtgatcagcactgaacacagaggactcaccatgggagtttggggctgagcttgggttttcctcgttgctcttttaagaggtgtccagtgtcaggtgcagctgggtggagtcgtgggggaggcgtggtccagcctggggaatccctgagctctcctgngcaacntctggattcgcttcagttaactttggcactccacgtcgggtccgccaggctccgaggcaagggactagaggtgggtgtacttttagtgggcngtgatggcaggtgaataaagcctaagtcgacagaccgtccgtacgaacgggtcccgtacctttcctcctaacttcctccgtaacggaacgaaccgaaaccggaccgtaaacgggaaacgttaccgggtttacccgtttttaggaacccttaaaacgtaacgtaaaaacggtcccgttaaggaaccgggtaaccccggaagggaacccgacgggtaccttagttacgttaacttacgtggtacggacggaaggcgacccgagggttacggagtacgggtacggacggtaacgggtcgggaccggtgggtaccggttaccggggg

SEQ ID NO: 81125 - DNA, 652 bp, Homo sapiens
  misc_feature: GYAE6OF01DAM1E.25.38.D05.1.454.CMB.1.raw
  modified_base (214)..(214): a, c, t, g, unknown or other
  misc_feature (214)..(214): n is a, c, g, or t
  modified_base (263)..(263): a, c, t, g, unknown or other
  misc_feature (263)..(263): n is a, c, g, or t
  modified_base (328)..(328): a, c, t, g, unknown or other
  misc_feature (328)..(328): n is a, c, g, or t
  modified_base (490)..(490): a, c, t, g, unknown or other
  misc_feature (490)..(490): n is a, c, g, or t
  modified_base (501)..(501): a, c, t, g, unknown or other
  misc_feature (501)..(501): n is a, c, g, or t
  modified_base (639)..(639): a, c, t, g, unknown or other
  misc_feature (639)..(639): n is a, c, g, or t
tcagactgtacagtcacgaccggtgctcgatttagtatctgatagttgggtttggggactgatcaggactcctcagttcaccttctcactatgaggctccctgctcagctcgttgggctgctaatgctcgtcgggtccctaggtaaggacaggaaggagagtggagggaggagaagtgggggtagggaaggactccgagtgacgagagtattgngactcgacccagacctccacttcctcttgtactactcccacccgtgganacgcgtacgccctccatcctccgtgcgtaggtctagtccgagacgtccctcctgactaataggtnacgtgtactactactttagttttgtagtttggtactacgactaagaaacgccgaggtcccaacgttcctaacccgcctcttccgtatacttcgtaagttaccgtaaccgttttcccgaaccggttttcagtagggactaccggacgtagtagttcggttacngggtacgacgngggttacggacggaacggactacgtttacgttaacaaccgaagtttaacgaaagtcccggtacggtaaccgggtagagtacggttggtaacggtttaagtttttcgaaagttttcaacgtggacttgtacgattaagnaacgtacgaatag

SEQ ID NO: 81126 - DNA, 688 bp, Homo sapiens
  misc_feature: GYAE6OF01BDRAO.25.38.D05.1.454.CMB.1.raw
  modified_base (284)..(284): a, c, t, g, unknown or other
  misc_feature (284)..(284): n is a, c, g, or t
tcagactgtacagtcacgaccggtgctcgatttagtatctgatagttgggtttgggggactgatcaggactcctcagttcaccttctcactatgaggctccctgctcaactcttggggctgctaatgctctgggtccctggtaaggacagaaggagatgagggaggagaagtgggggtgggaaggatccagtgcagagattgtgatgacccagactccactctccttgtctatccacccctggagagcaggcctcatctcctgcagtctagtcagacgcctccngcatagtgatgatacacttattgtattggttctgacaagaaacgccgaggcctagtaccctccacgtcctacctgatactatacgtaacgttttacccgaaccggtttctacgtaggtacgtcgacctaagtagtttacggttacgtaggttcgggacgtacgggtccgggtacgaacggggtaacgtaacggttaactttaaccgaaccgtaaaccgttaaaggtaaaacgttaccggaacggggtacccgggggttagggtaacggggtccgtagggttaacgggtttaaggtttttaacggggtttaagttttaaacgttttaacccggtaggtacccgtaaacggttaggaaccgtaaagggtactacgggtaactaaaacccggtaaaggttaaacccg

SEQ ID NO: 81127 - DNA, 675 bp, Homo sapiens
  misc_feature: GYAE6OF01EZ6H4.25.38.D05.1.454.CMB.1.raw
  modified_base (343)..(343): a, c, t, g, unknown or other
  misc_feature (343)..(343): n is a, c, g, or t
  modified_base (432)..(432): a, c, t, g, unknown or other
  misc_feature (432)..(432): n is a, c, g, or t
tcagactgtacagtcacgaccggtgctcgatttagtatctgatagttgggtttggggggggagaggagcccagcactagaagtcggcggtgtctccattcggtgatcagcactgaacacagaggactcaccatggagtttgggctgagcttgggttttcctcgttgcttcttttaagaggtgtccagtgtcaggtgcagcgtggtggagtcgtgggggagcgtggtccagtccgtagggaacgtcccgtagacgtacctcgtcctgtcgaccaactatccgttggactttccggccctttacgaagtttaaagtttggacctactccgacggttcgggtcccncgaggcctaccgaggaccgaagggtacctaggaggttggggttatttaacgtttttagtcgggactagttggaagtcggactaaggtanaacgtaaacgccttaatcggaccgaggtacccgtcccggtacgaacgggtccgtccttccgtacctacttcctaccgaagacgaacaaccgaccgaaagaacggtaccgtttctttacgactaaacgacgaaacgtccgtacggacgaccgaagaccgacgtactatagtagttacgtcgtacggtcgaacgtacgaccggtagaggagacggtcggacgtaggtcggtccggtggtaccggg

SEQ ID NO: 81128 - DNA, 667 bp, Homo sapiens
  misc_feature: GYAE6OF01C424M.25.38.D05.1.454.CMB.1.raw
tcagactgtacagtcacgaccggtgctcgatttagtatctgatagttgggtttgggggaggagcccagcactagaagtcggcggtgtctccattcggtgatcagcactgaacacagaggactcaccatggagtttgggctgagcttgggttttcctcgttgctcttttaagaggtgtccagtgtcaggtgcagctggtggagtcgtgggggaggcgtggtccagccgtggggaacgtccctgagactctcctgtgcaacatctggattcgccttcagttaactttggcatccacgtgggtccgccaggctccgagggcaagggactaggagttgggtagtactttttagtgggcagtgagtggcagtgaataaagcctagtgcagtacctccgtacgaacgggtcccgcttccgtccctaacgtccctacccgaagaccgtaaccgaaaccggtacccgaaaggtaacggtacccgggtttacctttttacggaacctaaaattacgggaaaacgcccgttaaggaaccggaaccccggaacgggaaccgaaccgggtacttaagttacgtttaagtttacgtaggtacggacggtaacggacgacccgaaggtcggacggtaggtcggacgtacggtaccggcccggttgggtacggtacccgggg

SEQ ID NO: 81129 - DNA, 835 bp, Homo sapiens
  misc_feature: GYAE6OF01C1YN9.25.38.D05.1.454.CMB.1.raw
tcagactgtacagtcacgaccggtgctcgatttagtatctgatagttggggtttggggggggagaggagcccagcactagaagtcggcggtgtctccattcggtgatcagcactgaacacagaggactcaccagtggaggtttgggctgagtcgttggggtttttcctcgttgtccttacgttttaaaggaggtgtccagtggtacgaggtgcaggtcgtgggtagggagtcggtggggggaggtcgtcgggtaccaggccgttaggggaacttcccgtaggaacgccttcctccgtaggtcgacaaactgttcgtacggtacttccgtcctttacgtaagttaacgtttggcctactccgtacggtcgggtcccgccgaggtcctaccggaagggacaaacgggggtactagggtaagggtttggggtaactttacgtttttaagggtcggggataaggttggtaaacggtgggtacgaaaggtacggtaaaacttaaaaccgggcccttaggttacgaccggaaaccggttaccgttaccccggtacgggaaaccggggtcccggtttccttacccgttaccgtaacttaccccgtaacgaacggaaaccgtaaaccgaaccggaaccggtaaagtaaccgggttaccgtttaccgtttaagaaccgtaaaagtaaccggaaacgtccgaacgggtaacccggaaccgggtacggaaccgacggttaacgtagttacgttacgttacggtcgtaggaccggaacgaggaaccggtagggttagaaggtcgggtaacggtacggttagggcgggttcccggcggggttaccggg

SEQ ID NO: 81130 - DNA, 535 bp, Homo sapiens
  misc_feature: GYAE6OF01BJM0Y.25.38.D05.1.454.CMB.1.raw
  modified_base (293)..(293): a, c, t, g, unknown or other
  misc_feature (293)..(293): n is a, c, g, or t
  modified_base (321)..(321): a, c, t, g, unknown or other
  misc_feature (321)..(321): n is a, c, g, or t
  modified_base (331)..(331): a, c, t, g, unknown or other
  misc_feature (331)..(331): n is a, c, g, or t
  modified_base (343)..(343): a, c, t, g, unknown or other
  misc_feature (343)..(343): n is a, c, g, or t
  modified_base (470)..(470): a, c, t, g, unknown or other
  misc_feature (470)..(470): n is a, c, g, or t
tcagactgtacagtcacgaccggtgctcgatttagtatctgatagttgggtttgggggactgatcaggactcctcagttcaccttctcactatgaggctccctgctcagctcttggggctgctaatgctctgggtccctggtaaggacagaaggagatggagggaggagaagtgggggtgggaaggatccagtgcagagattgtgatcgacccagacctccactctccttgtctatccaccctggagagcaggcctcatctcctgcaggtctagtcagcgcctctgcatagtnatggatacacttatttgtattggtttcngacagaaacnccaggccagtcnccacgctctgatctatgtaacgtttccgaaccgttctcgtggtagtcgcagtagtaggttcaggttggcaggcgggtacgagggacagtactttcactacgtagaaatcgaggccgggtaggacggngtaggtaggttagttttaggtagttttattacgttcgactagtagtacaagatgctacgtaaacg

SEQ ID NO: 81131 - DNA, 744 bp, Homo sapiens
  misc_feature: GYAE6OF01B2PD9.25.38.D05.1.454.CMB.1.raw
  modified_base (222)..(222): a, c, t, g, unknown or other
  misc_feature (222)..(222): n is a, c, g, or t
tcagactgtacagtcacgaccggtgctcgatttagtatctgatagttgggtttgggggactgatcaggactcctcagttcaccttctcactatgaggctccctgctcagctcttggggctgctaatgctcgtcgggtccctggtaaggacaggaaggagagtggagggaggaaggaaggtgggggtagggaaggtctaccgaggtgacgaggagtagttggngtacgtccgacccgagtacctccacttccttccttcgtctactcccgtacccgtgggacgagccgacggtccctacctacttcctccgtgaccgtagggttactacggtcgaaggtaccgtcccctacgtcggacttagttaggtagtacgtacggtaacttaaccgtacgttttaagttttcgttagttttcggttacacggacgaaaggaaacgccgacggtacctacgttcctacccgaccgtcctcgtagtacttacttagttaccgttaaccgtttccccggtaacggttccttacggtacgggtacgtaccgtaccgtaaggtaccgttaggtcgaacgggttccggacggtacgggtacgggtacggaacggtaacgtacgttaacctttcgaacgtaccgtaagtaaccgtcggacgggtacggggtagtacggtcgtaggtacggttttagttacggtacgttttacgacgtcgtacgtagtacgtacgtaacgagtccgaagtaagtaaccg

SEQ ID NO: 81132 - DNA, 662 bp, Homo sapiens
  misc_feature: GYAE6OF01EOPHM.25.38.D05.1.454.CMB.1.raw
  modified_base (185)..(185): a, c, t, g, unknown or other
  misc_feature (185)..(185): n is a, c, g, or t
  modified_base (340)..(340): a, c, t, g, unknown or other
  misc_feature (340)..(340): n is a, c, g, or t
  modified_base (389)..(389): a, c, t, g, unknown or other
  misc_feature (389)..(389): n is a, c, g, or t
tcagactgtacagtcacgaccggtgctcgatttagtatctgatagttgggtttgggggactgatcaggactcctcagttcaccttctcactatgaggctccctgctcagctcttggggctgctaatgctctgggtccctggtaaggacagaaggagatgagggaggagaagtgggggtggaaggntccagtgcagagtattgtgatcgacccagacctccactcttccttgtctactccacccgtggacgacgcacggcctccattcctcctgctaggtctagtcagacgtcctctgctatagtgatcggtactactactttatttgttagtttgtttcngacagaaacgccgaggtaccacgtcctaccaccgtcgtcctagtacttntaacgtcgttaacgtttcccgtaccggtttctacggtgtacgtcgacctaagtagtagttcgaagggtcggacgacggtcgggtacggaaggtaacgtagttacgtttacaacgttaacgaacgtaaacgtaccgggacgggtaccggggtagggtaggtaccggttaagggtaggttttaaggtttttacgggtttaaagttttttacgttaacggtcgttaacgttacgaaggttaccggaaagttacgtaacgaccgtaaacgtaaacgg

SEQ ID NO: 81133 - DNA, 833 bp, Homo sapiens
  misc_feature: GYAE6OF01DFWW3.25.38.D05.1.454.CMB.1.raw
  modified_base (171)..(171): a, c, t, g, unknown or other
  misc_feature (171)..(171): n is a, c, g, or t
  modified_base (191)..(191): a, c, t, g, unknown or other
  misc_feature (191)..(191): n is a, c, g, or t
  modified_base (798)..(798): a, c, t, g, unknown or other
  misc_feature (798)..(798): n is a, c, g, or t
tcagactgtacagtcacgaccggtgctcgatttagtatctgatagttgggtttgggggaggagcccagcactagaagtcggcggtgtctccattcggtgatcagcactgaacacagaggactcaccatggagtttgggctgagcttgggttttcctgttgcttatttaagnggtgtccagtgtcaggtgcngcgtgggtggagtcggtggggggagtcgtggtccagccgtagggaacgtccctggacgtaccttcctccgtgtacgaccaacgtagttccgtggtaactttcccggccttttacgtaaacggtttaacctttcgggactaaccgttcccgtacggttaccggggggttcccgaccccgtaaagggtccccgttaacccgaagggggaacccgtaaaaacggggtaccttaaggggttacgggttacgggtttaacgtttaccgttttttaaggcggggtactaagttggtaaggtagggacttaagggtagaaacttaaaaccggccttaagtacggaacctacggtacccggttccgaacgggaaccgggttcccgtacctttcctacccgtacgttacccgtaccgaacggtaaacgaacccggaaacctacccggtaaaaggtaaccggttacccgggtttaacccttttacggaaaccgttaaacgtaaacggtaaaccgtacccggtaacgaacccgggtaacccggaacggtaaccgtaacgggttactaaggttcgttaacgtacgtcggtacgacggaacgacgtcgaaggtcgaaggngtacggcgtaggccgtaccggtggcgggtaccggg

SEQ ID NO: 81134 - DNA, 847 bp, Homo sapiens
  misc_feature: GYAE6OF01D4YCR.25.38.D05.1.454.CMB.1.raw
  modified_base (258)..(258): a, c, t, g, unknown or other
  misc_feature (258)..(258): n is a, c, g, or t
  modified_base (263)..(263): a, c, t, g, unknown or other
  misc_feature (263)..(263): n is a, c, g, or t
tcagactgtacagtcacgaccggtgctcgatttagtatctgatagttgggtttggggggggagaggagcccagcactagaagtcggcggtgtctccattcggtgatcagcactgaacacagagactcaccatggagtttgggctgagcttgggttttcctcgttgcttcttttaagaggtgtccagtgtcgaggtgcagctgggtggagtcgtgggggagtcgtggtccagccgtgggactcctgagctctcctgtcncaacntcgtggtactttccgacctttacgaagtttaacgtttggacctacgttccccacggttcggggtccccgccgacgggtccctaccggaggacgaagggtacctagggtaggttcgggtacgtttacgtttttaggtcgggactaagttcggaagttcgggacctaagggttagtaaacgtttaaaaacgcccgtttaagtacggacctaaacgggtaaccccgttcccgggttaaccggtaaaccgggggtcccccgttaccgttttaccccgtacccgttaccttaccccgttaaacccggtaaacggtaaccgaaacccgtaaacccgggtaacccgaaaacgggtaaccgggttaccccggtttttaccgttttaaccggaaactaaaacggtaaggaaaacccgtccgttaacgggaacccggaaccccgggtaagggaacccgtaccggttaacttaacgttacgtttaaaccgttcgtaacgggttacggaccggtaaaggtacccgtaccggtaaggtaccgggtaaggtacggtacggacggttaacgggttccgggaccgttacggggtacccgg

SEQ ID NO: 81135 - DNA, 708 bp, Homo sapiens
  misc_feature: GYAE6OF01DLUCB.25.38.D05.1.454.CMB.1.raw
  modified_base (333)..(333): a, c, t, g, unknown or other
  misc_feature (333)..(333): n is a, c, g, or t
tcagactgtacagtcacgaccggtgctcgatttagtatctgatagttgggtttgggggactgatcaggactcctcagttcaccttctcactatgaggctccctgctcagctcttggggctgctaatgctctgggtccctggtaaggacagaaggagatgagggaggagaagtggggtgggaagatccagtgcagagattgtgatcgacccagacctccactctccttgtctactccacccgtggagagcacgcctcatcctctgcgagtctacgtcagacgtccctctgacatagtgatcggatactacttattttgttagtttcggtttacncgtacgaaagtaacgccgaaggccctagttcctacccgaacgtcctacccgtgtaacttcctaagttacgttaaccgttttaccccgtaaacccggttttcctacggttacgggtacggtaccgacccgtaagtaacggttaaggtttccgaagggttcgggacgtacggggtccggggtacgggaacgggtaacgttacggtactttaaccgaactaaccgtaacgtaaaacgtaccggtacgggtacccggggttagggacgggtacgttaacggggttaacggtttaggtttttaagggttacggttttaagttaccggttaggtaccctagtacggtacgtaaaagtcttaacgaccgtaaataaaaccgg

SEQ ID NO: 81136 - DNA, 618 bp, Homo sapiens
  misc_feature: GYAE6OF01BYTSG.25.38.D05.1.454.CMB.1.raw
  modified_base (541)..(541): a, c, t, g, unknown or other
  misc_feature (541)..(541): n is a, c, g, or t
  modified_base (580)..(580): a, c, t, g, unknown or other
  misc_feature (580)..(580): n is a, c, g, or t
tcagactgtacagtcacgaccggtgctcgatttagtatctgatagttgggtttgggggactgatcaggactcctcagttcaccttctcactatgaggctccctgctcagctcttggggctgctaatgctctgggtccctgggtaaggacagaaggagagtggagggaggagaagtgggggtagggaaggatccgagtgcagagtattgtgatcgacccagactccactcctcttgtctactccacccgtggagacgcacggcctccatcctcctgcgtaggtctagtcaggacgtcccttcgtgacagttacgtgagtggtaactactacctttattttgttatttcggttctgacgaagaacgcgtacgacctagtcctccgacgtcctctgacttactattacgttaacgtttccgtaacggttctcggtaggtacgtcgacgtaagttagtacggtacgtaggtcggcgacggtcggtacgaacgggactagttacttacaactacgtaagtaaacgtgacgggtcgggaggtacggngtaggtaggttaggttttaggttacgttttaattcggtntacgtacgtagtacaagtagtacgaacgtagtaaacgg

SEQ ID NO: 81137 - DNA, 703 bp, Homo sapiens
  misc_feature: GYAE6OF01DY29K.25.38.D05.1.454.CMB.1.raw
  modified_base (671)..(671): a, c, t, g, unknown or other
  misc_feature (671)..(671): n is a, c, g, or t
tcagactgtacagtcacgaccggtgctcgatttagtatctgatagttgggtttgggggactgatcaggactcctcagttcaccttctcactatgaggctccctgctcagctcttggggctgctaatgctctgggtccctggtaaggacagaaggagatggaggggaggagaagtgggggtgggaaggatccagtgcagagattgtgatcgacccagacctccactcctccttgcctatccaccctggacagcaggcctccatcctcctgactaggtctagcagacgccttccctagactaagttaggtagagttaggtaacttaaccgtaccttttagtttttaggtttagtttttcggtttctgacgaaacggaaacggtcccgagggtacccctacgttccgccctaaccgtccttccgtagtacttaccgttaagttaccggttaaccggtttttacccgtaaccggttttccttaccggttagggtacgttaccgtaacccgtaggttaacgttacggtttcggaggtcggacgtcgggacgggtacggaagggtactaaggtacttaacgaactaacgtaagtaaaccgttcggaccgggtcggggtaggacggtcgtagggtaacggttagttttacggggttattttaagttacgtgttaacgnttaacggataaggtctacgaacacgtaaaccg

SEQ ID NO: 81138 - DNA, 696 bp, Homo sapiens
  misc_feature: GYAE6OF01D6990.25.38.D05.1.454.CMB.1.raw
  modified_base (493)..(493): a, c, t, g, unknown or other
  misc_feature (493)..(493): n is a, c, g, or t
  modified_base (526)..(526): a, c, t, g, unknown or other
  misc_feature (526)..(526): n is a, c, g, or t
  modified_base (678)..(678): a, c, t, g, unknown or other
  misc_feature (678)..(678): n is a, c, g, or t
tcagactgtacagtcacgaccggtgctcgatttagtatctgatagttgggtttgggggactgatcaggactcctcagttcaccttctcactatgaggcctccctgctcagctcgttgggctgctaatgctcgtcggtcctagggaagacaggaaggagagtaggagggaggaagtaaggtgggggtagggaaggctccgaaggtgagaggtagtagttggtacgacgtacgacccagtacctcctacttccttccttagtactactcccgacccgtagggacgacgcgtaccggtccctaccacttcccgtcgtcgtacgtacggtctacggacgacggtcctcctacgtgacgtaagttggagtagttacgaacttacccttagtttagtttgttcgttttcgttacgacgacgtaagaaccgcgtacggtactacgtcccaccgtacgtccttctagtcttacgtacgttaacgttaccgttaccgtcgtntcggtcggatcgaacgtaggttgtacggtacgngtaccggcgtacggggtacgtaccggagtacacgtttacgacgaagtacgaagaaccggttcggcgggtacgggtactaggttacggttaggttaacggtttgtttaacggtaactttggaccgtagacgttacgaggaaacttggaacccngtaaaccgtagttaaccg

SEQ ID NO: 81139 - DNA, 658 bp, Homo sapiens
  misc_feature: GYAE6OF01D20JJ.25.38.D05.1.454.CMB.1.raw
  modified_base (392)..(392): a, c, t, g, unknown or other
  misc_feature (392)..(392): n is a, c, g, or t
  modified_base (561)..(561): a, c, t, g, unknown or other
  misc_feature (561)..(561): n is a, c, g, or t
tcagactgtacagtcacgaccggtgctcgatttagtatctgatagttgggtttgggggactgatcaggactcctcagttcaccttctcactatgaggctccctgctcagctcttggggctgctaatgctctcgggtccctaggtaaggacagaaggagagtggagggaggagaaggtggggtagggaaggatccagtgacagagtattgtagatacgaccacgacctaccacttccttccttgtaccttactcccaccccgtgggacgacgccgacggtccctcctactcctccgtgcgtaggttctagtcacggacctcccttctcgactaagttaggtacgtagtaggtaactaccttactttagttttacgttagttttcggttttacngtaacgaaacggaacgaccgacggccctacgtcctccgaccgtccttcgtacgtattacttagtacgtttaaccgtttaccgtaccggtttctcggtacggtacgtcgaacgtagtagttcgtacgagggtcggacgagggtcggacgaggtactaagtcttaaccganaacgtagaaacgtcggacgggtcgggagagtcgtagggtagtttagtttaggttatttactagttgacgtagtagtacgtagatcgaatacgtaacg

SEQ ID NO: 81140 - DNA, 690 bp, Homo sapiens
  misc_feature: GYAE6OF01EUH0H.25.38.D05.1.454.CMB.1.raw
  modified_base (361)..(361): a, c, t, g, unknown or other
  misc_feature (361)..(361): n is a, c, g, or t
tcagactgtacagtcacgaccggtgctcgatttagtatctgatagttgggtttggggactgatcaggactcctcagttcaccttctcactatgaggcctccctgctcagctcgttggggctgctaatgctcgtgggtccctgggtaaggacagaaggagatggagggaggagaagtggggtgggaaggatccagtgcagagtattgtgatcgacccagacctccacttcctccttgtctactccacccgtggagagcgacgcctccattccgtcctgccgtaggtctagtacgaagccgtcccctccgtgctagtaggtgagtcggacttacctactttattttcgttagtttcgtttacngacaagaaacgtcaacggctaactccgtacccgacgtcctaccgtagtacttactagttacgttaaccgtttacccgtaacgttctacgtgggtacttacgacctaggtacgtttacggttcgaagggtcggacgtaccgggtcggtagaacgggtacctaaggttacttacgaacctaacgtaagtaaacgttccggaacgggtccggggtaaggtacggacgtttaagggtaaggtttaggttttttacgggtaacgtttttaacgttacgacgttaccgagttagttaaacccggaaagtttacgacccgtaaagaacgtttaaac

SEQ ID NO: 81141 - DNA, 703 bp, Homo sapiens
  misc_feature: GYAE6OF01BS80G.25.38.D05.1.454.CMB.1.raw
  modified_base (215)..(215): a, c, t, g, unknown or other
  misc_feature (215)..(215): n is a, c, g, or t
  modified_base (271)..(271): a, c, t, g, unknown or other
  misc_feature (271)..(271): n is a, c, g, or t
  modified_base (686)..(686): a, c, t, g, unknown or other
  misc_feature (686)..(686): n is a, c, g, or t
tcagactgtacagtcacgaccggtgctcgatttagtatctgatagttgggtttgggggactgatcaggactcctcagttcaccttctcactatgaggctccctgctcagctcgttggggctgctaatgctcgtcggtccctggtaaggacaggaaggagagtggagggaggagaaggtgggggtagggaaggatccgagtgcaggagtagttggngagtacgacccagacctccctacttccttccttgtacctactccacccgtggacgngccgacgcctccacgtctccgtgctacggtactagtcgacgtacgtccctccgtgtactagttagagtagtacggtaacttacctacctttagttttagttacggttttcgtttactacggaacgtaaacggaacggtacccgtacggtacccgtaacgttccctacccgtaccgtccttcccgttagtacttacgttacgtaacggtttaccgttacccgtaaccgtttcgtacgtggtacgtcgtaccgtaagtacgttagtacgtggtcgggacgtacgggtcgtacgggaacgtacgttacgttactacgaacgtacgtaagtaaccgacgggtacggtcgggtaggacggtcgttaggtacggtttagttaggttacgttagtacgtgacgttagtacgtacgtaagtancgtaacgtaagtaaccg

SEQ ID NO: 81142 - DNA, 741 bp, Homo sapiens
  misc_feature: GYAE6OF01E0PY7.25.38.D05.1.454.CMB.1.raw
tcagactgtacagtcacgaccggtgctcgatttagtatctgatagttgggtttgggggactgatcaggactcctcagttcaccttctcactatgaggctccctgctcagctcttggggctgctaatgctctggtccctggtaaggacagaaggagatggagggagagaagtggggtgggaagatccgagtgcagagattggtagatgacccagactccactctaccttgtactactaccaccccgtggacgagcaggccctaccacttcctccttagcgtaaggtctaagtacgacgacggtcccttccgtacggactaagttagtacgaagttacggtaacttaaccttaacctttagttttaggtttagttttacgggttttctaggtaacgaaggtaaaccgtccgtaacggcgacgttcctacccgacgtccttacctagaactttacgttaacgttacggttaaaccgtttacccgtaaacccggttcttacggtagggtacggtacggtaacctaggtaagttacggttacggacggtcggacgtagggtaccgggttacggaacgggtaacgtattacgtttaaccgaacgtaacgtaacgtaaaactccgggttaacgggaccggggttagggacggtaccggtaggttaagggttaaggtttttaaggttaacgttttagttacgttaggaacgtagtacgtaacgaagtaagtcgaacgtaaagtaaaccg

SEQ ID NO: 81143 - DNA, 835 bp, Homo sapiens
  misc_feature: GYAE6OF01AVWGD.25.38.D05.1.454.CMB.1.raw
tcagactgtacagtcacgaccggtgctcgatttagtatctgatagttgggtttgggggactgatcaggactcctcagttcaccttctcactatgaggcctccctgctcagctcttggggctgctaatgctcgtgggtccctagggtaaggacaaggaaggagagtaggaggggaggaggaaggtggggggtagggaaggtactccgaggtgacgaggtagtagttggtagacgtaccgaacccacgtacctacctacttccgttccttcgtacctactacccgacccggtaggacgacgacgacggtaccctctacttcctccgtggacgtacggttactacgtacgacgtacctcccgtaccgtgaccgtaagtacggtagaacggtacggtaacttaaccgttaccttttaaggttttaggtttaagttttcggttaccgtcggaacgtaaaccggaaaccggtccgaacggtacccgttacgttcccgtaccgaaccgttccttaccgtagttaccgtttaacgttaacgggttaaccgtttaaccccgggtttcccgtaaccgggtttcgttacgggacgggttaccacggtaaccgttaagggttacgtacgggttacgtacgggtcgggaaccgtcggggttaaccggaagggtaacggtactaacgggtttacgtaaccgaacgttaacgtaaagtacgggtaccggacgggggttacgggtagaacggttggttaagttaccgggtttaagggtttacggttactttaacgtcggtaacggtcgtaaagttacggaaacgttgaaccggttcaacgtaagggtaacc

SEQ ID NO: 81144 - DNA, 692 bp, Homo sapiens
  misc_feature: GYAE6OF01DZTKH.25.38.D05.1.454.CMB.1.raw
  modified_base (228)..(228): a, c, t, g, unknown or other
  misc_feature (228)..(228): n is a, c, g, or t
  modified_base (273)..(273): a, c, t, g, unknown or other
  misc_feature (273)..(273): n is a, c, g, or t
  modified_base (642)..(642): a, c, t, g, unknown or other
  misc_feature (642)..(642): n is a, c, g, or t
  modified_base (670)..(670): a, c, t, g, unknown or other
  misc_feature (670)..(670): n is a, c, g, or t
tcagactgtacagtcacgaccggtgctcgatttagtatctgatagttgggtttgggggactgatcaggactcctcagttcaccttctcactatgaggctccctgctcagctcttgggctgctaatgctctggtccctggtaaggacagaaggagagtggagggaggagaagtggggtagggaaggactccgagtgcagtagtattgtgatcgacccagacctccactntccttgtctactccacccgtggacgagcgacgcctccatcctccngcgtacgtctagtcacgctcccgtcctgactagtacgtagagtcggaacttacctacgtttatttcgttagtttgtttacgacgtacgtaaggaaacgccgtacggaccgtaacgtcctacccgaccgtcgtaccctagtacttacgtacgttaagttaacccggtttacccgtaaccggtttctacggttacggtacggttcgacgtaaggttacgttacggtactacgggtacgggtgaacggggtccgggtaacaggggtacccttagtactttacccgaaagtaccgttaaggtaaaccgtcggaacgggtttccggaggcggtcgttagggttacgttagttttacgggtattttaaggtcccngttacgacgttacggaacgtaacgttanacgtaaaccgagttaaacccgg

SEQ ID NO: 81145 - DNA, 843 bp, Homo sapiens
  misc_feature: GYAE6OF01CRJY3.25.38.D05.1.454.CMB.1.raw
  modified_base (264)..(264): a, c, t, g, unknown or other
  misc_feature (264)..(264): n is a, c, g, or t
  modified_base (623)..(623): a, c, t, g, unknown or other
  misc_feature (623)..(623): n is a, c, g, or t
tcagactgtacagtcacgaccggtgctcgatttagtatctgatagttgggtttgggggactgatcaggactcctcagttcaccttctcactatgaggctccctgctcagctcttggggctgactaatgctcgtgggtccctggtaaggacagaaggagatggagggaggagaagtgggggtgggaaggatccgagtgcgaagagtagttgtgagtacgacccagacctaccacttccgttccttgtactactaccctaccccgngggaacgcgtaccgcggtcccttacccattcctccgtggaccgtaacgggttcctaacggtacgtaacggtccgtaaccccgttcctacgggtacctaagttacggtggtaacgtacggttaacttaaccttaccgtttagtttttacgtttacggttttacgggtttaccacggtaacggaaacggttaaccgccggttaaaccgggacctaacggttacccgaacccgtccgttacccgttaccgtagttaacgttaccgttaaaggttaccgtttaaaccgggtttcccgtaacccggtttcgtcggttacgggtaccgtgacccgttaaggttgtaaccgttacgtggggtccgnggttaacggggacgggtacgtaacgggtacgttaacgttacttaaccggaaccttaaacgtaaacgggtaccgtacgggtaaccgggtccggggtagggtacggttaccggtaagggtttacgggtttaacggtttttaggggttaacttttacccggttaaagttcccggtaagtacggtacgtaaccgtaaggactaccggtaagaaccgttaaacgg

SEQ ID NO: 81146 - DNA, 729 bp, Homo sapiens
  misc_feature: GYAE6OF01D855N.25.38.D05.1.454.CMB.1.raw
  modified_base (715)..(715): a, c, t, g, unknown or other
  misc_feature (715)..(715): n is a, c, g, or t
tcagactgtacagtcacgaccggtgctcgatttagtatctgatagttgggtttgggggactgatcaggactcctcagttcaccttctcactatgaggctccctgctcagctcttggggctgctaatgctctgggtccctggtaaggacagaaggagatgagggaggagaagtggggtgggaaggatccagtgcagagtattgtgatcgacccagacctccactctccttgtcctactccacccgtggagagcacggcctccatctcctgcgtaggtctagtcgaagcgcccttccgtgctagtacgtgagtcggaactacctaacctttattttggttattttcggtttctacggtacaacggaaaacgtccgacggcccgtacgttcctacccgtaccgtcccgtcctagtacttacttacgttaacggttaaccgttttacccgtaaaccgggtttcccttcggtacgggtacgttaaccgtacgtaagggttaacgtttacggggttacgtaacgggttcggggacgtaccggggtaccggggtacggtaaaggggtactaaccggttactttaaccgaacgtaacgtaagtaaacgtcggtaacgggtacccggggtaggacggtacggttaggtaggtttaaggttttacgggtttaaagttttacttacggtcgtaacgtacgtaggtacgtaaagtgtaacccggtanaaaacccggttaag

SEQ ID NO: 81147 - DNA, 808 bp, Homo sapiens
  misc_feature: GYAE6OF01BB8JE.25.38.D05.1.454.CMB.1.raw
tcagactgtacagtcacgaccggtgctcgatttagtatctgatagttgggtttgggggactgatcaggactcctcagttcaccttctcactatgaggctccctgctcagctcttggggctgctaatgctctgggtcctggtaaggacagaaggagatggagggaggagaagtggggtagggaaggatccgagtgcagagtattgtgatcgacccagactccactcttccttgtctactccacccctggagacgcgacgcctccatcctccgtgcgtaggtctacgtcgacgacgtcccttccgtgacctattacggtagagtaggaacttacctaaccgtttagttttggttaacgttttcggtttactacggtaccgtaaaagggtaaacccggtccggtaacggtacccgtaacggttaccctaccccgaccgtacccgttccgttaggtactttaccgttaacgttaacggtttaacccggttttaccccgtaaccgggttttcccgttacggttacggggtaacgtttacccgggacttaacggggttaacgtttacggggttacgtacgggtttacggggcccgggtaggggttacccgggggttacgaacggggttacgttaaacgtttaccggtttaaccgaaaccgttaaccggtaaaagtaaaccgttcgggacccggggtacgggggtagaaccgggttaggtacggggtttaagtttacgggtttttacggtaagtttttacggtactgggtaattacgttaggacctaaggtatcggaaactaacggttaaaccgg

SEQ ID NO: 81148 - DNA, 852 bp, Homo sapiens
  misc_feature: GYAE6OF01CAX61.25.38.D05.1.454.CMB.1.raw
  modified_base (164)..(164): a, c, t, g, unknown or other
  misc_feature (164)..(164): n is a, c, g, or t
  modified_base (209)..(209): a, c, t, g, unknown or other
  misc_feature (209)..(209): n is a, c, g, or t
tcagactgtacagtcacgaccggtgctcgatttagtatctgatagttgggtttgggggactgatcaggactcctcagttcaccttctcactatgaggctccctgctcagctcgttggggctgctaatgctcgtgggtccctaggtaaggacaggaaggagtagnggaaggggaggaggaggtgggggtagggaaggactccgaggtganaggtagtattggtagacgtaccgaccctacgacctacctaccttcttcctttgtacctaacctccccaacccggtgggaacgcggtacgaccggtccctacctacttccgtcccgtaggtacgtaacgggttaccttaggaccgtaaggacccggtccccttccgttacgacctaacggttaggtacgtaacgggttacggttaaaccttaacccgtttaaccgtttttaagtttttaacggtttcggttttttaacgggtttccggtaaacgacggtaaaaccggaaccggttacccggaaccggttacccgttaccggttaaccccgtacccgacccggttccttaacccggtgtaactttacgttaacgttacggttaaccgtttaccggttaccgtttacgtacggtaggtacggtcgaacgttacgtaaggttacggtacggtacggtacgggacggtacggtcgggtacggaacgtacgtaagttacgtaccgaacgtaacgtaaacgtaacggtaccggacgggtacgggggtacgacggttacgggttaggtagggtttagttttacggttacgtttacgttaacgtcggtacgttaggaacgttacggtaagtaccgtagaacgtaagtaacgg

SEQ ID NO: 81149 - DNA, 796 bp, Homo sapiens
  misc_feature: GYAE6OF01A1DEY.25.38.D05.1.454.CMB.1.raw
  modified_base (757)..(757): a, c, t, g, unknown or other
  misc_feature (757)..(757): n is a, c, g, or t
tcagactgtacagtcacgaccggtgctcgatttagtatctgatagttgggtttgggggaggagcccagcactagaagtcggcggtgtctccattcggtgatcagcactgaacacagaggactcaccatggagtttgggctgagtcgttgggtttttcctcgtttgcttacgtttttaaggaggttgtccagttgtcgaggtgcagcgtgggtggagtcggtgggggagcgtggtccaggtccgtagggaacgtcccgtgacgtaccttcctccgtggtcgaccaactattccgtggtactttcccggtaccttttacgtaaacgtttaaaccgttttgggaccttaacgttccccgtaaccgggttccggggtccccgacccgaacgggtcccttacccggaggaccgaaagggggtacctagggtaaggttcggggttacgtttaaacgttttttaggtcggggacttaaggtcgaaggttcgggaactaaggtaacgtaaagttaacgccgttaagtcgaaccgtacgtaccgtcccggtaacggaaccgggtccctccttacctaccctacttaccgtaaccgaaggaacgaacctaaaccggaaccgaaacgggtaacggttaccggtttaccgtttaaggaactaaacgaaacggtaaaccgtcgtaacggaaccggaacccggaacggtaccgtaaccgtacgttaagttagttaacttacggtgtacgagaccggagtaccgagggtagnggtagtcgacgtaggtacggtcggtcggtcggtacgggg

SEQ ID NO: 81150 - DNA, 760 bp, Homo sapiens
  misc_feature: GYAE6OF01EV0I6.25.38.D05.1.454.CMB.1.raw
tcagactgtacagtcacgaccggtgctcgatttagtatctgatagttggggtttgggggactgatcaggactcctcagttccaccttctcactatgaggcctccctgctcagctcgttggggctgctaatgctcgtcgggtcccgtaggtaaggacagaaggagagtggagggaggagaggtggggtgggaagatcgagtgacgagagtattgtgatcgacccgatacctaccctacttccgttcctttcgtacctaccgtaccccaccccggtagggacgacgaccgacgtccctaccctacttcctccgagcgtacggtactagtaccgacggtacctccccgttacctggacgtagttagggttacaggttacggaaccttaccttactttttagttttcgtttaagttttcggttactcgaaacgtaaggaacggcgtaaccggctacgtaccctccctaccgtccttcgtactattacggttacgtacgttaaccgtttaccctaccgtttcgtacgtacgtcgtactacgtaggtagttacggtcgacggttaggcgggttacggacgggtaaggacgacgtttaacgactttaaccgaagttaccgtaaagtaacgggttaccggacgggacggggttacgggtacggttaggttacggggtttacggttttagggtttttaacgggtttaacttttacgggagtccgtacgttaagtaccgaacgtacgggtaatcgtaagaacgtaaaccg

SEQ ID NO: 81151 - DNA, 805 bp, Homo sapiens
  misc_feature: GYAE6OF01AQ6OQ.25.38.D05.1.454.CMB.1.raw
tcagactgtacagtcacgaccggtgctcgatttagtatctgatagttgggtttgggggactgatcaggactcctcagttcaccttctcactatgaggctccctgctcagctcgttggggctgctaatgctctgggtccctgggtaaggacagaaggagagtggagggaggagaaggtggggtagggaagatccgagtgacgagagtagttgtgacgtcgaacccagacctccactcttccttgtctacgtacctacccgtggagagccgacggtccctaccctattcccgtccgttacggaccgttacggttaccgtacgttacgacggaccgtccccgtcctagactaagttacgagtagtacggtaacttacctaccgtttaagttttcgtttaggttttcggtttcgtaggtaaccgaaacggtaaacgacccggtaccggtcccgtacgttaccctaccccgtaaccgtcccgttcgttacgtacgtacttaacggttacgtttaaccggtttaccccgttaacccggtttcgttaccggttacgggtcggtaccggacgttaaacggtacgttagggttaaccggtagggtaccggaggtaccggggacgggtacgaagggtactaacggttacgttaaccgaacgtaaccgtaacgtaaccggttacgggaccgggtacggggtacggtacgggttacgttaggggttaaggtttaggtttaacgggtttagttttacgttaggttaccggtagtacggtaagtacggtaagtagtaaccggtagtaaacgtaaaccgg

SEQ ID NO: 81152 - DNA, 851 bp, Homo sapiens
  misc_feature: GYAE6OF01AHH1U.25.38.D05.1.454.CMB.1.raw
  modified_base (201)..(201): a, c, t, g, unknown or other
  misc_feature (201)..(201): n is a, c, g, or t
  modified_base (230)..(230): a, c, t, g, unknown or other
  misc_feature (230)..(230): n is a, c, g, or t
  modified_base (321)..(321): a, c, t, g, unknown or other
  misc_feature (321)..(321): n is a, c, g, or t
  modified_base (416)..(416): a, c, t, g, unknown or other
  misc_feature (416)..(416): n is a, c, g, or t
  modified_base (487)..(487): a, c, t, g, unknown or other
  misc_feature (487)..(487): n is a, c, g, or t
  modified_base (508)..(508): a, c, t, g, unknown or other
  misc_feature (508)..(508): n is a, c, g, or t
  modified_base (689)..(689): a, c, t, g, unknown or other
  misc_feature (689)..(689): n is a, c, g, or t
tcagactgtacagtcacgaccggtgctcgatttagtatctgatagttgggtttgggggtagggaggcccgagcactagaaggtcggcggtgtctccattcggtgatcagcactgaacacagaggactcacatggagtttgggctgagcgtgggttttcctggtttgcgttcttttaaggaggttcgttccgtagttggtcngggtatcgaggtctgggtcggaggtcggnggggggtacggcggtcggtaccgacggtccgttacgggggaacgtcccgttaggacgtaccgtccgtaccttggacggtacaaaaccgttntcggtcgggaactttccggtcccttcgaaggtttacccgttttggaccttacgttcccgtacgttcccggggtcccggtaccccaggggttcccnccggagggaccggtaacgggtaaactgggagggttacggggtaacgtttacggtttttaagcggggttaancgttaggggttaacgcgggtntaaacggggttagttaaacggtaaactccggtaagtccgggttacgtaaatcccgggtaaccggttaagccggggttaaccctccggttactacggtcctaaccgtccgtaaccggtacgaaccgtaactaaccgaacgtaacggtcctttaacgttcgaagttaacggaataaacccggntaacgggacccctaacgggacggtaccgtaaacggtcgtaaccggttagggtttaaacctagttcgggtacgggtaccctaagggaccctagtacggggtaacaacgggttaaggggctaaccgggtgggtaaccgggcgttaccggggtacccggtggggg

SEQ ID NO: 81153 - DNA, 774 bp, Homo sapiens
  misc_feature: GYAE6OF01EE2K9.25.38.D05.1.454.CMB.1.raw
  modified_base (153)..(153): a, c, t, g, unknown or other
  misc_feature (153)..(153): n is a, c, g, or t
tcagactgtacagtcacgaccggtgctcgatttagtatctgatagttgggttgggggactgatcaggactcctcagttcaccttctcactatgaggctccctgctcagctcgttgggctgctaatgctcgtggtcctaggtaagacagaaggnagtggagggagagaaggtggggtaggaagctcgagtgacgagtagtagttgtcgtagtccgaacccagtacctcctacttccttccgttcgtactacctacccgtaccgtaggacgacgtaccgacggtaccctacgtaaccttcccgttaccgtcggtaccggttacgttaccgtaacgtaccgaacggtacccgtcccgtttaccggtacgttaacgtaacggttaggttaaggtacgtaacggtttaacctaacccgttttaaccgtttttagttttaacggtttacggttttcggtttaacgagtaaccggtaaacgtaacccggacgtaccgtaccgtaccgtacctaccggtaacccgtccttacgtacttaacgttacgttaaggttaccgtttaaccggttacccgttaccgttcgttacggtcgtacgtacgtaacggtacgtacgttaggacgtacggtcggtacggtacggtcggacgtagtaacgtcgtaacttacgaagtactaacgtcgtacgggccggtaggtacggtacgtgttaacgttagttacggttttagtacgttatcgtacgactacgttagacgtactaaggtctaccgtaagtaccg

SEQ ID NO: 81154 - DNA, 862 bp, Homo sapiens
  misc_feature: GYAE6OF01AC8LQ.25.38.D05.1.454.CMB.1.raw
tcagactgtacagtcacgaccggtgctcgatttagtatctgatagttgggtttgggggactgatcaggactcctcagttcaccttctcactatgaggctccctgctcagctcttggggctgctaatgctctgggtccctggtaaggacagaaggagagtggagggagagtaagtggggtgggaagactccagtgcgagagtattgtgatcgacccgagtacctcctacgttccttccttgtactacctaccaccccgtaggacgacgcgtacggcccttccacttccctccgtcggacgtacgggttcctacggtaccgaacggtccgtccccttcccgtagtaccgtaagttacgtagtacgtacggtaacttaccgtaaccgtttttagttttggttaacgtttttcggttttaccgtacggtaacgtaacgggtaaaccgtccccggtaaacggttcccgtaaccgttacccgttaccccgaacccgttccgttacccgtaggttaaccttacctttacggttaacggtttaacccgtttaccccgggtttaacccggtttcgttacggttcgggtaacggttaccgacgttaacggttaacggttacgggttacggagggttacggacggtacgggtacgggacgtaccgggaacgttacggttaaccttaccgaaccgtaacggttaaccgtaaaacgtcccgggtaagggttcccgggggtacggtaacggttcgggtagggtttaaaccggttaagggtttttacggtttaaacggttttaccgttaacggtctacccggttaagtttaccggaacgttaaaggtacccgtaacgtaaccgggtactaaaaccgg

SEQ ID NO: 81155 - DNA, 829 bp, Homo sapiens
  misc_feature: GYAE6OF01BBEA8.25.38.D05.1.454.CMB.1.raw
  modified_base (246)..(246): a, c, t, g, unknown or other
  misc_feature (246)..(246): n is a, c, g, or t
tcagactgtacagtcacgaccggtgctcgatttagtatctgatagttgggtttgggggactgatcaggactcctcagttcaccttctcactatgaggctccctgctcagctcttggggctgctaatgctctgggtccctggtaagacagaaggagatgagggaggagaagtgggggtagggaaggactccagtgcagagattgtgatcgaccagactccactctcctgtctactccacccgtgganagcgacggtcctacactcctccgtgcgtacggtctagtcacggtaccgcccttccgtgacctagttacggtagtacgtaggtaacttacctaaccgttttagttttggtttactttttcgggtttaccgtacgaccggtaaaggaaccggtccgaacggtcccctaacggttccctttaccccggaacccgttccgttcccgttaacgttaccttaacttttaacggttaccgtttaacccggttttaaccccggttaccggttttcgttacggtagggtaccgttacgggacccgtaaggttaccggttagggttaccggagggttaccggtaccggacggggttaccgggtacgggaacgggtaacctttaggtaaccgtttaaccgaacccggttaacgtaaacgggtaaaacggtttcccgggaacgggggttaccggggttacgggaacggttacggttaaggggttaacgggttttaggttttaacggttaacggttttttacttaacggcggtttaacgacgggtttaaccgtaacggttaaacgtaccgtaacggaacccgtaaggtaaacccgg

SEQ ID NO: 81156 - DNA, 729 bp, Homo sapiens
  misc_feature: GYAE6OF01A54GA.25.38.D05.1.454.CMB.1.raw
  modified_base (154)..(154): a, c, t, g, unknown or other
  misc_feature (154)..(154): n is a, c, g, or t
tcagactgtacagtcacgaccggtgctcgatttagtatctgataggttgggtttggggactgatcaggactcctcagttcaccttctcactatgaggctccctgctcagctcttgggctgctaatgctctgggtccctggtaagacagaagganatggagggaggagaagtggggtggaaggatccgagtggcaagagtattgtgaatcgacccgagactaccactcgttccttgtactagtccaacccgtggagagacgaggccctacaagttcctccgagctaggtctaaggctacgacgtcccctccgtagtacgtacgttacggtataacggtacggtaacttaacccctacctttaaggttttcggttaaacggttttccggtttttaacgtacggaaaccgttaaacggaaaaccggttcccgaaacggggtaccctaaggtaccctaccgtaaccgtccttccggtaagtaccgtttactaacggttacgttaaacccgttttaccctaacgggtttctacgtcggacgtcgaccgtaagtacgttaggtccagttacgacggtcgtacggtacagggtaccaaggttactacggaacctaggttaacgaaagttcgacgggtaccgtaggacggttacgacggttaggttcgtttaaggaacttttagtacgtgaccaagggttacccaagtaagtactaccgtaagtaacggtaaacccg

SEQ ID NO: 81157 - DNA, 168 bp, Homo sapiens
  misc_feature: GYAE6OF02IDWOB.25.38.D05.1.454.CMB.1.raw
  modified_base (160)..(168): a, c, t, g, unknown or other
  misc_feature (160)..(168): n is a, c, g, or t
tcagactgtacagtcacgaccggtgctcgatttagtatctgatagttgggtttgggctgaccaaggtcaccgtcctaggtcagcccaaggccaaccccactgtcactctgttcccgccctcctcactgtacagtctgagcgggctggcaaggcgcatagnnnnnnnnn

SEQ ID NO: 81158 - DNA, 165 bp, Homo sapiens
  misc_feature: GYAE6OF02HPU0W.25.38.D05.1.454.CMB.1.raw
  modified_base (160)..(165): a, c, t, g, unknown or other
  misc_feature (160)..(165): n is a, c, g, or t
tcagactgtacagtcacgaccggtgctcgatttagtatctgatagttgggtttgggctgaccaaggtcaccgtcctaggtcagcccaaggccaaccccactgtcactctgttcccgccctcctcactgtacagtctgagcgggctggcaaggcgcatagnnnnnn

SEQ ID NO: 81159 - DNA, 161 bp, Homo sapiens; identical to SEQ ID NO: 81111
  misc_feature: GYAE6OF02GCM3K.25.38.D05.1.454.CMB.1.raw
  modified_base (160)..(161): a, c, t, g, unknown or other
  misc_feature (160)..(161): n is a, c, g, or t

SEQ ID NO: 81160 - DNA, 526 bp, Homo sapiens
  misc_feature: GYAE6OF02GKV1U.25.38.D05.1.454.CMB.1.raw
  modified_base (297)..(297): a, c, t, g, unknown or other
  misc_feature (297)..(297): n is a, c, g, or t
  modified_base (383)..(383): a, c, t, g, unknown or other
  misc_feature (383)..(383): n is a, c, g, or t
tcagactgtacagtcacgaccggtgctcgatttagtatctgatagttgggtttgggggaggagcccagcactagaagtcggcggtgtctccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaagtcccctgagactctcctgtgcaacatctggattcgccttcagtaactttggcatccactgggtccnccaggctccaggcaagggctagagtgggtgacttttagtgggcatgatggcagtgataaagctatgcagactccgtcaagggcccncttctccatcctccagacacaacgccaagacgacgtctttgcaaatgaaacgcctagaacgacccgaggaccacggctatgtaacttacgtgtgacgagacggccaggtgaagtaggtggcaggtcggacctgggacgtcggg

SEQ ID NO: 81161 - DNA, 533 bp, Homo sapiens
  misc_feature: GYAE6OF02G6U29.25.38.D05.1.454.CMB.1.raw
tcagactgtacagtcacgaccggtgctcgatttagtatctgatagttgggtttgggggactgatcaggactcctcagttcaccttctcactatgaggctccctgctcagctcttggggctgctaatgctctgggtccctggtaaggacagaaggagatgagggaggagaatggggtgggaaggatccagtgcagagattgtgatgacccagactccactctccttgtctatcacccctggagagcaggcctccatctcctgcaggtctagtcagagcctcctgcatagtgatggatacaccttatttgtatttggtttctgcagaaagccaggccagtcctccacgctcctgatctatgtaacgtttcccaaccggttctcgtgggagtcgccagtattaggttcaggtggcaggcgggtcagggacaggtattcaactactagaaattcgagggtccgggtaggacggcgtaggaggttagttttagggtaagttttattacgtgtctagtgacgtaagtatgacagtaacg

SEQ ID NO: 81162 - DNA, 523 bp, Homo sapiens
  misc_feature: GYAE6OF02IG98U.25.38.D05.1.454.CMB.1.raw
  modified_base (345)..(345): a, c, t, g, unknown or other
  misc_feature (345)..(345): n is a, c, g, or t
tcagactgtacagtcacgaccggtgctcgatttagtatctgatagttgggtttggggactgatcaggactcctcagttcaccttctcactatgaggctccctgctcagctcttggggctgctaatgctctgggtccctggtaaggacagaaggagatgagggaggagaatggggtgggaaggatccagtgcagagattgtgatgacccagactccactctccttgtctatccacccctggagagcaggcctccatctcctgcaggtctagtcagagcctcctgcatagtgatggatacactatttgtatttggttctgcagaaagcaggccagtctcacgctccngactctatgaacgtttccaaccgttctactggagtcgcagataggttcagtggcagcgggtacagggacagtagtttcactactagaaaactcgaagtccgggtaggacgtacgtaggaggtagttttagggaagttttacttacgtagtactagtgaccagtatacgcgaataacgg

SEQ ID NO: 81163 - DNA, 578 bp, Homo sapiens
  misc_feature: GYAE6OF02FX5YJ.25.38.D05.1.454.CMB.1.raw
tcagactgtacagtcacgaccggtgctcgatttagtatctgatagttgggtttgggggactgatcaggactcctcagttcaccttctcactatgaggctccctgctcagctcttggggctgctaatgctctgggtccctggtaaggacagaaggagatgagggaggagaatggggtgggaaggatccagtgcagagattgtgatgacccagactccactctccttgtctatcacccctggagagcaggcctccatctcctgcaggtctagtcagagcctcctgcatagtgatggatacacctatttgtattggtttctgcagaaacgccaggcagtctccacgctctgatctatagtaagtttcccaacggtttctcgtggagtgccagtagttaggttcagtcggcgagtcggggtacaggggtacaggtacttttccgaactaccgtagtaaaactcgaacgggcccggggtagggaacggtcgtaggtacgggttagttttttagggtagtttttaacgtttaccgtggtactaacggttagacgtaaaggtattacgggacctaacgtaaacgg

SEQ ID NO: 81164 - DNA, 528 bp, Homo sapiens
  misc_feature: GYAE6OF02JKSAL.25.38.D05.1.454.CMB.1.raw
  modified_base (271)..(271): a, c, t, g, unknown or other
  misc_feature (271)..(271): n is a, c, g, or t
  modified_base (298)..(298): a, c, t, g, unknown or other
  misc_feature (298)..(298): n is a, c, g, or t
  modified_base (327)..(327): a, c, t, g, unknown or other
  misc_feature (327)..(327): n is a, c, g, or t
  modified_base (371)..(371): a, c, t, g, unknown or other
  misc_feature (371)..(371): n is a, c, g, or t
  modified_base (378)..(378): a, c, t, g, unknown or other
  misc_feature (378)..(378): n is a, c, g, or t
tcagactgtacagtcacgaccggtgctcgatttagtatctgatagttgggtttgggggaggagcccagcactagaagtcggcggtgtctccattcggtgatcagcactgaacacagaggactcaccatggagtttgggctgagctgggttttcctcgttgctcttttaagaggtgtccagtgtcaggtgcagctggtggagtcgtgggggaggcgtggtccagcctgggaagtccctgagactctcctgtgcaacatctggattcgccttnagtaactttggctagtccatgggtccncaggctccaggcaagggactagagtggtnacttttatgggcatgatggcagtgataaagctatgcagctcgtnaaggccnctctcatctacagacgacaacgacaagaacgacgtacctttagactaaatcgaaacgctagacgaccgagacgacggactgtagtaactatggtagtcgtagacggtacaggtagagtagtacggcgaacgtggccgtaggacgtccggg

SEQ ID NO: 81165 - DNA, 537 bp, Homo sapiens
  misc_feature: GYAE6OF02G0LFM.25.38.D05.1.454.CMB.1.raw
  modified_base (391)..(391): a, c, t, g, unknown or other
  misc_feature (391)..(391): n is a, c, g, or t
  modified_base (450)..(450): a, c, t, g, unknown or other
  misc_feature (450)..(450): n is a, c, g, or t
tcagactgtacagtcacgaccggtgctcgatttagtatctgatagttgggtttgggggaggagcccgagcactagaagtcggcggtgtctccattcggtgatcagcactgaacacagaggactcaccatggagtttgggctgagctgggttttcctcgttgctcttttaagaggtgtccagtgtcaggtgcagctggtggagtctgggggagcgtggtccagcctgggaagtccctggagactctcctggtcgacaacatctggattcgccttcagttaactttggcatccactgggtccgccaggctccaggcaagggactagagtgggagacttttagttggggctagtgatgggcagtggactaaaagccctataggcagactccgtnaagggccgcttcgtccatcgtccagagacaacgtccaagtaagcggtctttagcaaatnaaaagcctagagacccgagacacggcaatgtatatgtgcgtagagcccaagtggaacgagcgggcgagtcgggcctgggacgtcggg

SEQ ID NO: 81166 - DNA, 611 bp, Homo sapiens
  misc_feature: GYAE6OF02I3X6D.25.38.D05.1.454.CMB.1.raw
  modified_base (327)..(327): a, c, t, g, unknown or other
  misc_feature (327)..(327): n is a, c, g, or t
  modified_base (349)..(349): a, c, t, g, unknown or other
  misc_feature (349)..(349): n is a, c, g, or t
tcagactgtacagtcacgaccggtgctcgatttagtatctgatagttgggtttgggggactgatcaggactcctcagttcaccttctcactatgaggctccctgctcagctcttggggctgctaatgctctgggtccctggtaaggacagaaggagatggagggaggagaagtggggtgggaaggatccagtgcagagattgtgatcgacccagactccactctccttgtctatccacccctggagagcacggcctccatcctcctgcaggtctagtcagacgcctcctgcagtagtgatggatacaccttatttgtatttggttcngacagaacgccaggccagtccnccacgctctgatctatgtacgttcctaaccggttctcgtaggacgtcgacctagtagtacggttcaggtcggcgagggtcggtacgaaggggtactaggttactttacgaacctacgtaacgtaaactccggaacgggttccggggtaggtacgggtaccgttagggtacggttaaggtttttggtaaacggttttttacgttaaccgttacgtaccgttaagtaggtaccgtaaggtaacgtcgtaaccgtacgtaaacgg

SEQ ID NO: 81167 - DNA, 566 bp, Homo sapiens
  misc_feature: GYAE6OF02GAMMQ.25.38.D05.1.454.CMB.1.raw
  modified_base (301)..(301): a, c, t, g, unknown or other
  misc_feature (301)..(301): n is a, c, g, or t
tcagactgtacagtcacgaccggtgctcgatttagtatctgatagttgggtttgggggaggagcccaagcactagaagtcggcggtgtctccattcggtgatcagcactgaacacagaggactcaccatggagtttgggctgagctgggttttcctcgttgctcttttaagaggtgtccagtgtcaggtgcagctggtggagtcgtgggggagcgtggtccagcctgggaagtccctgagactctcctgtgcaacatctggattcgccttcagttaactttggcatcccacgtgggtcccnccgaggcctccgaggcaaggggactaggagtgggtatacttttagtgggctagtgatggctagtgaataaagcctagtgacagaccgtccgtacgaacggggtcccgtcttcctcctactcctaccagaacgaaccgaaccgaccaaggaacggtaccgttccttttagactaaatacgaaacgcgtagacgacccgagacgacgactatgtattacgtgtgcgagacgccgaggtgagagtggcgaggtcggcgtaggcgtcgg

SEQ ID NO: 81168 - DNA, 545 bp, Homo sapiens
  misc_feature: GYAE6OF02F70CM.25.38.D05.1.454.CMB.1.raw
tcagactgtacagtcacgaccggtgctcgatttagtatctgatagttgggtttgggggggagaggagcccagcactagaagtcggcggtgtctccattcggtgatcagcactgaacacagaggactcaccatggagtttgggctgagctgggttttcctcgttgctcttttaagaggtgtccagtgtcaggtgcagctggtggagtcgtgggggagcgtggtccagcctgggaagtccctgagactctcctgtgcaacatctggattcgccttcagtaactttggcatccactcgggtcccgccaggcctccgaggcaagggactaggagtgggtgtacttttagtgggctatgatggcagtgataaagcctatgcagacctccgtacgaacgggcccgtcttcctccatcctaccagacgaaccaacgaccgaaagaacgacggttacctttagactaaatagaaaacgcctagacgacccgagaccacggctatgtattactgtgacgagacgcgagtgagagtggacagtcggccgtggacg

SEQ ID NO: 81169 - DNA, 592 bp, Homo sapiens
  misc_feature: GYAE6OF02GNYFS.25.38.D05.1.454.CMB.1.raw
  modified_base (331)..(331): a, c, t, g, unknown or other
  misc_feature (331)..(331): n is a, c, g, or t
  modified_base (583)..(583): a, c, t, g, unknown or other
  misc_feature (583)..(583): n is a, c, g, or t
tcagactgtacagtcacgaccggtgctcgatttagtatctgatagttgggtttggggactgatcaggactcctcatttcaccttctcactatgaggctccctgctcagctcttggggctgctaatgctctgggtccctggtaaggacagaaggagatggagggaggagaagtggggtgggaaggatccagtgcagagattgtgatgaccagactccactctccttgtctatccaccctggagagcaggcctcatctctgctaggtctagtcagacgcctccgtgactatagtgaattggaacttactaccttattttcgtatttggtttcngacaagtaacgcgacgctacgtcctacccacggctcctagtactacgttattcgtaactttccgtaacggttctcgtaggtgttcgcctagtacgttacggtaccaggttggctacgggcggtacgacgggtacaacggttctttacgacgtaaccgtagaaaacgtccgaaggtcccgggtaggaacgtcgtaggtacgttagtttaggtaacgtttaactcgtagactagtacgacgtaagtacgtcganaacgtaacg

SEQ ID NO: 81170 - DNA, 188 bp, Homo sapiens
  misc_feature: GYAE6OF02JXID4.25.38.D05.1.454.CMB.1.raw
  modified_base (160)..(160): a, c, t, g, unknown or other
  misc_feature (160)..(160): n is a, c, g, or t
  modified_base (166)..(188): a, c, t, g, unknown or other
  misc_feature (166)..(188): n is a, c, g, or t
tcagactgtacagtcacgaccggtgctcgatttagtatctgatagttggggtgttcggcggagggaccaagctgaccgtcctaggtcagcccaaggctgccccctggtcattctgttcccgccctcctcactgtacagtctgagcgggctgggcaaggcncatagnnnnnnnnnnnnnnnnnnnnnnn

SEQ ID NO: 81171 - DNA, 568 bp, Homo sapiens
  misc_feature: GYAE6OF02GF7A8.25.38.D05.1.454.CMB.1.raw
  modified_base (319)..(319): a, c, t, g, unknown or other
  misc_feature (319)..(319): n is a, c, g, or t
tcagactgtacagtcacgaccggtgctcgatttagtatctgatagttgggtttgggggactgatcaggactcctcagttcaccttctcactatgaggctccctgctcagctcttggggctgctaatgctctgggtccctggtaaggacagaaggagatgagggaggagaatggggtgggaaggatccagtgcagagattgtgatgacccagactccactctccttgtctatcacccctggagagcaggcctcatctcctgcaggtctagtcagacgccctctgcatagtgatggatacaccttatttgtatttggttcngcaagaaacgccaggccagtctccacgctcctgatctatgtaacgtttccaaccggtttctcgtggacgtgaccagtacgttaggttacaggtcggcgaggcgggtacgagggactagtactttcaactacgtagaaactcgaggccgggtaggacggtcgtaggtaggttagtttttagggtaacgtttttaagttacgttacgtacgttaagttcggtacgtaaaggtatacggaccaacgtaaacg

SEQ ID NO: 81172 - DNA, 589 bp, Homo sapiens
  misc_feature: GYAE6OF02G0Z1G.25.38.D05.1.454.CMB.1.raw
  modified_base (288)..(288): a, c, t, g, unknown or other
  misc_feature (288)..(288): n is a, c, g, or t
  modified_base (394)..(394): a, c, t, g, unknown or other
  misc_feature (394)..(394): n is a, c, g, or t
tcagactgtacagtcacgaccggtgctcgatttagtatctgatagttgggtttgggggactgatcaggactcctcagttcaccttctcactatgaggctccctgctcagctcttggggctgctaatgctctgggtccctggtaaggacagaaggagatgagggaggagaatggggtgggaaggatccagtgcagagattgtgatgacccagactccactctccttgtctatccacccctggagagcacggcctccatcctcctgctaggtctagtcagacgccctccngcatgtgagtggatactacttatttgttatttggttctgacaagaaacgccgagctagtctccacgtctctgatctagtgtaacgtttccgaacgttctcgtaggngtcgacgtagtagttacggtcaggtggacgtagggtcgggtacgaacgggtactaggttaactttaccgaaccgtaacgtaacgtaaaacgtccgaacgggtccggggttaggaacgggtcgttaggtacggttagttttaggtaagtttacttacgtagtactagttcgactaagacgtacgactaaccgtaag

SEQ ID NO: 81173 - DNA, 609 bp, Homo sapiens
  misc_feature: GYAE6OF02F0GEN.25.38.D05.1.454.CMB.1.raw
  modified_base (276)..(276): a, c, t, g, unknown or other
  misc_feature (276)..(276): n is a, c, g, or t
tcagactgtacagtcacgaccggtgctcgatttagtatctgatagttgggtttgggggactgatcaggactcctcagttcaccttctcactatgaggctccctgctcagctcttggggctgctaatgctctgggtccctggtaaggacagaaggagatgagggaggagaatggggtgggaaggatccagtgcagagattgtgatgacccagactccactctccttgtctatcacccctggagagcaggcctccatctcctgcaggtctagtcagancctcctgcatagtgatggactacacctatttgtattggtttctgcagaacgccaggccagtctccacgctctgatctatgaacgttccaaccggtttctcgtggagttcgaccctaggtaattacgggttccgaggttcgggacgacgggtccggggttacaagggggtacctaggtattttaccgaaccgtacgtaacgaaaacgttccgaaggggtcccggggtaggacgggtacgttagggtacggttagttttttggggtaaaggtttttacttaacgttaggtaccttaaggtcggtacctaaaggtgtacgtaccgaacgtaaacgg

SEQ ID NO: 81174 - DNA, 566 bp, Homo sapiens
  misc_feature: GYAE6OF02GSDQS.25.38.D05.1.454.CMB.1.raw
  modified_base (555)..(555): a, c, t, g, unknown or other
  misc_feature (555)..(555): n is a, c, g, or t
tcagactgtacagtcacgaccggtgctcgatttagtatctgatagttgggtttgggggaggagcccagcactagaagtcggcggtgtctccattcggtgatcagcactgaacacagaggactcaccatggagtttgggctgagctgggttttcctcgttgctcttttaagaggtgtccactgtcaggtgcacctggtggagtctgggggagcgtggtccagcctgggaggtccctgagactctccgtgtgaacgcctctggatttagttcagtggttctggcatgcacgtgggtcccgccaggcctccgagggccaagggggccgaggtggttggcagttatagcacatgatgggaagttctagtaatattatgcagtactcggtggaacgggtccgtacttcgaccatcctccaaggacgactaacttcccggaactagttgtgttaaccttggaaattggtacacgtcctaggagtggtacgaggtacctcgggtctcgtagttattacgtgtgcgtagagtcgggaggtggttagttagttagttaccgggntcagtgtacgg

SEQ ID NO: 81175 - DNA, 183 bp, Homo sapiens
  misc_feature: GYAE6OF02INH8R.25.38.D05.1.454.CMB.1.raw
  modified_base (164)..(164): a, c, t, g, unknown or other
  misc_feature (164)..(164): n is a, c, g, or t
  modified_base (166)..(172): a, c, t, g, unknown or other
  misc_feature (166)..(172): n is a, c, g, or t
  modified_base (174)..(183): a, c, t, g, unknown or other
  misc_feature (174)..(183): n is a, c, g, or t
tcagactgtacagtcacgaccggtgctcgatttagtatctgatagttgggtgttcggcggaggaccaagctgaccgtcctaggtcagcccaaggctgcccctcggtcactctgttcccgccctcctcactgtacacgtctgacgcggctggacaggcgcatagncnnnnnnntnnnnnnnnnn

SEQ ID NO: 81176 - DNA, 554 bp, Homo sapiens
  misc_feature: GYAE6OF02H319O.25.38.D05.1.454.CMB.1.raw
  modified_base (298)..(298): a, c, t, g, unknown or other
  misc_feature (298)..(298): n is a, c, g, or t
  modified_base (373)..(373): a, c, t, g, unknown or other
  misc_feature (373)..(373): n is a, c, g, or t
  modified_base (460)..(460): a, c, t, g, unknown or other
  misc_feature (460)..(460): n is a, c, g, or t
  modified_base (489)..(489): a, c, t, g, unknown or other
  misc_feature (489)..(489): n is a, c, g, or t
  modified_base (507)..(507): a, c, t, g, unknown or other
  misc_feature (507)..(507): n is a, c, g, or t
tcagactgtacagtcacgaccggtgctcgatttagtatctgatagttgggtttgggggaggagcccagcactagaagtcggcggtgtctccattcggtgatcagcactgaacacagaggactcaccatggagtttgggctgagctgggttttcctcgttgctcttttaagaggtgtccagtgtcaggtgcagctggtggagtctgggggagcgtggtccagcctgggaagtccctgagtactctcctggtgcaacatctggattcgccttctagtaactttggcatccactgggtccnccaggcctcgaggccgaagggactagagtgggtgacttttagtgggctatgagtggcagtgataaaagccttaangacagactccggtacaagggcctcttacctccacttcctccagacgacaacgaccaaagaagacggttcctttgactaaatgaaaanccgtagacgacccgaggacacggctaatntaatactgtagcgaggcnccgagtcgaaggaggtaggacgtaggtacggcccgtggacgtacggg

SEQ ID NO: 81177 - DNA, 649 bp, Homo sapiens
  misc_feature: GYAE6OF02I8OCL.25.38.D05.1.454.CMB.1.raw
  modified_base (242)..(242): a, c, t, g, unknown or other
  misc_feature (242)..(242): n is a, c, g, or t
  modified_base (282)..(282): a, c, t, g, unknown or other
  misc_feature (282)..(282): n is a, c, g, or t
tcagactgtacagtcacgaccggtgctcgatttagtatctgatagttgggtttggggactgatcaggactcctcagttcaccttctcactatgaggctccctgctcagctcttggggctgctaatgctctgggtccctggtaaggacagaaggagatgagggaggagaatggggtggaaggatccagtgcagagattgtgatgacccagactccactctccttgtctatccaccctggagancaggcctccatcctcctgcaggtctagtcagacgccctcngcatagtgatggatactacctatttgtattggtttctgcaagtaaagccaaggcctagtctccacgtctcctgtactcttatacgtaacgtttacccgtaaccggtttctcgtaggtagtcgacccaggtacgttagggtttaccgaggttcgggaccgtagggtccgggttaccggaagggtaacgtaacgttacgttttaccgaacgtaacgtaagaaaacgtccgtacgggtacccgggtagggaaccgtcgggttacgtagggttaagttttttacggggtaacgtttttaacgttaaccggttgtaaccgttaagttcggaacccgttaaaggacggttacgtaaccgtaaccgttaaacgg

SEQ ID NO: 81178 - DNA, 527 bp, Homo sapiens
  misc_feature: GYAE6OF02G6ROP.25.38.D05.1.454.CMB.1.raw
  modified_base (258)..(258): a, c, t, g, unknown or other
  misc_feature (258)..(258): n is a, c, g, or t
  modified_base (299)..(299): a, c, t, g, unknown or other
  misc_feature (299)..(299): n is a, c, g, or t
  modified_base (498)..(498): a, c, t, g, unknown or other
  misc_feature (498)..(498): n is a, c, g, or t
tcagactgtacagtcacgaccggtgctcgatttagtatctgatagttgggtttgggggaggagcccagcactagaagtcggcggtgtctccattcggtgatcagcactgaacacagaggactcaccatggagtttgggctgagcttgggttttcctcgttgcttcttttaagaggtgtccagtgtcaggtgcagctggtggagtcgtgggggagcgtggtccagcctgggaacgtccctgagactctcctgtgcaacntctggattcgccttcagtactttggcatccactcgggtccncaggcctccgaggcaagggactaggagtgggtgtaacttttagtgggacagtgagtgcagtgaataagctaatgcagactcgtcaagggccgtctctcatctacagagaacaacgaccaagaagacggttctttagacaaatagaaacgctagacgaccgagacgacgactatgtattactgtagcgagcgaccgtagngagagcggacgagtcggacgtggcgtcgg

SEQ ID NO: 81179 - DNA, 564 bp, Homo sapiens
  misc_feature: GYAE6OF02GYZ5K.25.38.D05.1.454.CMB.1.raw
tcagactgtacagtcacgaccggtgctcgatttagtatctgatagttgggtttgggggactgatcaggactcctcagttcaccttctcactatgaggctccctgctcagctcttggggctgctaatgctctgggtccctggtaaggacagaaggagatgagggaggagaatggggtgggaaggatccagtgcagagattgtgatgacccagactccactctccttgtctatcacccctggagagcaggcctccatctcctgcaggtctagtcagagccctcctgcatagtgatggatacacctatttgtattggtttctgcagaaacgccaggccagtcctaccacgcctcctgactctatgtaacgtttcctaaccggttctcgtggtagtcgccagtagttaggttcaggtcggcaggcgggtacgacgggacagtacttacactacgtagaaactcgacggccgggtaggacggtcgtaggtagggttacgttttagggtaagttttaacgttacgttcgtactagttacgtacggtaagtacgtcgacgtaacgtaacgg

SEQ ID NO: 81180 - DNA, 646 bp, Homo sapiens
  misc_feature: GYAE6OF02GLYE3.25.38.D05.1.454.CMB.1.raw
tcagactgtacagtcacgaccggtgctcgatttagtatctgatagttgggtttgggggactgatcaggactcctcagttcaccttctcactatgaggctccctgctcagctcttggggctgctaatgctctgggtccctggtaaggacagaaggagatgagggaggagaagtgggggtgggaaggatccagtgcagagattgtgatgacccagacctccactctccttgtctatccacccctggagagcacggcctccatcctcctgcaggtctagtcagacgcctcctgcattagtgagtggactacctaccttattttgttagtttggtttctgacaaggaaacgccgacggcctacgtcctccgacgtcctcctagtacttcttagtacgtaaccgttttacccgtaacccggttttctacggttagggtacgtcgacctaaggtacgttacgggttcgtaggtcgggacgtacgggtccgggtacgaagggtactaaggttactttaccacgtaacgtaagaaaacgttccggaacgggtccggggtagggaccggtacgtagggttacggtttaggttttagggtaacgttttagttacgtgtacgttagtagtaacgtaagtcgtacgacgtaagtaacg

SEQ ID NO: 81181 - DNA, 594 bp, Homo sapiens
  misc_feature: GYAE6OF02GL3KG.25.38.D05.1.454.CMB.1.raw
  modified_base (243)..(243): a, c, t, g, unknown or other
  misc_feature (243)..(243): n is a, c, g, or t
tcagactgtacagtcacgaccggtgctcgatttagtatctgatagttgggtttgggggactgatcaggactcctcagttcaccttctcactatgaggctccctgctcagctcttggggctgctaatgctctgggtccctggtaaggacagaaggagatgagggaggagaagtggggtgggaaggatccagtgcagagattgtgatgacccagactccactctccttgtctatcacccctgganagcaggcctccatctcctgcaggtctagtcagagcctcctgcatagtgatggatacactatttgtattggtttctgcagaaatcagccagtctcacgctcctgactctaatcgtaacgtttcccgaaccggtttactccgtggagttcggccaggtacttaaggttcaaggtggtcaggccgggtcgagggacctagtactttaccactaacgtagaaaactcgaacgggtccgggtaggaggtacgtacggtaggttaacgtttttagggaacgtttttaacgttaacccggttgtaccgtaagttacggtaacgtaaacgggttataccggtacgtaaccgtaaaacgg

SEQ ID NO: 81182 - DNA, 753 bp, Homo sapiens
  misc_feature: GYAE6OF02GQ5HZ.25.38.D05.1.454.CMB.1.raw
  modified_base (351)..(351): a, c, t, g, unknown or other
  misc_feature (351)..(351): n is a, c, g, or t
tcagactgtacagtcacgaccggtgctcgatttagtatctgatagttgggtttgggggactgatcaggactcctcagttcaccttctcactatgaggctccctgctcagctcttggggctgctaatgctctgggtccctggtaaggacagaaggagatggagggaggagtaagtgggggtgggaaggatccagtgcagagtattgtgatcggacccagtacctcctactcctccttgtcctatcccaccccgtggagagccgacggccctaccgactcctccgtgcctaggtctgtcacgacgcctccgtgcagtagtgagtgaactacactttattgtagtttcggttcngtacaacggaacgccgtacggcctagtcctacccgacctccgttcctagtacttcgtattaccgggttaacccgtttacccgtaacccgggtttctcggttaggggaccgttccgaaccgtagtacggttacgggttacggtacgggtcgggaccggtacgggttaccgggggtaccggaacgggtaccgtaaggtttacctttacccgaacgttaaccggtaaacgtaaaacgtccgggtaaccggggttccgggggtaaaggaccgggttaccgttaaggggttacgggtttttacggttttacggggtttaaaacgttttttccggtaaccggtttaggtaacctttacggttacgaaccggtaaaggttaccggtacgtaaccggtaaacgtaaccgg

SEQ ID NO: 81183 - DNA, 762 bp, Homo sapiens
  misc_feature: GYAE6OF02GR3VX.25.38.D05.1.454.CMB.1.raw
  modified_base (160)..(160): a, c, t, g, unknown or other
  misc_feature (160)..(160): n is a, c, g, or t
tcagactgtacagtcacgaccggtgctcgatttagtatctgatagttgggtttggggggggagaggagcccagcactagaagtcggcggtgtctccattcggtgatcagcactgaacacagaggactcaccatggagtttgggctgagctgggttttccncgttgcttcttttaagaggtgtccagtgtcaggtgcagctggtggagtcgtgggggagcgtggtccagtcctagggaacgtccctgacgactctccgtgtcgacaacatctggattccgcctttacaaggttaactttggacctacgtccctacgttcggggtccccgccgtaacgggccttacccggagggaccgaaacggggtaccttaggggacggttgggggttcttaaccgttttttaaggtcggggactagttggaagttcgggctaggttacgtaaagtaaaaccgccgttagtacggacctaacggtaccgttcccgggtaagaaccggggggtcccctaccgtttacccgtacccgtaccgttacccgtacccgtaacggaacgaaccgtaaacccgacccgtaaaagggtaaccggtacccggtttaccgttttacgaaacgtaaaacgtaacggaaaaccgtccgtaacggaacccggtacccggaaggtaccgacgggtaacttagtacgttaacttcgtaggtacgaccggaagaccgaccgtagtcggaaggtacggtcggaaccgtggtacggtcggtacggtccgg

SEQ ID NO: 81184 - DNA, 839 bp, Homo sapiens
  misc_feature: GYAE6OF02J1NFC.25.38.D05.1.454.CMB.1.raw
tcagactgtacagtcacgaccggtgctcgatttagtatctgatagttagggtttgggggactgatcaggactcctcgagttcacccttctcactatgaggctccctgctcgagctcttggggctgctaagtgcctcgtcgggtccctaggtaaggacagaaggagatggagggagagaagtggggtagggaaggatccgagtgcagagtgttgtcgatcgacccagacctccgactccgtcgttgtctatccgtacccgtaggtagacgcgacggtccctaccaacttccgtaccgtggcctacgggtaccttaacgtaccgagggtacccgtccccttaccgtacggtaccgtaagttaccgggtaggtaacggttaccgggtaaactaacccggtaacccgttttaggtttttacggttacggttttcgggtttacctacggaaccgtaaacggaaacccgtccgaaccggggccctaacggttccctacccgacggttccttacgtagtacttcgtaagttaccggtaacgtttacccgtacggtttacgtggttacggtacgtacggtcgttaacgtaacgttcgggttaccgaggggttcggaccggtaacggggtccgggtaacgaaacggggttaccgtaaacggttactttaccggaaaccgttccgttaaacgggtaaaccgttccgggaccggggttacccggggtaacggtacgggtaccgtttaaggggtacgtttacgggttttttaccggtaacgttttaccggtaccgtccgggtacgttaaggtacggaacgtaacgttaccgacggtaacccacggttaacg

SEQ ID NO: 81185 - DNA, 703 bp, Homo sapiens
  misc_feature: GYAE6OF02FJK9E.25.38.D05.1.454.CMB.1.raw
tcagactgtacagtcacgaccggtgctcgatttagtatctgatagttgggtttgggggactgatcaggactcctcagttcaccttctcactatgaggctccctgctcagctcttggggctgctaatgctctgggtccctggtaaggacagaaggagatgagggaggagaagtgggggtgggaaggatccagtgcagagattgtgatcgacccagacctccactccttccttgtctatccacccctgggagagcgacggccctccatcctcctgcgtagtctagccagacgtcctcctgctataggtgatggaacttactacctttattttgttatttcggtttctagacgtaaaggaaaccgcccgtaaggccctacggttcctacccgaccggtccttaccgtaaggtaccttacgttaacgttacgttaaccgtttaccccgaacccggttttgtccgttagggtaacgtccgtaccgaaggttaacgttacgggttccgagggttacggacgtaggggtccgggttaacgacgggtaactacgggttactttaccgaagttaaccgtaaagtaaacgttccgggaacgggtccggggttaaggcggttacgttgggtaacgggtttagttttacggggttaattttacggttacgtggtactacgttaggaacctaaggttcgacgtaccgtagtaaacg

SEQ ID NO: 81186 - DNA, 664 bp, Homo sapiens
  misc_feature: GYAE6OF02FNLB6.25.38.D05.1.454.CMB.1.raw
tcagactgtacagtcacgaccggtgctcgatttagtatctgatagttgggtttgggggactgatcaggactcctcagttcaccttctcactatgaggctccctgctcagctcttggggctgctaatgctctgggtccctggtaaggacagaaggagatgagggaggagaagtggggtgggaaggatccagtgcagagattgtgatgacccagactccactctccttgtctatccacccgtggagagcacggcctccatctcctgcaggtctagtcagcgtcctcctgcatagtgatggactacctacttatttgttatttggtttctgacaaggaaacgcaacggcctaacgttcctacccacgtccttcccttagacttacgtaacttcggtaaacgttttcccgtaaccggtttctcgtggtacgtcgaccgtagtacgttaggttacgtaggtcggacgacgggtcgggtacggaacgggtaccgtaggttaactttaccgaaccgtaacgtaaagtaaaaccgtcggtaaacggggtccggggtagggacggtcgttagggttaacggtttaggttttagggtttaacgtttaaacgtttaccggtacgttaacgtacgttacggacgtaaagtacggttacggtacctaaaggtaaccg

SEQ ID NO: 81187 - DNA, 719 bp, Homo sapiens
  misc_feature: GYAE6OF02JTL0R.25.38.D05.1.454.CMB.1.raw
  modified_base (268)..(268): a, c, t, g, unknown or other
  misc_feature (268)..(268): n is a, c, g, or t
  modified_base (326)..(326): a, c, t, g, unknown or other
  misc_feature (326)..(326): n is a, c, g, or t
tcagactgtacagtcacgaccggtgctcgatttagtatctgatagttgggtttggggaggagcccagcactagaagtcggcggtgtctccattcggtgatcagcactgaacacagaggactcaccatggagtttgggctgagctgggtttcctcgttgctcttttaagaggtgtccagtgtcaggtgcagctggtggagtcgtgggggagcgttggtaccaggcctgggaacgtccccgtggagacctccgtcctggtacgcaaacgntccgtggtacttccgccttacagttaaccgtttggctaacttccacgttgggtacccnccgacggccttcccgaagggtccaaaggggacctaggagggttcgggtagtaacctttttaggtcgggactaagttcgagtggactagtcgaataacgcctaagtcgactacgacctccgtagaacgggtcctacgttcctaccgtacgtccgtaccgacgaacgtaacgaaccggaccgtaaacggtaacggttaccggtttaccgttttacgaacgtaaaacgtacgtaaaaccggtccgttaacggaaccggaacccgaacgggtaaccgacccggtaacgttacttacggtaacgttacgtacggtacgtacggtaccggaacggtaccgtacggtcgtaacggtaggtcgacggtacggtcgggtaccgtacgggtaccgttacgggg

SEQ ID NO: 81188 - DNA, 686 bp, Homo sapiens
  misc_feature: GYAE6OF02IKD7E.25.38.D05.1.454.CMB.1.raw
  modified_base (289)..(289): a, c, t, g, unknown or other
  misc_feature (289)..(289): n is a, c, g, or t
tcagactgtacagtcacgaccggtgctcgatttagtatctgatagttgggtttgggggactgatcaggactcctcagttcaccttctcactatgaggctccctgctcagctcttggggctgctaatgctctgggtccctggtaaggacagaaggagatgagggaggagaagtggggtagggaaggatccagtgcaagagattgtgatcgaccagactccactctccttgtctactccaccccgtggagagcacgcctccatcctcctgcaggtctagtcagacgcctcngctagtagtgagtggactactacttattttgtatttggtttcagtacaagaaacgccgaaggtccacgttcctacccgacgtccttccgtgtaacttcgttaacgttacggtttaacccgtttacccgtaacccgggtttcttacggtggtacgtacgaccgtaagtacgttacggttacgtagggtcggtaccggacgggtacgggttacggaacgggtactaacggttactttaccgaacgttaaccttaaaggtaaaacgttccgggaacgggtaccgggggtacggtacggtacggttagggttacgggtttaggttttttacgggtaagtttttaccgttacgtacggtataacggttcgaacggtaagtagtacgtacgaaccgtaaacgg

SEQ ID NO: 81189 - DNA, 741 bp, Homo sapiens
  misc_feature: GYAE6OF02JTI7R.25.38.D05.1.454.CMB.1.raw
  modified_base (154)..(154): a, c, t, g, unknown or other
  misc_feature (154)..(154): n is a, c, g, or t
  modified_base (209)..(209): a, c, t, g, unknown or other
  misc_feature (209)..(209): n is a, c, g, or t
  modified_base (675)..(675): a, c, t, g, unknown or other
  misc_feature (675)..(675): n is a, c, g, or t
tcagactgtacagtcacgaccggtgctcgatttagtatctgatagttgggtttggggaggagcccagcactagaagtcggcggtgtctccattcggtgatcagcactgaacacagaggactcaccatggagtttgggctgagctgggttttccncgttgcctcgttttaagacggttgtccagtgtcaggtgcagcgtggtggagtcgnggggacgcgtcggtcagccgtgggactcccgtagacgacctcgtccgtgtgaccgaactgtcgtggtacgttccgtccttacgtagttaaccgttggtacctacgtacccgtacggttcggtccccgaccgtaacggtcccgtaccggaggaaccgtacgggtaccgtaagggacggttcgggtagtttaccgttttaggtggtacctaggtacgtaggttcgcgtaagtaggtaaacgtacgtcgttacgacgcgttaacgaccggtacccgagggtaaccgggtcccgttcttaccgacccgttagtacccgtaccgtaagtaacccgacgtaaccgaacgtaaaccggacggttaaccggtttaccgtttacggaacgtaaacgtaacgaaaaccgccgttaaaccgaccggtaaccgacggtaaccgacgtacgtacgttacgtaacttaccgtggtaccgnggtaccggacgtacgtaggacgaggtacggtcggacggtagtccggtcggttacggacgttacggg

SEQ ID NO: 81190 - DNA, 621 bp, Homo sapiens
  misc_feature: GYAE6OF02FU300.25.38.D05.1.454.CMB.1.raw
  modified_base (268)..(268): a, c, t, g, unknown or other
  misc_feature (268)..(268): n is a, c, g, or t
  modified_base (322)..(322): a, c, t, g, unknown or other
  misc_feature (322)..(322): n is a, c, g, or t
  modified_base (420)..(420): a, c, t, g, unknown or other
  misc_feature (420)..(420): n is a, c, g, or t
  modified_base (575)..(575): a, c, t, g, unknown or other
  misc_feature (575)..(575): n is a, c, g, or t
  modified_base (598)..(598): a, c, t, g, unknown or other
  misc_feature (598)..(598): n is a, c, g, or t
tcagactgtacagtcacgaccggtgctcgatttagtatctgatagttgggtttgggggaggagcccagcactagaagtcggcggtgtctccattcggtgatcagcactgaacacagaggactcaccatggagtttgggctgagctgggttttcctcgttgcttcttttaagaggtgtccagtgtcaggtgcagctgggtggagtcgtgggggaggcgtggtccaggcctggggaacgtcccctaggacgacttctcctggtcgcaacntctggacttcgccctttcaagttaactttggcagttccctacgttggggtcccnccgtacgggcctcccgagggccgaaaggggacctaggacgggttcgggttagtactttttagtggggactagtgattgggcaaggtgaataagcctangcacgtaccgtcgtacggaacgggcctcttcctccgtatccgtaccaggaacgaccaaccggaccaaacgtacggtaccgttacctttgaaccaaagtacgaaaacgcagaaccgccgaacggaacacgtatactgtacttacgtgtacgcgagngccaggtgtaggacgtgggtacnggtacggccgttgggacgtcggg

SEQ ID NO: 81191 - DNA, 567 bp, Homo sapiens
  misc_feature: GYAE6OF02GZM03.25.38.D05.1.454.CMB.1.raw
  modified_base (503)..(503): a, c, t, g, unknown or other
  misc_feature (503)..(503): n is a, c, g, or t
  modified_base (523)..(523): a, c, t, g, unknown or other
  misc_feature (523)..(523): n is a, c, g, or t
tcagactgtacagtcacgaccggtgctcgatttagtatctgatagttgggtttggggggggagaggagcccagcactagaagtcggcggtgtctccattcggtgatcagcactgaacacagaggactcaccatggagtttgggctgagctgggttttcctcgttgctcttttaagaggtgtccagtgtcaggtgcagctggtggagtcgtgggggagcgtggtccaggcctgggaagtccctgagactctcctgtgcaacatcgtggattccgccttcagttaactttggctatccacgtcgggtcccgcgaggcctccgaggccaaagggacctaggagttggggtatacgtttttagtgggcatgaagtggactagtgaaataaagcctatgacagtaccgtccgtacgaaggcccgtacttcctccatcctccagacacaaccgacaagaacgaccgttctttagactaaatagaaacgctagaccgaccgaggacacgntagtactattacgtgtacgngaagacgcgagtagagaggcggataggtcggtccgtggtaccgg

SEQ ID NO: 81192 - DNA, 595 bp, Homo sapiens
  misc_feature: GYAE6OF02F5KTL.25.38.D05.1.454.CMB.1.raw
tcagactgtacagtcacgaccggtgctcgatttagtatctgatagttgggtttgggggactgatcaggactcctcagttcaccttctcactatgaggctccctgctcagctcttggggctgctaatgctctgggtccctggtaaggacagaaggagatgagggaggagaagtggggtgggaaggatccagtgcagagattgtgatgaccagactccactctccttgtctatcacccctggagagcgaggcctccatctcctgcaggtcctagtcagacgcctcctgcatagtgatgatacaccttatttgtatttgttctgacaagaacgccgagccaacgtcctccacgcctccgtagtactctagtacgtaacgtttcccgaaccggtttctacgtggagtcgaccaagtagttagttcgaggtggcgaggtcggtacgagggactagtactttcaacgtaactaagtaaaagtcgacgggtacggggtggaacgggtccgtaggtacggtttaggttttacgggttagttttaacgttacggttacgattaacgtggaacctaaggttacgtacggaccaaacggtaaccgg

SEQ ID NO: 81193 - DNA, 669 bp, Homo sapiens
  misc_feature: GYAE6OF02H2MN8.25.38.D05.1.454.CMB.1.raw
  modified_base (192)..(192): a, c, t, g, unknown or other
  misc_feature (192)..(192): n is a, c, g, or t
  modified_base (255)..(255): a, c, t, g, unknown or other
  misc_feature (255)..(255): n is a, c, g, or t
  modified_base (261)..(261): a, c, t, g, unknown or other
  misc_feature (261)..(261): n is a, c, g, or t
  modified_base (379)..(379): a, c, t, g, unknown or other
  misc_feature (379)..(379): n is a, c, g, or t
  modified_base (398)..(398): a, c, t, g, unknown or other
  misc_feature (398)..(398): n is a, c, g, or t
  modified_base (462)..(462): a, c, t, g, unknown or other
  misc_feature (462)..(462): n is a, c, g, or t
tcagactgtacagtcacgaccggtgctcgatttagtatctgatagttgggtttgggggaggagcccagcactagaagtcggcggtgtctccattcggtgatcagcactgaacacagaggactcaccatggagtttgggctgagcttgggttttcctgttgcttacttttaagaggttcgtccagtgcaggtncagctgggtgagtcgtgggggagcgtcggtccagccgtgggactccgtgaacgctcctcgtgnaccaanttctaggtcttccgacttcgaagttaccttggactactccgtacggtcgggtcccgcgacggtcctacccggaggaacggaaggtctaggaggttgggtacttacgttttgtacggtnacgtaggtgtcggctaagnggtaaactaacggctagtcgacgtactaccgtccgagacccggtcgtccttactcctcgtaccncgtaagaccgtaaaccacgtaaccgaaacgtaacggtaccgtttaccgttacgaacttaagaaccgaacgtcgtacgaacgacccggtagaacgtaccgtagttagtacgtaacgttacgtcggttacgagtaaccggactaccggtagtaacgggtagtacggttaggacgttaccggtcggtacgttcgggaccgttaccggggg

SEQ ID NO: 81194 - DNA, 810 bp, Homo sapiens
  misc_feature: GYAE6OF02GKW94.25.38.D05.1.454.CMB.1.raw
  modified_base (323)..(323): a, c, t, g, unknown or other
  misc_feature (323)..(323): n is a, c, g, or t
  modified_base (426)..(426): a, c, t, g, unknown or other
  misc_feature (426)..(426): n is a, c, g, or t
tcagactgtacagtcacgaccggtgctcgatttagtatctgatagttgggtttgggggaggagcccagcactagaagtcggcggtgtctccattcggtgatcagcactgaacacagaggactcaccatggagtttgggctgagctgggttttcctcgttgcttcttttaagaggtgtccagtgtcaggtgcagctggtggagtcgtgggggaggcgtggtccagccgtgggaacgtccctgacgactctcctgtcgacaacatcgtggactttccgccttataacgttaactttggacctacgtcctaccgttcgggtacccnccgacggtcctaccgagggcgaagggtactagggagtgggttattacgttttaggtcgggactagtgtaacgcggactaaggtgaacttaaacgcccttaagnggacgtaacgtacccgtccggttaaccgggaaccgggtcccgtccgtttacctcccgtaaacttccctaacccggtacgaaaccggtaaaccgaaacccggtaacccgaaacgggtaaccgggttacccgggttttacccttttaacgggaaccttaaaaacggtacggtaaaaacccgtaccgttacggggaaacccggtaaccccgggaacgggtacccgtaaccggggttaccttaagtttaaccggtttaaacctttaacccgggttagtaccgggtaccggtaacggtacccgtaacggttaaggggtacggtaacgggtacggtacgggaccgtacgggtccgggttaccccggttaggggtacccccggttacgggg

SEQ ID NO: 81195 - DNA, 676 bp, Homo sapiens
  misc_feature: GYAE6OF02JECB1.25.38.D05.1.454.CMB.1.raw
  modified_base (379)..(379): a, c, t, g, unknown or other
  misc_feature (379)..(379): n is a, c, g, or t
tcagactgtacagtcacgaccggtgctcgatttagtatctgatagttgggtttgggggaggagcccagcactagaagtcggcggtgtctccattcggtgatcagcactgaacacagaggactcaccatggagtttgggctgagctggttttcctcgttgctcttttaagaggtgtccagtgtcagatgcaactggcggagtcgggggagcgtggtccagccgggaagtccctgagactctcctgtgcagtcgtccgcgtcctaccttccgtcgttttggccattcacgtcgggtccgccaggcctccaggcaagggactggaggtgggtcggcggtcatacgtgggtggacgtggaagtaagtcggtctaagtttttangactagacgtccggtaggaacgggcccgtactccacccgtacgtcctacccgaggacgcgacgtcctaccgtaaacgtaaccttacccgttttaatccgttagtacgtaacgtttaaccgaaaccgtcgtaacggaccttacggaacacccgtacggtacttcggttaccttaacgttacgtcggtaccggtacggggttactaggtaacggtaaccggtcggggttccggggtacccttacggtaccggtcgtaagttcgggacccgaccggttccggggaccgaacgggtacccg

SEQ ID NO: 81196 - DNA, 841 bp, Homo sapiens
  misc_feature: GYAE6OF02JREO8.25.38.D05.1.454.CMB.1.raw
  modified_base (344)..(344): a, c, t, g, unknown or other
  misc_feature (344)..(344): n is a, c, g, or t
tcagactgtacagtcacgaccggtgctcgatttagtatctgatagttgggtttgggggactgatcaggactcctcagttcaccttctcactatgaggctccctgctcagctcttggggctgctaatgctcgtggtccctaggtaaggacagaaggagatggaggggagtagaagtgggggtagggaaggatccgaggtgcagagtattggtacgagtcgaccctagacctccacttctcctttgtactactcccgtaccccgtgggaacgacgccgaacggtcccctacctacgttcccaccttcggaccgtacgggttacctaacggtccgtaacggtacccnccccttacttcggactacgttaggttaccgaagttcggaacctttaccgtaacttttacggtttttacggttaaacgttttcggttttccggaacggttaaccgaaacggtaacccgttaccggaaaccggggttcctaacggtttcccgttaaaccccgccggtttaccttacgggttaccttaacgttacgtttaacgtttaacccgggttttaacccgtttaacccgttaaccgggtttcttaccgggtttaacggtaccggttccgtaaaccgttagggtaaccgttcgggttaacggtacgtacggggtacgtccgggtaacggggttcgaacgggtacgtaaccggttaacttacgtaacgacgttaaacgaagtacccgggacgggtacgggaggtaccggtaacggttaggttacgttaaggttttacggttacgtttagttaccgtagacgtagttacgacggttacgtactaacggagacgttaacg

SEQ ID NO: 81197 - DNA, 790 bp, Homo sapiens
  misc_feature: GYAE6OF02IRC5F.25.38.D05.1.454.CMB.1.raw
  modified_base (199)..(199): a, c, t, g, unknown or other
  misc_feature (199)..(199): n is a, c, g, or t
tcagactgtacagtcacgaccggtgctcgatttagtatctgatagttgggtttgggggaggagcccagcactagaagtcggcggtgtctccattcggtgatcagcactgaacacagaggactcacatggagtttgggctgagcgttgggttttcctcgttgcttacgttttaagaggtgtccagtgtacgaggtgcagngtggtaggagtcggtgggggaggcggtggtccagccgtaggggaacctccctggaacgtacttccgtccgtggtcgacaactacgttccgtaggttaacttcccggcctttaccgtaagttaaccgtttggactaccgtaccgtagttcggggcccacgtacggtcctaccgaggacgaaacggtacgtagaggttcgggtacttaacgttttaggtcggatacgtagagtcgggactagggtataaagtaaacgtctaagtcgaactaacgtaccgttaccggaacggaccggtcccgtacttaccctaccgtacttaccgtacgaacggacaaccggaaacccgaacggtaaacggtaccgtaaccggtttaccttaaggaaacctaaacggtaagaaaaccgtcgtaacggaaaccgtaacccggacgtaaaccgtacgtaacgttaacgttaacgtaacgtttacgtaccggtaggtaaccggtaacgggtaaccggaacggttaacggaaggtaacccgggtttagggaaccggttacggtaccgggttacgggtacccggttacgggtaccggttaacccggggg

SEQ ID NO: 81198 - DNA, 688 bp, Homo sapiens
  misc_feature: GYAE6OF02HKBMP.25.38.D05.1.454.CMB.1.raw
  modified_base (202)..(202): a, c, t, g, unknown or other
  misc_feature (202)..(202): n is a, c, g, or t
  modified_base (286)..(286): a, c, t, g, unknown or other
  misc_feature (286)..(286): n is a, c, g, or t
  modified_base (438)..(438): a, c, t, g, unknown or other
  misc_feature (438)..(438): n is a, c, g, or t
tcagactgtacagtcacgaccggtgctcgatttagtatctgatagttgggtttgggggactgatcaggactcctcagttcaacttctcactatgaggctccctgctcagctcttggggctgctaatgctctgggtccctggtaaggacagaaggagatgagggaggagaagtggggtgggaaggatccagtgcagagattgngatgaccagactccactctccttgtctactccaccccgtggagacgcacggccctccatcctcctgctacggtctagtcagacncctctcgcatagtgagtacggaatacctactttatttcgttagtttcggtttctgacaagaaacgccgaggaccacgttcctaccgacgtccttacctgtacttcttaacgtagtaaccgtttccgtaaccgttcttcggtaggtgttacgngaacggtagttacggttcgtaggtcgggaacgtgggtccgggttagaacgggtactaacgtacgtttaacgaacccgtaagtaaacggtaaacgtaccgggaacggggtccggggttaagggaacgggttcgttaacggggtacggttttaggttttttaacggggtttaagttttacgtttaacggttcggtaaccggttaaggttacggaccgttaaaggtacgtacgtaacctaacggttaaaccgg

SEQ ID NO: 81199 - DNA, 874 bp, Homo sapiens
  misc_feature: GYAE6OF02H1JC5.25.38.D05.1.454.CMB.1.raw
  modified_base (483)..(483): a, c, t, g, unknown or other
  misc_feature (483)..(483): n is a, c, g, or t
tcagactgtacagtcacgaccggtgctcgatttagtatctgatagttgggtttggggactgatcaggactctcagttcaccttctcactatgaggctcctgctcagctcgttgggctgctaactgctcgtcggtccctggtaaggacaggaaggagatggagggaggagagtggggtggaagctccgagtgcgtaggagtagtttggacgagtaccgacccgacgtacctcccgtaccttccttcctttcggtaccttactccccgtaccccgtgggacgacggaccgtaccggtaccccttacctacgttcccttacccggtcgtacggtaaccggttaccgttaacggtaccgaacgggtaccgtccccgttaaccgttcgaccgttaacggttaggttacggtaacggttacggttaaccttaaccgtttaaacccgttttaagtttttacgggttacggttttttacgggttttacccngggtaaaccgtaaacggtaaacccgtacccgtacgggtaccccttaacggtttcccacccggtaccgtccttaccgttaacggtaccttacgttaacgtacggttttacccgtttaacccggtaccggttccgtaggtaccgggtacgtacgtaccgtaaaggttcgttaacgggttcgtacgggttaacggccggaggggttaccggtaaccggtagtaacgtacgttttacttaaacccggagttaacccgttaagggaccttcggaaccgggtccggggtagtacgtggtaacggttaggtttaccgggttttgaacggtttttccagggtacaacggtttacgtaaccgtcgtaaaccggtgttaaacccgaacgttaataaccccg

SEQ ID NO: 81200 - DNA, 641 bp, Homo sapiens
  misc_feature: GYAE6OF02IB27E.25.38.D05.1.454.CMB.1.raw
  modified_base (127)..(127): a, c, t, g, unknown or other
  misc_feature (127)..(127): n is a, c, g, or t
  modified_base (166)..(166): a, c, t, g, unknown or other
  misc_feature (166)..(166): n is a, c, g, or t
  modified_base (257)..(257): a, c, t, g, unknown or other
  misc_feature (257)..(257): n is a, c, g, or t
  modified_base (294)..(294): a, c, t, g, unknown or other
  misc_feature (294)..(294): n is a, c, g, or t
  modified_base (525)..(525): a, c, t, g, unknown or other
  misc_feature (525)..(525): n is a, c, g, or t
  modified_base (547)..(547): a, c, t, g, unknown or other
  misc_feature (547)..(547): n is a, c, g, or t
  modified_base (574)..(574): a, c, t, g, unknown or other
  misc_feature (574)..(574): n is a, c, g, or t
tcagactgtacagtcacgaccggtgctcgatttagtatctgataggttggggtttgggggactgatcaggactcctcagttccaccttctcactatgagcctccctgcctcagcctgttggggctgntaatcgctcgtcggtccctaggtaacgagaggaaggagngaggaggagaagtaaggtggggaggaagtactcgagtgagagtagtattgtaggcacgacccagtacctcctaccgtcttccttatctacnccctaccgaggatacgcgtacgcctccactcctacgngaccgtacggttctacgacgagtccgtcctaccgtagactaagtggacgtacgtagtacctttacctaagtttctttaggttctttacggttgtacgaacgtaacgaacgtccgacggtcctagtcccgtacgacctccgttactacgtaacttacgttacgtaccgttaacgtttcccgtaacgttcgtggtagtacgaccggtataggttaacgtgcgtacgtgccggngtacgacggacgataccgttanagaacttacgacgtaagcgtacggtgngacgtgaagttgtacgtttagtaacgtctaggtacgatggtactaggaattcgacacgtacgtaacg

SEQ ID NO: 81201 - DNA, 874 bp, Homo sapiens
  misc_feature: GYAE6OF02JX77K.25.38.D05.1.454.CMB.1.raw
tcagactgtacagtcacgaccggtgctcgatttagtatctgatagttgggtttgggggactgatcaggactcctcagttcaccttctcactatgaggctccctgctcagctcttggggctgctaatgctctgggtccctaggtaaggacagaaggagagtggagggaggagaagtgggggtagggaaggatccgagtgacagagtatttggtagagttacggacccaagtaccttaccctaccttcctttccgtttacgttaccttaactaccccgtaacccccgttagggaacgacggccgtaaccgggtcccctacctacttccgtaccgttacggacgtaacggtttaccgtacggttacgtaacgtaccggtccccttcccgtgtactaagttaggtagtacgttaggtaacttaacccgttaaccttttagttttacggtttaacgttttcgggttttctacggtaaccgtaaacggtaaaccgtacccggtaacgggtaccccgttaaccggttacccttacccgtaaccggttaccctttaccgttagttaacctttacggttaacgttaaacggttttaacccgtttacccggtaaccggttttctacgggttacgggttaccgtaccggtacgttaagggtttaacttacggggttaccgacgggttaccgggtccgtaccggggtacgggttaaccgggaagggtacttaaccggtttacttacgaaacccgtaacgtagtaaaccggtccgaagggttcccgggaaggtacggtcttaaggggtaggttttaacgtttttaggaacgtttttcgtacggtacgtacgtagttacgaacggattcgaacggtacaacggtaacg

SEQ ID NO: 81202 - DNA, 683 bp, Homo sapiens
  misc_feature: GYAE6OF02FET63.25.38.D05.1.454.CMB.1.raw
  modified_base (157)..(157): a, c, t, g, unknown or other
  misc_feature (157)..(157): n is a, c, g, or t
tcagactgtacagtcacgaccggtgctcgatttagtatctgatagttgggtttggggaggagcccagcactagaagtcggcggtgtctccattcggtgatcagcactgaacacagaggactcaccattggagtttgggctgagtctgggtttttccncgttgcttcttttaagaggtgtccagtgtcaggtgcagctggtggagtcgtgggggacgcgtcggtccaggccttaggggaacttcccctggaacgtcttcgtccctgtcgacaacagttcgtggactttcgccctttacgaaggttttaactttcggacacgttcccgtaccgtcggggtcccaccgacgggtcctccgaagggaccaaaggggtaccttaggacggtgggttagtactttttagtcggggactaggttgacgttggactagtaggtaaactaaggcccttagtacgacgtaacggtacccgttacccggtacgaaccgggtcccgttcctttaccgtacacttccgtaaccgaagtaccgaacgaaccgaccgaaaggtacggtacgttccgtttagaacctaagtacgaaactcgtagacgaccgagacgtacggactatgtagttacgagtgacgtgacgaccgaggtgacgaggttcgacggtaggtccggccgtagggtaccgtaccggg

SEQ ID NO: 81203 - DNA, 818 bp, Homo sapiens
  misc_feature: GYAE6OF02HPG8L.25.38.D05.1.454.CMB.1.raw
tcagactgtacagtcacgaccggtgctcgatttagtatctgatagttgggtttgggggaggagcccagcactagaagtcggcggtgtctccattcggtgatcagcaactgaacacagaggactcaccatggagtttgggctgagcgttgggttttcctgttgcttcgttttaagaggtgtccagtgtcgaggtgcagctgggtcggagtcgtgggggagcgttggtccaggccgtagggaaccttcctagacgacttcctccgtgtagacaactatccgtaggtacttccgacctttactaacgttaacgtttacggctatcccgacgttcggtcccgaccgagggtaccttacccggaacgggtacgaacggggtacgtaaggtacgggttaggggttacgttaaccgttttttaggtacggggtactaaggtgtaaggtcggtacggtagttaacggaaaagttaaacgtccgttaacggtacgtaacgtaacggtaccgtaccggttaaacgggaaaccggggttcccgtaccgtttaacccgttcctaaccgtttcccgtaacccgttaacgaaccggtaaaccgtaaacccggtaaccggaaaacggtaaacgggttaacccggtttacgtttaacgtaaaccgtaaaggtaaaccggtaaaccggtacgtaacggaaccgtaacccgggaacgtaaccgtaacgtacttaagttaacttaacgttacgtagttacgcggtaacggaacggtaccgaggtcggtaacgtagggtacgtacggtaggtccggtacggtacggtaccgtacgggg

SEQ ID NO: 81204 - DNA, 1043 bp, Homo sapiens
  misc_feature: GYAE6OF02GB3RS.25.38.D05.1.454.CMB.1.raw
  modified_base (156)..(156): a, c, t, g, unknown or other
  misc_feature (156)..(156): n is a, c, g, or t
tcagactgtacagtcacgaccggtgctcgatttagtatctgatagttgggtttgggggactgatcaggactcctcagttcaccttctcactatgaggctcctgctcagctcgttgggctgctaatgctcgtcggtcctaggtaagacaagaagganagtaggaagggaaggagtaaggtggggtagggaaggacttcgaggtgacgaagtacgtagttgttgacgtaccgaacccgacgtaacccttccctaccttccgttcctttacggttacctactaccccgtacccggtaggtaacgaccgtccggacgtcccctaaccttacgtcgtccgttacggcttacggtaccgtgtaacgtcggaccctcccgttctacggacttaacggtagtacggttaaccggtcggttaaaccctaccgttttaaccgtttaaggtttttacgttttaaccgggtttttcggttttaccgaaccggtacgtaaaacggtaaccggttaccgggaaccggtttaccccgttacggtacccccttaacccggtaccgttacccggttacccgttacggttaactttaccgtttacgggtttaaaaaccgtttaccccggtttttaaaccccggtaaccccggtttttcgggtacccgggttaacggttacccgggttaaccggaaccggtttaaccgggtttacgggttaaaacgtttcccgggggaaccggttttaaccggggacgggtcccgggttacccggggttaaaaacgggttcccggggtaaaaccgtttaggtttaaaaccccgtttccgaaaaaccggggttttaaccgttaaaacccggggttaacgtaaccccggggtaaaccggggggtttcggaaaaccggggttttccggtaacggggttaaccgggtttaaagttttttccgggggttttaaaaggttttcgtttaaccgttacccggttaaccgttacggttaaccggttaacggttaaacgtaacggttccggtaaacccgtccggtaaaagtttaaccccggg

SEQ ID NO: 81205 - DNA, 759 bp, Homo sapiens
  misc_feature: GYAE6OF02FE0AX.25.38.D05.1.454.CMB.1.raw
  modified_base (218)..(218): a, c, t, g, unknown or other
  misc_feature (218)..(218): n is a, c, g, or t
  modified_base (256)..(256): a, c, t, g, unknown or other
  misc_feature (256)..(256): n is a, c, g, or t
  modified_base (420)..(420): a, c, t, g, unknown or other
  misc_feature (420)..(420): n is a, c, g, or t
tcagactgtacagtcacgaccggtgctcgatttagtatctgatagttgggctgggtcacaagtaggcagcgctctcgggacgtctccaccatggcctgggctctgctgctcctcactctcctcactcgaggacacacgggtcctgggcccagtctgccctgactcagcctgcctcgtgtactgggtcctccgtgactagtcgataccacacgtctccngacctacgacggaactcaaccactcggtatcggttacnctactttacgattcgtaccttgttccttccgtacggtaaccaaacctaaccgaccccgtaagaaaacccgacccctaaaaactcaagttacgtaagtttacgtcgggacggtaccaaacggttaacggtcccggtaccccgtttacggttaacgggggttttcnccggttcgttccggtcctttccggttaccgtcgggtaccttacggaaacggttccgttaagggaacctaaccggtcccggtcctacccgttagaaaccgtctttcgtaccgttcggtacctaccgacggttcaaggaccgggtatacggtccgttaagttcttacgtttacgtcttaccgttactctaacgtacgttcgggaccttacgaacgttacggactttcgggttaacgggttgttaaccggacggtaaacgggtaccgggaaaccttcggttacccgttacccggtcgggtttacggaacccgacggtaccccgaggtccccttaaccccggg

SEQ ID NO: 81206 - DNA, 827 bp, Homo sapiens
  misc_feature: GYAE6OF02J2TDF.25.38.D05.1.454.CMB.1.raw
  modified_base (157)..(157): a, c, t, g, unknown or other
  misc_feature (157)..(157): n is a, c, g, or t
  modified_base (175)..(175): a, c, t, g, unknown or other
  misc_feature (175)..(175): n is a, c, g, or t
  modified_base (179)..(179): a, c, t, g, unknown or other
  misc_feature (179)..(179): n is a, c, g, or t
  modified_base (210)..(210): a, c, t, g, unknown or other
  misc_feature (210)..(210): n is a, c, g, or t
  modified_base (217)..(217): a, c, t, g, unknown or other
  misc_feature (217)..(217): n is a, c, g, or t
  modified_base (272)..(272): a, c, t, g, unknown or other
  misc_feature (272)..(272): n is a, c, g, or t
tcagactgtacagtcacgaccggtgctcgatttagtatctgatagttgggtttggggaggagcccagcactagaagtcggcggtgtctccattcggtgatcagcactgaaacacagaggactcaccatggagtttgggctgagcttagggttttccncgttgctacgttttaagnggtntccagtgtcaggtgcagcgtggtggagtcgngggggancgtggtccagccgtagggaactcccaggacgtactcgtctggtacgacctaactntccgtaggacttccggccttagaacgtttaaccgttggacctacgttcccgacggttcgggtcccgcgtaggcctaccggaggtaccgaagggttacctagggtaacgggttccggggtatttaacccgtttttagggacggggacctaagggttacgacggttcggaccgttaagggtactaaacgtttaacgccgttaagcgtaacgtacgtaccgtaccggtaggtaccggtcctacgttacgtacctacgttcccgtaacgtacggtaaaccgtaaccgtaacccggtacgaaaaccgggttacgggttacccgttttaacgtttacggaaacgttaaaggtaccggtaaaacgtcccgttaacggggtaacccgtaacccggtaacgtaacccgtacgggttacgttaaacgttacgtttaaaccgtacggttacggtaccgggtaacgtacgggtaacggtacccggttagtaccggggaacgtttacgggtcgggttaacctaccggggttacggtaccggttacccggggtacggtttaacccgggg

SEQ ID NO: 81207 - DNA, 882 bp, Homo sapiens
  misc_feature: GYAE6OF02HY9YM.25.38.D05.1.454.CMB.1.raw
tcagactgtacagtcacgaccggtgctcgatttagtatctgatagttgggtttgggggactgatcaggactcctcagttcaccttctcactatgaggctccctgctcagctcttggggctgctaatgctcgtggtccctggtaaggacaggaaggagatggagggaggtagaaggtgggggtagggaaggagtccgaggtgacgaggtaggtattggtgactacgacccgagacctccactccttcttgacttactacctaccccgtagggataccgacgtacggccctaccgtactccgtcctggtaccgacggtaccttaggtaccgtaaggacccggttccctaaccgtcgtaaccgtagttaaaccgggtcgtaaggttacggtaaccttaaccgttaacccgttttaacgtttttaggtaacgtttttccggggtttactaccggaaaccgttaaacggaaaacccggtccggtaaaacgggtccccgttaaagttccccggtttaacccaacccgggttccttaccccgtaagttaaccgtttaccttaaacggttacgggttttaaaaccccgttttcccggtttaaaccgtttcccgtttacggttaacggggttaccgtacgtaaccgttaaccgggtaaggtttaccgggttacggtagggtccggtaacggttacggtaccgggtaccggtaagggtaccgtacgttacgttaccgaacgtacgttaacggaaactccgggtaagggttaccgggaggtacggcgttagggtaacgtttcggtttaacggttgttttaacgtcggttacggttaacccgtaggtttacggaaccggttaagtacccggtaagtaccggtaaacgtaaccgg

SEQ ID NO: 81208 - DNA, 821 bp, Homo sapiens
  misc_feature: GYAE6OF02GCAKR.25.38.D05.1.454.CMB.1.raw
  modified_base (194)..(194): a, c, t, g, unknown or other
  misc_feature (194)..(194): n is a, c, g, or t
tcagactgtacagtcacgaccggtgctcgatttagtatctgatagttgggttggggagagcccagcactagaagtcggcggtgtctccattcggtgatcagcactgaacacagaggactcaccatcggagtttgggctgagtcgttgggttttcctgttgcttacttttaaggaggtgtccagttcgtcaggtncagcttggtgtagtcgtgggggagcgtggtccaggccgtagggtaactccctggacgtactcctaccgtgtagaccaactgtcgtaggtacttccggtccttacgtaaacgttaacgtttggcctaacgttacccacggtcgggtcccgaccggtacggtcctaccgagggtaccgaaaacgggtacgttaaggacgggttacggggttacttacgttttttaggtcggggaccttaagttaggaacggttcgggaccgttaaggtcggtaaaacttaacgttccgtaagttccggaactaccggtacccgttacggtaaccgtaaggggcccctttacgttaccccgtacacgttacctacccgaggtaactaaccgaacggtaccaaaggaaccgtttacccgttactttaaccgaacgtaaacgtaaggaaacgttccgaaaggtaacccgtacccggtaacgggtaaccgtaaccggttacttaaacggtaacgttaagttaaccgttcgggtacggacggttaaccggaaacccggtttacgaacgggttaacgaagggttaccgttaccggtaacggtcggttacccggggtacccggttaagggtcccggttaaccgggg

SEQ ID NO: 81209 - DNA, 654 bp, Homo sapiens
  misc_feature: GYAE6OF02GL0IO.25.38.D05.1.454.CMB.1.raw
  modified_base (428)..(428): a, c, t, g, unknown or other
  misc_feature (428)..(428): n is a, c, g, or t
  modified_base (466)..(466): a, c, t, g, unknown or other
  misc_feature (466)..(466): n is a, c, g, or t
  modified_base (500)..(500): a, c, t, g, unknown or other
  misc_feature (500)..(500): n is a, c, g, or t
  modified_base (509)..(509): a, c, t, g, unknown or other
  misc_feature (509)..(509): n is a, c, g, or t
tcagactgtacagtcacgaccggtgctcgatttagtatctgatagttgggtttgggggaggagcccagcactagaagtcggcggtgtctccattcggtgatcagcactgaacacagaggactcaccagtggagtttgggctgagcgttgggttttcctcgttgcttacgttttaaggaggtcgtaccgagttgtacgaggtgtcagtcgtggtggagtcggtggggagtcgtggtccagccgtgggaacgtccctagacgactctccgtgtacgacaactatctaggacttccgtccttacagttaaccgttcggctacgtcctacggtcggtccgacgcggtccacgaggacgaaggacgtagacggtggtacgttacgtttaggtcggactacgtagtacgtggctaggtacaagtacgactgtanacgtacgctaccggagaacggtctcttactactctacncgagactaacgaccgacgtaagtacgtaccgttnttacgaaanaagtaacgaacgcgtaacgaccgtaccggacgacgcggtactaacgtgttaaccgtagtcgggtagaacggtacgccggaccgtagggtacgtaaggcggttcggacggtacggtacggccgggtttaggcccggttaaccgggg

SEQ ID NO: 81210 - DNA, 136 bp, Homo sapiens
  misc_feature: GYAE6OF01D7YHI.48.47.E03.1.454.CMB.1.raw
  modified_base (136)..(136): a, c, t, g, unknown or other
  misc_feature (136)..(136): n is a, c, g, or t
tcagagtatacatacacgaccggtgctcgatttagactcgcgcacagagagaagggcacgaccggtgctcgatttagagctcacgtattgggtttggggtttttaggtatctgagcgggctggcaaggcgcatagn

SEQ ID NO: 81211 - DNA, 205 bp, Homo sapiens
  misc_feature: GYAE6OF01BFKZN.48.47.E03.1.454.CMB.1.raw
  modified_base (203)..(205): a, c, t, g, unknown or other
  misc_feature (203)..(205): n is a, c, g, or t
tcagagtatacatacacgaccggtgctcgatttagactcgcgcacagagagaagggcacgaccggtgctcgatttagctctacgctcagggcacgaccggtgctcgatttagctacgctctaagggaaaggggctggccctagcgtgttcctgttcccgccctcctctatgtatactctgagcgggctggcaaggcgcatagnnn

SEQ ID NO: 81212 - DNA, 137 bp, Homo sapiens
  misc_feature: GYAE6OF01DMOC6.48.47.E03.1.454.CMB.1.raw
  modified_base (137)..(137): a, c, t, g, unknown or other
  misc_feature (137)..(137): n is a, c, g, or t
tcagagtatacatacacgaccggtgctcgatttagactcgcgcacagagagaagggcacgaccggtgctcgatttagagctcacgtattgggtttggggttttttaggtatctgagcgggctggcaaggcgcatagn

SEQ ID NO: 81213 - DNA, 503 bp, Homo sapiens
  misc_feature: GYAE6OF01CS5L4.52.1.A01.1.454.CMB.1.raw
  modified_base (412)..(412): a, c, t, g, unknown or other
  misc_feature (412)..(412): n is a, c, g, or t
  modified_base (444)..(444): a, c, t, g, unknown or other
  misc_feature (444)..(444): n is a, c, g, or t
  modified_base (498)..(498): a, c, t, g, unknown or other
  misc_feature (498)..(498): n is a, c, g, or t
tcagcgcagtacgacacgaccggtgctcgatttagacgtctcatcagggcacagcatggacatgagggtccccgctcagctcctggggctcctgctactctggctccgaggtgccagatgtgtcatccagatgacccagtctccatcctccctgtccgcatctgtaggagacagagtcatcatcacttgccgggcaagtcagagcattagaacgtatttaaatggtatcaacagaaaccaggaaacgccctagaactcctgatctatggttcatccactttgctgagtgggtccatcaagttcagtggcagtggatcgtgggacagaattcactctcacatcaccagtctgcaggctgaggtattttgctaaacttacttctgtacaaactagtacgttacacgtttccctntacctttccggccctgggtaccctagttacgnggtaatatacaaacgactgtacggctgcaccatctgtcttcacttctacccgcntctag

SEQ ID NO: 81214 - DNA, 501 bp, Homo sapiens
  misc_feature: GYAE6OF01D5GHV.52.1.A01.1.454.CMB.1.raw
tcagcgcagtacgacacgaccggtgctcgatttagacgtctcatcagggggagtcagtctcagtcaggacacagcatggacatgagggtccccgctcagctcctggggctcctgctactctggctccgaggtgccagatgtgtcatccagatgacccagtctccatcctccctgtccgcatctgtaggagacagagtcatcatcacttgccgggcaagtcagagcattagaacgtattaaattggtatcaacagaaaccaggaaagcccctgaactcctgatctatggttcatccactttgctgagtgggtcccatcaagtcagtgcagtgatctgggacagaattcactctcaccatcacagtctgcaggctgaggattttgctaactttacttctgtacaactagaagttacagttccctactactttcggccctgggaccctatacgtaggatacgtacaaacgtaactcggtgacttggctaaccattcgtgttacc

SEQ ID NO: 81215 - DNA, 499 bp, Homo sapiens
  misc_feature: GYAE6OF01ARO1Z.52.1.A01.1.454.CMB.1.raw
  modified_base (407)..(407): a, c, t, g, unknown or other
  misc_feature (407)..(407): n is a, c, g, or t
  modified_base (494)..(494): a, c, t, g, unknown or other
  misc_feature (494)..(494): n is a, c, g, or t
tcagcgcagtacgacacgaccggtgctcgatttagacgtctcatcagggcacagcatggacatgagggtcccgctcagctcctggggctcctgctactctggctccgaggtgccagatgtgtcatccagatgacccagtctccatcctccctgtccgcatctgtaggagacagagtcatcatcacttgccgggcaagtcagagcattagaacgtatttaaattggtatcaacagaaaccagggaaagcccctgaactcctgatctatggttcatccactttgctgagtgggtcccatcaaggttcagtggcagtggatctgggacagaattcactctcaccatcacagtctgcaggctgaggtattttgctaacttacttctgtacaacagagtttacagttccctnacctttcggcccttagggaccctataggtgattacgtacaaacgtactggtgctcgctaccatctgttcttcattcctacccgcctntctag

SEQ ID NO: 81216 - DNA, 496 bp, Homo sapiens
  misc_feature: GYAE6OF01AYGFY.52.1.A01.1.454.CMB.1.raw
  modified_base (491)..(491): a, c, t, g, unknown or other
  misc_feature (491)..(491): n is a, c, g, or t
tcagcgcagtacgacacgaccggtgctcgatttagacgtctcatcagggcacagcatggacatgagggtccccgctcagctcctggggctcctgctactctggctccgaggtgccagatgtgtcatccagatgacccagtctccatcctccctgtccgcatctgtaggagacagagtcatcatcacttgccgggcaagtcagagcattagaacgtatttaaatggtatcaacagaaaccagggaaagcccctgaactcctgatctatggtcatccactttgctgagtgggtccatcaaggttcagtgcagtggatctgggacagattcactctcaccatcaccagtctgcaggctgagtatttgactaacttacttctgtacaacagacgttactacgttccctctaccgtttcggccctacgggacctagtagtggtatatacgaaacgtactgtgactgccacatcttgtcttctattccttcccgctntctag

SEQ ID NO: 81217 - DNA, 518 bp, Homo sapiens
  misc_feature: GYAE6OF01CSV7A.52.1.A01.1.454.CMB.1.raw
  modified_base (273)..(273): a, c, t, g, unknown or other
  misc_feature (273)..(273): n is a, c, g, or t
  modified_base (506)..(506): a, c, t, g, unknown or other
  misc_feature (506)..(506): n is a, c, g, or t
tcagcgcagtacgacacgaccggtgctcgatttagacgtctcatcaggggggagtcagtctcagtcaggacacagcatggacatgagggtccccgctcagctcctggggctcctgctactctggctccgaggtgccagatgtgtcatccagatgacccagtctccatcctccctgtccgcatctgtaggagacagagtcatcatcacttgccgggcaagtcagagcaattagaacgtatttaaattggtatacaacagaaaaccagggaaacncccctagaactcctgatctatggttcatccactttgctgagtgggtccatcaaggttcagtgcagtgatcgtagggacagaatcactctcaccatcaccagtctgcaggctgagtatttgactaactttacttctgtacaacgagtaacttactacgttccctctacgtttccggcccgttgggacctagtagtaggatacgtacaaacgtactggtcgtctcggacaccgtnttccgtgttccc

SEQ ID NO: 81218 - DNA, 483 bp, Homo sapiens
  misc_feature: GYAE6OF01D57H2.52.1.A01.1.454.CMB.1.raw
tcagcgcagtacgacacgaccggtgctcgatttagacgtctcatcagggggagtcagtctcagtcaggacacagcatggacatgagggtccccgctcagctcctggggctcctgctactctggctccgaggtgccagatgtgtcatccagatgacccagtctccatcctccctgtccgcatctgtaggagacagagtcatcatcacttgccggcaagtcagagcattagaacgtatttaaattggtatcaacagaaaccagggaaagcccctgaactcctgatctatggttcatccactttgctgagtggggtcccatcaaggttcagtggcagtggatctgggacagaattcactctcaccatcaccagtctgcaggctgagattttgcaacttacttctgtcaacagagttacagttccctctactttcggccctgggacccatagtggatatacaaactactgtggctgcacatctgtcc

SEQ ID NO: 81219 - DNA, 540 bp, Homo sapiens
  misc_feature: GYAE6OF01DOP0W.52.1.A01.1.454.CMB.1.raw
  modified_base (231)..(231): a, c, t, g, unknown or other
  misc_feature (231)..(231): n is a, c, g, or t
tcagcgcagtacgacacgaccggtgctcgatttagacgtctcatcagggcacagcatggacatgagggtccccgctcagctcctggggctcctgctactctggctccgaggtgccagatgtgtcatccagatgacccagtctccatcctccctgtccgcatctgtaggagacagagtcatcatcacttgccggcaagtcagagcattagaacgtatttaaatggtatcaanagaaaccagggaaagcccctgaactcctgatctatggttcatccactttgctgagtggggtcccagtcaaggttcagtggcagtggatctgggacagaattcactctcaccatcacagtctgcaggctgaggtattttgctaacttacttctgtcaacagtacgttacacgtttccctctaccttttccgggcccttggggaaccctagtacggtggtattaatccaaaacgtaacttggtacggctcggacctacccattccgttagttccctttactaccttccctttccccgcctattcccgtagg

SEQ ID NO: 81220 - DNA, 483 bp, Homo sapiens
  misc_feature: GYAE6OF01EST77.52.1.A01.1.454.CMB.1.raw
  modified_base (358)..(358): a, c, t, g, unknown or other
  misc_feature (358)..(358): n is a, c, g, or t
  modified_base (476)..(476): a, c, t, g, unknown or other
  misc_feature (476)..(476): n is a, c, g, or t
  modified_base (479)..(479): a, c, t, g, unknown or other
  misc_feature (479)..(479): n is a, c, g, or t
tcagcgcagtacgacacgaccggtgctcgatttagacgtctcatcagggcacagcatggacatgagggtccccgctcagctcctggggctcctgctactctggctccgaggtgccagatgtgtcatccagatgacccagtctccatcctccctgtccgcatctgtaggagacagagtcatcatcacttgccgggcaagtcagagcattagaacgtattaaattggtatcaacagaaaccagggaaagcccctgaactcctgatctatggttcatccactttgctgagtgggtcccatcaagttcagtgcagtggatctggacagaatcactctcacatcacagtctgcaggctgaggnttttgctaacttacttctgtacaactagagttacacgttccctctactttcggccctgggacctagtagtggatatacaaacgtactgtggctgccacatctgtcttcactcttcccnctntctg

SEQ ID NO: 81221 - DNA, 495 bp, Homo sapiens
  misc_feature: GYAE6OF01D97TQ.52.1.A01.1.454.CMB.1.raw
tcagcgcagtacgacacgaccggtgctcgatttagacgtctcatcagggggagtcagtctcagtcaggacacagcatggacatgagggtccccgctcagctcctggggctcctgctactctggctccgaggtgccagatgtgtcatccagatgacccagtctccatcctccctgtccgcatctgtaggagacagagtcatcatcacttgccgggcaagtcagagcattagaacgtatttaaattggtattcaacagaaaccagggaaagcccctgaactcctgatctatggttcatccactttgctgatggggtcccatcaaggttcagtggcagtggatctgggacagaattcactcttcaccatcaccagtctgcaggctgaggtattttgctaacttacttctgtcaacagagttacagttccctcactttccggccctgggaccctatagtaggtatactacaaacgaactgtggctgcaccatctgttcc

SEQ ID NO: 81222 - DNA, 512 bp, Homo sapiens
  misc_feature: GYAE6OF01BWZ9G.52.1.A01.1.454.CMB.1.raw
tcagcgcagtacgacacgaccggtgctcgatttagacgtctcatcagggggagtcagtctcagtcaggacacagcatggacatgagggtccccgctcagctcctggggctcctgctactctggctccgaggtgccagatgtgtcatccagatgacccagtctccatcctccctgtccgcatctgtaggagacagagtcatcatcacttgccgggcaagtcagagcattagaacgtatttaaattggtatcaacagaaaccagggaagcccctgaactcctgatctatggttcatccacttgctgagtgggtcccatcaaggttcagtggcagtggatcgtgggacagaattcactctcaccatcaccagtctgcaggtctgacgtattttgactaacgttacttctgtcaacagtagttacacgttccctcttaccttcggaccctagggtacctagtacgtggtatacgtacaaacggtactcgtaggctcggacacgtactcgtgttacc

SEQ ID NO: 81223 - DNA, 338 bp, Homo sapiens
  misc_feature: GYAE6OF01B26BL.52.1.A01.1.454.CMB.1.raw
  modified_base (331)..(338): a, c, t, g, unknown or other
  misc_feature (331)..(338): n is a, c, g, or t
tcagcgcagtacgacacgaccggtgctcgatttagacgtctcatcaggggggagtcagtctcagtcaggacacagcatggacatgagggtccccgctcagctcctggggctcctgctactctggctccgaggtgccagatgtgtcatccagatgacccagtctccatcctccctgtccgcatctgtaggagacagagtcatcatcacttgccgggcaagtcagagcattagaacgtatttaaattggtatacaacagaaaccagggaaacgcccctagaactcctgatctatgttcatccactttgctgagcggctggcaaggcgcatagnnnnnnnn

SEQ ID NO: 81224 - DNA, 494 bp, Homo sapiens
  misc_feature: GYAE6OF01EBZBZ.52.1.A01.1.454.CMB.1.raw
  modified_base (486)..(486): a, c, t, g, unknown or other
  misc_feature (486)..(486): n is a, c, g, or t
tcagcgcagtacgacacgaccggtgctcgatttagacgtctcatcaggggggagtcagtctcagtcaggacacagcatggacatgagggtccccgctcagctcctggggctcctgctactctggctccgaggtgccagatgtgtcatccagatgacccagtctccatcctccctgtccgcatctgtaggagacagagtcatcatcacttgccgggcaagtcagagcattagaacgtatttaaattggtatcaacagaaaccagggaaagcccctgaactcctgatctatggttcatccactttgctgagtgggtccagtcaaggtcagtgcagtgatctggacagaatcactctcacatcaccagtctgcaggctgaggtattttgctaacttacttctgtcaactagagttacagttccctactacctttccggcccttagggacctagtacgtgatactacaaacgtactgtggctgactaccntctgttcc

SEQ ID NO: 81225 - DNA, 491 bp, Homo sapiens
  misc_feature: GYAE6OF01AQ9UC.52.1.A01.1.454.CMB.1.raw
  modified_base (485)..(485): a, c, t, g, unknown or other
  misc_feature (485)..(485): n is a, c, g, or t
tcagcgcagtacgacacgaccggtgctcgatttagacgtctcatcagggcacagcatggacatgagggtccccgctcagctcctggggctcctgctactctggctccgaggtgccagatgtgtcatccagatgacccagtctccatcctccctgtccgcatctgtaggagacagagtcatcatcacttgccgggcaagtcagagcattagaacgtatttaaattggtatcaacagaaaccagggaaagccctgaactcctgatctatggttcatccactttgctgagtgggtccatcaaggttcagtgcagtggatctgggacagaattcactctcaccatcaccagtctgcaggctgaggtattttgctaacttacttctgtacaacagtacgttacacgttccctctacctttcggccctagggaccagtagtggatatacaaacgaactgtggctgcacatctgtcttcactcttcccgctntctacg

SEQ ID NO: 81226 - DNA, 497 bp, Homo sapiens
  misc_feature: GYAE6OF01AFFBO.52.1.A01.1.454.CMB.1.raw
  modified_base (427)..(427): a, c, t, g, unknown or other
  misc_feature (427)..(427): n is a, c, g, or t
tcagcgcagtacgacacgaccggtgctcgatttagacgtctcatcagggggagtcagtctcagtcaggacacagcatggacatgagggtccccgctcagctcctggggctcctgctactctggctccgaggtgccagatgtgtcatccagatgacccagtctccatcctccctgtccgcatctgtaggagacagagtcatcatcacttgccgggcaagtcagagcattagaacgtatttaaattggtattaacagaaaccagggaaagcccctgaactcctgatctatggttcatccactttgctgagtgggtccatcaaggttcagtggcagtggatctggacagattcactctcaccatcaccagtctgcaggctgaggattttgactaacttacttctgtcaacagtagttaccagtttccctntacctttcggcccttgggacctagtagtcggatagtcaaacgtactgtacgctcgcaccatctgtcttac

SEQ ID NO: 81227 - DNA, 502 bp, Homo sapiens
  misc_feature: GYAE6OF01CJA7N.52.1.A01.1.454.CMB.1.raw
tcagcgcagtacgacacgaccggtgctcgatttagacgtctcatcaggggggagtcagtctcagtcaggacacagcatggacatgagggtccccgctcagctcctggggctcctgctactctggctccgaggtgccagatgtgtcatccagatgacccagtctccatcctccctgtccgcatctgtaggagacagagtcatcatcacttgccgggcaagtcagagcattagaacgtatttaaattggtatcaacagaaaccagggaaagcccctgaactcctgatctatggttcatccatttgctgagtgggtcccatcaggttcagtggcagtggatcgtgggacagaattcactctcaccatcaccagtctgcaggctgaggtattttgctaactttacttctgtacaactagtagttacacgttccctctaccgtttccggccctgggacctagtagtggatactacaaacgtactgtggctcgacaccactctgttcc

SEQ ID NO: 81228 - DNA, 474 bp, Homo sapiens
  misc_feature: GYAE6OF01A22H6.52.1.A01.1.454.CMB.1.raw
  modified_base (466)..(466): a, c, t, g, unknown or other
  misc_feature (466)..(466): n is a, c, g, or t
  modified_base (469)..(469): a, c, t, g, unknown or other
  misc_feature (469)..(469): n is a, c, g, or t
tcagcgcagtacgacacgaccggtgctcgatttagacgtctcatcagggcacagcatggacatgagggtccccgctcagctcctggggctcctgctactctggctccgaggtgccagatgtgtcatccagatgacccagtctccatcctccctgtccgcatctgtaggagacagagtcatcatcacttgccggcaagtcagagcattagaacgtatttaaatggtatcaacagaaaccaggaaagcccctgaactcctgatctatggttcatccacttgctgagtgggtccatcaagttcagtggcagtgatctgggacagaattcactctcaccatcacagtctgcaggctgagtatttgctaacttattctgtacaacagagttacagttccctctacgtttcggccctgggacctatagtgatagtacaaacgatcgtgctgccacatctgtctctctctccnctntctag

SEQ ID NO: 81229 - DNA, 501 bp, Homo sapiens
  misc_feature: GYAE6OF01CV1RA.52.1.A01.1.454.CMB.1.raw
  modified_base (215)..(215): a, c, t, g, unknown or other
  misc_feature (215)..(215): n is a, c, g, or t
  modified_base (421)..(421): a, c, t, g, unknown or other
  misc_feature (421)..(421): n is a, c, g, or t
tcagcgcagtacgacacgaccggtgctcgatttagacgtctcatcaggggggagtcagtctcagtcaggacacagcatggacatgagggtccccgctcagctccgtggggctcctgctactctggctccgaggtgccagatgtgtcatccagatgacccagtctccatcctccctgtccgcatctgtaggagacagatcatcatcacttgccggnaagtcagagcattagaacgtatttaaatgtatcaacagaaacaggaacgcccctgaactctgatctatgttcatccacttgctgagtgggtccagtcaaggtcagtggcagtgatcgtgggacagaattcaactctcaccatcacagtctgcaggctgagtatttgactaacttactctgtacaacagtagttacacgttccctanacgtttccggcccttgggaacctagtagtggtaatataccaaaacgtctaggtggactgacctaaccgattcctgttacc

SEQ ID NO: 81230 - DNA, 485 bp, Homo sapiens
  misc_feature: GYAE6OF01BAO83.52.1.A01.1.454.CMB.1.raw
tcagcgcagtacgacacgaccggtgctcgatttagacgtctcatcagggcacagcatggacatgagggtccccgctcagctcctggggctcctgctactctggctccgaggtgccagatgtgttatccagatgacccagtctccatcctccctgtccgcatctgtaggagacagagtcatcatcacttgccgggcaagtcagagcattagaacgtatttaaattggtatcaacagaaaccagggaaagccctgaactcctgatctatggttcatccactttgctgagtggggtccagtcaaggttcagtggcagtggatctggacagaattcactctcaccatcaccagtctgcaggctgaggattttgctaacttacttctgtcaacagattacagttccctcactttcggccctgggaccagtagtggatatacaacgactgtgctgcaccatctgtcttcacttcttcccgccatctgtaac

SEQ ID NO: 81231 - DNA, 595 bp, Homo sapiens
  misc_feature: GYAE6OF01B71JS.52.1.A01.1.454.CMB.1.raw
tcagcgcagtacgacacgaccggtgctcgatttagacgtctcatcagggcacagcatggacatgagggtccccgctcagctcctggggctcctgctactctggctccgaggtgccagatgtgtcatccagatgacccagtctccatcctccctgtccgcatctgtaggagacagagtcatcatcacttgccgggcaagtcagagcattagaacgtatttaaattggtatcaacagaaaccagggaaacgcccctgaactcctgatctatggttcatccactttgctgagtgggtccagtcaaggttcagtggcagtggatcgtggacagaattcactctcacatcacagtctgcaggctgaggtattttgactaacttacttctgtacaacgtagtaacgtttactacgtttccccttactaaccgttttccgggccccgttagggaaccctagtaacggttaggaattaacgttaccaaaaccggtaacgttggttacgggtaccttacggaccctaacccgtaatttcccgttacggttaccctttcctaacctttcccttttacccccggacccttaccgtttcgttaacgg

SEQ ID NO: 81232 - DNA, 488 bp, Homo sapiens
  misc_feature: GYAE6OF01EO9FV.52.1.A01.1.454.CMB.1.raw
  modified_base (459)..(459): a, c, t, g, unknown or other
  misc_feature (459)..(459): n is a, c, g, or t
  modified_base (480)..(480): a, c, t, g, unknown or other
  misc_feature (480)..(480): n is a, c, g, or t
  modified_base (483)..(483): a, c, t, g, unknown or other
  misc_feature (483)..(483): n is a, c, g, or t
tcagcgcagtacgacacgaccggtgctcgatttagacgtctcatcagggcacagcatggacatgagggtccccgctcagctcctggggctcctgctactctggctccgaggtgccagatgtgtcatccagatgacccagtctccatcctccctgtccgcatctgtaggagacagagtcatcatcacttgccgggcaagtcagagcattagaacgtatttaaattggtatcaacagaaaccagggaaagcccctgaactcctgatctatggttcatccactttgctgagtgggtcccatcaagttcagtgcagtggatctgggacagaatcactctcacatcacagtctgcagctgagtattttgctaactttacttctgtacaactagtacgttacagtttcccctctacctttcggccctgggacctagtagtgatatacaaacgactgtgctgcacntctgtcttctactccttcccnctntctag

SEQ ID NO: 81233 - DNA, 533 bp, Homo sapiens
  misc_feature: GYAE6OF01D0QKI.52.1.A01.1.454.CMB.1.raw
  modified_base (375)..(375): a, c, t, g, unknown or other
  misc_feature (375)..(375): n is a, c, g, or t
tcagcgcagtacgacacgaccggtgctcgatttagacgtctcatcaggggggagtcagtctcagtcaggacacagcatggacatgagggtccccgctcagctcctggggctcctgctactctggctccgaggtgccagatgtgtcatccagatgacccagtctccatcctccctgtccgcatctgtaggagacagatcatcatcacttgccggcaagtcagagcattagaacgttatttaaattggtatcaacagaaaccagggaaacgcccctagaactcctgatctatggttcatccactttgctgagtgggtccatcaaggttcagtgcagtgatcgtgggacagattcactctcacatcacagtctgcagntgaggtatttgactaactttacttctcgtacaactagtaacgttacacgtttcccctacttaccgtttcggccccgtcgggaccctagtacgtaggtaacttacgtacaaaacggtacttcggtaggaccttacggaccaactacttcgttcgttccc

SEQ ID NO: 81234 - DNA, 500 bp, Homo sapiens
  misc_feature: GYAE6OF01C0LOT.52.1.A01.1.454.CMB.1.raw
  modified_base (333)..(333): a, c, t, g, unknown or other
  misc_feature (333)..(333): n is a, c, g, or t
  modified_base (346)..(346): a, c, t, g, unknown or other
  misc_feature (346)..(346): n is a, c, g, or t
  modified_base (377)..(377): a, c, t, g, unknown or other
  misc_feature (377)..(377): n is a, c, g, or t
  modified_base (491)..(491): a, c, t, g, unknown or other
  misc_feature (491)..(491): n is a, c, g, or t
  modified_base (494)..(494): a, c, t, g, unknown or other
  misc_feature (494)..(494): n is a, c, g, or t
tcagcgcagtacgacacgaccggtgctcgatttagacgtctcatcagggcacagcatggacatgagggtccccgctcagctcctggggctcctgctactctggctccgaggtgccagatgtgtcatccagatgacccagtctccatcctccctgtccgcatctgtaggagacagagtcatcatcacttgccgggcaagtcagagcattagaacgtatttaaatggtatcaaacagaaaccaggaaacgcccctgaactcctgatctatgttcatccactttgctgagtgggtccatcaagttcagtgcagtgatcgtggacagaattcactcncacatcacagtcngcagctgaggtatttgactaacttacttctntacaactagtacgttactacgtttccctactacctttcggccctagggacctagtagtagtatactacaaacgtacgtgtgctgccacattctgtcttacgtacttccttcccnctntcgtag

SEQ ID NO: 81235 - DNA, 535 bp, Homo sapiens
  misc_feature: GYAE6OF01CDDM8.52.1.A01.1.454.CMB.1.raw
  modified_base (193)..(193): a, c, t, g, unknown or other
  misc_feature (193)..(193): n is a, c, g, or t
  modified_base (230)..(230): a, c, t, g, unknown or other
  misc_feature (230)..(230): n is a, c, g, or t
  modified_base (336)..(336): a, c, t, g, unknown or other
  misc_feature (336)..(336): n is a, c, g, or t
tcagcgcagtacgacacgaccggtgctcgatttagacgtctcatcagggcacagcatggacatgagggtcccgctcagctcctggggctcctgctactctggctccgaggtgccagatgtgtcatccagatgacccagtctccatcctccctgtccgcatctgtaggagacagagtcatcatcacttgccggnaagtcagagcattagaacgtatttaaatggtatcaanagaaaccagggaaacgcccctagaactcctgatctatggttcatccactttgctgagtcgggtcccatcaaggttcagtgcagtgatcgtggacagaattcactcncacatcactagtctgcaggctgagtatttgactaacgttacttcgtgtacaactagtagttacacgtttccctactaccgttttcggccctagggtaccctaagtaggtcgaattactaccgtaaacgacttcgtggactacgcgaccctaggtctcggttacttaccgtacttccgtttacccgactagtcgttaacg

SEQ ID NO: 81236 - DNA, 497 bp, Homo sapiens
  misc_feature: GYAE6OF01EN6X1.52.1.A01.1.454.CMB.1.raw
  modified_base (214)..(214): a, c, t, g, unknown or other
  misc_feature (214)..(214): n is a, c, g, or t
  modified_base (252)..(252): a, c, t, g, unknown or other
  misc_feature (252)..(252): n is a, c, g, or t
  modified_base (334)..(334): a, c, t, g, unknown or other
  misc_feature (334)..(334): n is a, c, g, or t
  modified_base (465)..(465): a, c, t, g, unknown or other
  misc_feature (465)..(465): n is a, c, g, or t
tcagcgcagtacgacacgaccggtgctcgatttagacgtctcatcagggggagtcagtctcagtcaggacacagcatggacatgagggtccccgctcagctcctggggctcctgctactctggctccgaggtgccagatgtgtcatccagatgacccagtctccatcctccctgtccgcatctgtaggagacagagtcatcatcacttgccggnaagtcagagcattagaacgtatttaaattggtatcaanagaaaccaggaaagccctgaactcctgatctatggttcatccactttgctgagtgggtccatcaaggtcagtgcagtggatntgggacagaatcactctcacatcacagtctgcagctgaggtattttgctaactttacttctgttacaactagtagttaccaagtttcccctctacctttcggcccttgggacccagtacgtggtatactanaaacgtactgtggacttgacacatcgtgttcc

SEQ ID NO: 81237 - DNA, 491 bp, Homo sapiens
  misc_feature: GYAE6OF01BJXER.52.1.A01.1.454.CMB.1.raw
  modified_base (486)..(486): a, c, t, g, unknown or other
  misc_feature (486)..(486): n is a, c, g, or t
tcagcgcagtacgacacgaccggtgctcgatttagacgtctcatcagggcacagcatggacatgagggtccccgctcagctcctggggctcctgctactctggctccgaggtgccagatgtgtcatccagatgacccagtctccatcctccctgtccgcatctgtaggagacagagtcatcatcacttgccgggcaagtcagagcattagaacgtatttaaattggtatcaacagaaaccagggaaagcccctgaactcctgatctatggttcatccactttgctgagtggggtcccatcaaggttcagtggcagtggatctgggacagaattcactctcaccatcaccagtctgcaggctgaggtattttgctaacttacttctgtcaactagagttacagtttccctctacctttcggccctgggaccagtagtggatatcaaacgactgtcggctgcacatctgtcttcattcttacccgctntctag

SEQ ID NO: 81238 - DNA, 508 bp, Homo sapiens
  misc_feature: GYAE6OF01CSKKV.52.1.A01.1.454.CMB.1.raw
tcagcgcagtacgacacgaccggtgctcgatttagacgtctcatcagggcacagcatggacatgagggtccccgctcagctcctggggctcctgctactctggctccgaggtgccagatgtgtcatccagatgacccagtctccatcctccctgtccgcatctgtaggagacagagtcatcatcacttgccggcaagtcagagcattagaacgtatttaaatggtatcaacagaaaccagggaaagccctgaactcctgatctatggttcatccactttgctgagtggggtcccatcaaggttcagtgcagtgatctgggacagaattcactctcaccatcacagtctgcaggctgaggtatttgacctaacttacttctgtacaaactagtagttaccagtttcccctactaccttttcggccctggggtacctagttagtcggataactcaaaacgtactagtcgctggactaccatctcgtacttcacttcttcccgctctctag

SEQ ID NO: 81239 - DNA, 534 bp, Homo sapiens
  misc_feature: GYAE6OF01AFCQP.52.1.A01.1.454.CMB.1.raw
tcagcgcagtacgacacgaccggtgctcgatttagacgtctcatcagggcacagcatggacatgagggtccccgctcagctcctggggctcctgctactctggctccgaggtgccagatgtgtcatccagatgacccagtctccatcctccctgtccgcatctgtaggagacagagtcatcatcacttgccgggcaagtcagagcattagaacgttatttaaattggtatcaacagaaaccagggaaagcccctgaactcctgatctatggttcatccactttgctgagtggggtccatcaaggttcagtggcagtggatcgtagggacagattcactctcaccatcaccagtctgcaggctgaggtatttgactaactttacttctgtacaactagacgttacacgtttccctctaccgtttccggcccgtacgggacctagtacggtaggaacttactacgtaaaacgtacgtgtacggactcggacctacacttcgtcgttcttactacttccttaccccgcctatctacg

SEQ ID NO: 81240 - DNA, 508 bp, Homo sapiens
  misc_feature: GYAE6OF01DIP5Z.52.1.A01.1.454.CMB.1.raw
  modified_base (463)..(463): a, c, t, g, unknown or other
  misc_feature (463)..(463): n is a, c, g, or t
tcagcgcagtacgacacgaccggtgctcgatttagacgtctcatcagggcacagcatggacatgagggtccccgctcagctcctggggctcctgctactctggctccgaggtgccagatgtgtcatccagatgacccagtctccatcctccctgtccgcatctgtaggagacagagtcatcatcacttgccgggcaagtcagagcattagaacgtatttaaattggtatacaaacagaaaaccagggaaacgccctagaactcctgatctatggttcatccactttgctgagtgggtccatcaaggttcagtgcagtggatcgtggacagaattcactctcacatacacagtctgcaggctagagtatttgactaactttacttctagtacaacgtagtagttactacgttccctataccgtttcgccctagggacctagtagtgactatacaaagtacttgngctgccactatcttagtcttactacttcctacccgtcagtctacg

SEQ ID NO: 81241 - DNA, 559 bp, Homo sapiens
  misc_feature: GYAE6OF01D75Q2.52.1.A01.1.454.CMB.1.raw
  modified_base (215)..(215): a, c, t, g, unknown or other
  misc_feature (215)..(215): n is a, c, g, or t
  modified_base (391)..(391): a, c, t, g, unknown or other
  misc_feature (391)..(391): n is a, c, g, or t
  modified_base (542)..(542): a, c, t, g, unknown or other
  misc_feature (542)..(542): n is a, c, g, or t
tcagcgcagtacgacacgaccggtgctcgatttagacgtctcatcagggggagtcagtctcagtcaggacacagcatggacatgagggtccccgctcagctcctggggctcctgctactctggctccgaggtgccagatgtgtcatccagatgacccagtctccatcctccctgtccgcatctgtaggagacagagtcatcatcacttgccgggnaagtcagagcattagaacgtatttaaatggtatcaacagaaaccagggaaacgcccctagaactcctgatctatggttcattccactttgctgagtgggtcccatcaaggttcagtggcagtggatcgtgggaacagtaattcactcactacatcaccagtctgcaggctgaggtntttagctaactttactctagtacaacgtgtagttacacggtttaccctacttaaccgtttccggacccgttaggggaccctaagttacggtaggtaacttacgtaacgaaaccggtaacgttgggtacggaccgttacggactaaacccgntttccgtcggtttaccc

SEQ ID NO: 81242 - DNA, 544 bp, Homo sapiens
  misc_feature: GYAE6OF01BPN3W.52.1.A01.1.454.CMB.1.raw
  modified_base (269)..(269): a, c, t, g, unknown or other
  misc_feature (269)..(269): n is a, c, g, or t
  modified_base (345)..(345): a, c, t, g, unknown or other
  misc_feature (345)..(345): n is a, c, g, or t
tcagcgcagtacgacacgaccggtgctcgatttagacgtctcatcagggggggagtcagtctcagtcaggacacagcatggacatgagggtccccgctcagctcctggggctcctgctactctggctccgaggtgccagatgtgtcatccagatgacccagtctccatccctccctgtccgcatctgtaggagacagagtcatcatcacttgccgggcaagtcagagcattagaacgtatttaaatgtatcaacagaaaccagggaacncccctagaactcctgatctatggttcatctacttgctggagtgggtcccatcaaggttcagtggacagtggatcgngggacagtaattcactctcacatcaccagtctcgcaggcgtagaggtattttggacctaactttacttctagtaccaacgtagtacgttactactttcccctcttaccgtttcccggacccgttgggaacctagttacggtacgtatactaacgaaaccgtactcggtaggccgtgaccctacagttcctcggtttacc

SEQ ID NO: 81243 - DNA, 539 bp, Homo sapiens
  misc_feature: GYAE6OF01CHIGY.52.1.A01.1.454.CMB.1.raw
  modified_base (335)..(335): a, c, t, g, unknown or other
  misc_feature (335)..(335): n is a, c, g, or t
tcagcgcagtacgacacgaccggtgctcgatttagacgtctcatcagggcacagcatggacatgagggtccccgctcagctcctggggctcctgctactctggctccgaggtgccagatgtgtcatccagatgacccagtctccatcctccctgtccgcatctgtaggagacagagtcatcatcacttgccgggcaagtcagagcattagaacgtatttaaatggtatcaaacagaaaccagggaaacgcccctgaactcctgatctatgtcatccactttgctgagtgggtcccagtcaaggttcagtggcagtgatcgtggacagatcactcncacatcacagtctgcagctgaggtatttgctaacttcttactgttacaactagtacgttactacgtttccctactactttccggcccgttagggaccctagttacggtaggtattaacgtaccgtaaacgaacttggtacgcctgccaacctattccgttcgttcctttcgtaactttcccttccccgacctagttccttaacg

SEQ ID NO: 81244 - DNA, 594 bp, Homo sapiens
  misc_feature: GYAE6OF01D1777.52.1.A01.1.454.CMB.1.raw
tcagcgcagtacgacacgaccggtgctcgatttagacgtctcatcagggcacagcatggacatgagggtccccgctcagctcctggggctcctgctactctggctccgaggtgccagatgtgtcatccagatgacccagtctccatcctccctgtccgcatctgtaggagacagagtcatcatcacttgccgggcaagtcagagcattagaacgtatttaaatggtatcaacagaaaccagggaaacgcccctagaactcctgatctatggttcatccatttgctgagtgggtccatcaagttcagtggcagtggatcgtgggacagaattcactctcaccatccaccagtctgcaggctggagtattttgactaacttacttctgtacaactagtacgttactacgtttccctacttaccgtttcgggaccccgttgggaaccctagttaacggttagggtaacttaactaccgtaaaaccgtaaccgtggttacgggtccgttacggccctaacccgtactttcccgttacgtttaccctttaccgtaacctttccccgtttacccccgtacccttacgttcccgttaacgg

SEQ ID NO: 81245 - DNA, 475 bp, Homo sapiens
  misc_feature: GYAE6OF01B2OW6.52.1.A01.1.454.CMB.1.raw
  modified_base (449)..(449): a, c, t, g, unknown or other
  misc_feature (449)..(449): n is a, c, g, or t
  modified_base (459)..(459): a, c, t, g, unknown or other
  misc_feature (459)..(459): n is a, c, g, or t
tcagcgcagtacgacacgaccggtgctcgatttagacgtctcatcagggcacagcatggacatgagggtccccgctcagctcctggggctcctgctactctggctccgaggtgccagatgtgtcatccagatgacccagtctccatcctccctgtccgcatctgtaggagacagagtcatcatcacttgccggcaagtcagagcattagaacgtatttaaatggtatcaacagaaaccagggaaagcccctgaactcctgatctatggttcatccactttgctgagtgggtcccatcaaggttcagtggcagtgatctgggacagattcactctcacatcacagtctgcaggctgaggattttgctaacttacttctgtcaactagagttacagttccctcactttcggccctgggaccagtagtgatatcaaacgactgtgctgcacntctgtcttcnctcttcccgcatctag

SEQ ID NO: 81246 - DNA, 516 bp, Homo sapiens
  misc_feature: GYAE6OF01DDTEY.52.1.A01.1.454.CMB.1.raw
  modified_base (216)..(216): a, c, t, g, unknown or other
  misc_feature (216)..(216): n is a, c, g, or t
  modified_base (266)..(266): a, c, t, g, unknown or other
  misc_feature (266)..(266): n is a, c, g, or t
  modified_base (341)..(341): a, c, t, g, unknown or other
  misc_feature (341)..(341): n is a, c, g, or t
  modified_base (352)..(352): a, c, t, g, unknown or other
  misc_feature (352)..(352): n is a, c, g, or t
  modified_base (403)..(403): a, c, t, g, unknown or other
  misc_feature (403)..(403): n is a, c, g, or t
  modified_base (449)..(449): a, c, t, g, unknown or other
  misc_feature (449)..(449): n is a, c, g, or t
tcagcgcagtacgacacgaccggtgctcgatttagacgtctcatcaggggggagtcagtctcagtcaggacacagcatggacatgagggtccccgctcagctcctggggctcctgctactctggctccgaggtgccagatgtgtcatccagatgacccagtctccatcctccctgtccgcatctgtaggagacagagtcatcatcacttgccgggnaagtcagagcattagaacgtatttaatggtatcaacagaaaccaggaaanccctgaactcctgatctatggtcatccactttgctgagtgggtcccatcaaggttcagtggcagtgatgtggganagattcactcncacatcaccagtctgcaggctggagtatttgctaacttcttctgtactaanagtagttacacgtttccctcgtacctttcggccctagggtaacccngttaacggtggtaacttacgtacaaaacggtaacttcggtagctcgtacacctaattctgtttaccc

SEQ ID NO: 81247 - DNA, 808 bp, Homo sapiens
  misc_feature: GYAE6OF01BHNTS.52.1.A01.1.454.CMB.1.raw
tcagcgcagtacgacacgaccggtgctcgatttagacgtctcatcagggcacagcatggacatgagggtccccgctcagctcctggggctcctgctactctggctccgaggtgccagatgtgtcatccagatgacccagtctccatccctccctgtccgcatctaggtaggagacagagtcatcatctacgttcggccggacaagtcagagactaagttaacgtaaacgtttaattttaaagttggtaataaccgaaacgaaacgaaaaccggaaggggaaacctccccgtaagtaaacccttccgtagtaacttcgtaaggtttcggttacctacttacccgttaacgtttggtacgttagggtacgggttccggggttaccctaagttaccggttaaacgggtttccgaagggttcgggtacgtagggttacggtacttacgggtacggggaaactaaggttaacttaccaccgttacctaaccaaccctaactacccgtaacccgtaggttccgtacggaccggtacgggtcgttagggtaacggttttacgttttacgaaacccctttaaccgttttaccttacgtaacggttaacctaacggttaagttaacccgtttaacgttacccgtttccccttacgttaaccccggttttcccgggacccgttaagggaaccttaggttacggtacgtaacttaacgtaaccgaaacgtagttcggtccgtacgttaccgacctaccgttacgttcccgttgttacccttaccgtacgtttccccgtacccgacttacgttcgtaacg

SEQ ID NO: 81248 - DNA, 493 bp, Homo sapiens
  misc_feature: GYAE6OF01D8G1X.52.1.A01.1.454.CMB.1.raw
  modified_base (367)..(367): a, c, t, g, unknown or other
  misc_feature (367)..(367): n is a, c, g, or t
tcagcgcagtacgacacgaccggtgctcgatttagacgtctcatcagggcacagcatggacatgagggtccccgctcagctcctggggctcctgctactctggctccgaggtgccagatgtgtcatccagatgacccagtctccatcctccctgtccgcatctgtaggagacagagtcatcatcacttgccgggcaagtcagagcattagaacgtatttaaattggtatcaaacagaaaaccagggaaagcccctgaactcctgatctatggttcatccactttgctgagtggggtccatcaaggttcagtggcagtggatctgggacagaattcactctcaccatcaccagtctgcagctgaggtnttttgactaattacttctgtcaactagattacagttccctctaccgtttcggaccctgggaccctagtacgtggatatacaaacgactgtggctgcctacatctgtcttcattcttcctgctatcg

SEQ ID NO: 81249 - DNA, 580 bp, Homo sapiens
  misc_feature: GYAE6OF01CORPZ.52.1.A01.1.454.CMB.1.raw
  modified_base (271)..(271): a, c, t, g, unknown or other
  misc_feature (271)..(271): n is a, c, g, or t
tcagcgcagtacgacacgaccggtgctcgatttagacgtctcatcaggggggagtcagtctcagtcaggacacagcatggacatgagggtccccgctcagctcctggggctcctgctactctggctccgaggtgccagatgtgtcatccagatgacccagtctccatccctccctgtccgcatctgtaggagacagagtcatcatcacttggccgggcaagtcagagcattagaacgtaatttaatggtatacaacagaaaccagggaacnccctagaactcctgatctatcgtcatcctactttgcgtgaggtcgggtcccagtcgtaaggttcgaggtggcaggtgacgtcgtagggacaggtaacttcactctacaccatcaccagtctgcgaggtctggtagtattttcgactaacttcttctatacaactagtaacgttaccgacgtttccctacgttaccgtttccggacccgtacgggtaacctacgtaggttagtaacttacgtaaccgaaaacggtaccgttgggtacggtaccgtacggaccctaacccgtattcccgttggtttacccc

SEQ ID NO: 81250 - DNA, 493 bp, Homo sapiens
  misc_feature: GYAE6OF01EHE9E.52.1.A01.1.454.CMB.1.raw
  modified_base (463)..(463): a, c, t, g, unknown or other
  misc_feature (463)..(463): n is a, c, g, or t
tcagcgcagtacgacacgaccggtgctcgatttagacgtctcatcaggggggagtcagtctcagtcaggacacagcatggacatgagggtccccgctcagctcctggggctcctgctactctggctccgaggtgccagatgtgtcatccagatgacccagtctccatcctccctgtccgcatctgtaggagacagagtcatcatcacttgccgggcaagtcagagcattagaacgtatttaaattggtatcaacagaaaccagggaaagcccctgaactcctgatctatggttcatccactttgctgagtgggtcccatcaagtcagtgcagtgatctgggacagaattcactctcaccatcaccagtctgcaggctgaggtattttgctaacttacttctgtcaacagtagttacacgttccctctactttccggccctgggacctatacgtggtatactanaaacgtactgtggctgacaccatctgttcc

SEQ ID NO: 81251 - DNA, 513 bp, Homo sapiens
  misc_feature: GYAE6OF01CEHKD.52.1.A01.1.454.CMB.1.raw
tcagcgcagtacgacacgaccggtgctcgatttagacgtctcatcagggcacagcatggacatgagggtccccgctcagctcctggggctcctgctactctggctccgaggtgccagatgtgtcatccagatgacccagtctccatcctccctgtccgcatctgtaggagacagagtcatcatcacttgccggcaagtcagagcattagaacgtatttaaattggtatcaacagaaaccagggaaagcccctgaactcctgatctatgttcatccactttgctgagtcgggtcccatcaaggttcagtgcagtggatcgtgggacagaattcactctacaccatcaccagtctgcgaggctggagtattttgactaacttacttctgtacaacagtacgttacacgttccctctccgtttcggccctgggacctagtagtagtatactacaacgacgtgtcggctcgccactactcgttcgttccttctacttccttaccccgctagtctacg

SEQ ID NO: 81252 - DNA, 552 bp, Homo sapiens
  misc_feature: GYAE6OF01D95DO.52.1.A01.1.454.CMB.1.raw
tcagcgcagtacgacacgaccggtgctcgatttagacgtctcatcagggcacagcatggacatgagggtccccgctcagctcctggggctcctgctactctggctccgaggtgccagatgtgtcatccagatgacccagtctccatcctccctgtccgcatctgtaggagacagagtcatcatcacttgccgggcaagtcagagcattagaacgttatttaaattggtatcaacagaaaccagggaaacgcccctgaactcctgatctatggttcatcctactttgctggaggtcggggtcccatctaaggttcaggtggcagtggatcgtgggacagaattcactctcaccatcaccagtctgcaggtctaggaggtattttgacttaactttacttcttagtcaactagtacgttactacgtttccctctaccgtttccggcccttcgggacctagtaggtaggtaactataccgtaaacgtacgtggtcggcctaggcctactagttcctagttccttacgtacttcccttccccgcctatcgttaacg

SEQ ID NO: 81253 - DNA, 509 bp, Homo sapiens
  misc_feature: GYAE6OF01CL1B8.52.1.A01.1.454.CMB.1.raw
  modified_base (268)..(268): a, c, t, g, unknown or other
  misc_feature (268)..(268): n is a, c, g, or t
  modified_base (376)..(376): a, c, t, g, unknown or other
  misc_feature (376)..(376): n is a, c, g, or t
  modified_base (400)..(400): a, c, t, g, unknown or other
  misc_feature (400)..(400): n is a, c, g, or t
tcagcgcagtacgacacgaccggtgctcgatttagacgtctcatcaggggggagtcagtctcagtcaggacacagcatggacatgagggtccccgctcagctcctggggctcctgctactctggctccgaggtgccagatgtgtcatccagatgacccagtctccatcctccctgtccgcatctgtaggagacagagtcatcatcacttgccggcaagtcagagcattagaacgtatttaaatggtatcaacagaaaccagggaaacncccctagaactcctgatctatggtcatccactttgctgagtcgggtccatcagttcagtgcagtggatcgtagggacagtattcactctcaccatccaccagtctgcngctgagtatttgctacttcttctntacaactagtagttactacgttccctactccgtttccgccctgggacctagtacggtgacttactacgaaacgtacgttgtacggcttcggaccactctcttcgttacc

SEQ ID NO: 81254 - DNA, 605 bp, Homo sapiens
  misc_feature: GYAE6OF01C1BQC.52.1.A01.1.454.CMB.1.raw
  modified_base (247)..(247): a, c, t, g, unknown or other
  misc_feature (247)..(247): n is a, c, g, or t
tcagcgcagtacgacacgaccggtgctcgatttagacgtctcatcagggcacagcatggacatgagggtccccgctcagctcctggggctcctgctactctggctccgaggtgccagatgtgtcatccagatgacccagtctccatcctccctgtccgcatctgtaggagacagagtcatcatcacttggccggcaagtcagagcattagaacgttattaatgtatacaacagaaaccgagggaacnccctagaactcctagatctagtggttcactcctactttgctgaggtcgggtcccatacgaaggttcaggtggacgaggtggacttcggtagggaactaggtaactttcaacttcctacacctactaccaacctagtctaggcaagggtcgtaggtaacggttattttacgacttaactttacgttacgtagtacaacgtagtaacgttacaccgtttccctcgtaccgtttccggcccgtagggtaccctaagttaggtagtattaacgtaacgaaaacgtacgttggcggtaccttacgaccgtaccattccgttagttcccttactactttcccgtaccccgctaatttcccgaag

SEQ ID NO: 81255 - DNA, 337 bp, Homo sapiens
  misc_feature: GYAE6OF01D7N36.52.1.A01.1.454.CMB.1.raw
  modified_base (256)..(256): a, c, t, g, unknown or other
  misc_feature (256)..(256): n is a, c, g, or t
  modified_base (333)..(337): a, c, t, g, unknown or other
  misc_feature (333)..(337): n is a, c, g, or t
tcagcgcagtacgacacgaccggtgctcgatttagacgtctcatcaggggggagtcagtctcagtcaggacacagcatggacatgagggtccccgctcagctccgtggggctcctgctactctggctccgaggtgccagatgtgtcatccagatgacccagtctccatccctccctgtccgcatctgtaggagacagagtcatcatcacttgccggcaagtcagagcattagaacgttatttaaattggtatcaanagaaaaccagggaaagcccctgaactcctgatctatggttcatccactttgctgagcgggctggcaaggcgcatagnnnnn

SEQ ID NO: 81256 - DNA, 671 bp, Homo sapiens
  misc_feature: GYAE6OF01BGH4U.52.1.A01.1.454.CMB.1.raw
  modified_base (105)..(105): a, c, t, g, unknown or other
  misc_feature (105)..(105): n is a, c, g, or t
  modified_base (260)..(260): a, c, t, g, unknown or other
  misc_feature (260)..(260): n is a, c, g, or t
  modified_base (301)..(301): a, c, t, g, unknown or other
  misc_feature (301)..(301): n is a, c, g, or t
  modified_base (314)..(314): a, c, t, g, unknown or other
  misc_feature (314)..(314): n is a, c, g, or t
tcagcgcagtacgacacgaccggtgctcgatttagacgtctcatctagggggggtaggtcagtctcaggtcagggacacagacatgggactatgagggtcccccngtcagcttcctggggcttcctgctacgtctggctccggaggtgccgagactggtgtcatccagatcgaccctagtcctaccacttccctcccgtgtccgctattccgtgggtacggagacgagagtcatcatcacttcgccgggcaagtctagancatagaacgtattaaattggtatctaacgacgaacaggaancccctagaactcncgtatctatggttacattcctacgtttcgctacggacggttccggggtcccagtacgtaaggttcaggtggacgaggtggagtcgtaggggtactacggtaacttccacctacctacaaccagtacccaacctacgttccgtggccagggtctaggtaggttagttttcgacttaacgttacttcgtagtaccaacgtagtacttacgtaccgtttaccctcgttaaccgtttccgggtaccccgtacgggtaacccgtaagttacggtacgggttaactaacgttacccgaaaccggtaaccgttacggtaacgggtccgttacgacccgtaaccctcttcccgttaagtttcccg

SEQ ID NO: 81257 - DNA, 523 bp, Homo sapiens
  misc_feature: GYAE6OF01ALQXV.52.1.A01.1.454.CMB.1.raw
  modified_base (383)..(383): a, c, t, g, unknown or other
  misc_feature (383)..(383): n is a, c, g, or t
tcagcgcagtacgacacgaccggtgctcgatttagacgtctcatcaggggggagtcagtctcagtcaggacacagcatggacatgagggtccccgctcagctcctggggctcctgctactctggctccgaggtgccagatgtgtcatccagatgacccagtctccatcctccctgtccgcatctgtaggagacagagtcatcatcacttgccgggcaagtcagagctattagaacgtatttaaattggtatcaacagaaaccagggaacgcccctagaactcctgatctatggtcatcctattgctgagtgggtccatcaaggttcagtgcagtgatcgtggacagaattcactctcaccatcacagtctgcagctagaggtntttgactaacttacttctgtactaactagtacgttactacgtttccctacttacccgtttcggcccttagggaccctagttacgtcggtaatactaacaaacgtacgttcggtcgactcggacaacctattcgtgttacc

SEQ ID NO: 81258 - DNA, 613 bp, Homo sapiens
  misc_feature: GYAE6OF01C6SVD.52.1.A01.1.454.CMB.1.raw
tcagcgcagtacgacacgaccggtgctcgatttagacgtctcatcaggggggagtcagtctcagtcaggacacagcatggacatgagggtccccgctcagctcctggggctcctgctactctggctccgaggtgccagatgtgtcatccagatgacccagtctccatcctccctgtccgcatctgtaggagacagagtcatcatcacttgccgggcaagtcagagcattagaacgtatttaaattggtatcaacagaaaccagggaaagcccctgaactcctgatctatggttcatccactttgctgagtggggtcccagtcaaggttcagtggcaggtggatcgtggggactaggaattcactctcaacctatccaccagtctgcgaggtctggtagtattttgacctaactttactttctaggtacctaacgtacggtaacgtttacctaacggttttcccctacgttaacccgtttttcccgggcccccgttacgggggtaacccctaagttaacgggttcgggtaaactttaacgtaacccgtaaaaacggttaactttacgggtacggtaccttcggaccctaaccgtaactcgtttacggtttaccc

SEQ ID NO: 81259 - DNA, 493 bp, Homo sapiens
  misc_feature: GYAE6OF01DMIQ9.52.1.A01.1.454.CMB.1.raw
  modified_base (403)..(403): a, c, t, g, unknown or other
  misc_feature (403)..(403): n is a, c, g, or t
  modified_base (408)..(408): a, c, t, g, unknown or other
  misc_feature (408)..(408): n is a, c, g, or t
tcagcgcagtacgacacgaccggtgctcgatttagacgtctcatcaggggggagtcagtctcagtcaggacacagcatggacatgagggtccccgctcagctcctgggctcctgctactctggctccgaggtgccagatgtgtcatccagatgacccagtctccatcctccctgtccgcatctgtaggagacagagtcatcatcacttgccgggcaagtcagagcattagaacgtatttaaattggtatcaacagaaaccagggaaagcccctgaactcctgatctatggttcatccactttgctgagtggggtcccatcaaggttcagtggcaggtgatcgtgggacagaattcactctcacatcacagtctgcaggctgagtattttgctaacttcttctntcaanagtagttacagttccctctactttcggcctgggaccctatagtgatatcaaacgtactaggtgacgtgaccatactcttgttccg

SEQ ID NO: 81260 - DNA, 602 bp, Homo sapiens
  misc_feature: GYAE6OF01DBDND.52.1.A01.1.454.CMB.1.raw
  modified_base (367)..(367): a, c, t, g, unknown or other
  misc_feature (367)..(367): n is a, c, g, or t
tcagcgcagtacgacacgaccggtgctcgatttagacgtctcatcagggcacagcatggacatgagggtccccgctcagctcctggggctcctgctactctggctccgaggtgccagatgtgtcatccagatgacccagtctccatcctccctgtccgcatctgtaggagacagagtcatcatcacttgccggcaagtcagagcattagaacgttatttaaatggtatcaaacaagaaaccaagggaaacgcccctgaactcctgatctatggttcatccactttgctgagtgggtccatcaagttcagtgcagtgatcgtagggacagtaattcactctacaccatcaccagtctgcagctgagtntttgactacttacttctgtacaagtagtaagttactacgtttccctcttaaccgtttcccgggacccgttaggggtaaccctagttacggtagggtaacttaacgtaccgaaaacggtaaccgtttcgggtacgggtcctacggtaccctaacccgttaactttcccgtttacggtttaccctttacctaccgtttaccccgtttcccccggaaccctacgtttccgttaaacgg

SEQ ID NO: 81261 - DNA, 547 bp, Homo sapiens
  misc_feature: GYAE6OF01EM6GH.52.1.A01.1.454.CMB.1.raw
  modified_base (97)..(97): a, c, t, g, unknown or other
  misc_feature (97)..(97): n is a, c, g, or t
  modified_base (269)..(269): a, c, t, g, unknown or other
  misc_feature (269)..(269): n is a, c, g, or t
tcagcgcagtacgacacgaccggtgctcgatttagacgtctcatcagggggggagtcagtctcagtcaggacacagcatggacatgagggtccccgntcagctcctggggctcctgctactctggctccgaggtgccagatgtgtcatccagatgacccagtctccatcctccctgtccgcatctgtaggagacagagtcatcatcacttgccggcaagtcagagcattagaacgtatttaaattggtatcaacagaaaccagggaaancccctgaactccagatctatggttcatccactttgctgagtggggtccatcgaaggttcagtggcagtgatcgtgggacagaattcactctcaccatcacctagtctgcaggctagaggtatttgactaacttacttctagtacaacgtagtacgttaccacgtttccctcttaacccgtttcggaccccgtgggtaaccctacgttaggtaggtaattaacgtaaccaaaacggtacgtggtacggcttcggacctaacctattaccgtgtttaccc

SEQ ID NO: 81262 - DNA, 619 bp, Homo sapiens
  misc_feature: GYAE6OF01A0BJQ.52.1.A01.1.454.CMB.1.raw
  modified_base (601)..(601): a, c, t, g, unknown or other
  misc_feature (601)..(601): n is a, c, g, or t
tcagcgcagtacgacacgaccggtgctcgatttagacgtctcatctaggggtcgacgagcatggacatgagggtccccggctcagctcctggggctcctgctactctggctccgaggtgccagatgtgtcatccagatgacccagtctccatcctccctgtccgcatctgtaggagacagagtcatcatcacttgccgggcaagtcagagcattagaacttatttaaatggtatacaacagaaaccagggaaacgccctagaactcctgatctatggtcatcctactttgctgagtcgggtcccatcgaagttcagtggcagtggatcgtggacagtaatcactctacaccatccaccagtctgcgaggtctaggtaggttattttcgacttaactttacgtttcttacgtacaaaccgtaagttaacggtttacctacgtttcccctcgttaacccgttttcccggacccgttacggggacccttagtaaggttacggtaacttaactaaccgtaaaacgtacgttagggtacggtccgtacggtaccctacctacgtttccttaccgtttacctttacctacctttccccgttaccccncccttaagttccttaacg

SEQ ID NO: 81263 - DNA, 568 bp, Homo sapiens
  misc_feature: GYAE6OF01D79AT.52.1.A01.1.454.CMB.1.raw
  modified_base (306)..(306): a, c, t, g, unknown or other
  misc_feature (306)..(306): n is a, c, g, or t
  modified_base (389)..(389): a, c, t, g, unknown or other
  misc_feature (389)..(389): n is a, c, g, or t
tcagcgcagtacgacacgaccggtgctcgatttagacgtctcatcagggggggagtcagtctcagtcaggacacagcatggacatgagggtccccgctcagctcctggggctcctgctactctggctccgaggtgccagatgtgtcatccagatgacccagtctccatccctccctgtccgcatctgtaggagacagagtcatcatcacttgccgggcaagtcagagcattagaacgtatttaaattggtatcaacagaaaccagggaaacgcccctagaactcctgatctatgttcatccatttnctgagtggggtcccatcgaaggttcaggtggcagtggatcgtgggacagtaattcgacttcctacacctatcaacccgagtcngtcaaggtctagaggtatttgacctaactttacttcctagtccaaacgtaggtaacgttacctacgtttccccttctaaccgtttcccggaccttcggggaccctagttacgtaggtacttaataccgtaaaacgtaacgtgttaacggcctcgactaaccctattcccgtgtttaccc

SEQ ID NO: 81264 - DNA, 584 bp, Homo sapiens
  misc_feature: GYAE6OF01DO2VO.52.1.A01.1.454.CMB.1.raw
  modified_base (374)..(374): a, c, t, g, unknown or other
  misc_feature (374)..(374): n is a, c, g, or t
tcagcgcagtacgacacgaccggtgctcgatttagacgtctcatcagggcacagcatggacatgagggtccccgctcagctcctggggctcctgctactctggctccgaggtgccagatgtgtcatccagatgacccagtctccatcctccctgtccgcatctgtaggagacagagtcatcatcacttgccggcaagtcagagcattagaacgtatttaaattggtatcaaacaagaaacccaagggaaacgcccctgaacctcctagatctatggttcatcctactttgctggaggtgggtcccagtcaaggttcagtgcagtgatcgtgggacagatcactctcaccatcaccagtctgcaggctggaggtnttttgactaacttacttctcgtacaactagtaacgttacctacgtttcccctactaccgtttccggaccccgttgggaaccctagttacgggtaggtaacttaacgtaccaaaaccggtaacgttggtacggtcgtacggaccaaccgtacttccgttcgttctttaccctaactttccccgtttaccccgaccctacgttccgtaacgg

SEQ ID NO: 81265 - DNA, 503 bp, Homo sapiens
  misc_feature: GYAE6OF01CLNW2.52.1.A01.1.454.CMB.1.raw
  modified_base (216)..(216): a, c, t, g, unknown or other
  misc_feature (216)..(216): n is a, c, g, or t
  modified_base (225)..(225): a, c, t, g, unknown or other
  misc_feature (225)..(225): n is a, c, g, or t
tcagcgcagtacgacacgaccggtgctcgatttagacgtctcatcaggggggagtcagtctcagtcaggacacagcatggacatgagggtccccgctcagctcctggggctcctgctactctggctccgaggtgccagatgtgtcatccagatgacccagtctccatcctccctgtccgcatctgtaggagacagagtcatcatcacttgccgggnaagtcagancattagaacgtatttaaatgtatcaacagaaacagggaaagcccctgaactcctgatctatggttcatccactttgctgagtgggtccatcaagtcagtggcagtggatctgggacagaaattcactctcacaatcaccagtctgcaggctgagtattttgctaacttacttctgtacaacagtattacgacgttccctctactttccggaccctgggaccagtacgtggaataacttacaaaacgaactagtaggctcgacaccaacttcgtgttcc

SEQ ID NO: 81266 - DNA, 484 bp, Homo sapiens
  misc_feature: GYAE6OF01EX9X7.52.1.A01.1.454.CMB.1.raw
  modified_base (476)..(476): a, c, t, g, unknown or other
  misc_feature (476)..(476): n is a, c, g, or t
  modified_base (479)..(479): a, c, t, g, unknown or other
  misc_feature (479)..(479): n is a, c, g, or t
tcagcgcagtacgacacgaccggtgctcgatttagacgtctcatcagggcacagcatggacatgagggtccccgctcagctcctggggctcctgctactctggctccgaggtgccagatgtgtcatccagatgacccagtctccatcctccctgtccgcatctgtaggagacagagtcatcatcacttgccgggcaagtcagagcattagaacgtatttaaattggtatcaacagaaaccaggaaagccctagaactcctgatctatgttcatccacttgctgaggtcgggtccatcaagttcagtggcaggtgatcgtggacagtaattcactctcaccatcacagtctgcagctgagtatttgctaacttcttctgtacaactagacgttacacgttccctctaccgtttcggccctgggacctagtagtgtatatacaacgtactgtgctgcacatctgtctctactcctccnctntctag

SEQ ID NO: 81267 - DNA, 523 bp, Homo sapiens
  misc_feature: GYAE6OF01AMU34.52.1.A01.1.454.CMB.1.raw
  modified_base (371)..(371): a, c, t, g, unknown or other
  misc_feature (371)..(371): n is a, c, g, or t
  modified_base (511)..(511): a, c, t, g, unknown or other
  misc_feature (511)..(511): n is a, c, g, or t
tcagcgcagtacgacacgaccggtgctcgatttagacgtctcatcaggggggagtcagtctcagtcaggacacagcatggacatgagggtccccgctcagctcctggggctcctgctactctggctccgaggtgccagatgtgtcatccagatgacccagtctccatccctccctgtccgcatctgtaggagacagagtcatcatcacttgccgggcaagtcagagcattagaacgtatttaaattggtatcaacagaaaccagggaaacgcccctagaactcctgatctatggtcatcctactttgctgagtgggtcccatcgaaggttcagtggcagtggatcgtgggacagtaacttcactctacacntacacagtctgcagctgagtatttgactacttactctagtacaactagtagttactacgtttccctctacgtttccggccctagggacctagtacgtggtaacttacgtacaaacgtactggtacgctacgacctaaccngttcgtgttacc

SEQ ID NO: 81268 - DNA, 527 bp, Homo sapiens
  misc_feature: GYAE6OF01AR8TT.52.1.A01.1.454.CMB.1.raw
  modified_base (393)..(393): a, c, t, g, unknown or other
  misc_feature (393)..(393): n is a, c, g, or t
tcagcgcagtacgacacgaccggtgctcgatttagacgtctcatcagggcacagcatggacatgagggtccccgctcagctcctggggctcctgctactctggctccgaggtgccagatgtgtcatccagatgacccagtctccatcctccctgtccgcatctgtaggagacagagtcatcatcacttgccgggcaagtcagagcattagaacgttatttaaattggtatcaacagaaaccaggaaacgccctagaactcctgatctatggttcatcctactttgctgagtcgggtccatcaaggttcagtggcagtggatcgtgggacagtaatcactctcaccatcacagtctgcgaggctgaggtatttgactaacttcttctgtacaanagtacgttactacgtttccctctaccgtttccggcccgtaggacctagtagtacgtatactacaaacgtacgtgtcgctcggacctacagttcctcgttccttacgtaccttccgttccccgactattcgtacg

SEQ ID NO: 81269 - DNA, 584 bp, Homo sapiens
  misc_feature: GYAE6OF01ECAS0.52.1.A01.1.454.CMB.1.raw
  modified_base (190)..(190): a, c, t, g, unknown or other
  misc_feature (190)..(190): n is a, c, g, or t
  modified_base (269)..(269): a, c, t, g, unknown or other
  misc_feature (269)..(269): n is a, c, g, or t
  modified_base (397)..(397): a, c, t, g, unknown or other
  misc_feature (397)..(397): n is a, c, g, or t
tcagcgcagtacgacacgaccggtgctcgatttagacgtctcatcaggggggagtcagtctcagtcaggacacagcatggacatgagggtccccgctcagctcctggggctcctgctactctggctccgaggtgccagatgtgtcatccagatgacccagtctccatcctcctgtccgcatctgtagganacagagtcatcatcacttgccggcaagtcagagcattagaacgtatttaaatggtatacaacacgaaaccagggaaacncccctagaacctcctagatctagtggttacatcctactttgctggacggtcgggtcccagtcgaaggttcaggtcggctaggtggactcgtgggactagtaattccacttctccaacctataccaccngtctgcaggctggtagtatttacgaccttactttacttcgtatacaacgtagtacgttactacgtttccctcgtaccgtttccggacccgttacgggaacctagttacggtacggtaacttaacgtaccaaaacggaccgttggtacggaccttcggaccctaacccgttcgttacgttcggttacc

SEQ ID NO: 81270 - DNA, 568 bp, Homo sapiens
  misc_feature: GYAE6OF01DX3CD.52.1.A01.1.454.CMB.1.raw
  modified_base (279)..(279): a, c, t, g, unknown or other
  misc_feature (279)..(279): n is a, c, g, or t
tcagcgcagtacgacacgaccggtgctcgatttagacgtctcatcagggggggagtcagtctcagtcaggacacagcatggacatgagggtccccgctcagctcctggggctcctgctactctggctccgaggtgccagatgtgtcatccagatgacccagtctccatcctccctgtccgcatctgtaggagacagagtcatcatcacttgccgggcaagtcagagcattaagaacgttatttaaattggtaatacaaacaagaaaaccgagggaaacncccctagaactcctgatctatggttcatcctactttgctggtagtcggggtcccagtacgtaaggttcagtggctaggtggatcgtagggacagtaattcactctacaccatccaccagtctgcgaggctaggtaggtattttgacttaactttacttctacgtacaactagtaagttacgtacgtttccctacttaccgtttccggcccgtagggtaacctagtacggttaggaacttacgtaaccgaaacgtacgtggtacgctcgacctacctacttcgtgttacc

SEQ ID NO: 81271 - DNA, 551 bp, Homo sapiens
  misc_feature: GYAE6OF01CDVA7.52.1.A01.1.454.CMB.1.raw
tcagcgcagtacgacacgaccggtgctcgatttagacgtctcatcagggcacagcatggacatgagggtccccgctcagctcctggggctcctgctactctggctccgaggtgccagatgtgtcatccagatgacccagtctccatcctccctgtccgcatctgtaggagacagagtcatcatcacttgccggcaagtcagagcattagaacgtatttaaatggtatcaacagaaaccagggaacgcccctgaactctgatctatggttcatccactttgctgaggtcgggtccatcgaaggttcagtggcagtggatcgtgggacagtaattcactctcacatccactagtctgcaggctaggtaggtattttgacctaactttacttctgtacaactagtaacgttactacgtttcccctctaccgttttccggcccgttcgggaccctagttaggtggtaatacgtacaaacgtacgtggtcggactcggacctacctacgttcttcgttcctttacgtacttcccttacccgccctagtcgttaacg

SEQ ID NO: 81272 - DNA, 561 bp, Homo sapiens
  misc_feature: GYAE6OF01CMH8V.52.1.A01.1.454.CMB.1.raw
  modified_base (194)..(194): a, c, t, g, unknown or other
  misc_feature (194)..(194): n is a, c, g, or t
tcagcgcagtacgacacgaccggtgctcgatttagacgtctcatcagggcacagcatggacatgagggtccccgctcagctcctggggctcctgctactctggctccgaggtgccagatgtgtcatccagatgacccagtctccatcctccctgtccgcatctgtaggagacagagtcatcatcacttgccggnaagtcagagcattagaacgttattaaatggtatcaacagaaaccagggaaacgccctgaactcctgatctatggtcatccatttgctgagtgggtccatcaagttcagtggcagtgatcgtggacagaattcgactctcaccatcaccagtctgcaggctgagtatttgactaacttacttctgtacaactagtagttactacgtttccctctaccgtttcggcccgtcgggaacctagtacgtaggtaacttaagtaccgaaaacgtaacgttcggtacggtccttacggaccctaaccgtacttccgttacggttccctttacctactttacccctttacccccggaccctagttccgttaacgg

SEQ ID NO: 81273 - DNA, 614 bp, Homo sapiens
  misc_feature: GYAE6OF01DUYSF.52.1.A01.1.454.CMB.1.raw
  modified_base (342)..(342): a, c, t, g, unknown or other
  misc_feature (342)..(342): n is a, c, g, or t
tcagcgcagtacgacacgaccggtgctcgatttagacgtctcatcagggcacagcatggacatgagggtccccgctcagctcctggggctcctgctactctggctccgaggtgccagatgtgtcatccagatgacccagtctccatcctccctgtccgcatctgtaggagacagagtcatcatcacttgccgggcaagtcagagcattagaacgtatttaaattggtatcaaacagaaaccagggaaagccctgaactcctgatctatggttcatccactttgctgagtgggtccatcaaggttcagtggcagtgatcgtgggacagaattcactctcaccntcaccagtctgcaggctgagattttgctaacttcttcgtgtacaacgagtacgttactacgtttccctactaccgtttcgggaccccttaggggtaacccctaagttacggttacgggtaactttaacgtacctaaaaaccggtaaccttagggttaccgggtacctttacggaccctaaaccccgtacgtttcccgttacgggtttcccctttaccggttaacctttaccccgtttaccccccggtacccgtacgtttcccgttaaaccgg

SEQ ID NO: 81274 - DNA, 526 bp, Homo sapiens
  misc_feature: GYAE6OF01B7E1I.52.1.A01.1.454.CMB.1.raw
  modified_base (276)..(276): a, c, t, g, unknown or other
  misc_feature (276)..(276): n is a, c, g, or t
  modified_base (414)..(414): a, c, t, g, unknown or other
  misc_feature (414)..(414): n is a, c, g, or t
tcagcgcagtacgacacgaccggtgctcgatttagacgtctcatcagggggggagtcagtctcagtcaggacacagcatggacatgagggtccccgctcagctcctgggctcctgctactctggctccgaggtgccagatgtgtcatccagatgacccagtctccatccctccctgtccgcatctgtaggagacagagtcatcatcacttggccgggcaagtcagagcaattagaacgttatttaaattggtatacaacaagaaaccagggaaacncccctagaactcctgatctatgtcactctactttgctgagtcgggtcccatcgaaggttcagtggcaggtggatcgtgggacagaattcactctcacatcacagtctgcgagctgagtatttcgactaacttcttctntacaactgtaattactacgttccctacgttaccgtttccggcccttagggacctagttaggtagtaatactacaaacggtacgtggtacgctacgacacctcttcgtgttcc

SEQ ID NO: 81275 - DNA, 584 bp, Homo sapiens
  misc_feature: GYAE6OF01B6Z6B.52.1.A01.1.454.CMB.1.raw
tcagcgcagtacgacacgaccggtgctcgatttagacgtctcatcagggcacagcatggacatgagggtccccgctcagctcctggggctcctgctactctggctccgaggtgccagatgtgtcatccagatgacccagtctccatccctccctgtccgcatctgtaggagacagagtcatcatcacttgccgggcaagtcagagctattaagaacgttatttaaatggtatacaacagaaaccgagggaaacgcccctagaacctcctgatctatggttcatcctactttgctgaggtcgggtacccagtacgtaaggttcaggtggcaggtggatcgtagggacagtaacttcactctcaccatccactagtctgcgaggctaggtaggtatttgactaactttacttctagtacaagtagtacgttactaccgtttccctacttaccgtttccggcccgtacgggtaccctagttacggtaggtaatacgtaccgaaacgtacgtgtcggactcgacctacctattccgttcgttaccctttacgtacctttccccgttacccgtaccttcgttcgtaacg

SEQ ID NO: 81276 - DNA, 611 bp, Homo sapiens
  misc_feature: GYAE6OF01B5ZYB.52.1.A01.1.454.CMB.1.raw
  modified_base (196)..(196): a, c, t, g, unknown or other
  misc_feature (196)..(196): n is a, c, g, or t
  modified_base (235)..(235): a, c, t, g, unknown or other
  misc_feature (235)..(235): n is a, c, g, or t
tcagcgcagtacgacacgaccggtgctcgatttagacgtctcatcagggcacagcatggacatgagggtccccgctcagctcctggggctcctgctactctggctccgaggtgccagatgtgtcatccagatgacccagtctccatccctccctgtccgcatctgtaggagacagagtcatcatcacttgccgganaagtcagagcattagaacgttatttaaatggtatacaanacgaaaccgagggaacgcccctagaacctcctgatctatggttacacttcctactttgctggtacggtcgggtccctagtacgtaaggtttcaggttggcgtaggtaggtatcgtagggaactaggtacttacactcctacacctataccacctagtctcgcaaggtcgtaggtacgttatttacggacctaactttaccttcgtacgtactaaacgtagttaacgttactaccgtttaccctacttaccggttccggtacccgttagggtaccctagttacggtacgtaataacctaccgaaacgtacgtgcgtacgtcgacctactacgtgttaccgtcttaccgtaccttaccgtaccccgacttagtcgtag

SEQ ID NO: 81277 - DNA, 489 bp, Homo sapiens
  misc_feature: GYAE6OF01ES61I.52.1.A01.1.454.CMB.1.raw
  modified_base (484)..(484): a, c, t, g, unknown or other
  misc_feature (484)..(484): n is a, c, g, or t
tcagcgcagtacgacacgaccggtgctcgatttagacgtctcatcagggcacagcatggacatgagggtccccgctcagctcctggggctcctgctactctggctccgaggtgccagatgtgtcatccagatgacccagtctccatcctccctgtccgcatctgtaggagacagagtcatcatcacttgccgggcaagtcagagcattagaacgtatttaaattggtatcaacagaaaccagggaaagcccctgaactcctgatctatggttcatccactttgctgagtggggtcccatcaaggttcagtggcagtggatctgggacagaattcactctcacatcaccagtctgcaggctgagtatttgctaacttacttctgtcaacagtagttacacgttccctctactttcggccctgggacctagtacgtgatatacaaacgactgtgctgctacatctgtctctactccttacccgctntctag

SEQ ID NO: 81278 - DNA, 538 bp, Homo sapiens
  misc_feature: GYAE6OF01DG85P.52.1.A01.1.454.CMB.1.raw
  modified_base (307)..(307): a, c, t, g, unknown or other
  misc_feature (307)..(307): n is a, c, g, or t
tcagcgcagtacgacacgaccggtgctcgatttagacgtctcatcagggcacagcatggacatgagggtccccgctcagctcctggggctcctgctactctggctccgaggtgccagatgtgtcatccagatgacccagtctccatcctccctgtccgcatctgtaggagacagagtcatcatcacttgccgggcaagtcagagcattagaacgtatttaaatggtatcaacagaaaccaggaacgccctagaactcctgatctatgtcatccactttgctgagtcgggtccatcaagtcagtgacngtgatcgtggacagattcactctcacatcacctagtctgcaggctagagtatttgactaacttacttctgtacaactagtacgtactacgtttccctctaccgtttccggccctgggacctagtacggtgtactactacgaaaacgtacgttggtacggtcctacgccgtaacctagttccttacgttcctttacgtacctttacccgttccccgacctattccgtaacgg

SEQ ID NO: 81279 - DNA, 629 bp, Homo sapiens
  misc_feature: GYAE6OF01AOGNO.52.1.A01.1.454.CMB.1.raw
tcagcgcagtacgacacgaccggtgctcgatttagacgtctcatcaggggggagtcagtctcagtcaggacacagcatggacatgagggtccccgctcagctcctggggctcctgctactctggctccgaggtgccagatgtgtcatccagatgacccagtctccatcctccctgtccgcatctgtaggagacagagtcatcatcacttgccggcaagtcagagctaattagaacgttatttaaattggtatacaacaagaaaccgagggaaacgcccctagaacctccgtagacttctagtcggttacacttcctactttgctaggacgtcggggtaccctagtaccgtaaaggttcaggtcggacgtaggtggatcggtagggtactaacggtaacttcaccttactaccaacctactaccaaccgtacgtctacgcgtacgggtactaggtaacgggttacttttacggaacctttaacgtttaccttcgtacgtacctaacgtagtaacgttaccgtaccgtttccctaccgttccgtttaccggacccgtacgggtacctagttaggtagtactactaaccgaaacgtacgtggtcgacgtgacctacctcttcgttcgttacc

SEQ ID NO: 81280 - DNA, 556 bp, Homo sapiens
  misc_feature: GYAE6OF01D88E8.52.1.A01.1.454.CMB.1.raw
  modified_base (351)..(351): a, c, t, g, unknown or other
  misc_feature (351)..(351): n is a, c, g, or t
  modified_base (378)..(378): a, c, t, g, unknown or other
  misc_feature (378)..(378): n is a, c, g, or t
  modified_base (543)..(543): a, c, t, g, unknown or other
  misc_feature (543)..(543): n is a, c, g, or t
tcagcgcagtacgacacgaccggtgctcgatttagacgtctcatcagggcacagcatggacatgagggtccccgctcagctcctggggctcctgctactctggctccgaggtgccagatgtgtcatccagatgacccagtctccatcctccctgtccgcatctgtaggagacagagtcatcatcacttgccgggcaagtcagagcattaagaacgttatttaaagttggtaatacaaacaagaaaccgagggaaacgccctagaactctgatctatgtcatccatttgctgaggtcgggtccagtcaaggttcagtgactagtgatcgtggacagtatcactctacactanacacagtctgcgaggtctggtaagttntttacgacctaacgttacttctagtacccaagtgtacgttactccgtttccctacttaccgttcggcccgtacgggacctaagttacggtacgaattaactacgaaacgtactggtacgacttcgacctactattccgtgttaccttctaacttccgttaccccncttactcgtaacg

SEQ ID NO: 81281 - DNA, 492 bp, Homo sapiens
  misc_feature: GYAE6OF01C5BAK.52.1.A01.1.454.CMB.1.raw
  modified_base (232)..(232): a, c, t, g, unknown or other
  misc_feature (232)..(232): n is a, c, g, or t
  modified_base (334)..(334): a, c, t, g, unknown or other
  misc_feature (334)..(334): n is a, c, g, or t
  modified_base (339)..(339): a, c, t, g, unknown or other
  misc_feature (339)..(339): n is a, c, g, or t
  modified_base (483)..(483): a, c, t, g, unknown or other
  misc_feature (483)..(483): n is a, c, g, or t
  modified_base (486)..(486): a, c, t, g, unknown or other
  misc_feature (486)..(486): n is a, c, g, or t
tcagcgcagtacgacacgaccggtgctcgatttagacgtctcatcagggcacagcatggacatgagggtccccgctcagctcctggggctcctgctactctggctccgaggtgccagatgtgtcatccagatgacccagtctccatcctccctgtccgcatctgtaggagacagagtcatcatcacttgccgggcaagtcagagcattagaacgtatttaaatggtatcaanagaaaccagggaagccctagaactcctgatctatggttcatccactttgctgagtgggtccatcaaggttcagtggcagtgatcgtggacagaattcactcncaccntcacagtctgcaggctgaggtatttgactaacttacttctgtacaacagtagttacagttccctctacgtttcgccctgggacctagtagtgtatatacaaacgtactgtcgctgccacattctcgttcttcacttccttcccnctntctacg

SEQ ID NO: 81282 - DNA, 563 bp, Homo sapiens
  misc_feature: GYAE6OF01DMSGJ.52.1.A01.1.454.CMB.1.raw
tcagcgcagtacgacacgaccggtgctcgatttagacgtctcatcagggcacagcatggacatgagggtccccgctcagctcctggggctcctgctactctggctccgaggtgccagatgtgtcatccagatgacccagtctccatcctccctgtccgcatctgtaggagacagagtcatcatcacttgccgggcaagtcagagcattaagaacgttaattttaaatggtatcaaacaagaaaccaagggaacgaccctgaactcctgatctatgtcatcactttgctgtaggcgggtccagtcgaaggttcaggtgacgaggtgatcgtagggactaagtaattcaactctacaccatccaccagtctagcaggactgtaagggtattttagactaactttacttctacgtacaaacgtagtaactttactacgtttccctactacgtttccggcccgtgggaaccctagttacgtggtaactattacgaaacgtacgtaggtcggactcgacctactacttcttacgtcttaccttacgtacccttcccgactatccgtaa

SEQ ID NO: 81283 - DNA, 648 bp, Homo sapiens
  misc_feature: GYAE6OF01ADC5O.52.1.A01.1.454.CMB.1.raw
  modified_base (613)..(613): a, c, t, g, unknown or other
  misc_feature (613)..(613): n is a, c, g, or t
tcagcgcagtacgacacgaccggtgctcgatttagacgtctcatcaggggggaggtcagtctcagtcaggacacagcatggacatgagggtccccgctcagctcctggggctcctgctactctggctccgaggtgccagatgtgtcatccagatgacccagtcctccatccctccctgtccgcatctgtaggagacagagtcatcatcacttgccgggcaagtcagagcattagaacgtatttaattggtatacaacaagaaaccagggaacgcccctgaactcctgatctagtggtacctatcctactttgcgttggaggttcggggtacccagtaccgtaaggttacgagtggaccgtaggtgacgtcgtagggacctagtaaacttcgacctacttacccgactaatccctacctacgtccttcggaacctagggcctttagggaacggtttacgtttttacacccgtttaaccgtttaccgtttctaggtttaaccaaacggtagtttaaccgttaccgttacggtttacccccttaccgttaccggttttcccgggtacccccttggggtaaccctagttcggtaagtacgtaactagtaaacccgtnttggtaacgtcgtcgacaccgtcttcgttcgtacc

SEQ ID NO: 81284 - DNA, 531 bp, Homo sapiens
  misc_feature: GYAE6OF01EX3LQ.52.1.A01.1.454.CMB.1.raw
tcagcgcagtacgacacgaccggtgctcgatttagacgtctcatcagggcacagcatggacatgagggtccccgctcagctcctggggctcctgctactctggctccgaggtgccagatgtgtcatccagatgacccagtctccatcctccctgtccgcatctgtaggagacagagtcatcatcacttgccgggcaagtcagagcattagaacgtatttaattggtatcaacagaaaccagggaaacgcccctagaactcctgatctatggttcatcctatttgctgagtcgggtccatcaaggttcagtgcagtgatcgtggacagtattcactctcacctatccacctagtctgcgtaggctagaggtattttcgactaacttacttctagtaccaatagtacgttactaccgtttccctcctaccgtttccggcccgtgggaccctagtagttgaatataacgaaacgacttggtcgtctgacctacctatcttcgtcttactacttcctaccccgtctactcgtacg

SEQ ID NO: 81285 - DNA, 550 bp, Homo sapiens
  misc_feature: GYAE6OF01BXWQC.52.1.A01.1.454.CMB.1.raw
  modified_base (194)..(194): a, c, t, g, unknown or other
  misc_feature (194)..(194): n is a, c, g, or t
  modified_base (202)..(202): a, c, t, g, unknown or other
  misc_feature (202)..(202): n is a, c, g, or t
  modified_base (244)..(244): a, c, t, g, unknown or other
  misc_feature (244)..(244): n is a, c, g, or t
  modified_base (518)..(518): a, c, t, g, unknown or other
  misc_feature (518)..(518): n is a, c, g, or t
  modified_base (541)..(541): a, c, t, g, unknown or other
  misc_feature (541)..(541): n is a, c, g, or t
tcagcgcagtacgacacgaccggtgctcgatttagacgtctcatcagggcacagcatggacatgagggtccccgctcagctcctggggctcctgctactctggctccgaggtgccagatgtgtcatccagatgacccagtctccatcctccctgtccgcatctgtaggagacagagtcatcatcacttgccggnaagtcagngcattagaacgttatttaatggtatcaacagaacagggaacnccctagaactcctagatctatggttcatcctactttgctggagtcgggtccatcgtaagttcagtggctaggtggatcgtgggactagtaattcactctacacctataccaccgtagtctgcgaggcctaggtagttattttcgaccttaactttacttctagtacaacgtagtaacgttacctacgtttccctagtaccgttttccggcccgttagggacctaagttacggtaggtattacgtacgaaacgtacgtggtcgctcgacctactntctcgttcttctcttccgtcccnctgtctacg

SEQ ID NO: 81286 - DNA, 617 bp, Homo sapiens
  misc_feature: GYAE6OF01CHET4.52.1.A01.1.454.CMB.1.raw
tcagcgcagtacgacacgaccggtgctcgatttagacgtctcatcagggggggagtcagtctcagtcaggacacagcatggacatgagggtcccccgctcagctcctggggctcctgctactctggctccgaggtgccagatgtgtcatccagatgacccagtcctccatccctccctgtccgcatctggtaggagacagagtcatcatcacgttggccggacaagtcagagctaattagaacgttaatttaaattggtaatacaaacaagaaaaccgaagggaaaccgcccctagaacctcctagattctattcggttcactcctactttgcttggaggtcgggtaccctatacgtaaggttcaggttcggacgtaggtggtactcggtaggggtactaagtaactttcacgttcctaccgacctactccaaccgtcgtcgtagcgaggtctaggtagttactttgacctttaacgttcttctagtaaccactagtacgttactaccgttccctactaccggtttccgcccgtaggtaacctaggtagttaggaacttaacgtaagaaaccgtgtcggtaggtcctacggacctacctactttccgtggtttaccc

SEQ ID NO: 81287 - DNA, 493 bp, Homo sapiens
  misc_feature: GYAE6OF01BPCSZ.52.1.A01.1.454.CMB.1.raw
  modified_base (233)..(233): a, c, t, g, unknown or other
  misc_feature (233)..(233): n is a, c, g, or t
  modified_base (248)..(248): a, c, t, g, unknown or other
  misc_feature (248)..(248): n is a, c, g, or t
  modified_base (345)..(345): a, c, t, g, unknown or other
  misc_feature (345)..(345): n is a, c, g, or t
  modified_base (487)..(487): a, c, t, g, unknown or other
  misc_feature (487)..(487): n is a, c, g, or t
tcagcgcagtacgacacgaccggtgctcgatttagacgtctcatcagggcacagcatggacatgagggtccccgctcagctcctggggctcctgctactctggctccgaggtgccagatgtgtcatccagatgacccagtctccatcctccctgtccgcatctgtaggagacagagtcatcatcacttgccgggcaagtcagagcattagaacgtatttaaattggtatcaanagaaaccagggaaanccctgaactcctgatctatggttcatccactttgctgagtgggtccatcaagttcagtggcagtggatcgtgggacagtatcactctcaccatcacngtctgcaggctagaggtattttgactaacttacttctgtacaactagtagttactacgttccctctacctttcggccctagggacctagtagtgatatacaaacgactgtgctgctacatctgtcttctatccttcccgctntctacg

SEQ ID NO: 81288 - DNA, 529 bp, Homo sapiens
  misc_feature: GYAE6OF01CCDF3.52.1.A01.1.454.CMB.1.raw
tcagcgcagtacgacacgaccggtgctcgatttagacgtctcatcaggggggagtcagtctcagtcaggacacagcatggacatgagggtccccgctcagctcctggggctcctgctactctggctccgaggtgccagatgtgtcatccagatgacccagtctccatcctccctgtccgcatctgtaggagacagagtcatcatcacttgccgggcaagtcagagcattagaacgtatttaaattggtatcaacagaaaccaggaaagcccctgaactcctgatctatggttcatccactttgctgagtgggtcccatcaaggttcagtggcagtggatcgtgggacagtaatcactctcaccatcaccagtctgcaggctgaggtatttcgactaactttacttcttcgtacaacgtagtaacgttacctacgtttcccctacttaccgtttcccggcccgttacgggacctagttaggtagtactactaacgaaacgtactggtgcgtacgaccactattctgttcc

SEQ ID NO: 81289 - DNA, 573 bp, Homo sapiens
  misc_feature: GYAE6OF01B59QH.52.1.A01.1.454.CMB.1.raw
  modified_base (211)..(211): a, c, t, g, unknown or other
  misc_feature (211)..(211): n is a, c, g, or t
tcagcgcagtacgacacgaccggtgctcgatttagacgtctcatcagggcgacagcatggacatgagggtccccgctcagctcctgggctcctgctactctggctccgaggtgccagatgtgtcagtccagatgacccagtctccatcctccctgtccgcatctgtaggagacagagtcatcatcacttgccgggcaagtcagagcattanaacgggggtatttaattgtatcaacagaaaccaaggaaacgcccctagaactcctgatctatggttcatcctactttgctgaggtcgggtcccatactaagttcgagtggcgagtggatcgtggacagtaattcactctcaccactaccaccagtctagcaggctggagtattttgacttaacttcttcgtacgtacaagtagttacgttactaccgtttccctacttacccgttccgacccgtaggtacctaggttaggtagtaacttacgtaccgaaacgtacgtggtacggctacgacctaacctacttcgttaccgttcttaccttacttccccgttaccccgacttcgttcgtaacg

SEQ ID NO: 81290 - DNA, 528 bp, Homo sapiens
  misc_feature: GYAE6OF01CCE8H.52.1.A01.1.454.CMB.1.raw
  modified_base (214)..(214): a, c, t, g, unknown or other
  misc_feature (214)..(214): n is a, c, g, or t
  modified_base (266)..(266): a, c, t, g, unknown or other
  misc_feature (266)..(266): n is a, c, g, or t
tcagcgcagtacgacacgaccggtgctcgatttagacgtctcatcaggggggagtcagtctcagtcaggacacagcatggacatgagggtccccgctcagctcctgggctcctgctactctggctccgaggtgccagatgtgtcatccagatgacccagtctccatcctccctgtccgcatctgtaggagacagagtcatcatcacttgccggnaagtcagagcattagaacgtatttaaattggtatcaacagaaaccaggaacncccctgaactcctgatctatggttcatcctatttgctggagttcggggtaccctatactaaggttcagtggcagtggatcgtggactagaattcactctcacctatacaccagtctgcagctgagtatttgactaactttcttctgtacaatagtaattaccgtacgtttccctataccgtttcggccgtaggaccctagttacgtaggtactactagaaaacggtacttggtacgcgtgacctaacgtcttcgtcgttacc

SEQ ID NO: 81291 - DNA, 480 bp, Homo sapiens
  misc_feature: GYAE6OF01APTKB.52.1.A01.1.454.CMB.1.raw
  modified_base (446)..(446): a, c, t, g, unknown or other
  misc_feature (446)..(446): n is a, c, g, or t
tcagcgcagtacgacacgaccggtgctcgatttagacgtctcatcaggggggagtcagtctcagtcaggacacagcatggacatgagggtccccgctcagctcctggggctcctgctactctggctccgaggtgccagatgtgtcatccagatgacccagtctccatcctccctgtccgcatctgtaggagacagagtcatcatcacttgccgggcaagtcagagcattagaacgtatttaaattggtatcaacagaaacccagggaaagcccctgaactcctgatctatggttcatccactttgctgagtggggtcccatcaaggttcagtggcagtggatctgggacagaattcactctcaccatcaccagtctgcaggctgagatttgcaacttactctgtcaacagacgttacagttccctcactttcggccctagggaccntagtggatatcaacgactgtgctgcacatctgtc

SEQ ID NO: 81292 - DNA, 488 bp, Homo sapiens
  misc_feature: GYAE6OF01DN7I8.52.1.A01.1.454.CMB.1.raw
  modified_base (229)..(229): a, c, t, g, unknown or other
  misc_feature (229)..(229): n is a, c, g, or t
  modified_base (482)..(482): a, c, t, g, unknown or other
  misc_feature (482)..(482): n is a, c, g, or t
  modified_base (484)..(484): a, c, t, g, unknown or other
  misc_feature (484)..(484): n is a, c, g, or t
tcagcgcagtacgacacgaccggtgctcgatttagacgtctcatcagggcacagcatggacatgagggtccccgctcagctcctggggctcctgctactctggctccgaggtgccagatgtgtcatccagatgacccagtctccatcctccctgtccgcatctgtaggagacagagtcatcatcacttgccggcaagtcagagcattagaacgtatttaatgtatcaanagaacaggaagccctagaactctgatctatgtcatccacttgctgagtgggtcccatcaaggttcagtggcagtgatcgtggacagaattcactctcacatcaccagtctgcaggctgagtattttgctaacttacttctacgttcaactagtagttactacgttccctctaccgtttcggccctagggacctagtagtggatacgtacaaacgaactgtcgctgcacatctgtcttctacttcctcccgctntntacg

SEQ ID NO: 81293 - DNA, 495 bp, Homo sapiens
  misc_feature: GYAE6OF01EBF9G.52.1.A01.1.454.CMB.1.raw
  modified_base (247)..(247): a, c, t, g, unknown or other
  misc_feature (247)..(247): n is a, c, g, or t
  modified_base (489)..(489): a, c, t, g, unknown or other
  misc_feature (489)..(489): n is a, c, g, or t
tcagcgcagtacgacacgaccggtgctcgatttagacgtctcatcagggcacagcatggacatgagggtccccgctcagctcctggggctcctgctactctggctccgaggtgccagatgtgtcatccagatgacccagtctccatcctccctgtccgcatctgtaggagacagagtcatcatcacttgccgggcaagtcagagcattagaacgtatttaaattggtatcaacagaaaccaggaaancccctgaactcctgatctatggttcatccactttgctgagtgggtccatcaaggttcagtggcagtggatcgtgggacagaattcactctcacatcacagtctgcaggctggagtattttgactaacttacttctgtacaactagtacttacacgttccctctacctttcggccctagggacctagtagtacggatatacaaacgactgtggctgccacatctgtctctattcctccgcctntctacg

SEQ ID NO: 81294 - DNA, 547 bp, Homo sapiens
  misc_feature: GYAE6OF01ETCG7.52.1.A01.1.454.CMB.1.raw
  modified_base (97)..(97): a, c, t, g, unknown or other
  misc_feature (97)..(97): n is a, c, g, or t
  modified_base (215)..(215): a, c, t, g, unknown or other
  misc_feature (215)..(215): n is a, c, g, or t
  modified_base (280)..(280): a, c, t, g, unknown or other
  misc_feature (280)..(280): n is a, c, g, or t
  modified_base (536)..(536): a, c, t, g, unknown or other
  misc_feature (536)..(536): n is a, c, g, or t
tcagcgcagtacgacacgaccggtgctcgatttagacgtctcatcagggggggagtcagtctcagtcaggacacagcatggacatgagggtccccgntcagctcctggggctcctgctactctggctccgaggtgccagatgtgtcatccagatgacccagtctccatcctcctgtccgcatctgtaggagacagagtcatcatcacttgccggnaagtcagagcaattaagaacgttaattttaaattggtaatacaaacaagaaaccgaagggaaacncccctagaactcctagattctagtggttcactcctactttgctggaggtcgggtcccagtcgaagttcaggtggcagtgatcgagggacagtaatcactctacaccatccacagtctgacaggtcgtaggaggttatttcgactaactttcgttactcgtacaatagtaacttactacgttccctcttacgttccggaccgtcggacctagtagtagattacgtaacgaaacgtacgtggtcgactcgacaacctnttctgttaccc

SEQ ID NO: 81295 - DNA, 546 bp, Homo sapiens
  misc_feature: GYAE6OF01BOFI9.52.1.A01.1.454.CMB.1.raw
  modified_base (215)..(215): a, c, t, g, unknown or other
  misc_feature (215)..(215): n is a, c, g, or t
tcagcgcagtacgacacgaccggtgctcgatttagacgtctcatcaggggggagtcagtctcagtcaggacacagcatggacatgagggtccccgctcagctcctggggctcctgctactctggctccgaggtgccagatgtgtcatccagatgacccagtctccatcctccctgtccgcatctgtaggagacagagtcatcatcacttgccggnaagtcagagcattagaacgtatttaaatggtatcaacagaaaccaggaaacgccctgaactcctgatctatgttcatctactttgctgagtcgggtccatcaaggttcagtggcagtggactcgtgggacagtaattcgactctacacctatcaacctagtctagacgaggcgtagagttatttgcttaactttacttctagtacaacgtagtacgtttacgacgtttccctacttacgtttcccggacctgggaacctagtacggtagtaacgtactacgaaacgtaacttggtacggacttacggaccctaactcttcgttcgttaccg

SEQ ID NO: 81296 - DNA, 545 bp, Homo sapiens
  misc_feature: GYAE6OF01CT11M.52.1.A01.1.454.CMB.1.raw
  modified_base (194)..(194): a, c, t, g, unknown or other
  misc_feature (194)..(194): n is a, c, g, or t
  modified_base (352)..(352): a, c, t, g, unknown or other
  misc_feature (352)..(352): n is a, c, g, or t
  modified_base (364)..(364): a, c, t, g, unknown or other
  misc_feature (364)..(364): n is a, c, g, or t
  modified_base (381)..(381): a, c, t, g, unknown or other
  misc_feature (381)..(381): n is a, c, g, or t
tcagcgcagtacgacacgaccggtgctcgatttagacgtctcatcagggcacagcatggacatgagggtccccgctcagctcctggggctcctgctactctggctccgaggtgccagatgtgtcatccagatgacccagtctccatcctccctgtccgcatctgtaggagacagagtcatcatcacttgccggnaagtcagagcattagaacgttatttaaatggtatcaaacagaaaccgaggaacgccctagaactcctagatctatgttcatccactttgctgagtcgggtaccatcgaagttcagtggcagtggatgtggacagaattcactctcacatacacagtcngcaggctgagtntttgctaacttctcgtntacaatagtacgtactacgttccctataccgtttcggcctagggtacctagtagtaggtattaactacgaaacgtacgtggtcgtccgtacggcctaacccgtattcccgttacgttacccgttactacccgtttcccgttaccccgactaccttcggttaacg

SEQ ID NO: 81297 - DNA, 559 bp, Homo sapiens
  misc_feature: GYAE6OF01EHFOP.52.1.A01.1.454.CMB.1.raw
  modified_base (270)..(270): a, c, t, g, unknown or other
  misc_feature (270)..(270): n is a, c, g, or t
  modified_base (344)..(344): a, c, t, g, unknown or other
  misc_feature (344)..(344): n is a, c, g, or t
  modified_base (414)..(414): a, c, t, g, unknown or other
  misc_feature (414)..(414): n is a, c, g, or t
tcagcgcagtacgacacgaccggtgctcgatttagacgtctcatcaggggggagtcagtctcagtcaggacacagcatggacatgagggtccccgctcagctcctggggctcctgctactctggctccgaggtgccagatgtgtcatccagatgacccagtctccatcctccctgtccgcatctgtaggagacagagtcatcatcacttgccgggcaagtcagagcattagaacgtatttaaattggtatcaacagaaaccagggaaacncccctgaactcctgatctatggttcatccatttgctgagtcgggtccatcgaaggttcagtggcagtggatcgngggacagaattcactctcaccatccacagtctgcaggctagagtatttcgctaacttcttcgtgtacaanagtagttactacgttccccttctaccgtttccggaccccgtagggaccctagttacggtaggtaacttaacgttaaccgaaaacggtacgttacgggtacggtaccgttacggaccctaaccctaacttcccgttcgtttacccg

SEQ ID NO: 81298 - DNA, 569 bp, Homo sapiens
  misc_feature: GYAE6OF01A4RIJ.52.1.A01.1.454.CMB.1.raw
  modified_base (557)..(557): a, c, t, g, unknown or other
  misc_feature (557)..(557): n is a, c, g, or t
tcagcgcagtacgacacgaccggtgctcgatttagacgtctcatcagggggggagtcagtctcagtcaggacacagcatggacatgagggtccccgctcagctcctggggctcctgctactctggctccgaggtgccagatgtgtcatccagatgacccagtctccatccctccctgtccgcatctgtaggagacagagtcatcatcacttgccgggacaagtcagagcattagaacgtatttaaattggtatcaacagaaaccgaggaaacgcccctagaacctcctagactcgtatggttacatcctacttttgcttggtaggtcggggtacccagttacgaaggttcaaggtggcgaggtggatcgtaggggaacaggtaacttcacttcctacaccaatccacctagtctgacaggctaggagttatttcgactaacttacttctgtacaacgtagtacgttacacgtttacccctacttacccgtttccggccctacgggtacctagttaggttcgaattacgtacaacggtaatgttacgctcgactaccnttcgtcgttacc

SEQ ID NO: 81299 - DNA, 597 bp, Homo sapiens
  misc_feature: GYAE6OF01DA0TN.52.1.A01.1.454.CMB.1.raw
  modified_base (234)..(234): a, c, t, g, unknown or other
  misc_feature (234)..(234): n is a, c, g, or t
  modified_base (250)..(250): a, c, t, g, unknown or other
  misc_feature (250)..(250): n is a, c, g, or t
tcagcgcagtacgacacgaccggtgctcgatttagacgtctcatcagggcacagcatggacatgagggtccccgctcagctcctggggctcctgctactctggctccgaggtgccagatgtgtcatccagatgacccagtctccatcctccctgtccgcatctgtaggagacagagtcatcatcacttgccgggcaagtcagagcaattagaacgttatttaaatggtatcaanagaaaccagggaaacncccctagaactcctagatctatggtcatcctactttgctgagtcgggtcccatctaagttcagtggacagtggactcgtagggacaagattcgactcgtcaccatccactgtctgcaggtcgtgaggttatttcgacttaacgttacttctgtaccaacgtacgtacgttacgtaccgtttccctaccgttacgttttcccggacccgttaggggaaccctagttacggtacggtattacgtacgaaaacgtacgttggtacgggtctacggacctacctaacgttccgttacgttcctttaacgtaccttaccccgtttaccccggaccctacgttccgttaaacg

SEQ ID NO: 81300 - DNA, 509 bp, Homo sapiens
  misc_feature: GYAE6OF01DBNWJ.52.1.A01.1.454.CMB.1.raw
  modified_base (489)..(489): a, c, t, g, unknown or other
  misc_feature (489)..(489): n is a, c, g, or t
tcagcgcagtacgacacgaccggtgctcgatttagacgtctcatcaggggggagtcagtctcagtcaggacacagcatggacatgagggtccccgctcagctcctgggctcctgctactctggctccgaggtgccagatgtgtcatccagatgacccagtctccatcctccctgtccgcatctgtaggagacagagtcatcatcacttgccgggcaagtcagagcattagaacgtatttaaatggtatcaacagaaacagggaaagcccctgaactcctgatctatggtcatcactttgctgagtgggtcccatcaagttcagtggcagtggatctagggacagaattcactctcaccatcaaccagtctgcaggctggagtattttgacctaaactttacctttcgtgtacaacgtagtaagttaactacgtttcccctacttactttccggcccgttgggacctatacggtgatatacaaacgtacngtgctcgacacatctgttcc

SEQ ID NO: 81301 - DNA, 485 bp, Homo sapiens
  misc_feature: GYAE6OF01CNBOT.52.1.A01.1.454.CMB.1.raw
  modified_base (222)..(222): a, c, t, g, unknown or other
  misc_feature (222)..(222): n is a, c, g, or t
  modified_base (246)..(246): a, c, t, g, unknown or other
  misc_feature (246)..(246): n is a, c, g, or t
  modified_base (260)..(260): a, c, t, g, unknown or other
  misc_feature (260)..(260): n is a, c, g, or t
  modified_base (351)..(351): a, c, t, g, unknown or other
  misc_feature (351)..(351): n is a, c, g, or t
tcagcgcagtacgacacgaccggtgctcgatttagacgtctcatcaggggggagtcagtctcagtcaggacacagcatggacatgagggtccccgctcagctcctgggctcctgctactctggctccgaggtgccagatgtgtcatccagatgacccagtctccatcctccctgtccgcatctgtaggagacagagtcatcatcacttgccggcaagtcagngcattagaacgtattaaatgtatnaacagaacaggaanccctgaactctgatctatgtcatccattgctgagtgggtccatcagttcagtggcagtgatgtggacagatcactctcacatcactagtcngcagctgagtatttgactaacttacttctctacaactagtagttaccacgtttccctacttacgtttccggcctacggacctagtagtgtaatactacgtaaagtacgtgtacgctacgacactgtctgttacc

SEQ ID NO: 81302 - DNA, 543 bp, Homo sapiens
  misc_feature: GYAE6OF01B33R6.52.1.A01.1.454.CMB.1.raw
  modified_base (216)..(216): a, c, t, g, unknown or other
  misc_feature (216)..(216): n is a, c, g, or t
  modified_base (409)..(409): a, c, t, g, unknown or other
  misc_feature (409)..(409): n is a, c, g, or t
tcagcgcagtacgacacgaccggtgctcgatttagacgtctcatcaggggggagtcagtctcagtcaggacacagcatggacatgagggtccccgctcagctcctggggctcctgctactctggctccgaggtgccagatgtgtcatccagatgacccagtctccatcctccctgtccgcatctgtaggagacagagtcatcatcacttgccgggnaagtcagagcattagaacgtatttaaatggtatcaacagaaaccagggaaacgcccctagaactcctagatctatggttcatcctacttgctgagtgggtccatcaggttcagtggcagtggatcgtagggacagtaattcactctacacatccacagtctgcgagctgagtatttgactaactttacttctntacaactgtaacgttacgtacgttccctctaccgtttccggcccgtacgggacctaagttacggtagtaacttaacgtacaaaaccggtaacgttcggtcgggtacctacggaccacctacttcgtagttaccc

SEQ ID NO: 81303 - DNA, 516 bp, Homo sapiens
  misc_feature: GYAE6OF01EQ3XS.52.1.A01.1.454.CMB.1.raw
  modified_base (337)..(337): a, c, t, g, unknown or other
  misc_feature (337)..(337): n is a, c, g, or t
tcagcgcagtacgacacgaccggtgctcgatttagacgtctcatcagggcacagcatggacatgagggtccccgctcagctcctggggctcctgctactctggctccgaggtgccagatgtgtcatccagatgacccagtctccatcctccctgtccgcatctgtaggagacagagtcatcatcacttgccggcaagtcagagcattagaacgtatttaaattggtatcaacagaaaccagggaaagcccctgaactcctgatctatggttcatccactttgctgagtcggggtcccatcaaggttcagtggcaggtggatcgtgggacagaattcnctctcacctatcaccagtctgcaggctggagtattttgactaactttctctacgtcaactagtattacacgtttccctactaccgtttcggtccctagggaccctagtagtggatacgtacaaacgtactggtgctcgcaccctatctcgttcttcacttccttacccgctagtgtacg

SEQ ID NO: 81304 - DNA, 507 bp, Homo sapiens
  misc_feature: GYAE6OF01D9P7A.52.1.A01.1.454.CMB.1.raw
  modified_base (240)..(240): a, c, t, g, unknown or other
  misc_feature (240)..(240): n is a, c, g, or t
  modified_base (323)..(323): a, c, t, g, unknown or other
  misc_feature (323)..(323): n is a, c, g, or t
tcagcgcagtacgacacgaccggtgctcgatttagacgtctcatcagggcacagcatggacatgagggtccccgctcagctcctggggctcctgctactctggctccgaggtgccagatgtgtcattcagatgacccagtctccatcctcctgtccgcatctgtaggagcagagtcatcatcacttgccggcaagtcagagcattagacgtattaaatggatcaacagaaacagggaaanccctgaactcctgatctatggttcatcactttgctgacgtgggtccatcaagttcagtgcagtgatctgggacagatcactcncacatcacagtctgcaggctgagtctttgactacttacttctacgtacaatgtagtactacgttccctcacgtttcgacccgttggaacctagtacggtagtatactacaaacgtactggtacggacgtcgaccgtactatcgttagtaccttacgtacttccttacccgcctagttcgtaacg

SEQ ID NO: 81305 - DNA, 598 bp, Homo sapiens
  misc_feature: GYAE6OF01C3DV8.52.1.A01.1.454.CMB.1.raw
  modified_base (319)..(319): a, c, t, g, unknown or other
  misc_feature (319)..(319): n is a, c, g, or t
  modified_base (355)..(355): a, c, t, g, unknown or other
  misc_feature (355)..(355): n is a, c, g, or t
  modified_base (369)..(369): a, c, t, g, unknown or other
  misc_feature (369)..(369): n is a, c, g, or t
tcagcgcagtacgacacgaccggtgctcgatttagacgtctcatcagggcacagcatggacatgagggtccccgctcagctcctggggctcctgctactctggctccgaggtgccagatgtgtcatccagatgacccagtctccatcctccctgtccgcatctgtaggagacagagtcatcatcacttgccgggcaagtcagagcattagaacgttatttaaatggtatcaacagaaccagggaaagccctgaactcctgatctatggttcatccactttgctgagtggggtcccatcaaggttcagtggcagtggatntgggacaggaattcactctcaccatcacgatctgcnggtactggaagttntttagactaactttacttctagtacaactagtacgttacgtcgttacccttacttacgttccgggtccctacgggtaacctagtacggtaggtaacttaactaccgtaaaacggaaccgtttggaccgggttacgtaccggtaccctaacccgttacttccgttaccggtttccctttacctacccgttttaccccttacccccgtacccgtacgtttccgttaaacgg

SEQ ID NO: 81306 - DNA, 582 bp, Homo sapiens
  misc_feature: GYAE6OF01BLBY2.52.1.A01.1.454.CMB.1.raw
  modified_base (248)..(248): a, c, t, g, unknown or other
  misc_feature (248)..(248): n is a, c, g, or t
tcagcgcagtacgacacgaccggtgctcgatttagacgtctcatcagggcacagcatggacatgagggtccccgctcagctcctggggctcctgctactctggctccgaggtgccagatgtgtcatccagatgacccagtctccatcctccctgtccgcatctgtaggagacagagtcatcatcacttgccgggcaagtcagagcattagaacgtatttaaatggtatacaacagaaaccagggaaancccctagaactcctgatctatggttcatccactttgctgaggtgggtcccatcaaggttcaggtggcagtggatcgtgggacagaattcactctcaccatcaccagtctgcaggtctggaggtattttgactaacttacttctgtaccaactagtacgtttaactccgtttcccctctaccgttttccggcccgttagggaccctaagttacggtaggtaacttaacgtacctaaaacggtaacttcggtcggtaccttacggccctaaccctagttcccgttacgttcctttacctacctttcccgtttacccccggccttacttcgtaaacg

SEQ ID NO: 81307 - DNA, 489 bp, Homo sapiens
  misc_feature: GYAE6OF01AZNA4.52.1.A01.1.454.CMB.1.raw
  modified_base (453)..(453): a, c, t, g, unknown or other
  misc_feature (453)..(453): n is a, c, g, or t
tcagcgcagtacgacacgaccggtgctcgatttagacgtctcatcagggcacagcatggacatgagggtccccgctcagctcctggggctcctgctactctggctccgaggtgccagatgtgtcatccagatgacccagtctccatcctccctgtccgcatctgtaggagacagagtcatcatcacttgccgggcaagtcagagcattagaacgtatttaaattggtatcaacagaaaccagggaaagccctgaactcctgatctatggttcatcctactttgctgagtgggtccatcaagttcagtgcagtggatcgtgggacagaattcactctcacactcacagtctgcaggctgagtatttgactaacttacttctgtacaacagtagtactacttcctctacgtttcggcctgggacctagtagtggatatacaaacgtactgcggtntcgcaccatctgtcttcacttctacccgctatctag

SEQ ID NO: 81308 - DNA, 556 bp, Homo sapiens
  misc_feature: GYAE6OF01EDQ6X.52.1.A01.1.454.CMB.1.raw
  modified_base (367)..(367): a, c, t, g, unknown or other
  misc_feature (367)..(367): n is a, c, g, or t
  modified_base (370)..(370): a, c, t, g, unknown or other
  misc_feature (370)..(370): n is a, c, g, or t
  modified_base (380)..(380): a, c, t, g, unknown or other
  misc_feature (380)..(380): n is a, c, g, or t
  modified_base (397)..(397): a, c, t, g, unknown or other
  misc_feature (397)..(397): n is a, c, g, or t
tcagcgcagtacgacacgaccggtgctcgatttagacgtctcatcagggcacagcatggacatgagggtccccgctcagctcctggggctcctgctactctggctccgaggtgccagatgtgtcatccagatgacccagtctccatcctccctgtccgcatctgtaggagacagagtcatcatcacttgccgggcaagtcagagcattagaacgttatttaaagttggtatacaaacaagaaaccgagggaaacgcccctagaacctcctgatctatggtcatcctactttgctggaggtgggtcccatacgtaaggttcagtggctaggtggatcgtggacagtattcactctcacatcacagtcngcnggctagagtntttgacttaacttcttntagtaccaagtagtacttactacgttccctcgtccgtttccggcccgtacgggtacctagttacggtagtaactactacgaaacgtagtcggtcgtctacgcccgtactacttccttacgttccgttactacttcccttaccccgctacgttcgtaacg

SEQ ID NO: 81309 - DNA, 575 bp, Homo sapiens
  misc_feature: GYAE6OF01EV52U.52.1.A01.1.454.CMB.1.raw
  modified_base (216)..(216): a, c, t, g, unknown or other
  misc_feature (216)..(216): n is a, c, g, or t
tcagcgcagtacgacacgaccggtgctcgatttagacgtctcatcagggggggagtcagtctcagtcaggacacagcatggacatgagggtccccgctcagctcctggggctcctgctactctggctccgaggtgccagatgtgtcatccagatgacccagtctccatcctccctgtccgcatctgtaggagacagagtcatcatcacttgccggnaagtcagagcattagaacgtatttaaattggtatcaacagaaaccagggaaagcccctgaactcctgatctatggttcatccactttgctgagtgggtccatcaaggttcagtggcagtggatcgtgggacaggaattcacttctacacctatcacctagtctgcgaggctaggaggttatttcgacttaactttactttcttacgtacaaacgtacgtaagttacctacgtttcccctaccgttaccgtttcccgggacccgttacgggacctagttacggtaggtaacttaactaacgtaaaaccggtacgttacggtcggtaccgtacgacctaaccctacttcgtcgtttacccg

SEQ ID NO: 81310 - DNA, 517 bp, Homo sapiens
  misc_feature: GYAE6OF01ET8CI.52.1.A01.1.454.CMB.1.raw
  modified_base (247)..(247): a, c, t, g, unknown or other
  misc_feature (247)..(247): n is a, c, g, or t
  modified_base (495)..(495): a, c, t, g, unknown or other
  misc_feature (495)..(495): n is a, c, g, or t
  modified_base (507)..(507): a, c, t, g, unknown or other
  misc_feature (507)..(507): n is a, c, g, or t
tcagcgcagtacgacacgaccggtgctcgatttagacgtctcatcagggcacagcatggacatgagggtccccgctcagctcctggggctcctgctactctggctccgaggtgccagatgtgtcatccagatgacccagtctccatcctccctgtccgcatctgtaggagacagagtcatcatcactgccgggcaagtcagagcattagaacgtatttaaatggtatcaacagaaaccagggaaacncccctgaactcctgatctatgttcatccactttgctgagtgggtccatcaaggttcagtggcagtgatcgtgggacagatcactctcaccatcacagtctgcaggctgagtatttgactaacttatctagtacaacagtagttactacgtttccctacgtacctttccggccctagggacctaagtggtaggaattacgtacgaaaacgtacgtggtcggctcgctaacccattcctagttccttacncttccttccccncctatctacg

SEQ ID NO: 81311 - DNA, 496 bp, Homo sapiens
  misc_feature: GYAE6OF01BQR0P.52.1.A01.1.454.CMB.1.raw
  modified_base (493)..(493): a, c, t, g, unknown or other
  misc_feature (493)..(493): n is a, c, g, or t
tcagcgcagtacgacacgaccggtgctcgatttagacgtctcatcagggcacagcatggacatgagggtccccgctcagctcctggggctcctgctactctggctccgaggtgccagatgtgtcatccagatgacccagtctccatcctccctgtccgcatctgtaggagacagagtcatcatcacttgccgggcaagtcagagcattagaacgtatttaaattggtatcaacagaaaccagggaaacgcccctagaactcctgatctatggttcatccactttgctgagtgggtcccatcaaggtcagtgcagtggatcgtgggacagattcactctcaccatcaccagtctgcaggctagaggtattttgactaacttacttctagtcaacagtacgttacacgtttccctctactttccggcctgggacctagtagtggatactacaaacgactgtggctgcacatctgtcttctattcctcccgctatntag

SEQ ID NO: 81312 - DNA, 507 bp, Homo sapiens
  misc_feature: GYAE6OF01D5G2O.52.1.A01.1.454.CMB.1.raw
  modified_base (380)..(380): a, c, t, g, unknown or other
  misc_feature (380)..(380): n is a, c, g, or t
  modified_base (390)..(390): a, c, t, g, unknown or other
  misc_feature (390)..(390): n is a, c, g, or t
  modified_base (395)..(395): a, c, t, g, unknown or other
  misc_feature (395)..(395): n is a, c, g, or t
  modified_base (407)..(407): a, c, t, g, unknown or other
  misc_feature (407)..(407): n is a, c, g, or t
  modified_base (411)..(411): a, c, t, g, unknown or other
  misc_feature (411)..(411): n is a, c, g, or t
  modified_base (418)..(418): a, c, t, g, unknown or other
  misc_feature (418)..(418): n is a, c, g, or t
  modified_base (497)..(497): a, c, t, g, unknown or other
  misc_feature (497)..(497): n is a, c, g, or t
tcagcgcagtacgacacgaccggtgctcgatttagacgtctcatcaggggggagtcagtctcagtcaggacacagcatggacatgagggtccccgctcagctcctggggctcctgctactctggctccgaggtgccagatgtgtcatccagatgacccagtctccatcctccctgtccgcatctgtaggagacagagtcatcatcacttgccggcaagtcagagcaattagaacgtatttaaattggtatacaacagaaaccagggaaacgcccctagaactcctagatctatggttcatcctactttgctggagtcggggtccctagtcgaaggttcaggtggcagtggatcgtgggacagtatcactctcacatcacngtctgcagcngagtntttgactacttntctntacaacngtagttacacgttccctactacgttccgcctcggtacctagtacgtagatacgacaaacgtacgtgtcgctgactaccnttcgtgttcc

SEQ ID NO: 81313 - DNA, 621 bp, Homo sapiens
  misc_feature: GYAE6OF01B0KT6.52.1.A01.1.454.CMB.1.raw
  modified_base (101)..(101): a, c, t, g, unknown or other
  misc_feature (101)..(101): n is a, c, g, or t
  modified_base (196)..(196): a, c, t, g, unknown or other
  misc_feature (196)..(196): n is a, c, g, or t
tcagcgcagtacgacacgaccggtgctcgatttagacgtctcatcaggggggtaggtcagtctcaggtcaggacacagcatggacagtcgagggtccccgntcagcgtcctgggctcctgctactctggctccgaggtgccagatgtgtcatccagactgacccagtctccatcctcctgtccgcatctgtagganacagatcatcatcacgttgaccggcaagtcagagtacagttaagaacgtatttaaatcggtaatacgaaacacgaaaccgaggaacgtcccctagaactctgatctatcgtacactcacttgctgaggtcggtccagtcgagttcagtcgcaggtcggaatcgtaggactacgtaattccacttcactaacctattaccaacctagtctagacgtaggtctaggtacgttatttacgaacgtttaacttacgttacttagtaaccgtaacgtaggtaaccgttaacgtacgttttaccccgatttaacccgttaccggtaacccggttacggtaaccgttaacggttacggtacggttactaaacgttaccgaaaacggttccgttacgtacggtcctaccgtacctacctacttcgtccgttac

SEQ ID NO: 81314 - DNA, 563 bp, Homo sapiens
  misc_feature: GYAE6OF01DDE3X.52.1.A01.1.454.CMB.1.raw
  modified_base (217)..(217): a, c, t, g, unknown or other
  misc_feature (217)..(217): n is a, c, g, or t
tcagcgcagtacgacacgaccggtgctcgatttagacgtctcatcagggggggagtcagtctcagtcaggacacagcatggacatgagggtccccgctcagctcctggggctcctgctactctggctccgaggtgccagatgtgtcatccagatgacccagtctccatcctccctgtccgcatctgtaggagacagagtcatcatcacttgccgggnaagtcagagcattagaacgttaatttaaatggtatacaaacaagaaaccagggaaacgcccctagaacctcctagatctatcggttcatcctatttgctgagtcgggccatacgtaggttcagtggcagtggatcgtagggacaagtaacttcactctacacctatccacctagtctgcgaggctggagttactttcgacttaactttctttctacgtacaaactacgtacgttacctacggttccctataccgtttccggcccgtagggaccctagtacggtagtaactactaacgaaacgtacgtcggttacggctacggacctacgtaactccgttgttaccc

SEQ ID NO: 81315 - DNA, 519 bp, Homo sapiens
  misc_feature: GYAE6OF01BSO9N.52.1.A01.1.454.CMB.1.raw
  modified_base (194)..(194): a, c, t, g, unknown or other
  misc_feature (194)..(194): n is a, c, g, or t
  modified_base (470)..(470): a, c, t, g, unknown or other
  misc_feature (470)..(470): n is a, c, g, or t
  modified_base (493)..(493): a, c, t, g, unknown or other
  misc_feature (493)..(493): n is a, c, g, or t
  modified_base (497)..(497): a, c, t, g, unknown or other
  misc_feature (497)..(497): n is a, c, g, or t
  modified_base (501)..(501): a, c, t, g, unknown or other
  misc_feature (501)..(501): n is a, c, g, or t
  modified_base (511)..(511): a, c, t, g, unknown or other
  misc_feature (511)..(511): n is a, c, g, or t
  modified_base (514)..(514): a, c, t, g, unknown or other
  misc_feature (514)..(514): n is a, c, g, or t
  modified_base (516)..(516): a, c, t, g, unknown or other
  misc_feature (516)..(516): n is a, c, g, or t
tcagcgcagtacgacacgaccggtgctcgatttagacgtctcatcagggcacagcatggacatgagggtccccgctcagctcctggggctcctgctactctggctccgaggtgccagatgtgtcatccagatgacccagtctccatcctccctgtccgcatctgtaggagacagagtcatcatcacttgccggnaagtcagagcattagaacgtatttaaattggtaatcaacagaaaccgagggaaacgcccctagaacctcctagatctatggttcactcctacgtttgctgtaggtggggtacccagtacgaaggttcagtggacaggtggatcgtgggacagtaactcactctacacctataccaccagtcctgctaggctaggaggttatttcgactaacgttcttctgtacaactagtagtactcttccctctaccgtttccggcctggactagtaggtgatanacgaacgtacgtgtgctcgcacntctntctntctctacccnctntntcg

SEQ ID NO: 81316 - DNA, 519 bp, Homo sapiens
  misc_feature: GYAE6OF01DMTC5.52.1.A01.1.454.CMB.1.raw
  modified_base (377)..(377): a, c, t, g, unknown or other
  misc_feature (377)..(377): n is a, c, g, or t
tcagcgcagtacgacacgaccggtgctcgatttagacgtctcatcaggggggagtcagtctcagtcaggacacagcatggacatgagggtccccgctcagctcctggggctcctgctactctggctccgaggtgccagatgtgtcatccagatgacccagtctccatcctccctgtccgcatctgtaggagacagagtcatcatcacttgccgggcaaagtcagagcattaagaacgtaatttaaattggtatccaacaagaaaccaagggaaagccccctgaactcctgatctatggttcatccactttgctgagtgggtcccatcaaggttcagtgcagtggatctgggacagaattcactctcaccatcaaccngtactgcaagctgaggtattttgctaactttacttctacgtactaacgaagtagttaactacgtttccctctaactttccggcccgtcgggaacccagtagtggatactactaaacgaactgtggctgacacctactctgtc

SEQ ID NO: 81317 - DNA, 693 bp, Homo sapiens
  misc_feature: GYAE6OF01CBCWI.52.1.A01.1.454.CMB.1.raw
tcagcgcagtacgacacgaccggtgctcgatttagacgtctcatcaggggggagtcagtctcagtcaggacacagcatggacatgagggtccccgctcagctccgtggggctcctgctactctggctccgaggtgccagatgtgtcatccagatgacccagtcctccatccctccctgtccgcatctggtaggagacagatcatcatcacttgccgggacaagtcagagcattaagaacgttatttaaagttggtactacaacaacgaaacgaggaaacgccctagactcctgatctatgtcactctactttgcgtgacgtcgggtccctagtacgtaacggtacaggtggacgtaggtgtacgttcggtaggggaactaaggtaacttccgaaccgttcttaccgaacctacgtacctaaccgtaagttcccgtggaccgtaacggtccgttaagggtacggtttaagttttcggaaccctttaaaccttttccgtttacgttacgtaacccgtaaacgtacgtttaacggtttaacccttaccgggttttaccccctacttaacccggttttcccgggccccgttaacgggtaacctaaggttacgggttaggtaactaaccggttaacaaaacccggttcgtacggttcgggtactaccgggacctaacccgtatttccgttcgttaccc

SEQ ID NO: 81318 - DNA, 727 bp, Homo sapiens
  misc_feature: GYAE6OF01BEVB0.52.1.A01.1.454.CMB.1.raw
  modified_base (222)..(222): a, c, t, g, unknown or other
  misc_feature (222)..(222): n is a, c, g, or t
  modified_base (715)..(715): a, c, t, g, unknown or other
  misc_feature (715)..(715): n is a, c, g, or t
tcagcgcagtacgacacgaccggtgctcgatttagacgtctcatcagggggggagtcagtctcagtcaggacacagcatggacatgagggtccccgctcagctccgtggggctcctgctactctggctccgaggtgccagatgtgtcatccagatcgacccagtcctccatccctccctgtccgcatctggtaggagacagagtcatcatcacttgccgganaagtcagagctattagaacgttaatttaaagttggtaatacaaacaagaaaccgaagggaaactcccctagaacctccgtagtacttctagttcggttcactcctactttgacgtaggtacggtcgggtacccaagttacggtaaacggtttcgaagggttcgggacgtacgggttagggtaacgttcggtaacgggggtaaacctaaaggttaaactttccgaaacctttcctaccaaacccttacgttaccctaaccgttagttccgtacggaccgtaagggtccgttaagggtaacggtttaacgttttacggaaccctttaaacgtttccgtttacgtacgttaaccctaaagtacggttaacgttttaacccgtaccgtttaccccgttacgttacccgttttccgggaccccggttagggtaaccctagttacggttacgtaagttaccgtaacgtaacgtaacgtcgtacggtctagaccctactnttccgtgttacc

SEQ ID NO: 81319 - DNA, 597 bp, Homo sapiens
  misc_feature: GYAE6OF01EGL6T.52.1.A01.1.454.CMB.1.raw
  modified_base (250)..(250): a, c, t, g, unknown or other
  misc_feature (250)..(250): n is a, c, g, or t
tcagcgcagtacgacacgaccggtgctcgatttagacgtctcatcagggcacagcatggacatgagggtccccgctcagctcctggggctcctgctactctggctccgaggtgccagatgtgtcatccagatgacccagtctccatcctccctgtccgcatctgtaggagacagagtcatcatcacttggccggcaagtcagagcattaagaacttatttaaatggtatacaacagaaaccagggaaacncccctagaacctcctgatctagtgtcactccactttgcgtgaggtcgggtaccagtacgaaggttcaggtgactagtggatcgtaggactagtaacttcactactaccacctactaccacctgtcctgacgaggtctaggtagttatttacgacttaactttcttctacgactaacgtagttacttacctacgttcccttacgtaccgttccggcccgtaggtaccctagttacggtagaacttaacgaacgtaaacgtacgtcggtacggtacctcggaccctaccgtacttccgttacgttcctttaccctacgtttccccgtaccccgtactcgttcgtaaacg

SEQ ID NO: 81320 - DNA, 591 bp, Homo sapiens
  misc_feature: GYAE6OF01DML9O.52.1.A01.1.454.CMB.1.raw
  modified_base (355)..(355): a, c, t, g, unknown or other
  misc_feature (355)..(355): n is a, c, g, or t
tcagcgcagtacgacacgaccggtgctcgatttagacgtctcatcagggcacagcatggacatgagggtccccgctcagctcctggggctcctgctactctggctccgaggtgccagatgtgtcatccagatgacccagtctccatcctccctgtccgcatctgtaggagacagagtcatcatcacttgccgggcaagtcagagcaattagaacgttatttaaattggtatcaaacaagaaaccgaagggaaacgcccctagaacctcctgatctatggttcatcctactttgcgtgaggtcgggtcccatcaaggttcaggtgcagtgatcgtgggacagattcactctcaccntcaccagtctgcgagctgaggtatttgacttaacttacttctgtacaacgtagtagttactacgtttccctacttaccgtttccggcccgtgggtaaccctagttacggtaggtaattacgtaacgtaaaccgtaaccgtggtccggtccgtacggtaccctaccttatttcccgttacgttcccgtttaccctacctttacccccgtttcccccgtaccttacgttccgttaacg

SEQ ID NO: 81321 - DNA, 623 bp, Homo sapiens
  misc_feature: GYAE6OF01ASYE6.52.1.A01.1.454.CMB.1.raw
tcagcgcagtacgacacgaccggtgctcgatttagacgtctcatcagggcacagcatggacatgagggtccccgctcagctcctggggctcctgctactctggctccgaggtgccagatgtgtcatccagatgacccagtctccatcctccctgtccgcatctgtaggagacagagtcatcatcacttgccggcaagtcagagcattaagaacgttatttaaatggtatacaaacaagaaaaccgaagggaaacgcccctagaacctcctagatactatggttacatcctactttgcgtaggaggtcgggtacctatacgtaaggttcagtcggcgaggtggtatcgtagggaacagtaattcactctacaccataccactacgtctagcaggtcgtaggtagtacgtttagacctaactttactctagtacaaacgtagtaacgttactaccgttccctacttaccgtttccgaccgtacggtacccaagttacgtacggtaacttaacgtaaccgtaaacgtacgttacggtacggtacctacggtacctaactacggtttccttcgtttaccttacccgttaccgttccccgtttaccccggaccttagttcgtaaaccg

SEQ ID NO: 81322 - DNA, 533 bp, Homo sapiens
  misc_feature: GYAE6OF01AS0XX.52.1.A01.1.454.CMB.1.raw
  modified_base (249)..(249): a, c, t, g, unknown or other
  misc_feature (249)..(249): n is a, c, g, or t
  modified_base (523)..(523): a, c, t, g, unknown or other
  misc_feature (523)..(523): n is a, c, g, or t
tcagcgcagtacgacacgaccggtgctcgatttagacgtctcatcagggcacagcatggacatgagggtccccgctcagctcctggggctcctgctactctggctccgaggtgccagatgtgtcatccagatgacccagtctccatcctccctgtccgcatctgtaggagacagagtcatcatcacttgccggcaagtcagagcattagaacgttatttaaattggtatacaacagaaaccagggaaancccctgaactcctgatctatggttcatccactttgctgagtcgggtccatcaaggttcagtggcagtggatcgtgggacagaacttcgactctcacatcaccagtctgcagctgaggtatttgactaacgttcttcgtagtacaacgtagtacgtttacacgtttccctctaccgtttccggcccgttagggacctagttaggtcgtaattacgtacaaacgtacgtaggtcggctcgactacctattcctagttcctctacttcccgtacccnctgtccgtag

SEQ ID NO: 81323 - DNA, 532 bp, Homo sapiens
  misc_feature: GYAE6OF01C0X2B.52.1.A01.1.454.CMB.1.raw
  modified_base (224)..(224): a, c, t, g, unknown or other
  misc_feature (224)..(224): n is a, c, g, or t
tcagcgcagtacgacacgaccggtgctcgatttagacgtctcatcaggggggagtcagtctcagtcaggacacagcatggacatgagggtccccgctcagctcctggggctcctgctactctggctccgaggtgccagatgtgtcatccagatgacccagtctccatcctccctgtccgcatctgtaggagacagagtcatcatcacttgccgggcaagtcagngcattagaacgtatttaaattggtatcaacagaaaccagggaaagcccctgaactcctgatctatggttcatccactttgctgagtggggtcccatcaaggttcagtggcagtgatcgtgggacagaattcactctcaccatccaccagtctgcaggctgaggtattttgactaactttactttctgttacaactagtaattactacgtttccctcttaccgtttccggcccgttcgggaccctatacggtgaagttactactaaaacgtacgtggtcgcgttcgaccacctactccgttggttaccc

SEQ ID NO: 81324 - DNA, 576 bp, Homo sapiens
  misc_feature: GYAE6OF01CETRS.52.1.A01.1.454.CMB.1.raw
tcagcgcagtacgacacgaccggtgctcgatttagacgtctcatcagggcacagcatggacatgagggtccccgctcagctcctggggctcctgctactctggctccgaggtgccagatgtgtcatccagatgacccagtctccatcctccctgtccgcatctgtaggagacagagtcatcatcacttgccggcaagtcagagcattagaacgttatttaaatggtatcaacagaaaccgagggaaacgcccctagaactcctgatctatggttcatcctactttgctgaggtcgggtccctagtcgaaggttcagtggcagtggatcgagggacagaattcactctacactatcactgtctgcaggctaggaggttattttcgacttaactttacttcgtacgtacaacgtagtacgtttacacgtttccctctaccgtttccggcccgttagggaccctagttacgtaggtaacttacaccaaacggtacttggtcggtacctacgtacctaacctagttccgttcgttcctttacgtaacctttcccgttaccccgtccttagttcgttaacg

SEQ ID NO: 81325 - DNA, 544 bp, Homo sapiens
  misc_feature: GYAE6OF01B6J77.52.1.A01.1.454.CMB.1.raw
  modified_base (217)..(217): a, c, t, g, unknown or other
  misc_feature (217)..(217): n is a, c, g, or t
tcagcgcagtacgacacgaccggtgctcgatttagacgtctcatcagggggggagtcagtctcagtcaggacacagcatggacatgagggtccccgctcagctcctggggctcctgctactctggctccgaggtgccagatgtgtcatccagatgacccagtctccatccctccctgtccgcatctgtaggagacagagtcatcatcacttgccggnaagtcagagcattagaacgttatttaaattggtaatacaaacaagaaaaccgagggaaacgcccctagaacctcctagactactagtggttcactcctactttgctggagtcgggtcccatacgtaaggttcagtggacaggtgatcgtggactagtatcactcacacactacacctagtctgcgaggctagagttatttgactaacttactctgtacaacgtagtacttacacgttccctacttacgttccggcctagggacctagttacgaggtaactagtaaccgaaacgtctggtacgtactcgaccactacttcgtgttacc

SEQ ID NO: 81326 - DNA, 560 bp, Homo sapiens
  misc_feature: GYAE6OF01BPGRY.52.1.A01.1.454.CMB.1.raw
  modified_base (326)..(326): a, c, t, g, unknown or other
  misc_feature (326)..(326): n is a, c, g, or t
  modified_base (364)..(364): a, c, t, g, unknown or other
  misc_feature (364)..(364): n is a, c, g, or t
tcagcgcagtacgacacgaccggtgctcgatttagacgtctcatcagggcacagcatggacatgagggtccccgctcagctcctggggctcctgctactctggctccgaggtgccagatgtgtcatccagatgacccagtctccatcctccctgtccgcatctgtaggagacagagtcatcatcacttgccgggcaagtcagagcattagaacgttatttaaatggtatcaaacagaaaccgagggaaacgcccctagaacctcctgatctatggttcatccatttgctgagtgggtccatcgaaggttcagtggcagtggatcgnggacagtaatcactctcaccatccacagtctagcaggntagaggtatttgactaacttcttcgtacgtacaacagtacgttactacgttccctactaccgtttccggacccgtacgggacctaagtaggtaggtactaacgtaccgaaacgtacgtcggtacggtcctacgacctacctaacttccgttcgttaccttcgtaccttcccttaccccggtactaccgtcgttacg

SEQ ID NO: 81327 - DNA, 620 bp, Homo sapiens
  misc_feature: GYAE6OF01AQIFA.52.1.A01.1.454.CMB.1.raw
tcagcgcagtacgacacgaccggtgctcgatttagacgtctcatcagggcacagcatggacatgagggtccccgctcagctcctggggctcctgctactctggctccgaggtgccagatgtgtcatccagatgacccagtctccatcctccctgtccgcatctgtaggagacagagtcatcatcacttgccgggcaagtcagagcattagaacgttatttaaattggtatcaacagaaaccagggaaacgccctgaactcctgatctatggttcatcctactttgctggagtcggggtcccatacgtaaggttcaggtggcaggtggatcgtgggactagtaacttcactctacaccataccacagtctgacgaggtctggtaggtacttttcgaccttaaactttacttcgttacgtactaactaaggttacgtttacctaccgtttcccttcgttaacccgtttcccgggtacccgttaccggggtaacctacgtttaacggtaggtaacttacgtaccgtaaaacggtacgttggtacggcgttacgacctaacctacttccgttcgttaccctttaccgtaccttccccgtttaccccgccttacgtccgttaacg

SEQ ID NO: 81328 - DNA, 533 bp, Homo sapiens
  misc_feature: GYAE6OF01C7CRX.52.1.A01.1.454.CMB.1.raw
  modified_base (218)..(218): a, c, t, g, unknown or other
  misc_feature (218)..(218): n is a, c, g, or t
  modified_base (270)..(270): a, c, t, g, unknown or other
  misc_feature (270)..(270): n is a, c, g, or t
  modified_base (367)..(367): a, c, t, g, unknown or other
  misc_feature (367)..(367): n is a, c, g, or t
tcagcgcagtacgacacgaccggtgctcgatttagacgtctcatcagggggggagtcagtctcagtcaggacacagcatggacatgagggtccccgctcagctcctggggctcctgctactctggctccgaggtgccagatgtgtcatccagatgacccagtcctccatccctccctgtccgcatctgtaggagacagagtcatcatcacttgccggnaagtcagagcattagaacgtatttaaatggtatcaacaagaaaccaggaaancccctgaactcctgatctatgtcatctactttgctgagtgggtcccatcaaggttcagtgcagtgatcgtggacagaattcactctcactatcactntctgcaggctgagtatttgactaacttacttctagtactaacagtaacgttactacgtttcccctacttaccgttttcccggccccgttagggaaccctaagtacggtaggtaactaaccgtactaaaacgtacttggtcgctaggaccacctactcttgttaccc

SEQ ID NO: 81329 - DNA, 694 bp, Homo sapiens
  misc_feature: GYAE6OF01DJ4MW.52.1.A01.1.454.CMB.1.raw
tcagcgcagtacgacacgaccggtgctcgatttagacgtctcatcaggggggagtcagtctcagtcaggacacagcatggacatgagggtccccgctcagctcctggggctcctgctactctggctccgaggtgccagatgtgtcatccagatcgacccagtcctccactccctccctgtccgcatctggtaggagacagagtcatcatcacttcggccggacaagtcgagagactaagtttaagaaacgttaattttaaagttggtaactacaaacaagaaaccgaagggaaacgcccctagaaccttcgtgactctatcggttcacgttcctatttcgcgtggtacggtcgggtaccctagtacgtaaggttcgaaggttggacgtaggtggtacgtcggtagggactaagtaacgttcctactcctacgtacctactaccaaccgtacgtctacggaccgaggtaccgttaggtaggttacttttacgaaccgtttaacctttacgtttccgtacgttaaccaacgttaacgttaacgtttaaccgttaccgtttacccctacgtttacccgtttaccgggaccccgttacggtaaccttaggtacggttacgtaacgttaacgtaaccgaaaacggtccgttaggtacggtaccgtacggtacccacgtactttccgttacgtttacccg

SEQ ID NO: 81330 - DNA, 632 bp, Homo sapiens
  misc_feature: GYAE6OF01EH9WX.52.1.A01.1.454.CMB.1.raw
  modified_base (97)..(97): a, c, t, g, unknown or other
  misc_feature (97)..(97): n is a, c, g, or t
  modified_base (219)..(219): a, c, t, g, unknown or other
  misc_feature (219)..(219): n is a, c, g, or t
tcagcgcagtacgacacgaccggtgctcgatttagacgtctcatcagggggggagtcagtctcagtcaggacacagcatggacatgagggtccccgntcagctcctggggctcctgctactctggctccgaggtgccagatgtgtcatccagatgacccagtctccatccctccctgtccgcatctgtaggagacagagtcatcatcacgttggccggnaagtcagagctaattaagtaacgttaatttaaagttggtaatacaaacaagaaaaccgaagggaaacgcccctagaactcctagactcttatggttctatcctactttgctgtaggtcgggtaccctagtcgtaaggttcaggtggactaggtggtatcgtagggactaaggtaacttcactctacactactaccactagtctagacgtagtcgtaggtagttacgtttacgacttaactttacgtacttacgtactaacgtaagtacgttactaccgtttccctacgttaccgttcccggtacccgtacggtaaccgtagttaacggtacgttaacgtaacgtaaaccgtaaacggtaccgttaggtaccggttactaccggacctaacccgttacttcgtaccggtttacc

SEQ ID NO: 81331 - DNA, 607 bp, Homo sapiens
  misc_feature: GYAE6OF01CK1PK.52.1.A01.1.454.CMB.1.raw
tcagcgcagtacgacacgaccggtgctcgatttagacgtctcatcagggcacagcatggacatgagggtccccgctcagctcctggggctcctgctactctggctccgaggtgccagatgtgtcatccagatgacccagtctccatcctccctgtccgcatctgtaggagacagagtcatcatcacttgccggcaagtcagagcattagaacgttatttaaattggtatacaacagaaaccgagggaaacgcccctagaacctcctagactctagtggttcatcctactttgctggtacggtcgggtccctagtcgaaggttcaggtggcaggtggatcgtagggacagtaacttcactcacacatcaccagtctgcaggctaggagttatttgacttaactttacttctagtacaactagtacgttactacgtttccctacgttaccgtttccggcccgttagggaccctaagttaggtacggtacttaacgtacgtaaaaccgtacgttgtaccgggtctacggtaccctaaccgtacgtttcgttacgttaccctttacccgtaccgtttcccccttacccccgtccttaacgttcgttaaccg

SEQ ID NO: 81332 - DNA, 583 bp, Homo sapiens
  misc_feature: GYAE6OF01B9ZTD.52.1.A01.1.454.CMB.1.raw
  modified_base (339)..(339): a, c, t, g, unknown or other
  misc_feature (339)..(339): n is a, c, g, or t
tcagcgcagtacgacacgaccggtgctcgatttagacgtctcatcagggcacagcatggacatgagggtcccgctcagctcctggggctcctgctactctggctccgaggtgccagatgtgtcatccagatgacccagtctccatcctccctgtccgcatctgtaggagacagagtcatcatcacttgccgggcaagtcagagcattagaacgtatttaaattggtatcaacagaaaccagggaaacgcccctgaactcctgatctatggttcatccactttgctgagtggggtcccatcaaggttcagtggcagtggatcgtggacagaattcactcncaccatcacagtctgcaggctggagtatttgactaacttacttctgtacaacgtagtaacgttactacggtttcccctacgttaacccgtttcgggccccgttacggggaaccctaagttacgggtacgtataaccgtacgaaaaccgtaaccgttgggtacggaccttacggacctacccgtaacttccgtagttaccctttacaccgttccctttaccccggaccttacgttccgttaacgg

SEQ ID NO: 81333 - DNA, 868 bp, Homo sapiens
  misc_feature: GYAE6OF01AHZFE.52.1.A01.1.454.CMB.1.raw
tcagcgcagtacgacacgaccggtgctcgatttagacgtctcatcagggcacagcatggacatgagggtccccgctcagctcctggggctcctgcctactctggctccgaggtgccagatgtgtcatccagatcgacccagtcctccactccctccctgtccgcatctgtaggagacagagtcatcatcacttcggccgggacaagtcagagactaagttaagtaaacgttaattttaaagttggtactacaaacgaacggaaaacccgaaggggaaaccgtccccgtagaaccttccgtagacttacttagttcggttaccacttccctacgttttcggtcgtggtacgggttccggggttaccctaagttaccgtaagggtttcgagggtacggtcgtaggtggtacgttacggtacggggaactaaggtaacttccgtactcctaccacctaactacccaccgtacgtcgtacggaccgtacggacgtttttttttttttttttttttttttacggacggtttacgtttacgtaccgttaacctttaccgttaccgttacgtaaccgtaaccgtaacggttaacgttaaccgttacccggtttaccccgtttacccgttacccggtttacccgggttacccccggttaacccgggtaacccggttaacggttaacggttaacggttaacgttaaccgtaaccggtaaaaccggttaacggttacgggttaccggttaccggttacccggtacccgtaaccccgttaacccgttacccgtttacccggttttaccccgtttacccgttaccccgtttacccccgtttacccccggttaccccgttacccgtttacccggttaacgg

SEQ ID NO: 81334 - DNA, 627 bp, Homo sapiens
  misc_feature: GYAE6OF01C9BJ6.52.1.A01.1.454.CMB.1.raw
tcagcgcagtacgacacgaccggtgctcgatttagacgtctcatcaggggggagtcagtctcagtcaggacacagcatggacatgagggtccccgctcagctcctggggctcctgctactctggctccggaggtgccagatgtgtcatccagatgacccagtctccatccctccctgtccgcatctggtaggagacagagtcatcatcacttggccgggacaagtcagagctaattaagaacgttaattttaaagttggtaatacaaacaacggaaaccgaaggggaaaccgcccctagtaacctcctgtactctagtcggttcacttcctatttgctggacggtcgggtacccagtcgtaaggttcgaggtgacgtaggtggatcgtagggactaggtaacttcactctacacctatccacgtagtctcgacgaggtctaggtagttattttcgaccttaactttacttctagtacctaacgtagttaacgttaccgtaccgtttacccctacgttaccggtttcccggacccgttacgggtaacctagttacgggtacggtaacttacgtaacgtaaacggtcgttcgggtacgcttacgacctaacctcgttcgtccgtttacc

SEQ ID NO: 81335 - DNA, 568 bp, Homo sapiens
  misc_feature: GYAE6OF01BAFOP.52.1.A01.1.454.CMB.1.raw
tcagcgcagtacgacacgaccggtgctcgatttagacgtctcatcagggggggagtcagtctcagtcaggacacagcatggacatgagggtccccgctcagctcctggggctcctgctactctggctccgaggtgccagatgtgtcatccagatgacccagtctccatccctccctgtccgcatctgtaggagacagagtcatcatcacttgccgggcaagtcagagcaattagaacgttatttaaattggtaatacaaacaagaaaaccgaagggaaacgccccctagaacctcctagattctatcggttcacttcctactttgctggaggtcggggtccagttcgaaggttcaggtcggactaggtggactcgtaggggacagtaattcacctctacaccatccaccagtctcgcaggtctggagtctttgaccttaacttcttctacgtacaacgtagtaacgttaccacgttccctactaccgtttcgccccgttaggaccctagtacgtaggtataactacgaaacgtcgtagttggacctcgacctaactcttcctgttacc

SEQ ID NO: 81336 - DNA, 541 bp, Homo sapiens
  misc_feature: GYAE6OF01BL5BZ.52.1.A01.1.454.CMB.1.raw
  modified_base (328)..(328): a, c, t, g, unknown or other
  misc_feature (328)..(328): n is a, c, g, or t
  modified_base (368)..(368): a, c, t, g, unknown or other
  misc_feature (368)..(368): n is a, c, g, or t
tcagcgcagtacgacacgaccggtgctcgatttagacgtctcatcagggcacagcatggacatgagggtccccgctcagctcctggggctcctgctactctggctccgaggtgccagatgtgtcatccagatgacccagtctccatcctccctgtccgcatctgtaggagacagagtcatcatcacttgccggacaagtcagagcattagaacgttatttaaagttggtatacaaacagaaaccgaagggaaacgcccctagaactcctagatctatggtcatccactttgctgagtgggtccatctaagttcagtgacagtgatcgnggacagatcactctcacatcactagtctgcgagctgagtntttgactacgttactctagtacaactagtacgttactacgttccctactaccgtttcggcccgttagggacctagttaggtacggtaatacgtacgaaacgtacgtggtcgtactacgccaaccgtacttcgttacttcctactaccttcccttacccgcttacgtcgtaacg

SEQ ID NO: 81337 - DNA, 575 bp, Homo sapiens
  misc_feature: GYAE6OF01CHQ4S.52.1.A01.1.454.CMB.1.raw
  modified_base (159)..(159): a, c, t, g, unknown or other
  misc_feature (159)..(159): n is a, c, g, or t
  modified_base (170)..(170): a, c, t, g, unknown or other
  misc_feature (170)..(170): n is a, c, g, or t
  modified_base (202)..(202): a, c, t, g, unknown or other
  misc_feature (202)..(202): n is a, c, g, or t
  modified_base (229)..(229): a, c, t, g, unknown or other
  misc_feature (229)..(229): n is a, c, g, or t
  modified_base (243)..(243): a, c, t, g, unknown or other
  misc_feature (243)..(243): n is a, c, g, or t
  modified_base (310)..(310): a, c, t, g, unknown or other
  misc_feature (310)..(310): n is a, c, g, or t
  modified_base (456)..(456): a, c, t, g, unknown or other
  misc_feature (456)..(456): n is a, c, g, or t
  modified_base (499)..(499): a, c, t, g, unknown or other
  misc_feature (499)..(499): n is a, c, g, or t
tcagcgcagtacgacacgaccggtgctcgatttagacgtctcatcagggcacagcatggacatgagggtccccgctcagctcctggggctcctgctactctggctccgaggtgccagatgtgtcatccagatgacccagtctccatccctccctgtccnatctgtagganacagatcatcatcacttgccggcaagtcagancaattagaacttattaaatgatcaaanagaaaccaggaacnccctagaactcctgatctattggttcatcctatttgcttgaggtcggtccatcaaggttcagtcganagtggatcgtaggacaagtaattcaacttcacaccatacctaaccgtaacgtccgtgacgagggtaccttagggtaaggttacttttacggaccttaacgtttaacttccgtagtacaacgtaggtacttacgtacgttacccttntaaccgtttccggaccgttagggaacctaagtgttacgattanaaccaaagtacgtgtcggatcggcctaagctgttccgtctttaacctccgtttacccctcccgacttagtgtaacg

SEQ ID NO: 81338 - DNA, 520 bp, Homo sapiens
  misc_feature: GYAE6OF01BP85T.52.1.A01.1.454.CMB.1.raw
  modified_base (337)..(337): a, c, t, g, unknown or other
  misc_feature (337)..(337): n is a, c, g, or t
tcagcgcagtacgacacgaccggtgctcgatttagacgtctcatcagggcacagcatggacatgagggtccccgctcagctcctggggctcctgctactctggctccgaggtgccagatgtgtcatccagatgacccagtctccatcctccctgtccgcatctgtaggagacagagtcatcatcacttgccgggcaagtcagagcattagaacgtatttaaatggtatcaacagaaaccagggaaagcccctgaactcctgatctatggttcatccactttgctgagtgggtcccatcaaggttcagtggcagtggatcgtgggacagaatcactcncaccatcacctagtctgcgagtctgagttatttgctaacttcttctgtacaactagtacgttacacgttccctctaccgtttcggccctgggacctagtacggtaggtattactaccaaacgtactgtcgtctcgcctacctattcctcgttcttctacttcccttaccccgctactcgtacg

SEQ ID NO: 81339 - DNA, 551 bp, Homo sapiens
  misc_feature: GYAE6OF01EEKOT.52.1.A01.1.454.CMB.1.raw
  modified_base (310)..(310): a, c, t, g, unknown or other
  misc_feature (310)..(310): n is a, c, g, or t
  modified_base (346)..(346): a, c, t, g, unknown or other
  misc_feature (346)..(346): n is a, c, g, or t
  modified_base (418)..(418): a, c, t, g, unknown or other
  misc_feature (418)..(418): n is a, c, g, or t
tcagcgcagtacgacacgaccggtgctcgatttagacgtctcatcagggggggagtcagtctcagtcaggacacagcatggacatgagggtccccgctcagctcctggggctcctgctactctggctccgaggtgccagatgtgtcatccagatgacccagtctccatccctccctgtccgcatctgtaggagacagagtcatcatcacttgccgggcaagtcagagacattagaacgttattaaagttggtatacaacaagaaaccaaggaaacgcccctagaactcctgatctatgtcatcctacttnctgagtcgggtccagtacgagtcagtgcagtgatgnggacagtaatcatctacactactcactagtctgacgagctaggtacgttatttagaccttaactttaccgtnttacggtacaacctaaggttacgttaactccgtttaccctaccgttccgttacccggccgttacggactaggttacgtaggtaatactaaccgtaaagtacgtggtcgctacgacccactgttcctgttaccc

SEQ ID NO: 81340 - DNA, 553 bp, Homo sapiens
  misc_feature: GYAE6OF01EREL9.52.1.A01.1.454.CMB.1.raw
tcagcgcagtacgacacgaccggtgctcgatttagacgtctcatcagggcacagcatggacatgagggtccccgctcagctcctggggctcctgctactctggctccgaggtgccagatgtgtcatccagatgacccagtctccatcctccctgtccgcatctgtaggagacagagtcatcatcacttgccggcaagtcagagcattaagaacgttatttaaagttggtatacaaacagaaaccagggaaacgcccctagaactcctgatctatggttcatccatttgctgaggtcgggtccagtcgaagtcagtgacagtgatcgtgggacagaattcactctcacatccacagtctgacgaggctagacggtatttcgactaaacttcttctacgtacaactagtacgtttactacgtttccctagtaccgttccggcccgtagggacctagtagtggtaatactacgaaacgtacgtcggtcggacttcgacctaacctattcctacgtttacttacctacttcccgttacccgaccttagtcttaacgg

SEQ ID NO: 81341 - DNA, 585 bp, Homo sapiens
  misc_feature: GYAE6OF01EXVTO.52.1.A01.1.454.CMB.1.raw
  modified_base (194)..(194): a, c, t, g, unknown or other
  misc_feature (194)..(194): n is a, c, g, or t
  modified_base (250)..(250): a, c, t, g, unknown or other
  misc_feature (250)..(250): n is a, c, g, or t
  modified_base (378)..(378): a, c, t, g, unknown or other
  misc_feature (378)..(378): n is a, c, g, or t
tcagcgcagtacgacacgaccggtgctcgatttagacgtctcatcagggcacagcatggacatgagggtccccgctcagctcctggggctcctgctactctggctccgaggtgccagatgtgtcatccagatgacccagtctccatcctccctgtccgcatctgtaggagacagagtcatcatcacttgccggnaagtcagagcattaagaacgttatttaaatggtatcaaacagaaaccagggaaacnccctagaactccagatctatggtcactccacttttgctgacggtcgggtcccatacgtaaggttcaggtcggactaggtggatcgtgggacagtaattcactctcactataccgactagtctgcaggntagtagtatttgactaactttacttctagtcaaactagtaacgtttacctacggtttcccttactaccgtttccgcccgttagggacctagttacgtacggtattaacctaacgtaaaccgtaacgttggtaccgggctacggacctaacccgtattcgttcgttacctttacctaccttacccttccccgtacctacttcgtaacg

SEQ ID NO: 81342 - DNA, 582 bp, Homo sapiens
  misc_feature: GYAE6OF01CHHO3.52.1.A01.1.454.CMB.1.raw
  modified_base (234)..(234): a, c, t, g, unknown or other
  misc_feature (234)..(234): n is a, c, g, or t
  modified_base (248)..(248): a, c, t, g, unknown or other
  misc_feature (248)..(248): n is a, c, g, or t
  modified_base (372)..(372): a, c, t, g, unknown or other
  misc_feature (372)..(372): n is a, c, g, or t
  modified_base (375)..(375): a, c, t, g, unknown or other
  misc_feature (375)..(375): n is a, c, g, or t
  modified_base (530)..(530): a, c, t, g, unknown or other
  misc_feature (530)..(530): n is a, c, g, or t
tcagcgcagtacgacacgaccggtgctcgatttagacgtctcatcagggcacagcatggacatgagggtccccgctcagctcctggggctcctgctactctggctccgaggtgccagatgtgtcatccagatgacccagtcctccactccctccctgtccgcatctgtaggagacagagtcatcatcacttggccggcaagtcagagctatagaacttattaatggtatacaanagaaacgaggaacnccctagaactcctagatctagtgtcactcctatttgctgaggtcgggtcctatcgaaggttcagtggacgtaggtggtatcgtaggacgtataacgttcactcctacaactacgtacactgtcncgnacggtctaggtagtatttacgactaacgtttactcgttagtaccgtaactagtaccgtttacgtaccgttcccttacgtaccgtttccggtacccgttacggtaccgtaacgtaggttacgtaacgttaacgtacctaaaaggtacgtgtacgtntccgactactactcttacgtcttactaccttaccctccgtcctagtcgtacg

SEQ ID NO: 81343 - DNA, 617 bp, Homo sapiens
  misc_feature: GYAE6OF01EQDWD.52.1.A01.1.454.CMB.1.raw
tcagcgcagtacgacacgaccggtgctcgatttagacgtctcatcaggggggagtcagtctcagtcaggacacagcatggacatgagggtccccgctcagctcctggggctcctgctactctggctccgaggtgccagatgtgtcatccagatgacccagtctccatccctccctgtccgcatctgtaggagacagagtcatcatcacttggccggcaagtcagagcattagaacgttatttaaattggtatacaacaagaaaccagggaaacgcccctagaacctcctgatctatggttcatcctactttgctgagtcgggtccagtcgaaggttcagtggcgagtggatcgtgggacagtattcactctacaccatccactagtctgacaggtctaggaggttattttcggaccttaactttactttcttagtacctaaacgtagttaacgtttacctaccggtttccccttacgttacccgttttccgggaccccgttacggggtaaccctaaaggtttacggtacggttaacgttaacgttaacccgtaaaaaccggtaaccgttgggttacggaccttacggaccctaaccctagttccttcggtttacccg

SEQ ID NO: 81344 - DNA, 562 bp, Homo sapiens
  misc_feature: GYAE6OF01ALQVV.52.1.A01.1.454.CMB.1.raw
  modified_base (311)..(311): a, c, t, g, unknown or other
  misc_feature (311)..(311): n is a, c, g, or t
  modified_base (317)..(317): a, c, t, g, unknown or other
  misc_feature (317)..(317): n is a, c, g, or t
  modified_base (344)..(344): a, c, t, g, unknown or other
  misc_feature (344)..(344): n is a, c, g, or t
tcagcgcagtacgacacgaccggtgctcgatttagacgtctcatcagggcacagcatggacatgagggtccccgctcagctcctggggctcctgctactctggctccgaggtgccagatgtgtcatccagatgacccagtctccatccctccctgtccgcatctgtaggagacagagtcatcatcacttgccgggcaagtcagagcattagaacgttatttaaatggtatacaacagaaaccagggaaacgccctagaactcctgatctatggttcactcctacttgctgagtcgggtccagtcaaggttnagtggngagtggatcgtggacagactacactcncaccactccacctagtctgcgtaggctaggtagttagtttacgtacctaactttacgttcgttacgtactaacgtagtacgttacgtaccgttcccctacttaccgtttcccggcccgtacgggtacctagttacggtgtaacgtactaaccaacggtactcggtacggactacgtcactagtccttcgtccttactacttcctaccgcctgtctacg

SEQ ID NO: 81345 - DNA, 539 bp, Homo sapiens
  misc_feature: GYAE6OF01BQ62W.52.1.A01.1.454.CMB.1.raw
  modified_base (272)..(272): a, c, t, g, unknown or other
  misc_feature (272)..(272): n is a, c, g, or t
tcagcgcagtacgacacgaccggtgctcgatttagacgtctcatcagggggggagtcagtctcagtcaggacacagcatggacatgagggtccccgctcagctcctggggctcctgctactctggctccgaggtgccagatgtgtcatccagatgacccagtctccatcctccctgtccgcatctgtaggagacagagtcatcatcacttgccgggcaagtcagagcattagaacgtatttaaattggtatacaacagaaaccagggaaacncccctgaactcctgatctatggttcatcctacttgctgagtcgggtccatcgaagttcagtgcagtgatcgtggacagatcactctcacatcacctgtctgcagctgagtatttgacttaacttacttctgtacaactagtagttaccgtacgttcccctcgttaccgtttcccggcccgtacgggtaccctaagttacggtaggtaacgtacgtaacgaaacgtacgtaggtcggacgtcgaccctaacctcttcgtcgttacccg

SEQ ID NO: 81346 - DNA, 615 bp, Homo sapiens
  misc_feature: GYAE6OF01EXX7C.52.1.A01.1.454.CMB.1.raw
tcagcgcagtacgacacgaccggtgctcgatttagacgtctcatcagggcacagcatggacatgagggtccccgctcagctcctggggctcctgctactctggctccgaggtgccagatgtgtcatccagatgacccagtctccatcctccctgtccgcatctgtaggagacagagtcatcatcacttgccggcaagtcagagcattagaacgtatttaaattggtatacaacagaaaccaaggaaacgccctagaactcctgatctatggttctatcctactttgctggaggttcggggtcccatacgtaaggtttcaggtggactaggtggatcgtagggacagtaattcactctacactactccaccagtctcgcgaggtctaggtaggtattttcgacttaacttacttactacgtaccaaacgtagtacgtttaacctacgtttccctaccgttaccgttccggaccccgttaggggaccctaggttagtaggtaacttactaacctaaaacggtacgttaggtacggtccttaggaccctaaccgttaacttccgttagttccctttacgttacccttccctttaacccccggccttagtcccgttaag

SEQ ID NO: 81347 - DNA, 658 bp, Homo sapiens
  misc_feature: GYAE6OF01BU8AC.52.1.A01.1.454.CMB.1.raw
  modified_base (296)..(296): a, c, t, g, unknown or other
  misc_feature (296)..(296): n is a, c, g, or t
  modified_base (645)..(645): a, c, t, g, unknown or other
  misc_feature (645)..(645): n is a, c, g, or t
tcagcgcagtacgacacgaccggtgctcgatttagacgtctcatcagggggggagtcagtctcagtcaggacacagcatggacatgagggtccccgctcagctcctggggcctcctgctactctggctccgaggtgccagatgtgtcatccagatgacccagtcctccatccctccctgtccgcatctgtaggagacagagtcatcatcacttggccgggacaagtcagagactaagttaagaacgttaatttaaaagttggtaatacgaaacaacgaaaacccgaagggaaaccncccctagaaacctccgtagacttctaagttcggttactacttacctaacttttcggctaggtaacggtcggggtacccctagttaccggtaaagggtttccgggtaggtcgtaaggttagggaagttcggtaaggggtaacctaaggtttaactttttaccttaccacctacgtacccggactaacgtacctgacgtaacgtccgtaaaggaactagttactacgaactaaactattaacttactacgtaacaatagtatagtaactacttccgtaccctcttacgtacgttcgggacggaacggaccgtaagggtgaacgtagaccgaggaactacgtggtcgtactnacctactgttccg

SEQ ID NO: 81348 - DNA, 529 bp, Homo sapiens
  misc_feature: GYAE6OF01DVAR1.52.1.A01.1.454.CMB.1.raw
  modified_base (97)..(97): a, c, t, g, unknown or other
  misc_feature (97)..(97): n is a, c, g, or t
  modified_base (227)..(227): a, c, t, g, unknown or other
  misc_feature (227)..(227): n is a, c, g, or t
  modified_base (271)..(271): a, c, t, g, unknown or other
  misc_feature (271)..(271): n is a, c, g, or t
  modified_base (391)..(391): a, c, t, g, unknown or other
  misc_feature (391)..(391): n is a, c, g, or t
  modified_base (421)..(421): a, c, t, g, unknown or other
  misc_feature (421)..(421): n is a, c, g, or t
tcagcgcagtacgacacgaccggtgctcgatttagacgtctcatcagggggggagtcagtctcagtcaggacacagcatggacatgagggtccccgntcagctccgtggggctcctgctactctggctccgaggtgccagatgtgtcatccagatgacccagtcctccatcctcctgtccgcatctgtaggagacagagtcatcatcacttgccggacaagtcagancattagaacgttatttaatggtatcaacagaaaccagggaaacncccctagaactcctgactctatggtcatcactttgctggagtcgggtccatcgaagttcagtggcaggtgatcgtggacagaattcactctcacatcactagtctgcaggctaggagttntttcgactaactttcttctacgtacaacgngtaacttacctcgttccctactaccgtttccggccctagggaccctagtacgtaggtattaacacgtaaacgtacgtggtacgctcggacctactcttcgttgttacc

SEQ ID NO: 81349 - DNA, 872 bp, Homo sapiens
  misc_feature: GYAE6OF01DFZ27.52.1.A01.1.454.CMB.1.raw
  modified_base (140)..(140): a, c, t, g, unknown or other
  misc_feature (140)..(140): n is a, c, g, or t
  modified_base (172)..(172): a, c, t, g, unknown or other
  misc_feature (172)..(172): n is a, c, g, or t
tcagcgcagtacgacacgaccggtgctcgatttagacgtctcatcagggggggagtcagtctcagtcaggacacagcatggacatggacgggtccccgctcagctccgtggggctcctgctactctggctccggaggtcnccagatgtgtcactccagatcgacccagtccnccatccctcctgtccgcattctaggtaggacgacaggtactcaatcactcctacgttcgggaccgggactaacggtcgaacggacgactaaagtttaacgtaaacggttttaaattttaaacgttaggttaactaacgaaaaccgaaacggaaaaccggtaaacggggaaaccgtcccccgttaaggtaaccttaccgtagtaacttcgttaacgtttccgggtttactaccttaccgtttaacgttttcggtaccggttagggtaccgggtaccggggtaccctaacggttaaccggttaacggtttacgacgggttcgggacgtaggggttaggtacgtacggtacggggaactaagttaacgttcctaaccttaccctaacccaacgtacttaccaccgtagttccgtacggtcgtaacgggtcgttacggtacggtttacgtttacgaacctttaaccgttttactaccgttacgttaaccgtaaacggtttacgttaaccgttttaaccgtacccgtttaccccttaccggtttaacccggtttccccggggtaccggttacgggtaaccggtttaacggtacgggttaaggttaaaaccgttaccgttaaaacccggaaaaccggttcggtttaccggggtacgtaccgttaccggtaacccttaccgttacgtttcccgttcgttttaacccg

SEQ ID NO: 81350 - DNA, 661 bp, Homo sapiens
  misc_feature: GYAE6OF01B582E.52.1.A01.1.454.CMB.1.raw
  modified_base (511)..(511): a, c, t, g, unknown or other
  misc_feature (511)..(511): n is a, c, g, or t
  modified_base (619)..(619): a, c, t, g, unknown or other
  misc_feature (619)..(619): n is a, c, g, or t
  modified_base (651)..(651): a, c, t, g, unknown or other
  misc_feature (651)..(651): n is a, c, g, or t
tcagcgcagtacgacacgaccggtgctcgatttagacgtctcatcagggcacagcatggacatggagggtccccgctcagctcctggggctcctgctactctggctccgaggtgccagatggtgtcatccagatcgaccccagtcctccatccctccctgtccgcatctggtaggagacagagtcatcatcacttggccggacaagtcaagagctaagttaagaacgttaattttaaagtggtaatacgaaacgaacggaaaaccgagggaaaccgtcccctaggtaaaccttccgtagacttcgttaagttcggttacacttccgttacttttcggacgttaggtacgggttccggggtaccctaagttacggtaacggtttcgaaggttcggacgtaggtcggtacgtcggtagggaactagtaacgttctacttcgtaccaactactacccaactacgttccgagacgacggtctaggtaggttacttttcgactttaacttacgttntacgtacaagtagtacgttacctacgtttccctagttacccgttccgaccgtacggtacctagtacgtacgtatacgtacgaaacgttcgtgtcgactcgacctactnttcgtacgttccttacgtaccttccacccgtntcgttctacg

SEQ ID NO: 81351 - DNA, 578 bp, Homo sapiens
  misc_feature: GYAE6OF01EI2T6.52.1.A01.1.454.CMB.1.raw
  modified_base (381)..(381): a, c, t, g, unknown or other
  misc_feature (381)..(381): n is a, c, g, or t
tcagcgcagtacgacacgaccggtgctcgatttagacgtctcatcagggcacagcatggacatgagggtccccgctcagctcctggggctcctgctactctggctccgaggtgccagatgtgtcatccagatgacccagtctccatccctccctgtccgcatctgtaggagacagagtcatcatcacttggccgggacaagtcagagctaattaagaacgttaattttaaagttggtaatacaaacaagaaaaccgaagggaaacgcccctagaactcctgatctatgtactatcctactttgctggaggtcggggtccctagtcgtaaggttcaggtggctaggtggatcgtgggaacagtaatcactctcacatccacngtctgcaggctaggagttatttagacttaactttacttctacgtacaacgtagtacgtttactaccgtttccctacgtaccgtttccggacccgtcgggtaacctagtacggtggtaatacgaacgtaacgtagtggtcgctcgaccacttatccgttacgttctcctaccttccccgtaccgacctcgtcgtaacg

SEQ ID NO: 81352 - DNA, 807 bp, Homo sapiens
  misc_feature: GYAE6OF01EI4G7.52.1.A01.1.454.CMB.1.raw
tcagcgcagtacgacacgaccggtgctcgatttagacgtctcatcagggcacagcatggacatgacgggtccccgctcagcctccgtggggctcctgctactctggctccgaggtgccagatgtgtcatccagatcgacccagtctccactccctccctgtcccgcatctaggtaggagacagtacgtacactcactctacgtcggaccggacaagtcagacgactaaagcccttaaagttaaaacgttagttttaaattcggaaactaaccgaaaaccgaaagggaaaaccacccgggtaacgacccctacgtaaccttacctcgtattacgttacgtacgtttacctacttaccttacgtttcgatttttccgggtaccgtcggtaacgttacgtacgtaggtcgtaggacgaggtacgtacgggtaactacggaagttacctaacgttacctaccgtacctaacctaacctaccctaacggtaccctacggtcctacggaccgttggtaacgggttacgttacgggttacgtttaccgttaacctttaaccgtttacgttccaaaacggttaccgtaacggttaacgtttaccggtttacccccgttaccgtttacccgtttaacccggttacccgggttacccgggttacccggtaaccggtaaccggttaacggtaactaacggttaaactaacgtaaaccggtaacggttacgtcggttacgaccgtacctacctacccgttacttcccgttacctaccttcccgttacccgtaccttacccgttcttacggtacttaacg

SEQ ID NO: 81353 - DNA, 755 bp, Homo sapiens
  misc_feature: GYAE6OF01E5SPY.52.1.A01.1.454.CMB.1.raw
tcagcgcagtacgacacgaccggtgctcgatttagacgtctcatcaggggagtcagtctcagtcaggacacagcatggacatgagggtccccgctcagctccgtggggcctcctgctactctggctccgaggtgccagatgtgtcatccagatcgacccagtcctccatccctccctgtccgctactcgtaggtaggacgacgaggtacgtactactacattacctacgttaccggacccgtaataacgtcgaacggacgtacttaagtttaaacggaaacgttttaaattttaaacggtttggtaactaaccgaaaacgaaacgtaaaacccgggaagggtaaaaccccgtcccctaagtaaccctccgtagactttacgttaacgttcggttacctacgttccttagtttcgacgttaggtacgggttccgggtaccctaagttaccggtaaggtcgtacgggtcggtacggtaggttacgtacgttcgggtaacgggaaacctagtttaacgtacctacttaccgacctaaccgtcctaccgtaacgtgttaccgtaggaccggtagttcgtaaggttacgtttgtttaccctaacgtttaacctttcgtacgtacgtaacaaacggttcgttaacttaccgttccgttaccttacccgttacggttcccgaccgttacgaccgttagtaccggtaagtacttaacgaacgaaacgttcgtggccacgtcgaccctaagtcttcctagttcc

SEQ ID NO: 81354 - DNA, 588 bp, Homo sapiens
  misc_feature: GYAE6OF01BD6VJ.52.1.A01.1.454.CMB.1.raw
tcagcgcagtacgacacgaccggtgctcgatttagacgtctcatcagggcacagcatggacatgagggtccccgctcagctcctggggctcctgctactctggctccgaggtgccagatgtgtcatccagatgacccagtctccatcctccctgtccgcatctgtaggagacagagtcatcatcacttgccggacaagtcagagcattagaacgttatttaaatggtatacaacagaaaccaggaaacgccctagaactcctgatctagtggttcatcctatttgcgtgaggtcgggtcccatcaaggttcaggtggctaggtcgagtcgtaggacagaacttcactctacacctactcacctagtctgacgtagctaggtagttatttgactaaacgtttcttacgtacgtacgaacgtagtacgttaccgtacgtttccctacttaccgtttcggcccgtagggtaccctagttacggtacgtattaacgtacgtaaacgtaacgtcggtacgcgtacggacctaccgtacttcgttcgttaccttcgttaccttacccgttaccccgtaccttacgttcgtaacg

SEQ ID NO: 81355 - DNA, 584 bp, Homo sapiens
  misc_feature: GYAE6OF01AFFJN.52.1.A01.1.454.CMB.1.raw
  modified_base (275)..(275): a, c, t, g, unknown or other
  misc_feature (275)..(275): n is a, c, g, or t
  modified_base (394)..(394): a, c, t, g, unknown or other
  misc_feature (394)..(394): n is a, c, g, or t
  modified_base (428)..(428): a, c, t, g, unknown or other
  misc_feature (428)..(428): n is a, c, g, or t
  modified_base (553)..(553): a, c, t, g, unknown or other
  misc_feature (553)..(553): n is a, c, g, or t
  modified_base (578)..(578): a, c, t, g, unknown or other
  misc_feature (578)..(578): n is a, c, g, or t
tcagcgcagtacgacacgaccggtgctcgatttagacgtctcatcagggggggagtcagtctcagtcaggacacagcatggacatgagggtcccccgctcagctcctggggctcctgctactctggctccgaggtgccagatgtgtcatccagatgacccagtctccatcctccctgtccgcatctggtaggagacagagtcatcatcacttgccgggcaagtcagagctattagaacgttatttaaatggtatcaacagaaaccgagggaaacncccctagaacctcctagtatctagtggttcatcctactttgctggtaggtcgggtccagtacgaaggttcagtggctaggtggatcggtagggactagtaacttcacttcctacaaccntaccacgtacgtctggactagggctaggtagttntttacgaccttaactttctcgttcgactaacgtgtaacgttactaccgtttcccttacgtccgtttaccgggcccgttagggacctagttacgtagtaactacgtaaccgaaacgtcgtaggtcncgttacccgacttactacgtcgttnttcccg

SEQ ID NO: 81356 - DNA, 573 bp, Homo sapiens
  misc_feature: GYAE6OF01E26QY.52.1.A01.1.454.CMB.1.raw
tcagcgcagtacgacacgaccggtgctcgatttagacgtctcatcagggcacagcatggacatgagggtccccgctcagctcctggggctcctgctactctggctccgaggtgccagatgtgtcatccagatgacccagtctccatcctccctgtccgcatctgtaggagacagagtcatcatcacttgccgggcaagtcagagcattagaacgttatttaaattggtatcaacagaaaccagggaaacgcccctagaactcctgatctatggttcatccactttgctggagtcggggtcccatcaaggttcagtggcagtgatcgtggacagaattcactctacaccataccacagtctgcgaggctagagtattttgacttaactttacttctagtacaacgtagtaacgtttacctacgtttccctacttaccgtttccggcccgtacgggaaccctagtacgtacggtaactacgtaaccaaacggtacttggtacggcttacggccctaaccattccgttgtttaccttacctaacttcccgttacccccgcttaacgttcgttaacg

SEQ ID NO: 81357 - DNA, 600 bp, Homo sapiens
  misc_feature: GYAE6OF01A29RT.52.1.A01.1.454.CMB.1.raw
  modified_base (257)..(257): a, c, t, g, unknown or other
  misc_feature (257)..(257): n is a, c, g, or t
  modified_base (275)..(275): a, c, t, g, unknown or other
  misc_feature (275)..(275): n is a, c, g, or t
  modified_base (587)..(587): a, c, t, g, unknown or other
  misc_feature (587)..(587): n is a, c, g, or t
tcagcgcagtacgacacgaccggtgctcgatttagacgtctcatcagggcacagcatggacatgagggtccccgctcagctcctggggctcctgctactctggctccgaggtgccagatgtgtcatccagatgacccagtctccatcctccctgtccgcatctgtaggagacagagtcatcatcacttgccgggacaagtcagagctaattagaacgttattttaaagttggtatacaaacagaaaccagggaaacncccctagaactcctgatntatggttcactcctactttgctgacggtcggggtccagtcgtaaggttcaggttggacgtaggtggatcgtaggaactaggtaacttcactctcacctactacactagtctagcaggtctaggtaggttatttcgacttaactttacgttctacgtaccaacgtagtacgtttaacctccggttaccctcttacccgtttccgggccctacggggtaacctagttaggttacgaattaactacgaaacgtaacgtgtacggcttacgaccgtacctacttctcgttacctttaccgtacttcccgttacccnctacgttctaacg

SEQ ID NO: 81358 - DNA, 557 bp, Homo sapiens
  misc_feature: GYAE6OF01D2107.52.1.A01.1.454.CMB.1.raw
  modified_base (97)..(97): a, c, t, g, unknown or other
  misc_feature (97)..(97): n is a, c, g, or t
  modified_base (218)..(218): a, c, t, g, unknown or other
  misc_feature (218)..(218): n is a, c, g, or t
  modified_base (227)..(227): a, c, t, g, unknown or other
  misc_feature (227)..(227): n is a, c, g, or t
  modified_base (234)..(234): a, c, t, g, unknown or other
  misc_feature (234)..(234): n is a, c, g, or t
tcagcgcagtacgacacgaccggtgctcgatttagacgtctcatcagggggggagtcagtctcagtcaggacacagcatggacatgagggtccccgntcagctcctggggctcctgctactctggctccgaggtgccagatgtgtcatccagatgacccagtctccatccctccctgtccgcatctagtagagacagagtcatcatcacttgccgganaagtcagancaataanacggtaattaagtggtatacaacaagaaaaccagggtaaacgccctagtaactacctgtactctatggttacatccactttgctgagtcgggtaccagtacaaggttcagtggcagtcgatcgtaggtacagtaactacactactcaaccatccaactagtactgcgtagctgtaggtatttgactaacttctatgtacaacaagtacttacgtacgttccctataccgtttcggcccttagggaacctaacggtgtaacggtataacgtaaccaaacggtaaccgtggtacggtactcggtaccaactacttcgtgttaccc

SEQ ID NO: 81359 - DNA, 857 bp, Homo sapiens
  misc_feature: GYAE6OF01E5NUL.52.1.A01.1.454.CMB.1.raw
tcagcgcagtacgacacgaccggtgctcgatttagacgtctcatcaggggggagtcagtctcagtcaggacacagcatggacatggacgggtccccgctcagctccgtggggctcctgctactctggctccggaggtgccagatgtgtcatccagatcgacccagtcctccactccctccctgtcccgcatctggtaggagacagagtcatcatctacgttcggccgggacaagtcaggagtactaagttaacgaacgtttaattttaaagttggtaactaccgaaacaaacggaaaaccgaacggggaaacccgcccctacgtaacctcctagtacttactagttcggttacacttccctacgttttcgcgttacgggtacgggtcgggtaccctaagttacgtaaacggttcgaaggtcggacgtagggttcggtacgttacggtaggggtaactacggttaaaccttccctaaccgttaccctacccaaccctaaccttacccgacccggtacgttccgtacggtaccggtaacgggttcgttaacgggttaacggtttacgtttttacgaacccttttaaacccgtttaccgtttacgttaacggtaaccgtaaacgttaaccggttaaccgtttaacccgttacccggttttaccccgtttaacccggtttaccccggttttaccccgggtacccgggttaaccggggtaacccttaaggtttaacgggtaaccggttaaaacgtttaaccggtaaaacccggttaaaaacccggttccgggtttagggtacccggttacccgttacggaaccccttaacccgttcgttttaccccggttcggttttacccc

SEQ ID NO: 81360 - DNA, 588 bp, Homo sapiens
  misc_feature: GYAE6OF01DEGHN.52.1.A01.1.454.CMB.1.raw
  modified_base (196)..(196): a, c, t, g, unknown or other
  misc_feature (196)..(196): n is a, c, g, or t
  modified_base (222)..(222): a, c, t, g, unknown or other
  misc_feature (222)..(222): n is a, c, g, or t
tcagcgcagtacgacacgaccggtgctcgatttagacgtctcatcaggggggagtcagtctcagtcaggacacagcatggacatgagggtccctgctcagctcctggggctcctgctgctctggctctcgaggtgccagatgtgtcatccagatcgacccagtcctccattccctccctgtctgcatctatagganacagaatcaccatcacttggccgggnagtcgagacattagcatgtatctgaattggtatcagacaaaaaccgaggacacgacccctaaactcctgactcctcgatcgcactcctactttacggaaacgtacggggtcccaataccgtaaaggtttcaagggtaggaacggtcggtcttcgtagggtactaagttactttttaccttaccacctatcagcgaggctgccacgcctagaacgattagttacgactaactattaacttaccgtataacaacgtattattacgtacttacgttccctcccgcgttccgtaaccgggtttccgggggaccggggggtaacgaaggggtacggaggtaactcgaaacgtcggaaacgtggtcggtacg

SEQ ID NO: 81361 - DNA, 551 bp, Homo sapiens
  misc_feature: GYAE6OF01B4YIC.52.1.A01.1.454.CMB.1.raw
  modified_base (262)..(262): a, c, t, g, unknown or other
  misc_feature (262)..(262): n is a, c, g, or t
tcagcgcagtacgacacgaccggtgctcgatttagacgtctcatcaggggggagtcagtctcagtcaggacacagcatggacatgagggtccccgctcagctcctgggctcctgctactctggctccgaggtgccagatgtgtcatccagatgacccagtctccatcctccctgtccgcatctgtaggagacagagtcatcatcacttgccggcaagtcagagcatagaacgtatttaaatgtatcaacagaaacaggaacncccctgaactcctgatctatgttcatcctacttgctgagtcgggtccatcaaggtcagtgcgtagtggatcgtagggacagtaatcactctacacctatccacagtctgacaggctagaggttattttcgactaacctttactttctagtaccaagtaagtacttaaccgactttccctactacgtttaccggccctagggacctaacgtagtcgggtaactacgttaacccgaaaacgtaaccgtggttaggtacctacggaccctaacccgtatccgttgttacccg

SEQ ID NO: 81362 - DNA, 502 bp, Homo sapiens
  misc_feature: GYAE6OF01APFTK.52.1.A01.1.454.CMB.1.raw
  modified_base (351)..(351): a, c, t, g, unknown or other
  misc_feature (351)..(351): n is a, c, g, or t
  modified_base (365)..(365): a, c, t, g, unknown or other
  misc_feature (365)..(365): n is a, c, g, or t
tcagcgcagtacgacacgaccggtgctcgatttagacgtctcatcagggcacagcatggacatgagggtccccgctcagctcctggggctcctgctactctggctccgaggtgccagatgtgtcatccagatgacccagtctccatcctccctgtccgcatctgtaggagacagagtcatcatcacttgccgggcaagtcagagcattagaacgttatttaaattggtatcaacagaaaccagggaaacgccctgaactcctgatctatggttcatccatttgctgaggtgggtcccatcaaggttcagtggcagtggatcgtgggacagaattcactctcaccatcaccntctgcagctgagtntttgctaacttacttctgtcaactagtacttactacgttccctctaccgtttccggcccgtagggacctagtagtggaatacgtacaaacgtactgtggctgccactatctgtcttcacttcctacccgctgtctag

SEQ ID NO: 81363 - DNA, 568 bp, Homo sapiens
  misc_feature: GYAE6OF01DTJMP.52.1.A01.1.454.CMB.1.raw
  modified_base (523)..(523): a, c, t, g, unknown or other
  misc_feature (523)..(523): n is a, c, g, or t
  modified_base (559)..(559): a, c, t, g, unknown or other
  misc_feature (559)..(559): n is a, c, g, or t
tcagcgcagtacgacacgaccggtgctcgatttagacgtctcatcagggcacagcatggacatgagggtccccgctcagctcctggggctcctgctactctggctccgaggtgccagatgtgtcatccagatgacccagtctccatccctccctgtccgcatctgtaggagacagagtcatcatcacttgccgggacaagtcagagcaattagaacgttatttaaatggtatcaacagaaaccagggaacgccctagaacctctgatctatggttcatccatttgctgagtcgggtccatcaagttcagtgacagtgatcgagggacagtaacttcactctacacctactcacctagtctgcaggtctggaaggtatttgacttaactttacgttctgtacaacgtagtacgtttaccaccgttttccctacttacccgtttcgggaccccgttaggggtaccctaagttacggtacggtattaacgtcgaaaaaccgtacttggtggtacctgaccaacgtnttccgtgttacttccgtacttcccgttcccaccgtnttcgtaacg

SEQ ID NO: 81364 - DNA, 532 bp, Homo sapiens
  misc_feature: GYAE6OF01EURUU.52.1.A01.1.454.CMB.1.raw
  modified_base (329)..(329): a, c, t, g, unknown or other
  misc_feature (329)..(329): n is a, c, g, or t
  modified_base (355)..(355): a, c, t, g, unknown or other
  misc_feature (355)..(355): n is a, c, g, or t
  modified_base (359)..(359): a, c, t, g, unknown or other
  misc_feature (359)..(359): n is a, c, g, or t
tcagcgcagtacgacacgaccggtgctcgatttagacgtctcatcagggcacagcatggacatgagggtccccgctcagctcctggggctcctgctactctggctccgaggtgccagatgtgtcatccagatgacccagtctccatcctccctgtccgcatctgtaggagacagagtcatcatcacttgccgggcaagtcagagcattagaacgtatttaaattggtatcaacagaaaccagggaaacgcccctagaacctcctagatctagtggttcatccactttgctgaggtcgggtccatcgtaagttcagtggcagtggatcgngggacagtaatcactctcacatcacngtcngcaggctagagtatttgactaacttactctagtacaacagtacttactacgttccctactacgttccggcccgttagggaccctagtaggtgattactacgaaacgtacgtggtcgactcgacctaccattccgtgttcttaccgtacttcccgtaccctcctagtcgtaacg

SEQ ID NO: 81365 - DNA, 641 bp, Homo sapiens
  misc_feature: GYAE6OF01CDE86.52.1.A01.1.454.CMB.1.raw
  modified_base (227)..(227): a, c, t, g, unknown or other
  misc_feature (227)..(227): n is a, c, g, or t
  modified_base (237)..(237): a, c, t, g, unknown or other
  misc_feature (237)..(237): n is a, c, g, or t
  modified_base (409)..(409): a, c, t, g, unknown or other
  misc_feature (409)..(409): n is a, c, g, or t
  modified_base (456)..(456): a, c, t, g, unknown or other
  misc_feature (456)..(456): n is a, c, g, or t
tcagcgcagtacgacacgaccggtgctcgatttagacgtctcatcagggggggagtcagtctcagtcaggacacagcatggacatgagggtccccgctcagctcctggggctcctgctactctggctccgaggtgccagatgtgtcatccagatgacccagtcctaccactccctccctgtcccgcattctgtaggagacagagtcatcatcacgttcggccggganaagtcaaggngactaagttaagaacgtttaattttaaattggtaactacaaacgaacgaaaaccgaacggggaaacgtccccctagaaacctccgtagaattctagttacggttacctacgttcctaacgtttgccgttaggacggttcgggtacccataccgtaaggttcgaggtcggacnggtgagtcgtagggaacagtaacttcactctacacctatacctaacntacctgcgtaggtctagtaggttattttcggacttaactttcttctactactaacgtagtactttacgaccgtttacctacgttaccgtttccggaccgtacggtactaagttcggtacgtaagtacttaacgaaacggtacgtcggtagtacgtaccgaccgttacctacttcgttcgttaccc

SEQ ID NO: 81366 - DNA, 801 bp, Homo sapiens
  misc_feature: GYAE6OF01BERFQ.52.1.A01.1.454.CMB.1.raw
  modified_base (121)..(121): a, c, t, g, unknown or other
  misc_feature (121)..(121): n is a, c, g, or t
  modified_base (183)..(183): a, c, t, g, unknown or other
  misc_feature (183)..(183): n is a, c, g, or t
tcagcgcagtacgacacgaccggtgctcgatttagacgtctcatcagggcacagcatggacatggagggtccccgctcagctccgtggggctcctgctactcgtggctccgaggtgccagntgtgtacatccagatcgaccctagtcctccactcccgtcctcgtccgctatcgtagtagganactaggatcatcatctacgtcggccggacaagtcaagagactaagttaacgtaaacgtttagtttaaagttcggtaactacgaaacgaaacggtaaaaccggaacggggtaaaccgtacccctagtaaccttccgtaagtacttaccgtaagtttcggttacctaacgttccttacgttttcggacgtttacgggtacggttaccgggtacctaacgttaccggtaagggttaccgaggttacggacgttaggtacggttacgtcggttaaggaaccgtaaacgttacgttacctaccgtccttaacccaacgtaacctacccgaacgttacgtccgagtccggacggtacgtaggttaagttacgttaacgttacttaacgtttcgttactacgtaacgtaacgtacgttaccgttaccgtaccctttacccgtctttacccggtacccggtccggtaaccggtaccgtaattacggtaccgtaataaccggtaaaccgtaacggtacggttacgggtacgtaccgttaacgtcccgtacttaccggttacgtttcccggttacttaccccggttaccgtttaccccgtaccctaaccgttaccttacggttaaccg

SEQ ID NO: 81367 - DNA, 804 bp, Homo sapiens
  misc_feature: GYAE6OF01BDPQV.52.1.A01.1.454.CMB.1.raw
  modified_base (794)..(794): a, c, t, g, unknown or other
  misc_feature (794)..(794): n is a, c, g, or t
tcagcgcagtacgacacgaccggtgctcgatttagacgtctcatcagggcacagcatggacatggagggtccccgctcagctcctggggctcctgctactctggctccgaggtgccagatgtgtcatccagatgacccagtctccatccctccctgtccgcattcgtggtaggagacagagtcatcatcacttgccggacaagtcagagctaattaagaacgttatttaaagttggtatacaaacaacgaaacgaaggaacgccctagaactctagattctacgtggttcacttccgtactttcgacgtcggtacggttcgggttaccctacgttacgtaacggtttacgaacggttggacgtaagggtggtacgttacggttacgggaacgtaaacggttaaactttcctaaccttaccgttaccaaaccctaactacccgtaaaccgtacggttcgtaccggacggtacggtaccgtttaggtaaggtttacgtttttacgaacccgttaaaccgttttacccgttacgttaacggtacccgtaaaacgtagttaaaccggtttacccttaaccgtttccccccttagtaaccccgtttttcccggggaccccgtttaaccgggtaaccgttaacgttaggttaacgggtaacttaaccgttaacccgaaaacggttaacgtcggttacggtaccgttaccggtccttaaccttaaccggtttccgttaccgtttaccctttacccggttaacctttcccccggttaaccccggttacccttaaccgggttnttaaacccgg

SEQ ID NO: 81368 - DNA, 560 bp, Homo sapiens
  misc_feature: GYAE6OF01A72DA.52.1.A01.1.454.CMB.1.raw
  modified_base (356)..(356): a, c, t, g, unknown or other
  misc_feature (356)..(356): n is a, c, g, or t
  modified_base (360)..(360): a, c, t, g, unknown or other
  misc_feature (360)..(360): n is a, c, g, or t
tcagcgcagtacgacacgaccggtgctcgatttagacgtctcatcagggcacagcatggacatgagggtccccgctcagctcctggggctcctgctactctggctccgaggtgccagatgtgtcatccagatgacccagtctccatcctccctgtccgcatctgtaggagacagagtcatcatcacttgccggcaagtcagagcattagaacgttatttaaattggtatcaacagaaaccagggaaacgcccctgaactcctgatctatggttcatcctactttgctgagttcgggtcccatcaaggttcagtggcagtggatcgtgggacagtaacttcactctcaccatccacngtcngcaggctaggtaggtatttgactaacgtttcttctagtacaaacgtagtacgtttacgtacgtttcccctacgttaccgtttccggccccgtacgggtacctagtacgttagaacttactaccaaacgtacttaggtcggtctcgactaccctagttccttcgtctttaccgtacttcccttaccccgctcgttcgtacg

SEQ ID NO: 81369 - DNA, 897 bp, Homo sapiens
  misc_feature: GYAE6OF01C42ZH.52.1.A01.1.454.CMB.1.raw
tcagcgcagtacgacacgaccggtgctcgatttagacgtctcatcagggcacagcatggacatgagggtccccgctcagctcctggggctcctgctactctggctccgaggtgccagatgtgtcatccagatgacccagtctccatccctccctgtccgcatctggtaggagacagagtcatcatccacttcggccggacaagtcagagactattaaggtaacgttaattttaaagttggtatacaaacgaacgaaaccgagggaaacgcccctagtaacctcctagtactctatcggtctatcctacttgtcgtggtacggtccgggtacctacgtcgtaacggttgacggtggcgtagtggtacgtcgtaggacgtagtaaccgtttcaccttccacctaaccctaccgtacctaaccccgtacgttaccggtacgtaccgtacgggttacgtacggttaacggtttaacgtttttaccgacgtttaaacccttttaccgtttaccgttaccgtaaccgtaaacggtaaccggttaaccgtttaacccgttacccgtttttacccccttaccccgtttaacccccgggttttaccccgggtccccggggttaaccggtaaaccccggttaacgggtttaacgggttaaaccgggttaaactttaaacccgggttaaaccccgtaaaaacgggtttaaaccccgggtttggggttaaccccgggttacccgtttaaccccgggtaaaccccggttaacccccggtttaacgttttacccccccgggttttacggtttaacccccggtttttaccccccttaacccgttttaccccccccggttttaccccccgttaaacccccgtttacccgttttaacccgtttaaaacccgggg

SEQ ID NO: 81370 - DNA, 544 bp, Homo sapiens
  misc_feature: GYAE6OF01B501A.52.1.A01.1.454.CMB.1.raw
  modified_base (271)..(271): a, c, t, g, unknown or other
  misc_feature (271)..(271): n is a, c, g, or t
  modified_base (365)..(365): a, c, t, g, unknown or other
  misc_feature (365)..(365): n is a, c, g, or t
tcagcgcagtacgacacgaccggtgctcgatttagacgtctcatcaggggggagtcagtctcagtcaggacacagcatggacatgagggtccccgctcagctcctggggctcctgctactctggctccgaggtgccagatgtgtcatccagatgacccagtctccatcctccctgtccgcatctgtaggagacagagtcatcatcacttgccgggcaagtcagagcattagaacgtatttaaattggtatacaacagaaaccagggaaacncccctagaactcctgatctatggtcatcctactttgctgacggtcgggtccagtcgaaggttcagtggacagtgatcgtggacagtatcactcncacatacacatctgcgaggctagaggttatttgactaacttcttctacgtacaacgtagtacgttacctacgtttccctacttaccgttccggtaccgttacggtacctagttacgtaggtaacgtactacgaaacgtacgtcggtacggacttcgacctacctacttcttggttaccc

SEQ ID NO: 81371 - DNA, 551 bp, Homo sapiens
  misc_feature: GYAE6OF01CIXK3.52.1.A01.1.454.CMB.1.raw
  modified_base (373)..(373): a, c, t, g, unknown or other
  misc_feature (373)..(373): n is a, c, g, or t
  modified_base (393)..(393): a, c, t, g, unknown or other
  misc_feature (393)..(393): n is a, c, g, or t
tcagcgcagtacgacacgaccggtgctcgatttagacgtctcatcagggggggagtcagtctcagtcaggacacagcatggacatgagggtccccgctcagctcctggggctcctgctactctggctccgaggtgccagatgtgtcatccagatgacccagtctccatccctccctgtccgcatctgtaggagacagagtcatcatcacttcgccgggcaagtcagagcattagaacgtaatttaaattggtatcaaacagaaaccaagggaaacgcccctagaacctcctgactctatggttacatcctactttgctgtagtcggggtccagtacaaggttcaggtgacaggtgatcgtgggacagtaatcnctctcactatcaccagtccngacaggctgagtatttgactaacgtttactctagtacaactaggtaacttaacaccgtttcccctacttacccgtttccggcccgttacgggtaccagttacggtagtataacttacgaaaacgtactggtcgtactcgactacctacttctgttacc

SEQ ID NO: 81372 - DNA, 580 bp, Homo sapiens
  misc_feature: GYAE6OF01EOQCV.52.1.A01.1.454.CMB.1.raw
  modified_base (423)..(423): a, c, t, g, unknown or other
  misc_feature (423)..(423): n is a, c, g, or t
  modified_base (437)..(437): a, c, t, g, unknown or other
  misc_feature (437)..(437): n is a, c, g, or t
  modified_base (568)..(568): a, c, t, g, unknown or other
  misc_feature (568)..(568): n is a, c, g, or t
  modified_base (575)..(575): a, c, t, g, unknown or other
  misc_feature (575)..(575): n is a, c, g, or t
tcagcgcagtacgacacgaccggtgctcgatttagacgtctcatcagggggggagtcagtctcagtcaggacacagcatggacatgagggtccccgctcagctcctggggctcctgctactctggctccgaggtgccagatgtgtcatccagatgacccagtctccatccctcctgtccgcatctggtaggagacagagtcatcatcacttggccgggacaagtcagacgctaattaagaaacgttaattttaaaagttggtaatacaaacaagaaaaccgaagggaaacgcccctagaacctctgatctagtcgttcatcctacttgctggacggtcggggtcccatctaagtttcaggtggacgtaggtggtagtcgtgggaacaggtaacttccacttctacaccactaccacctgttcngcgaggctgagttntttgacttaacttcttctagtaccaacgtagtacgttacgtaccgtttcccttcttaccggtttccgcccgttacgggacctagtaggtacggataactaacgaaacgtacgtggtacgctacgacaactnttccgtnttacc

SEQ ID NO: 81373 - DNA, 738 bp, Homo sapiens
  misc_feature: GYAE6OF01A4XPL.52.1.A01.1.454.CMB.1.raw
  modified_base (641)..(641): a, c, t, g, unknown or other
  misc_feature (641)..(641): n is a, c, g, or t
  modified_base (679)..(679): a, c, t, g, unknown or other
  misc_feature (679)..(679): n is a, c, g, or t
tcagcgcagtacgacacgaccggtgctcgatttagacgtctcatcagggcacagaatggacatgagggtcccgctcagctcctggggctcctgctactctggctccgaggtgccagatgtgtcatccagatgacccagtctccatcctcctgtccgcatctggtaggagacagagtctatcatcacgttggccgggacaagtcagagcagttaagaaacgttattttaaaattggtaatacaaacgaacgaaaccgaaggggaaacgtacccctaggtaacttcccgttaggtaactccgttaagttcggtttacacttacctacgtttttggacgttcggtaacgggttcgggggttacccctagttaccgtaaacgggtttcgaagggttcggacgtaggttagggtacttccggtaggggtaactaagtaactttaccgaacttcctaccacctaagtacccaaccgttagttcccgtagaccggtacggtcgttaggtaaggttactttttcgaaccttaaaccgtttactttccgtagttaaccaaagtacggtaagtttaacctccggtttaccctacgttacgtttcccgggtaccgtacgggaaccttaacgtacgggtagttattaacctanaaaccggttacttggtacggtactccggtccaaccgtnttcgtttactccgtttacacgtttcccccgttaccctaccgtactttcgttgtaaaccg

SEQ ID NO: 81374 - DNA, 643 bp, Homo sapiens
  misc_feature: GYAE6OF01BYJ32.52.1.A01.1.454.CMB.1.raw
  modified_base (333)..(333): a, c, t, g, unknown or other
  misc_feature (333)..(333): n is a, c, g, or t
tcagcgcagtacgacacgaccggtgctcgatttagacgtctcatcagggcacagcatggacatgagggtccccgctcagctcctggggctcctgctactctggctccgaggtgccagatgtgtcatccagatgacccagtctccatccctccctgtccgcatctgtaggagacagagtcatcatcacttgccgggcaagtcagagctattaagaacgttattttaaattggtatacaaacagaaaccgagggaaacgcccctagaacctcctagatctagtcggttcactcctactttgcgtggtacggtcgggtccctagtacgtaaggttnaggtcggctaggtggatcgtagggacagtaacttcacctctacacctactaccaccgtagtctggacgaggtcgtaggtaggttattttacgaccttaaaccgtttcttacttacgtacctaaacgtacggttaacgtttacctaccgttttcccctacgttacccgtttccggacccgtacgggacctagttacggtagtaactacgtaaccgaaacgttacgtggtacgtccgtacgacctacctagttccgttcgtttacccttacgttacctttccccttaccccggtaccttacgtccgttaacg

SEQ ID NO: 81375 - DNA, 926 bp, Homo sapiens
  misc_feature: GYAE6OF01EZ31A.52.1.A01.1.454.CMB.1.raw
  modified_base (121)..(121): a, c, t, g, unknown or other
  misc_feature (121)..(121): n is a, c, g, or t
tcagcgcagtacgacacgaccggtgctcgatttagacgtctcatcagggctacgagcattggacatgagggtcccgctcagctcctggggctcctagactactctcggcctccgaggttcnccagatgtgtcatccagatcgaccctagtcctccatcctccctgtccgcatcgtaggtacggacgacaggacgttcaactcgacgttacgaccgttcggcccgggtacaaaggtccaggactacgtacgtttaacggtaacgtttaagttttaaagttcggtaactaccaaacgaacgaaaccgaacgggtaaacctccccgttacgtaaccttccgtaggacttaccgtagttccggttaccaccgttaccgtacgggtttcgtcgttagggtacgggtttacggggtccctaaggttaccgttaaacgggtttccggaaggtacgggtacgaggttacggtacgttacgttaaccggggaacctacgttaaacgttacctaaccgttacctaccgaaccttaaacgtaccctaaccggtacggttacctaacgggtaaccgtaacgggtaccctttaacgggttacgtttaacgttttaccgggaaccctttaaaccttttaccgggttcctaaacgttaaccggtaaacccgtcggttaacctttaaaccccggttccgtttacccttacccggttacgttttcccgggtacccgttaccgggtaaaccttacgggttaggtaccggttaaacgttaacccggtaaccgtaaaccggttacgggtacgggtttacccgggtacgtttccggaaccccgtttagttaaccgttttcccgggtttaacttttacccggttaacccgtacccgggtttttaccccggaaacccccggtttctttaacggtttcgttaaacccggg

SEQ ID NO: 81376 - DNA, 684 bp, Homo sapiens
  misc_feature: GYAE6OF01B82N5.52.1.A01.1.454.CMB.1.raw
  modified_base (455)..(455): a, c, t, g, unknown or other
  misc_feature (455)..(455): n is a, c, g, or t
tcagcgcagtacgacacgaccggtgctcgatttagacgtctcatcagggcacagcatggacatgagggtccccgctcagctcctggggctcctgctactctggctccgaggtgccagatgtgtcatccagatgacccagtctccactcctcctgtccgcatctgtaggagacagagtcatcatcactggccggacaagtcagagacaagttagaaacgttattttaaagtggtaatacgaaacaagaaaaccgaagggaaacgtcccctaagaaccttctagactacgttagtcggttactaactccttaacgttttcgcttacgggtacgggtaccggggtaccctaagtaccggtaaagggtttacggagttgggtactaaggttggtacgtacgtagggaaactaagggtaactctaaccttccactaacccgatacccaaccgtagttccngacgagtcggtaggtaacggtttatttcgaacttaaactttcttactagtactaaacgagtaacgtaaccgttaccgttccctacttaaccggttcgaccccggtagggaactaagttagtagtaacttaacgtaaccgaaacttaaccggtggttacggacctacgtacctaccgttacgttacgttaccttcttaacgtacttaccccgttcccacggtatcctaag

SEQ ID NO: 81377 - DNA, 657 bp, Homo sapiens
  misc_feature: GYAE6OF01DLB29.52.1.A01.1.454.CMB.1.raw
  modified_base (239)..(239): a, c, t, g, unknown or other
  misc_feature (239)..(239): n is a, c, g, or t
tcagcgcagtacgacacgaccggtgctcgatttagacgtctcatcagggcacagcatggacatgagggtccccgctcagctcctggggctcctgctactctggctccgaggtgccagatgtgtcatccagatgacccagtctccatccctccctgtccgcatctggtaggagacagagtcatcatcacttggccggacaagtcagagctaattagaacgttatttaaatggtatacaanagaaacgaggaacgccctagaacctctgtactcgtagtcggttacactcctacgtttgcgtaggacggtcgggtaccctagtacgtaaagggttcctaggtcggacgtaggtaggtactcggtagggaacctagtacttacgactcctactaacctataccacgtacgtcgtcgacgaggtccgttaggtacggtttacgttttacggacccttaaaccgtttacgtttacgtacgtaaccaaacggtaacgttacgtttaccgtaccgttccccgttacgttaccggttccggtcccggtacggacctagttacgttaggacttaacgtaacgaaacgtcgtaggtcgtaccgacgtacctactacgttctacgttccgttacttaccgttcccgtttaccgccttagttccctaag

SEQ ID NO: 81378 - DNA, 599 bp, Homo sapiens
  misc_feature: GYAE6OF01BYW7Q.52.1.A01.1.454.CMB.1.raw
  modified_base (219)..(219): a, c, t, g, unknown or other
  misc_feature (219)..(219): n is a, c, g, or t
  modified_base (275)..(275): a, c, t, g, unknown or other
  misc_feature (275)..(275): n is a, c, g, or t
tcagcgcagtacgacacgaccggtgctcgatttagacgtctcatcagggggggagtcagtctcagtcaggacacagcatggacatgagggtccccgctcagctcctggggctcctgctactctggctccgaggtgccagatgtgtcatccagatgacccagtcctccatccctccctgtccgcatctgtaggagacagagtcatcatcacttgccgggnaagtcagagcattagaacgtatttaaattggtatacaacagaaaccgagggaaacncccctagaacctctgatctatggttcatcctacttgctggaggtcggggtcccagtcgaaggttcgagtggcagtggatcgtgggacagtattcactctcacctataccactagtctgcgaggtctaggagttattttgaccttaaccgtttctttcgtagttaccaacgtacgttaacgtttacctaccggtttcccccttacgttacccgttttcccgggacccgttacgggaccctagttacggtacggttaactacgttaacgaaaacggtaacgttggtacggtccgtcggaccctaacctacttccgttcgtttaccc

SEQ ID NO: 81379 - DNA, 662 bp, Homo sapiens
  misc_feature: GYAE6OF01BCJAL.52.1.A01.1.454.CMB.1.raw
  modified_base (202)..(202): a, c, t, g, unknown or other
  misc_feature (202)..(202): n is a, c, g, or t
  modified_base (229)..(229): a, c, t, g, unknown or other
  misc_feature (229)..(229): n is a, c, g, or t
  modified_base (250)..(250): a, c, t, g, unknown or other
  misc_feature (250)..(250): n is a, c, g, or t
  modified_base (273)..(273): a, c, t, g, unknown or other
  misc_feature (273)..(273): n is a, c, g, or t
tcagcgcagtacgacacgaccggtgctcgatttagacgtctcatcagggcacagcatggacatgagggtccccgctcagctcctggggctcctgctactctggctccgaggtgccagatgtgtcatccagatgacccagtctccatccctcctgtccgcatctgtaggagacagagtcatcatcacttgcggcaagtcagancattagaacgtatttaaattggtactnaaacagaaaccgagggaaacncccctagaacctcgtagaacttntaacgtggttacactcctacgtttgcgtggtacggttcgggtacccagttaacctaagggttacaaggtggccaagggtggtaactcggtagggaactaagtaacttctaacctctactaacctaactccaaaccggtgtaccgttggacctaaggtccgtagtaaggggttaacttttacggaccttaaaccgttttacttacgtacgtaacgtaaacgtaaggtaacgtttaaccgtacgtttacccttaccttaaccgtttccgggtacccgttacggaaccgtacgtaacgttaggacttaacgtactaaaacgtacgttacgtggtactggacctactaacttctcgttacttactccgttacccttccgtacctagttccgta

SEQ ID NO: 81380 - DNA, 551 bp, Homo sapiens
  misc_feature: GYAE6OF01CXL83.52.1.A01.1.454.CMB.1.raw
  modified_base (194)..(194): a, c, t, g, unknown or other
  misc_feature (194)..(194): n is a, c, g, or t
  modified_base (251)..(251): a, c, t, g, unknown or other
  misc_feature (251)..(251): n is a, c, g, or t
  modified_base (345)..(345): a, c, t, g, unknown or other
  misc_feature (345)..(345): n is a, c, g, or t
  modified_base (349)..(349): a, c, t, g, unknown or other
  misc_feature (349)..(349): n is a, c, g, or t
  modified_base (536)..(536): a, c, t, g, unknown or other
  misc_feature (536)..(536): n is a, c, g, or t
tcagcgcagtacgacacgaccggtgctcgatttagacgtctcatcagggcacagcatggacatgagggtccccgctcagctcctggggctcctgctactctggctccgaggtgccagatgtgtcatccagatgacccagtctccatcctccctgtccgcatctgtaggagacagagtcatcatcacttgccggnaagtcagagcattagaacgttatttaagtggtatacaacaagaaaccgagggaaacnccctagaactcctgatctatgtcatcacttgctgagtcgggccatcaagtcgagtggcagtgatcgtaggactagattcactctacacatcacngtcngcgagtctaggagtatttcgacttaactttcgttctgtacaacgtagtacttacgtactttccctactaccgtttccggcccgttagggaaccctgtaacggtgtaacttactacgaaacggtactggtacggtctacggtactaccgtattccgttcgttactttacctacgtttccccttacccncctattccgttaacg

SEQ ID NO: 81381 - DNA, 601 bp, Homo sapiens
  misc_feature: GYAE6OF01APL2C.52.1.A01.1.454.CMB.1.raw
  modified_base (195)..(195): a, c, t, g, unknown or other
  misc_feature (195)..(195): n is a, c, g, or t
  modified_base (232)..(232): a, c, t, g, unknown or other
  misc_feature (232)..(232): n is a, c, g, or t
tcagcgcagtacgacacgaccggtgctcgatttagacgtctcatcagggcacagcatggacatgagggtccccgctcagctcctggggctcctgctactctggctccgaggtgccagatgtgtcatccagatgacccagtctccatcctccctgtccgcatctgtaggagacagagtcatcatcacttgccgggnaagtcagagcattagaacgtatttaaatggtatcaanagaaaccaggaaacgccctgaactcctgatctatgtcactcctactttcgctggaggttcgggtcccagtacctaaagggtttcaggttcggacgtaggtggacgtcgtagggactagtaacttcgacctctaccaaccgtactaccaccgtaagttctacgcgtacggtcgttacggtaaggttacttttcggaaccttaaccgtttacttcgtacgtacaacgtacgtaacgttacttaccgttccccttacgtaccgtttccggacccgtagggtaaccctaggtagttacgtagttaactacgaacgtaacgtggtcggtactgaccactattctcgttctcgtactctacccgctagtcgtacg

SEQ ID NO: 81382 - DNA, 811 bp, Homo sapiens
  misc_feature: GYAE6OF01B9MT9.52.1.A01.1.454.CMB.1.raw
tcagcgcagtacgacacgaccggtgctcgatttagacgtctcatcagggcacagcatggacatgagggtccccgctcagctcctggggctcctgctactctggctccgaggtgccagatgtgtcatccagatcgacccagtctccatccgtccctgtccgcatctgtaggagacagagtcatcatcacttggccggacaagtcagacgactaagttaacgaacgtttatttaaagttcggtaataccgaaacgtaacggaaaacccgaagggtaaaccgtcccccgtaggtaaacccttcccgtagtaacttaccgtaagttcggttacacgttacccttacgttttggccttaggtacgggttccgggtaccctaagttaccggtaaagggtttccgagggtacggtaccgtaagggtaggtaacgttacggtacggggtaacctaacggttaacgttccgtaaccgttccctaaccgtaacccgtacgttaacccaaccgttacggttaaccgttcggaaccgtacgggttcgttaacgggtaacggtttaacttttacggaaacccctttaaaccgtttacgtttaccgttaccggtaaccgtaaacggttacggttaaaccgtttaacccgtaccgtttacccctttacggttaccccgtttaccggacccgtttaagggaacccttaagggttacggtaacgttaacgttaccgtaaaccgtaacggtaacgttcggtacgtacctcggaaccgtacttacgttcgttccgttactccgtacgttccctacccgctagtcgtaacg

SEQ ID NO: 81383 - DNA, 714 bp, Homo sapiens
  misc_feature: GYAE6OF01AESPL.52.1.A01.1.454.CMB.1.raw
  modified_base (201)..(201): a, c, t, g, unknown or other
  misc_feature (201)..(201): n is a, c, g, or t
  modified_base (565)..(565): a, c, t, g, unknown or other
  misc_feature (565)..(565): n is a, c, g, or t
  modified_base (598)..(598): a, c, t, g, unknown or other
  misc_feature (598)..(598): n is a, c, g, or t
tcagcgcagtacgacacgaccggtgctcgatttagacgtctcatcagggcacagcatggacatgagggtccccgctcagctcctggggctcctgctactctggctccgaggtgccagatgtgtcatccagatgacccagtctccatccctcctgtccgctatcgtggtaggagacagacgtcatcatcacgttggccgganaagtcagacgctaattaaggtaaacgtttaattttaaagttggtaactaccgaaaacgaacgtaaaacccggaaggggtaaaccgtcccccgtaggtaaacctccgttaggtaacttcgttaagtttcggttacctaacgttcccgttaacgttttcgcgttcggtagggtccggggttacccaagttaccggtaacggttcgacggtaggtagtacggtaggacgttcggtacggggaaactaggtaacttccgaccgttcctacaacctccgtaccacgtacgtcgtcgagacggtgtaggttaacgttactttcgaaccttaaccgtttcgtattacgaactacgtaagtaccgtttaccnccgttttaccctaccgttaccgttccggtaccncggtacctaggttacgcgtaactaacgacgtaacgtacgtggtaccggactacgcctaacgtagtttccgtcttaccgttacccaccgtttcccccttacgtcctagttcctaagg

SEQ ID NO: 81384 - DNA, 581 bp, Homo sapiens
  misc_feature: GYAE6OF01BD1QS.52.1.A01.1.454.CMB.1.raw
  modified_base (229)..(229): a, c, t, g, unknown or other
  misc_feature (229)..(229): n is a, c, g, or t
  modified_base (353)..(353): a, c, t, g, unknown or other
  misc_feature (353)..(353): n is a, c, g, or t
tcagcgcagtacgacacgaccggtgctcgatttagacgtctcatcagggggggagtcagtctcagtcaggacacagcatggacatgagggtccccgctcagctcctggggctcctgctactctggctccggaggtgccagatgtgtcatccagatgacccagtctccatccctccctgtccgcatctgtaggagacagagtcatcatcacgttggccggcaagtcagancattagaacgtatttaaattggtatcaacagaaaccagggaaacgcccctgaactcctagatctatggttcactcctactttgctggaggtcggggtcccagtcaaggttcaggtgcgagtggntcgtgggacagaattcactctcaccatcaccagtctcgacgaggctaggagttagttttcgacttaactttacttctagtacctaacgacgtagttaacctacgtttcccctacttaccgtttcccggcccgttaggggaaccctaggttacggttagaacgttacgtaccgtaaaacggtaacttggtacggtcttacggaccctaaccgacttccgttgtttaccc

SEQ ID NO: 81385 - DNA, 581 bp, Homo sapiens
  misc_feature: GYAE6OF01EP1I5.52.1.A01.1.454.CMB.1.raw
  modified_base (256)..(256): a, c, t, g, unknown or other
  misc_feature (256)..(256): n is a, c, g, or t
  modified_base (388)..(388): a, c, t, g, unknown or other
  misc_feature (388)..(388): n is a, c, g, or t
tcagcgcagtacgacacgaccggtgctcgatttagacgtctcatcagggcacagcatggacatgagggtccccgctcagctcctggggctcctgctactctggctccgaggtgccagatgtgtcatccagatgacccagtctccatcctccctgtccgcatctgtaggagacagagtcatcatcacttgccgggcaagtcagagctattagaacgttatttaaattggtaactacaacaagaaaccgagggaaacncccctagaacctcctgatctatggttcatccagtttgctggaggttcggggtcccagttacgtaaggtttcaggtggtcaggtcggatcgtgggactagtaattcacttctacacctagtcacagtctgacnggctgagtatttagactaaccttcttcgtcgtaacaactaggtacgttaccacgtttccctacctaccgtttcggcccgttagggtaccctagttacggttacgaacttacgtaccgaaacgtacgtggtcgctggtccttacctttgtcgttaccttctaccgttccttaccccgactacttcgtagtaacg

SEQ ID NO: 81386 - DNA, 564 bp, Homo sapiens
  misc_feature: GYAE6OF01CH9CV.52.1.A01.1.454.CMB.1.raw
tcagcgcagtacgacacgaccggtgctcgatttagacgtctcatcagggggagtcagtctcagtcaggacacagcatggacatgagggtccccgctcagctcctggggctcctgctactctggctccgaggtgccagatgtgtcatccagatgacccagtctccatcctccctgtccgcatctgtaggagacagagtcatcatcacttgccgggcaagtcagagcattagaacgtatttaaattggtatcaacagaaaccagggaaagcccctgaactcctgatctatggtcatccactttgctgagtgggtcccatcaaggttcagtggcagtgatcgtggacagaattcactctacaccatccacctatctgcaggctgaggtattttgactaacttacttctagtacaacgagtacgttactacggtttccctacgttacctttccggcccgttacgggaccctaagttacggttaggtaacttaacgtaccgaaaacggtaaccttagggttaggtaccgtacggtacccgaaccttaacgttccgttacggtttacccg

SEQ ID NO: 81387 - DNA, 799 bp, Homo sapiens
  misc_feature: GYAE6OF01B17ND.52.1.A01.1.454.CMB.1.raw
  modified_base (97)..(97): a, c, t, g, unknown or other
  misc_feature (97)..(97): n is a, c, g, or t
  modified_base (302)..(302): a, c, t, g, unknown or other
  misc_feature (302)..(302): n is a, c, g, or t
  modified_base (760)..(760): a, c, t, g, unknown or other
  misc_feature (760)..(760): n is a, c, g, or t
tcagcgcagtacgacacgaccggtgctcgatttagacgtctcatcaggggggagggtcagtctcagtcaggacacagcatggacatgagggtccccntcagctccgtgggctcctgctactctggctccggaggtgccagatgtgtcatccagatcgacccagtcctccactccctccctgtccgcatctggtaggagacagagtcatcatcacgttcggccgggactaagtcgagagactaagttaacgaacgtttaatttaaaagttggtaataacaaacgaacgaaaccgagggaaccncccctaggtaacctcgtagacttacgtagtttcggttaccaacttccttacgttttcggaccttagggtaacgggttccgggtacccctaaggttaccggtaaacgggtttcgagggttacgggaccgtagggtcgggtaacgttaccgggttaggggaaaccctaaggttaaacctttcccgaacccgtttaccctaaccctaacccgttaaccgttacccctaacccggttaacgttcgttaacggaccggtaaacggggttccgttaagggttaaccgggtttactttttaaccggaaaccctttttaaacgtttacccgtttacgtacgttaaacccgtaacgttacgttaaaccggttttaccctaccggttttacccctacgttacccggttttcccggaccgttaacgggtaacctaggttacggtacgtaaactacgtaccgtaaacgtntacgggttacgacttacgcctaactgttccgtcgttacc

SEQ ID NO: 81388 - DNA, 763 bp, Homo sapiens
  misc_feature: GYAE6OF01CSTKJ.52.1.A01.1.454.CMB.1.raw
  modified_base (743)..(743): a, c, t, g, unknown or other
  misc_feature (743)..(743): n is a, c, g, or t
tcagcgcagtacgacacgaccggtgctcgatttagacgtctcatcagggcacagcatggacatgagggtccccgctcagctcctggggctcctgctactctggctccgaggtgccagatgtgtcatccagatcgacccagtcctcccactccctccctgtcccgcatcgtggtacggagacaggactcatcatcacgttcggccggacaagtcgagagactaagttagaaacgtttaatttaaagttggaactacaaaacgaacgaaaccggaacgggaaaccgacccgtaacgtaaccttccgtagtacttacgttacgttcggtactaccttaccgtactttgacgtggtacggtcgggtacctagtacgtaacggttcgaggtcggtacgtaagtggtaacgttcggtaaggaaccgttaacggtacttaccgtaaccttccgtaaccctaacctactacccgtaaccgttagtaccgtacggtaccggtacggtaccgttagggttaacgtttaacgtttaccggtaaacctttaaccttttacgttacggtaccgttaacctaaacggtaccggttaacggtaacctttacccgtttacccgttcgtttaaccgttcccggtaccggtaaccgttacgtagtacggttaagtaactaaccgttacgaaaacgttacggtcggtccgtacgaccgtaccgacccttagtcccgttcgttacccttctacccctttaccncccgttactcgttagtaacg

SEQ ID NO: 81389 - DNA, 631 bp, Homo sapiens
  misc_feature: GYAE6OF01A1IW2.52.1.A01.1.454.CMB.1.raw
  modified_base (174)..(174): a, c, t, g, unknown or other
  misc_feature (174)..(174): n is a, c, g, or t
  modified_base (623)..(623): a, c, t, g, unknown or other
  misc_feature (623)..(623): n is a, c, g, or t
tcagcgcagtacgacacgaccggtgctcgatttagacgtctcatcagggcacagcatggacatgagggtccccgctcagctcctggggctcctgctactctggctccgaggtgccagatgtgtcatccagatgacccagtctccatcctcctgtccgcatctgtaggagacagngtcatcatcacgttggccgggacaagtcagagactattagaacgttatttaaagttggtactacaaacgacgaaaccgagggaaaccgtcccctagaaccttcctagtatactatcggttacacttcctactttgcgttggacggtcggggtacccatacgtaaggttcaggtaggctaggtacggtatcgtagggactagtacttacaccttctacgtacccatccaacctagtacaggtaccgaggtcgttaggaaggtttacgttttacgacttaaacgtttccttattcgtaacctaacgtacgttacgttaacctaccgtttacccttcgtaccgttttccggcccttagggaccctaggtcggttagaacttactaacgaacgtaacttggtacgactacacctacagttccttacgtccttactaccgttccctacgtcctnttcgtaac

SEQ ID NO: 81390 - DNA, 551 bp, Homo sapiens
  misc_feature: GYAE6OF01EBPP9.52.1.A01.1.454.CMB.1.raw
  modified_base (217)..(217): a, c, t, g, unknown or other
  misc_feature (217)..(217): n is a, c, g, or t
  modified_base (267)..(267): a, c, t, g, unknown or other
  misc_feature (267)..(267): n is a, c, g, or t
  modified_base (340)..(340): a, c, t, g, unknown or other
  misc_feature (340)..(340): n is a, c, g, or t
tcagcgcagtacgacacgaccggtgctcgatttagacgtctcatcaggggggagtcagtctcagtcaggacacagcatggacatgagggtccccgctcagctcctggggctcctgctactctggctccgaggtgccagatgtgtcatccagatgacccagtctccatccctccctgtccgcatctgtaggagacagagtcatcatcacttgccgggnaagtcagagcattagaacgtatttaaatggtatcaacagaaacaggaaancccctagaacctctgatctatggttcatcctactttgctgagtgggtcccatcaagtcagtgcgagtgatcgnggacagatcactctcacatccacagtctgcagctgagtatttgactaacttacttcttagtacaactagtaacttacgtacgttacccttacgtaccgttttccggacccgttacgggaacctaagttacggtacgggtaattaacgttaaccgaaaacgttacgttacgggttcggaccttcggacccaacctacttcgtcgtttacccg

SEQ ID NO: 81391 - DNA, 695 bp, Homo sapiens
  misc_feature: GYAE6OF01CRXMD.52.1.A01.1.454.CMB.1.raw
  modified_base (202)..(202): a, c, t, g, unknown or other
  misc_feature (202)..(202): n is a, c, g, or t
  modified_base (417)..(417): a, c, t, g, unknown or other
  misc_feature (417)..(417): n is a, c, g, or t
tcagcgcagtacgacacgaccggtgctcgatttagacgtctcatcagggcacagcatggacatgagggtccccgctcagctcctggggctcctgctactctggctccgaggtgccagatgtgtcatccagatcgacccagtctccatccctcccgtgtcccgctatctaggtaggacacagagtcatcatcacttggccggnaagtcagagcaagttagaacgtttaattaaacgtggtataacgaaacaagaaaccgaaggggaactcccctagaacctccgtagacttactacgttgtactactacctatttgacgtggtacggtccgggtacctagtacgtaagttcaggtgacgtacggtgactacggtggaactaagtaccttcgactctaccaactagtaccacgtagtcncgcgtacggtagtagtagggttactttacgggaacttaacctttacgttcgttaacgaacctaacggttaacgtaacgttaccttaacccggtttcccttaacgttacccggtttaccggaacccgtacgggtaacccttaagggtaattaccgggaacttaacggtaacccgtaaaacggtaccgttaggtaccggtacgttaccgaccttaaccgtacttccgttaccggttactttaccgtacccgtttaccctaccggaccttctagttaaacg

SEQ ID NO: 81392 - DNA, 570 bp, Homo sapiens
  misc_feature: GYAE6OF01EANQ4.52.1.A01.1.454.CMB.1.raw
  modified_base (197)..(197): a, c, t, g, unknown or other
  misc_feature (197)..(197): n is a, c, g, or t
  modified_base (223)..(223): a, c, t, g, unknown or other
  misc_feature (223)..(223): n is a, c, g, or t
  modified_base (232)..(232): a, c, t, g, unknown or other
  misc_feature (232)..(232): n is a, c, g, or t
  modified_base (286)..(286): a, c, t, g, unknown or other
  misc_feature (286)..(286): n is a, c, g, or t
  modified_base (430)..(430): a, c, t, g, unknown or other
  misc_feature (430)..(430): n is a, c, g, or t
tcagcgcagtacgacacgaccggtgctcgatttagacgtctcatcagggggggagtcagtctcagtcaggacacagcatggacatgagggtccccgctcagctcctggggctcctgctactctggctccgaggtgccagatgtgtcatccagatcgaccccagtcctccatccctccctgtccgcatcctgtagganacagagtcatcagtcacttgccgggnaagtcagancaattaagaacgttaatttaaattggtatactaaaccaagaaaccgaggaaacncccctagaactcctgatctagttcgttacactcctagtttgctaggacggtcgggtcccagtcgtaaggttcgagtggcgtaggtggtatcgtgggacagtaacttcactcacacctatccactgtctgactggctagtagttntttgaccttaacttcttctagtaccaagtacgtacgttacctaccgtttccctaccttccgttcccggaccgtacggaacctaggtacgtagtaatactacgaaacgtacgtgtacgctagacctactcttcgtcgttcc

SEQ ID NO: 81393 - DNA, 601 bp, Homo sapiens
  misc_feature: GYAE6OF01CPPYY.52.1.A01.1.454.CMB.1.raw
  modified_base (397)..(397): a, c, t, g, unknown or other
  misc_feature (397)..(397): n is a, c, g, or t
  modified_base (409)..(409): a, c, t, g, unknown or other
  misc_feature (409)..(409): n is a, c, g, or t
tcagcgcagtacgacacgaccggtgctcgatttagacgtctcatcagggcacagcatggacatgagggtccccgctcagctcctggggctcctgctactctggctccgaggtgccagatgtgtcatccagatgacccagtctccatccctccctgtccgcatctgtaggagacagagtcatcatcacttggccgggacaagtcagagctattagaacgttatttaaattggtatacaaacaacggaaaccgaagggaaacgcccctagaacctcctagtatcttattggttaccacttccctacttttgcgtggtaggtccggggtacccagttaccgtaaggtttcgaggtggcgtaggtgtacgtcgtagggacagtaacttcaactcaccaccntacaccagtcgngcgagtctaggtagttatttcgacttaacgtttacttcgtactacaaccgtagttaaccgttactacgtttcccctaccgtaccgtttccggtccgtacgggtacctagtgtagtactaactacaaagtacgtggtcgctacgccactcgttcttcgttcgttctaccgttcccctaccgcctgtcgtaacg

SEQ ID NO: 81394 - DNA, 554 bp, Homo sapiens
  misc_feature: GYAE6OF01DZ4UR.52.1.A01.1.454.CMB.1.raw
  modified_base (345)..(345): a, c, t, g, unknown or other
  misc_feature (345)..(345): n is a, c, g, or t
  modified_base (350)..(350): a, c, t, g, unknown or other
  misc_feature (350)..(350): n is a, c, g, or t
  modified_base (354)..(354): a, c, t, g, unknown or other
  misc_feature (354)..(354): n is a, c, g, or t
  modified_base (357)..(357): a, c, t, g, unknown or other
  misc_feature (357)..(357): n is a, c, g, or t
  modified_base (359)..(359): a, c, t, g, unknown or other
  misc_feature (359)..(359): n is a, c, g, or t
tcagcgcagtacgacacgaccggtgctcgatttagacgtctcatcagggcacagcatggacatgagggtccccgctcagctcctggggctcctgctactctggctccgaggtgccagatgtgtcatccagatgacccagtctccatcctcctgtccgcatctgtagagacagagtcatcatcacttgccggcaagtcagagcattagaacgtatttaaattggtatcaaacagaaaccaagggaaacgcccctagaacctcctgactctaatggttcactccgtactttgctggaggtcgggtccagtcaagttcagtgcagtgatcgtaggacagattcactcncactncacntcngntaggctgagtatttgactaattctactgtactaactagtagttcacgtttcccataccgttcgacccgttggacctaagtacgtggtaacttacgtaacgtaaacgtaacgttgtacggtctacgtacctaaccgtacgttcctttagttccttaccttaccgttccctttacccggaccttagttcccgttaag

SEQ ID NO: 81395 - DNA, 757 bp, Homo sapiens
  misc_feature: GYAE6OF01A12S1.52.1.A01.1.454.CMB.1.raw
tcagcgcagtacgacacgaccggtgctcgatttagacgtctcatcagggcacagcatggacatgagggtccccgctcagctcctggggctcctgctactctggctccgaggtgccagatgtgtcatccagatgacccagtctccatccctccctgtccgcatctgtaggagacagagtcatcatcacttggccgggacaagtcagagcaattaagaacgttatttaaagttggtaatacaaacaacgaaaaccgaagggaaacgcccctagaaccttcctagacttctagttggttaccaacttcctactttgtcgtaggtacggtcggggtaccctagttacgtaacggttcaggtcggacgtaggtaggagttcggtaggaacgtagtaacgttcaaccttcgtaccaccaactaccaaccgtacgttccgtaggaccgtacggtcgttacggggtaacggtttaactttttacggaaccgttaaaccttttaccgtttcgttaaccgtaccgtaaaccgtacggttaacgtttacccgttaccgttttaccccgttaccgttacccgttttacccgggacccggttaaccgggtacccttaaggttacgttacgggttaacttaaccgtaaccggtaaaaccgggtacgttcgggtacggtaccgttacggaccctaacccgttacgttccgttacgttacctttaacccgttactttacccccgttacccccgctttaaccggtctttaacgg

SEQ ID NO: 81396 - DNA, 664 bp, Homo sapiens
  misc_feature: GYAE6OF01CP6CH.52.1.A01.1.454.CMB.1.raw
  modified_base (202)..(202): a, c, t, g, unknown or other
  misc_feature (202)..(202): n is a, c, g, or t
  modified_base (265)..(265): a, c, t, g, unknown or other
  misc_feature (265)..(265): n is a, c, g, or t
tcagcgcagtacgacacgaccggtgctcgatttagacgtctcatcagggcacagcatggacatgagggtccccgctcagctcctggggctcctgctactctggctccgaggtgccagatgtgtcatccagatcgacccagtctccactcctccctgtccgcatcgtggtaggaagacagagtcatcatcacttggccggganaagtcagagctaattagaaacgttatttaaagttggtatacaaacagaaaccgaagggaaacnccctagtaacctccgttagattcttatcggttcaacttcctactttcgcgtacggtacggtcggggtaccctaagtacggtaaggtcctaggtcggacgtaggtggtactcggtaggaactagtacttcactctacaccactcgacagtcgtcggacacggtacgtgtacggttatttacgaccttaacgtttactcgtacaacgtaacgtagtacgttaacctccgtttaccttactacccggtttacggcccgttaaggtaccgtaatacgggtacgttacgttaaccaacggtaaacgtaacgttcgggtacgttaccgtacgggcccttaccgtagttaccgtttccgtctttaccgtacccttcccgtaccccgtacttaacgttccgttaacg

SEQ ID NO: 81397 - DNA, 693 bp, Homo sapiens
  misc_feature: GYAE6OF01DVR9B.52.1.A01.1.454.CMB.1.raw
  modified_base (163)..(163): a, c, t, g, unknown or other
  misc_feature (163)..(163): n is a, c, g, or t
tcagcgcagtacgacacgaccggtgctcgatttagacgtctcatcagggcacagcatggacatgagggtccccgctcagctccgtggggctcctgcctactctggctccgaggtgccagatgtgtcatccagatcgacccagtcctccatccctccctgtccncatctggtaggagacagagtcatcatcattcggcggacaagtcagagctaattaagaacgtttatttaaagtggtaactacaaacgaagaaaaccgagggaaacgtcccctagtaacctcctagatctagttgtctactcctatttgcctggacgtcgggtacctagtacgtaaggtcgtaggtcggacgtaggtaggtaacgttcgtagggaacgtaagtactttaaccgaaccttcctaaccaaccttaaacgtacccgaacccgttagtccgtacggaccgtacggtaccgttagggaagttttcttttaacgtaacctttaaacctttaccgtttacgtaccgtaaccgtaacgtaagttaaccgtttaaccgtaccgtttaccccttacttacccgggttttccggcccgtacggtaacctaggttaacgtacggtaacttaacgtaaccgtaaacgtacgtcgttacgactacggtcaacgttctcgttacttctacgtacctccctaccgtctagtcgttaac

SEQ ID NO: 81398 - DNA, 560 bp, Homo sapiens
  misc_feature: GYAE6OF01ATQQ4.52.1.A01.1.454.CMB.1.raw
  modified_base (273)..(273): a, c, t, g, unknown or other
  misc_feature (273)..(273): n is a, c, g, or t
  modified_base (337)..(337): a, c, t, g, unknown or other
  misc_feature (337)..(337): n is a, c, g, or t
tcagcgcagtacgacacgaccggtgctcgatttagacgtctcatcaggggggagtcagtctcagtcaggacacagcatggacatgagggtccccgctcagctcctggggctcctgctactctggctccgaggtgccagatgtgtcatccagatgacccagtctccatccctccctgtccgcatctgtaggagacagagtcatcatcacttcgccgggcaagtcagagctattagaacgtatttaaattggtatacaacagaaaccagggaacncccctagaacctcctgtatctatggttcatcctactttgcttgaggtcgggtccatcaaggttnaggtgcagtgatcgtgggactagaatcactctacaccataccacacgttctagcgtaggctggaagtattttacgaccttaacttccttacttacgtactaacgtagtaacgttacgtaccgtttccctactaaccgtttcgacccgtggaccctagtacgtggtatacgttacaaacgtacttacggtacgtacgtacacctaccacttccgtgtttacccg

SEQ ID NO: 81399 - DNA, 942 bp, Homo sapiens
  misc_feature: GYAE6OF01C1CIR.52.1.A01.1.454.CMB.1.raw
tcagcgcagtacgacacgaccggtgctcgatttagacgtctcatcagggcacagcatggacatgcgggtccccgctcagctcctggggctcctgctactctggctccgaggtgccagatgtgtcatccagatcgacccagtcctccactccctccctgtccgcatctggtaggagacagagtcatctagtcacgttcggccggactaagtcaagacgactaattaacgtaaacgttattttaaaagttggtaactacgaaacaaacgaaaccgtaagggaaaccgtacccgtagtaaaccttcctagtattacgttacgttcggttactacttacccttacgtttcgacgtacggtaacgggttccggggttaccctaagttaccgtaaacggttttcgaagggttcggtacggtaaggtcggtaacgttacgggtacggggtaaacttaaacggttaaacgtttaccctaaccctttaacccgtaacctaaacccccgtaacgtttaccccaaaaccggttaacggtttacccgttacggaccgggttaagggtaccggttttaagggtaaacgggttttaaccttttttaacggggaacccttttaaaacccgtttttacggtttacccgttaaccgggttaaaccgttaaaccttaaacgggttaaaccgggttttaaccccttaaccccgggtttttaaccccctttacccgggtttaaccccgtttttaccccgggggtaccccgtttaaccggggaaacccgtttaagtttaaccgggttaacggaaaccgttttaacgaaacccggttaaacggtttaaaccggttcggttcgggtaaccggtaccctaaccgtaaccccgtttaggtttaacccttaccgtttaacccttcgtttaacccttaccccggttaccctaacgtacgttcgtaaccg

SEQ ID NO: 81400 - DNA, 603 bp, Homo sapiens
  misc_feature: GYAE6OF01DQ9UC.52.1.A01.1.454.CMB.1.raw
  modified_base (280)..(280): a, c, t, g, unknown or other
  misc_feature (280)..(280): n is a, c, g, or t
tcagcgcagtacgacacgaccggtgctcgatttagacgtctcatcaggggggagtcagtctcagtcaggacacagcatggacatgagggtccccgctcagctccgtggggctcctgctactctggctccgaggtgccagatgtgtcatccagatgacccagtcctccatcctccctgtccgcatctgtaggagacagagtcatcatcacttgccggcaagtcagagcaattaagaacgttaatttaaagttgtaactacgaaacagaaaccgaaggaacncccctgaactccgtagactctagtggttcactcctactttgcgtgtacggtcgggtcccagtacgtaaggttcaggtggcagtggtatcggtagggactaagtaacttacgacttaccgtcaacccgtatcccaaccgtgtccgtagcgtaggtctaggtagttactttcgacttaaactttcttactctaccaatacgttacgtttacacccgtttccctaccgtttaccgtttcccggcccgttaggaaccctagttacggagtactaactaacccgaaacgttctacggttcgacctcgacctagtacttcgtcgttacc

SEQ ID NO: 81401 - DNA, 710 bp, Homo sapiens
  misc_feature: GYAE6OF01ESTZ7.52.1.A01.1.454.CMB.1.raw
tcagcgcagtacgacacgaccggtgctcgatttagacgtctcatcagggggggagtcagtctcagtcaggacacagcatggacatgagggtccccgctcagctcctggggctcctgctactctggctccgaggtgccagatgtgtcatccagatgacccagtcctccatccctccctgtccgcatctgtaggagacagagtcatcatcacttgccgggacaagtcagacgctattagaacgttaatttaaagttggtatacaacaacgaaaccgagggaaacgcccctagaacctcctgtatctagtggttctactcctacgtttgcgtggtacggttcggggtaccctagtaccgtaacggttccgaagggtcggtacgtaggtacggtaacgttcggtacggggtaacgtaacggtaaactttcccgtaaccttcccgttacctaaccctacttacccaccgtaacgttcgtacggaccgtacggtcgttagggtagggtttaacgtttttacggtaccctttaaacctttaccgtttacttacgtaacctaacgtaacggttaacgtttaacctaccggttttaccccttaccgttaccgtttcccggtacccgttaccgggacctagttacggtaagtaacgtaacgtaacgtaaaccggtacgttcggtcggtaccgtacgaccctacctacttcgttcgttacc

SEQ ID NO: 81402 - DNA, 558 bp, Homo sapiens
  misc_feature: GYAE6OF01EPIZP.52.1.A01.1.454.CMB.1.raw
  modified_base (353)..(353): a, c, t, g, unknown or other
  misc_feature (353)..(353): n is a, c, g, or t
  modified_base (390)..(390): a, c, t, g, unknown or other
  misc_feature (390)..(390): n is a, c, g, or t
tcagcgcagtacgacacgaccggtgctcgatttagacgtctcatcagggcacagcatggacatgagggtccccgctcagctcctggggctcctgctactctggctccgaggtgccagatgtgtcatccagatgacccagtctccatcctccctgtccgcatctgtaggagacagagtcatcatcacttgccggcaagtcagagcattagaacgtatttaaattggtatcaacagaaaccagggaaacgcccctgaactcctgatctatgttcatccactttgctgagtgggtccatcaaggttcagtgcagtggatctgggacagaattcactctcacatcaccagtctgacngctgaggtattttgctaacttacttctacgtactaanaagtacgttaactacggttccctactaccgtttcggcccttacggggacctagtacggttagggacttaacgtactaaaaccgtacttggtacgggtccttaggaccctaccgtacttccgtcgtttcctttacctacttcccttaccccggccttaactcgttaacg

SEQ ID NO: 81403 - DNA, 810 bp, Homo sapiens
  misc_feature: GYAE6OF01BZVFD.52.1.A01.1.454.CMB.1.raw
  modified_base (199)..(199): a, c, t, g, unknown or other
  misc_feature (199)..(199): n is a, c, g, or t
tcagcgcagtacgacacgaccggtgctcgatttagacgtctcatcagggcacagcatggacatgagggtccccgctcagctcctggggctcctgctactctggctccgaggtgccagatgtgtcatccagatcgacccagtcctccatcctccctgtccgcatctagtaggagacagagtcatcatcacttggccgganaagtcagagctaattaagtaaacgtttattttaaaagtggtaactacaaacgaacgaaaacccgaaggggaaaaccgcccctaggaaaccttccctaggtacttacgttaagttcggttaccacttacccttacgtttgacgttggtacggttccggggtaccctagttacgtaagggttccaaggttggaccgtaggtggtagtcggtacgggaactaacgtaacgttacaccttacctacccgtaactacctaaccgaccgtacgttcctacggtacgtacgggtccttagggtaacgggtttaacttttcggaaacctttaaacccgttttaccgtttccttaaccggttaaccgaaacgttacggttaaccttttaacccgtacccgtttttaccccttaccgttaacccggtttcccgggtaccccgttaacgggtaacccctaaggtttaacgggtacgtaacgtttaaccgtaaacgtaaaacccggttaggttaccggtccggtaacgttaccgtaacccttaaccgtacgtttcccgttccgtttacctttacccgttcctttacccctccccggttaccttaccgttaccggtttaaaccg

SEQ ID NO: 81404 - DNA, 716 bp, Homo sapiens
  misc_feature: GYAE6OF01DTKBD.52.1.A01.1.454.CMB.1.raw
  modified_base (96)..(96): a, c, t, g, unknown or other
  misc_feature (96)..(96): n is a, c, g, or t
  modified_base (135)..(135): a, c, t, g, unknown or other
  misc_feature (135)..(135): n is a, c, g, or t
  modified_base (181)..(181): a, c, t, g, unknown or other
  misc_feature (181)..(181): n is a, c, g, or t
  modified_base (193)..(193): a, c, t, g, unknown or other
  misc_feature (193)..(193): n is a, c, g, or t
  modified_base (198)..(198): a, c, t, g, unknown or other
  misc_feature (198)..(198): n is a, c, g, or t
  modified_base (327)..(327): a, c, t, g, unknown or other
  misc_feature (327)..(327): n is a, c, g, or t
tcagcgcagtacgacacgaccggtgctcgatttagacgtctcatcaggggggagtcagtctcagtcaggacacagcatggacatgagggtccccgntcagctcctggggctcctgctactctggctccggaggtnccagatgtgtcatccagatgacccagtctccatccctccctgtccncatctgtagganacagngtcatcatcacgttgccggacagtcagagctaattagaacgttaattttaaagttggtaattacaaacgaagaaaaccgaagggaaacgcccctagaactctgattctatggttacactcctatttcgntggagtcgggtcctagtacgtaacggttctaggtcggacgtaggtggtacgtcgtacggggactaagaactttccgaacttcctaccacctactaccctaaccgtacgttcctaggccgtaacgggtaccttagggtaacgggttatttttcggaaccttaaaccgttttaccgtttcgtaacgtaccgtaacgtaaacggtttacgtttaaacccgtaccgtttttccccgtaactttaacccggttttcccgggaccccgttaacggggtaaaccctaacggttacggttacgggtaaaccttaaccggttaaacccgaaaaacggttaccgttacggttacgggtaccttaccgtaccaaccgttaactttccgttacgtttaccc

SEQ ID NO: 81405 - DNA, 724 bp, Homo sapiens
  misc_feature: GYAE6OF01DRO6H.52.1.A01.1.454.CMB.1.raw
tcagcgcagtacgacacgaccggtgctcgatttagacgtctcatcaggggggagtcagtctcagtcaggacacagcatggacatgagggtccccgctcagctcctggggctcctgctactctggctccgaggtgccagatgtgtcatccagatgacccagtctccatccctcctgtccgcatctggtaggagacagagtcatcatcacgttcggccgggacaagtcagagctaattaagaacgttattttaaagttggtaatacaaacaagaaaaccgagggaaacgccccctaggtaaacctccgtaggtacttcttaattcggttacctacttccgtacttttgcgtaggtacggtcggggtccctagtaccgtaacggtttccgaggttcggacgtaggtgtacgtccgtagggactaagtaattccgacttacctaccaacctactacctaccgtagttctcggtacgacggttccgtaggtaacggttacttttacggtaccttaacgttttccgtttacgtacgtaaccgtaaccgtaaggttacgtttaacccgtacccgttttccccgttacgttaaccccggttttccgggaccccggtttagggtaaccccttaaggttaccggttagggtaacttaaacccgtaaacgtaaaccggttacgttacgggttacgcccttacggaccctaaccttacgttccgttaacgtttccc

SEQ ID NO: 81406 - DNA, 661 bp, Homo sapiens
  misc_feature: GYAE6OF01A5I1J.52.1.A01.1.454.CMB.1.raw
tcagcgcagtacgacacgaccggtgctcgatttagacgtctcatcagggcacagcatggacatgagggtccccgctcagctcctggggctcctgctactctggctccgaggtgccagatgtgtcatccagatgacccagtctccatcctccctgtccgcatctgtaggagacagagtcatcatcacttgccggcaagtcagagcatagaacgtatttaatggtatacaacagaaaccgagggaaacgcccctagaacctcctagacttctagttcggttaccactaccctacgtttcgcgttaggacggttcggggtaccctagttacgtaaaggtttcgaaggttcgggacgtagggtaggtagtacggtaggaacgtaagtacttaccgaccttacctacaaccctactaccgtaaccgtacgttacctcggaccgtacggtcgtaggtacgttactttacgaacccttaactttcttacgtacgtactaacgtagttaaccgttacctaccgttacctacttacccggttaccggcccgttacggtacctagttacggtagtaacttacgtaacgtaaacgtacgtcggtcgacgtacgaccgtacctactcgttcgtaccttactaccgttaccccttaccgcctagtccgttaacg

SEQ ID NO: 81407 - DNA, 716 bp, Homo sapiens
  misc_feature: GYAE6OF01DLYPT.52.1.A01.1.454.CMB.1.raw
  modified_base (254)..(254): a, c, t, g, unknown or other
  misc_feature (254)..(254): n is a, c, g, or t
tcagcgcagtacgacacgaccggtgctcgatttagacgtctcatcagggggggagtcagtctcagtcaggacacagcatggacatggagggtcccccgctcaggctccgtggggctcctgctactctggcctcggaggtgccagatggtgtcatccagactcgaccctagtcctccacttcccctccctgtcccgcattcgtaggtaggagacaggtactactatcatctacgttcggccgggactagtcgagngactaagttaacgtaacgtttaattaagtggtaactacaaacgaacgaaaccggaggaacctccctaggaaccctcgtagtattcgtagtcgtaccacttccctagttcgcgtggtacgggtcggtacctagtaccgtaaggtcgtaggcgtacgtaggtgaacgtcggtacgggtaactaagtactttcaccgttacctacaacctctaacgaccgttgtcgtacggtacgaggtcgttaaggtacgtttacgtttaccgtaaaccttactttaccgtacgttaaccgaacgtaacgttaacgttaaccgtttacctaccccgtttcccgtaaccggttaccgtttccccggggtacctacggggttacctagggtacgttaacggtaacttaaccggaacgttaaacggtcgttacggtccggaccttacgtaaccctaccttacgttcttccgttaccg

SEQ ID NO: 81408 - DNA, 786 bp, Homo sapiens
  misc_feature: GYAE6OF01DZZ49.52.1.A01.1.454.CMB.1.raw
  modified_base (127)..(127): a, c, t, g, unknown or other
  misc_feature (127)..(127): n is a, c, g, or t
  modified_base (565)..(565): a, c, t, g, unknown or other
  misc_feature (565)..(565): n is a, c, g, or t
  modified_base (776)..(776): a, c, t, g, unknown or other
  misc_feature (776)..(776): n is a, c, g, or t
tcagcgcagtacgacacgaccggtgctcgatttagacgtctcatcagggcacagcatggacatgacgggtccccgctcagcctccgtggggctcctgctactcgtggctccgaggtgccagatggtntcactccagatcgaccctagtcctccctacttccctcccgtcgtcccgctactcgtaggtaggagagacccccgtagtcactctagtcctacggttccggaccggacgtaacgtacgagacgtacgttaagttaacggtaaacgtttaagttttaaagttacggtaactaaccgaaaacgaaacggaaaccggaaacgggtaaccgtaccctacgtaaccttaccgtagtacttacgtacgttcgtactaccgttaccttcgttcgtcgtggtacggttccggtactacgtagttacggtagtacggtggtacgtaggtacgtacgtacggtacggtaacttagtaccttacgtacctacgtaacactactacgtactacgttagtcgtacgacggtcgttaggtacgttagtttacttaaccgtaccttacgtttanccgttaagtaacaacggttaattaccggttccttacccgtttccgaccgtttacccgggtcccgtaaccggttaccgtaacgttaggtaacgttacgtaaacgttacccgaaacggttaaccggtgtaacccggtgaaccccggttcgaaccctttacgtttccgttacttcgtttaccccgttaccttaccgggttacccctccgtttanacgtttaccg

SEQ ID NO: 81409 - DNA, 674 bp, Homo sapiens
  misc_feature: GYAE6OF01B0AVK.52.1.A01.1.454.CMB.1.raw
  modified_base (178)..(178): a, c, t, g, unknown or other
  misc_feature (178)..(178): n is a, c, g, or t
  modified_base (283)..(283): a, c, t, g, unknown or other
  misc_feature (283)..(283): n is a, c, g, or t
  modified_base (290)..(290): a, c, t, g, unknown or other
  misc_feature (290)..(290): n is a, c, g, or t
  modified_base (612)..(612): a, c, t, g, unknown or other
  misc_feature (612)..(612): n is a, c, g, or t
tcagcgcagtacgacacgaccggtgctcgatttagacgtctcatcagggcacagcatggacatgagggtccccgctcagctccgtggggctcctgctactctggctccgaggtgccagatgtgtcatccagatcgacccagtcctccactcctccctgtccactatcgtaggtagganacagacgtcaatcatcgtacgttcggaccggtacaagtcagactactagttaacgtaacgttaatttaacgttgaactacgaacgaacgaaaccgacggtaaccncccgtanacctacagtactcgtattgttacctacgtaccttacgttcgcgtaggtacggtccggtaccagtcgtaagtcgagtcgacgtgtgacgtacggagactagtactactacgtccactaccatccaacgtcgtacgtcgacgtagtacgtaggttatttacgtacgttacttaacgtttactacgtaccggtaactaacggttacgttaaccgttaacccgttcccgtttaccccgttacgttacccggttcccggtaccgtaccggtacgttaacgttaggtactaacgttaacgtaaccgaagttcgtagtcgtaccgtacncccgtaattacgttctaccgttacaccgttccgttaccctcccgtcttacgtccggttaacg

SEQ ID NO: 81410 - DNA, 679 bp, Homo sapiens
  misc_feature: GYAE6OF01CTCM2.52.1.A01.1.454.CMB.1.raw
  modified_base (164)..(164): a, c, t, g, unknown or other
  misc_feature (164)..(164): n is a, c, g, or t
  modified_base (204)..(204): a, c, t, g, unknown or other
  misc_feature (204)..(204): n is a, c, g, or t
  modified_base (488)..(488): a, c, t, g, unknown or other
  misc_feature (488)..(488): n is a, c, g, or t
  modified_base (546)..(546): a, c, t, g, unknown or other
  misc_feature (546)..(546): n is a, c, g, or t
  modified_base (602)..(602): a, c, t, g, unknown or other
  misc_feature (602)..(602): n is a, c, g, or t
  modified_base (623)..(623): a, c, t, g, unknown or other
  misc_feature (623)..(623): n is a, c, g, or t
  modified_base (634)..(634): a, c, t, g, unknown or other
  misc_feature (634)..(634): n is a, c, g, or t
tcagcgcagtacgacacgaccggtgctcgatttagacgtctcatcagggcacagcatggacatggagggtcccccgctcagctccgtggggctcctgctactctggctccgaggtgccagatgtgtcatccagatcgacccagtcctccatccctccctgtccncatcgtgtaggagacagagtcatcatcacgttggccgganaagtcaaggatacaagttaagtaaacgtttaattttaaagttaggtaataaccaaaacgaaacggaaaacccgaacgggaaaccgccctaacggaacctaccgtagtacttacttagttcggttactactttacccgtacgtttgtacgttcgggtacggttaccggggtaccctaagttaccggtaaaagggtttccgaaggttcggacgtagggtacgtacttacggtaggaactaagtaacttcgaaccttactaccaacctactacctaacgtgtaccgngacgacggtgttacggtaagttcttttaacgacttaacgtttctacgtacactaacgnggttaccttactaccgttccctaacgtcccgttacggcccgtacggactaggtacngtaatacgacacgtatcggtnactcgacctancgttctacgtcttacctctttaccctccgaattagttccgtaacg

SEQ ID NO: 81411 - DNA, 593 bp, Homo sapiens
  misc_feature: GYAE6OF01BKXD0.52.1.A01.1.454.CMB.1.raw
tcagcgcagtacgacacgaccggtgctcgatttagacgtctcatcagggcacagcatggacatgagggtccccgctcagctcctggggctcctgctactctggctccgaggtgccagatgtgtcatccagatgacccagtctccatcctccctgtccgcatctgtaggagacagagtcatcatcacttgccgggcaagtcagagcattagaacgttatttaaattggtatcaaacagaaaccagggaaacgcccctagaactcctgatctagtcgttcatcctactttgctgagtcgggtaccatcgaaggttcagtggacagtggatcgtaggacagtattcactctacacctatccactagtctacgcagtctaggagtagtttcgaacgtaactttacttcgttacgtactaacgtagttacgttacctacgtttcccctacgttaccgtttcccgggacctacgggaccctagttacggtaggtaactaacgtacgaaacgtacgttggtacgctacggtcctacgtattcctacggttacccttaccgtaccgttaccccgtttacccgacccttagttcccgtaacg

SEQ ID NO: 81412 - DNA, 566 bp, Homo sapiens
  misc_feature: GYAE6OF01CH4ZH.52.1.A01.1.454.CMB.1.raw
  modified_base (197)..(197): a, c, t, g, unknown or other
  misc_feature (197)..(197): n is a, c, g, or t
  modified_base (251)..(251): a, c, t, g, unknown or other
  misc_feature (251)..(251): n is a, c, g, or t
  modified_base (363)..(363): a, c, t, g, unknown or other
  misc_feature (363)..(363): n is a, c, g, or t
  modified_base (384)..(384): a, c, t, g, unknown or other
  misc_feature (384)..(384): n is a, c, g, or t
tcagcgcagtacgacacgaccggtgctcgatttagacgtctcatcagggcacagcatgcacatgagggtccccgctcagctcctggggctcctgctactctggctccgaggtgccagatgtgtcatccagatgacccagtctccatccctccctgtccgcatctgtaggagacagagtcatcatcacttggccgggnaagtcagagcattagaacgttatttaaagtgtatacaacagaaaccagggaacnccctagaactctgatctatggtcatctacttgctgaggtcggggtcccagtcaaggttcaggtggcaggtggatcgtagggacagtaacttcgactctaccaccatcacctntcgtgcgaggctggtacgttntttgtacctactttcttcgtataccaacgtagtacgttaacctcgttccctacgttacgtttccggacccgtcggtaaccctagttacggtagaacttacaaccgaaacgtacgtgtacggactcggacccaactcgttaccttgttccttccttaccttcccgttccccgtctcgtttacg

SEQ ID NO: 81413 - DNA, 784 bp, Homo sapiens
  misc_feature: GYAE6OF01ACZO3.52.1.A01.1.454.CMB.1.raw
tcagcgcagtacgacacgaccggtgctcgatttagacgtctcatcagggcacagcatggacatgacgggtccccgctcagctccgtggggctcctgcctactctggctccgaggtgccagatgtgtcatccagatcgaccctagtcctccactccctccctgtcccgactattccgtaggtaaggacgaacaggtacgtcctaatcctaactcctacgttcgggcccgggtacaacggtccaggacgtactaagttaaggtaaacgttttaattttaaacgttagggtaactaaccgaaaacgaaacggaaaaacccggaacggggtaaaacccgtccccgtaagtaaccttcccgtagtaccttacgtaagttcggttacctactccttagttacgcgtacggacggtccgggtacctagttacggtaacggtcgaaggtcggagtaggtacggtactcggtacggaactaacgtaccttacctacttccaacctacctacctaccgtacgtacgtcgtaggtacgtacggtacgttagggtaacgtttacgtttacgtaaccctttaacgttaccgttcgtaaccgtaacgtaaccgttaggttacccgttacgttccccgttacccgttaccgttaacccgggtttcccggacccggttacgaacgttagtacggtacttaacgtactaaccggtaacgtcgttggaccgtcctagacccgttatacgtccgtttactaccttaccgttacccgttaccccgtaccgtcttagtccgtacg

SEQ ID NO: 81414 - DNA, 756 bp, Homo sapiens
  misc_feature: GYAE6OF01DTMID.52.1.A01.1.454.CMB.1.raw
  modified_base (164)..(164): a, c, t, g, unknown or other
  misc_feature (164)..(164): n is a, c, g, or t
  modified_base (176)..(176): a, c, t, g, unknown or other
  misc_feature (176)..(176): n is a, c, g, or t
  modified_base (204)..(204): a, c, t, g, unknown or other
  misc_feature (204)..(204): n is a, c, g, or t
  modified_base (748)..(748): a, c, t, g, unknown or other
  misc_feature (748)..(748): n is a, c, g, or t
tcagcgcagtacgacacgaccggtgctcgatttagacgtctcatcagggcacagcatggacatggagggtccccgctcagctcctggggctcctgctactctggctccgaggtgccagatgtgtcatccagatcgacccagtcctccactccctccctgtccgnatctggtagganacagatcatcatcacgttcggccggganaagtcaggagactaagttaacgtaacgtttaattttaagttaggtaactacgaaagtaacggaaaacccggaagggaaccctaccccgttaagtaaacccttccgtaagtacgttacgttacgttaccggttacctacctttacctttacgtttcggtcggttaacgggtacggggttccgggtaccctagttaacgtaggtacagggtcgacgtaggtgtacgttcgaaggtactaagtaccttccacgttaccaccaactactaccacggttactcgacgacgacggtcgtaggttacgtttactttacgtaacctttaaccttcgttaccgtaacgtaccgtaaacggttacgtttaacccgtttaccttaccccgttcccgtttaaccggttacccggttcccgggtacccggtaaccggtaaccgtttaggtaacgggttagaaaccttaacggtaacctaaacgggtcgtcggtacggtacctacggtacctaccgtattccgttacgttcttacccgttaccttccctacctcgttnttcgtacg

SEQ ID NO: 81415 - DNA, 675 bp, Homo sapiens
  misc_feature: GYAE6OF01DX4FK.52.1.A01.1.454.CMB.1.raw
tcagcgcagtacgacacgaccggtgctcgatttagacgtctcatcagggcacagcatggacatgagggtccccgctcagctcctggggctcctgctactctggctccgaggtgccagatgtgtcatccagatgacccagtctccatcctccctgtccgcatctggtaggagacagacgtcatcatcacgttgccgggcaagtcagagcaattagaacgttatttaaatggtatcaaacagaaaccagggaaacgccctagaacctctagatctatgtcatctacttgctgaggtcgggtaccagtacgaaggttcaggtcggacgtaggtcgaatcggtaggacgaagaacttcacgttactccactactcaacctgtctagcgaacggtcttaggaacggttacttttacggaaccctttaacgtttaaccgttcgttacgtaaccgtaaacgtaggttaacgtttaaccgtaacccgttttccctaaccgtttaacccgttttcccgggaaccccgttaggggtaaccccttaagtggttaaccggtaattaaccgttaccgaaaacggttcgtaggttaccggtactaccgaaccttaaccctaagtttcccgttacgtttaccttaaccctaaccgtttcccccttccccggaactacctttcggtaaacg

SEQ ID NO: 81416 - DNA, 567 bp, Homo sapiens
  misc_feature: GYAE6OF01COAD1.52.1.A01.1.454.CMB.1.raw
  modified_base (96)..(96): a, c, t, g, unknown or other
  misc_feature (96)..(96): n is a, c, g, or t
  modified_base (180)..(180): a, c, t, g, unknown or other
  misc_feature (180)..(180): n is a, c, g, or t
  modified_base (195)..(195): a, c, t, g, unknown or other
  misc_feature (195)..(195): n is a, c, g, or t
  modified_base (216)..(216): a, c, t, g, unknown or other
  misc_feature (216)..(216): n is a, c, g, or t
  modified_base (224)..(224): a, c, t, g, unknown or other
  misc_feature (224)..(224): n is a, c, g, or t
  modified_base (270)..(270): a, c, t, g, unknown or other
  misc_feature (270)..(270): n is a, c, g, or t
tcagcgcagtacgacacgaccggtgctcgatttagacgtctcatcaggggggagtcagtctcagtcaggacacagcatggacatgagggtccccgntcagctcctgggctcctgctactctggctccgaggtgccagatgtgtcatccagatgacccagtctccatccctccctgtccgnatctggtaggagacngatcatcatcactggccgganaagtcagngtcattagaacgttatttaaatggtatacaacagaaaccaggaacncccctagactctgatctagtgtcatcctacttgctgacgtcgggtacccatcgtaaggttcagtggcaggtgaatcggtacggactagtaaattccgaccttactaccacctacttaccaccgtagtctagccgaggtactggtagttagttttcgactaaccgtttacttcgtagtaccaacgtaagtactttacgtaccgttcctaccttactttccggaccttacggactagtagtggtaactactaccgaaacgtacgttcggtcgtcgtcgacacctcgttacgtcgttacc

SEQ ID NO: 81417 - DNA, 708 bp, Homo sapiens
  misc_feature: GYAE6OF01DF789.52.1.A01.1.454.CMB.1.raw
  modified_base (271)..(271): a, c, t, g, unknown or other
  misc_feature (271)..(271): n is a, c, g, or t
tcagcgcagtacgacacgaccggtgctcgatttagacgtctcatcagggcacagcatggacatgagggtccccgctcagctcctggggctcctgctactctggctccgaggtgccagatgtgtcatccagatgacccagtcctccactccctccctgtccgcatcgtgtaggagacagagtcatcatcacgttcggccgggcaagtcagagactaagttagtaacgttaattttaaagttggtatacaaacgaagaaaccgaagggaaacnccccgtagaacctcctagtatactagtcggtctactccttacgtttgcgtaggtacggtcgggtaccctagtacggtaaacggtttcgaaggtcggtacgtaggtggtacgttcggttacggggaactaacggttaacttacccctaacttcccttaccgaaccccgttatacccctaaccgttaacgttccgtacggcgtacgggttacgtagggtttaacgtttacgttttacggaccctttaaaccgtttacgtttccgtacgtaacaacgtagttaacgttacgtaccgtttccctagttccgtttccggccgttacgggacctaggtacggtggtacttacgtaacgtaaacgtacgtggccggtcgtacgaccgtaactcttcgttaacttccttaactcccttaccccgttaccctccgtattcgtaacg

SEQ ID NO: 81418 - DNA, 679 bp, Homo sapiens
  misc_feature: GYAE6OF01C9R4V.52.1.A01.1.454.CMB.1.raw
  modified_base (200)..(200): a, c, t, g, unknown or other
  misc_feature (200)..(200): n is a, c, g, or t
  modified_base (271)..(271): a, c, t, g, unknown or other
  misc_feature (271)..(271): n is a, c, g, or t
  modified_base (636)..(636): a, c, t, g, unknown or other
  misc_feature (636)..(636): n is a, c, g, or t
tcagcgcagtacgacacgaccggtgctcgatttagacgtctcatcagggcacagcatggacatgagggtccccgctcagctcctggggctcctgctactctggcctccgaggtgccagatgtgtcatccagatgacccagtctccatccctccctgtccgcatctgtaggagacagagtcatcatcacgttcggccgganaagtcagagactaattagaacgttaattttaaagtggtaataccaaacaacgaaaaccgaaggggaaaccnccccgtagaaaccttcctagtaacttacttacgtcggttacctacttaccgttacgttttggcgttaggtacgggttcggggtaccctagtaccgtaaggtttcgaggttacggacgtaggtggtacgttcggtacgggaactaaacgtaacctttccaaccttcctaccaaccctacgttacccaacgtacgttcgtacgacgaggtcttagggtaagttactttcgactttaactttaccgttctacggtactaacgtaagttcgttaaccttccgtttccccttacgtccgtttaccggcctacgggtactacgtggtagtacttaacgacgaacgtacgttgacggtctacggacctactnttccgttacttctactacgttccctacccgtctgttacgtacg

SEQ ID NO: 81419 - DNA, 957 bp, Homo sapiens
  misc_feature: GYAE6OF01C5LMT.52.1.A01.1.454.CMB.1.raw
  modified_base (214)..(214): a, c, t, g, unknown or other
  misc_feature (214)..(214): n is a, c, g, or t
tcagcgcagtacgacacgaccggtgctcgatttagacgtctcatcaggggcacagcatggacatgagggtccccgctcagctcctggggctcctgctactctggctccgaggtgccagatgtgtcatccagatcgacccagtctccatccctccctgtccgcatctgtaggagacagagtcatcatccacgttggccgggacaagtcgaagacnctaattaacggaacgtttaattttaaatgggtaataccaaacaacggaaaaccgtaaggggaaaaccgcccccgtaggaaaccttcccgtaggtaacttacgttaagttcggtttaccaactttccccttaacgttttggccgttagggtacgggttaccggggggttaccccaaggttaccgttaaaacgggttttccggaagggttcggggtaccgtagggttagggtaaaccgtttaccgggttaacgggggtaacccttaaaggggttaaactttaccccggtaacttaccccgttaacccaacccttacgtaaccctaaaccccggtagtttacccgtcggaaccggtaaacgggttccggttagggttaaacgggttttacgtttttcccggaaacctttaaaccggtttttaaccttaccggttacgtaacccgtaaacggtacggtttaaaccgttaacccgttttaacccggtttaccccctttaaccgtttacccggttttacccggggacccccgtttaagggggtaaacccccttaaggtttaaaccgggttaggtaaaccgtttaaacggttaaccgtaaaaaccggtacggtttacggtaccgggttaccgtacccgggtaaccccttaaacgtacgttttacccgtttcgggtttacccccctttttacgtaacccccttttaccccggtttacccccccggtaaacttccgtttaccggttaaacgg

SEQ ID NO: 81420 - DNA, 714 bp, Homo sapiens
  misc_feature: GYAE6OF01B7VLC.52.1.A01.1.454.CMB.1.raw
  modified_base (183)..(183): a, c, t, g, unknown or other
  misc_feature (183)..(183): n is a, c, g, or t
tcagcgcagtacgacacgaccggtgctcgatttagacgtctcatcaggggggagtcagtctcagtcaggacacagcatggacatgagggtccccgctcagctccgtggggctcctgctactctggctccgaggtgccagatgtgtcatccagatcgacccagtcctccatccctccctgtccncatctgtagagacagagtcatcatcacttggccgggacaagtcagagactagttaagaaacgttaattttaaagttggtaatacaaacaacgaaaaccgaacgggaaacgtcccctagaaccttcgtagtatacctagttacggttacacttacctacgtttgcgttaggtacggtccgggtaccctagtaccgtaaaggttctaggtggacgtaggtggacgttgtacgggtaactaagtaacttcaccgttacctaccgtacctacttaacccaacccgttagtcccgtacgaccgaacgggtaccgttaggtaacgggtttatttacgtaacctttaaccgtttacttacgttcgtaaccaaacgtagttaacgttaaccgttacgttccccttaccgttaccgtttcccgggacccgtacgggtaaccttacggttaggtaccgttaaacgttaaccgtaaacgtaaaccggttacgtcggttaacccggtcgttaccgaactaccctttatccgtttcgttaaccc

SEQ ID NO: 81421 - DNA, 695 bp, Homo sapiens
  misc_feature: GYAE6OF01CWSFS.52.1.A01.1.454.CMB.1.raw
  modified_base (273)..(273): a, c, t, g, unknown or other
  misc_feature (273)..(273): n is a, c, g, or t
  modified_base (350)..(350): a, c, t, g, unknown or other
  misc_feature (350)..(350): n is a, c, g, or t
tcagcgcagtacgacacgaccggtgctcgatttagacgtctcatcagggcacagcatggacatgagggtccccgctcagctcctggggctcctgctactctggctccgaggtgccagatgtgtcatccagatcgacccagtctccactcctccctgtccgcatcgtgtaggaagacagatcaatcatcacttcggaccgggacaagtcaagagactaagttaacgtaacgttaatttaaagtgtactacgaaacaagtaaaccgaagggaacnccctagaacctcctagactactatcggtactactacctacttgcgtaggtacgtcgggtaccagtacgtaacggttnaggtgtacgagtggtatcggtaggaactaagacttcaactcacctacactacaaccattcgagcgacgtctaggtaaggttctttacgaacctttaaaccgtttactttaacgtcgtaaactaacgtaaacgggtttaccttaaccgtaccggttttaccccacgttttaacccgggttttcccggaaacccgggtccgggttaaaaccggtaagttttaacggggaactaaagtttaacccgaacgtaaaaccggttaacgtggtaaccgtctacggaccctaacgtacttcgaacttttccgtaacttcggttacccctttccgaaacttggtctaaaacggg

SEQ ID NO: 81422 - DNA, 768 bp, Homo sapiens
  misc_feature: GYAE6OF01CAOAH.52.1.A01.1.454.CMB.1.raw
  modified_base (101)..(101): a, c, t, g, unknown or other
  misc_feature (101)..(101): n is a, c, g, or t
tcagcgcagtacgacacgaccggtgctcgatttagacgtctcatcgagggggggagtcagtctcagtcaggacacagcatggacatggacgggtcccccgntcagctccgtggggctcctgctactctggctcgaggtgccagatgtgtcatccagatcgacccagtcctccatccctccctggtccgctattcgtggtaggagacagacgtcatcatcctacgttcggaccgggataacgtcaaggacgtactaaagtttaagaaagtttagttttaaagttttaaaagttcggttaactaccaaaaccgaaacggaaaacccgaaggggaaacccgtcccccgtaagtaaacccgttccgttagtactttaccgttaagtttcggttacctaactttcccttaagttttcgacggttcggtaacgggtttccggggtacccctaaggttaccggtaacgggtttcagggttcggacgtaggtggtaacgtcggtagggaaccagttaacttactacctccgtacaccgactacgacccttagtccgtcgacggtaacgtcgtaagggttggtttaacttcgtaacttaaccgttttacttcgttaacgacctaacgtacgtttaacggttacccttaaccgtttccccttaagtttccccggttaccggacccgttcgggtaacctagtagggtacgtaaacgttataacccggtaaaaggtaccgttggtaccgtaccttacgacctacccgtagttccttaccg

SEQ ID NO: 81423 - DNA, 671 bp, Homo sapiens
  misc_feature: GYAE6OF01BPSN0.52.1.A01.1.454.CMB.1.raw
  modified_base (97)..(97): a, c, t, g, unknown or other
  misc_feature (97)..(97): n is a, c, g, or t
  modified_base (220)..(220): a, c, t, g, unknown or other
  misc_feature (220)..(220): n is a, c, g, or t
  modified_base (654)..(654): a, c, t, g, unknown or other
  misc_feature (654)..(654): n is a, c, g, or t
tcagcgcagtacgacacgaccggtgctcgatttagacgtctcatcagggggggagtcagtctcagtcaggacacagcatggacatgagggtccccgntcagctcctggggctcctgctactctggctccgaggtgccagatgtgtcatccagatgacccagtctccatccctcctgtccgcatctgtaggacacagagtcatcatctacgttggccgganaagtcagagcattaagtaacgttaattttaaattggtactacaaacaacgaaaaccgaacgggaaaccgtccccgtagaacccttcctacgtacttccgttagttcggttaccacttcccgtactttcgtcttagggtacggttccgggtaccctaagtaccggtaacggttcgtaagggtcggtacgagggtacggtagttcggtagggaacctagtaacttcctaacttcctaccacctactacctacctacgtcgtacgacgtacgtacgtagtacggtagtttacgtacttacgttaccttacttacgtactaacgtaacgttaacgttaccgttaccgttacccgttaccgttaccgttacccggtaccgtaccggtaccgtagtagtagtacgtacgtaacgaacgtacgtgtgtacgtcgacactcncgtttttttttcgtccg

SEQ ID NO: 81424 - DNA, 756 bp, Homo sapiens
  misc_feature: GYAE6OF01CO78E.52.1.A01.1.454.CMB.1.raw
  modified_base (117)..(117): a, c, t, g, unknown or other
  misc_feature (117)..(117): n is a, c, g, or t
  modified_base (334)..(334): a, c, t, g, unknown or other
  misc_feature (334)..(334): n is a, c, g, or t
  modified_base (446)..(446): a, c, t, g, unknown or other
  misc_feature (446)..(446): n is a, c, g, or t
tcagcgcagtacgacacgaccggtgctcgatttagacgtctcatcagggcacagcatggacatgagggtccccgctcagctcctggggctcctgctactctggctccgaggtgcagntgtgtcatccagatcgacccagtcctccacttccctccctgtcccgctagttccgtaggtaaggagacgaggacgtcctatacaacttccgtacgtttcgggacccgggataaacggtcaagggtacgtactaaagttaacggtaaacgttttaaatttttaaaacggtggttaaactaccgaaaacgaaacggaaaacccgaaaggggtaaacccncccctaagaacctttccaagtactaccttaagtcggttaccaacgttaccctaagtttggcgtgggtacggttaccgggaccctaagtaccgtaagttcgaggtgacgtagngtactcgtagggaactagtactcaactctactaccagtccactagtcagtacgacggtacgtagttaacggttattttacgaacctttaaccgtttacttacgtttacgaacctaaaggttaccgttaacgtttaccctaacccggtttcccttaccttaccggttttaccccggacggtaacgggtacccttaaaggttggtaacgttaacttaacgtaacgaaaccggttattcgggacgtaccgtagtaaccctcttacgtacgttccttacctacgtaccttacccttccccgaattgtaccgtaa

SEQ ID NO: 81425 - DNA, 950 bp, Homo sapiens
  misc_feature: GYAE6OF01DOL9Q.52.1.A01.1.454.CMB.1.raw
  modified_base (161)..(161): a, c, t, g, unknown or other
  misc_feature (161)..(161): n is a, c, g, or t
  modified_base (173)..(173): a, c, t, g, unknown or other
  misc_feature (173)..(173): n is a, c, g, or t
tcagcgcagtacgacacgaccggtgctcgatttagacgtctcatcagggcacagcatggacatgagggtccccgctcagctcctggggctcctgctactctggctccgaggtgccagatgtgtcatccagatcgacccagtcctccactccctcctgtccncatctgtagganacagagtcatcatcacgttcggccggacaagtcagagctaattaagtaacgttaattttaaattggtaactacaaacgtaaacgaaaaccgaaggggaaaccgtcccctagtaaccctccgtagtacttacgttagttacggttactacttaccccgttacgttttacggccgttagggtaccgggttccggggtacccctagttaccgtaaagggtttccgagggttacggaccgtaggttaggtacgttacggtaggggtaacctaacgggttaacctttcctaacccgtttcctaacccgtaacccctaacgtttaaccccgtaacccggttaacggttaccgttaccgggtacccgggtaacgggttaccggtttaacgggttaaccgggtttttaacggtttttacccggaaacccctttttaaacccggtttttacccgtttaccggttaaccggttaacccgtaaaacccggtttaaagggtttaacccggttttaaacccgtttacccgttttacccccccgttttaccggttaccccgggtttttaacccccgggtaccccgggtttaacgggggtaacccctttaaagggtttaaccgggttaaagggtttaacccgttaaaacgttaacccggtaaaacccggttaacccgggtttacggggttaccggacccgtttaccggaacccgttacccgtaacgtttccggtttacccgttacctttacccgtacgtttacccccttcccgtacttacgtcccgttaaag

SEQ ID NO: 81426 - DNA, 766 bp, Homo sapiens
  misc_feature: GYAE6OF01C673V.52.1.A01.1.454.CMB.1.raw
  modified_base (331)..(331): a, c, t, g, unknown or other
  misc_feature (331)..(331): n is a, c, g, or t
  modified_base (372)..(372): a, c, t, g, unknown or other
  misc_feature (372)..(372): n is a, c, g, or t
tcagcgcagtacgacacgaccggtgctcgatttagacgtctcatcgagggggggagtcagtctcagtcaggacacagcatggacatggacgggtccccgctcagctccgtggggctcctgctactctggcctcgagtcgccagatgtgtcactccagtactcgacccagtcctcctactccctcccgtcgtccgcattcgtaggtaaggacgacaggagtcatctacgtctacgttcggccgggtactaaggtcgaagacgtactaagttaagtaacgtttaatttaaagtcgttaactacgaaactaacggaaaaccgaacgggaacccnccccgtataaccttcgtagtaacttacttaggtcgtttacnccttacgttacgtttacgcggttaggtacgggtccgggtaccagtttaccgacgggtttagacggtcggacgttgggacgtagtaccgggtaggaattaacggtattacccgtacgtaccttaaccgtccttaacccgtacctaacccgtaacgttctaccgggtacggaacgggttcgttagggttaacgtttacgtttaacgaccctttaactttacggttcctaagtaactacgtaacggtttaacggttaccttaccccgttttccgacctttacccgggtttacgacccgttacggttaacctacgggtttagaacgtaacttaaccgtaaagttaaccggtattcggggtcaccgggttcaaccttaacttctacgggtttcctttac

SEQ ID NO: 81427 - DNA, 806 bp, Homo sapiens
  misc_feature: GYAE6OF01BFR4Q.52.1.A01.1.454.CMB.1.raw
tcagcgcagtacgacacgaccggtgctcgatttagacgtctcatcagggcacagcatggacatgagggtccccgctcagctcctggggctcctgctactctggctccgaggtgccagatgtgtcatccagatcgacccagtcctccactcccgtccctgtccgctattcgtggtaaggacgacaggagtcatcatcacgttcggccggacaagtcagacgactaagttaacgtaaacgtttaattttaaacgtggtaactaccgaaaacgtaaacggaaaaacccggtaacggggaaaaccgtccccgtaacggtaaaccttcccgtaaggtacttaccgttaagttcggttacctaacttacccgtaacgtttttcgacgttacgggtacgggtccgggggtaccctaacgttacggtaaacgggtttcgaggttcggacgtaacggtggtaactcggtaggggactaaagtaacttaccgtacttcctacgaacctactcctaaccgtacggtcttcgaccgtacggtcgttacggtaaggtttacgttttacgtaacccttaaccgtttaccttcgttaacgtacctaaacgtacggtaaccgttttaaccgtaccgttaccccttcgttacccggtttaccgggccccgttaagggtaccctaacgtttacggtaggtaaaccttacggtaaacgtaaaccgaaccggtttggtaccgggtaacgttccgaccgttaccttacttcgttaccggttccttacccgtactttacccggttaccctcctaacgttcccgttaag

SEQ ID NO: 81428 - DNA, 626 bp, Homo sapiens
  misc_feature: GYAE6OF01AILZM.52.1.A01.1.454.CMB.1.raw
tcagcgcagtacgacacgaccggtgctcgatttagacgtctcatcagggcacagcatggacatgagggtccccgctcagctcctgggctcctgctactctggctccgaggtgccagatgtgtcatccagatgacccagtctccatcctccctgtccgcatctgtaggagacagagtcatcatcacttggccgggcaagtcagagcattagaacgttatttaaagttggtatacaacaagaaaccaggggaaacgcccctagaacctcctgattctattcggttcatcctactttgctgaggtcggggtcccatcgaggttcaggtggcgtagtggatcgtgggacagtatcactctccacactaccacctgtctcgacgtaggtcgtagtaggtacttttcgaccttaaacgtttcttcgttacgtacctaacgtaagtacgtttaacctaccggtttcccttaccgtaccgtttcccggacccgttgggaacccgtagttaacggttgtacttaacgtaaccgtaaaccggtaaccgttggtacgggtcgtacgtaccctaccctattccgttcggtttacctttccgtaccttccccgttaccccggccttaccgtcgttacgg

SEQ ID NO: 81429 - DNA, 864 bp, Homo sapiens
  misc_feature: GYAE6OF01CPOY8.52.1.A01.1.454.CMB.1.raw
  modified_base (843)..(843): a, c, t, g, unknown or other
  misc_feature (843)..(843): n is a, c, g, or t
tcagcgcagtacgacacgaccggtgctcgatttagacgtctcatcagggggggagtcagtctcagtcaggacacagcatggacatgagggtccccgctcagctcctggggctcctgctactctggctccggaggtgccagatgtgtcatccagactgacccagtcctccatccctccctgtcccgcatctgtaggagacagagtcatcatctacttcggccgggctaagtcaaggagactaagttaagtaaacgttaattttaaaagttggtaactacaaaacgaacgaaaacccgaaggggaaaaccgtccccctaggaaccttccgtagtaacttcgttagttcggttacctaactttcccttaaccgttttggtaccgttagggtaacggggttccgggggttacccctagttaaccggtaaggtttaccgaagggttcggggtactaggggttacggtaagtccggtagggggaactaaaggttaaactttccgacccttacctaacccgtaaccctaacgtacccaacccgttacggttaccgttacggaccgtacgggtacctagggttaaggtttacgtttttaaccgaacccttttaaaccgtttttaccgttttaccgttaacgggttaaaccctaaaacggtttaaccgttaaaaccggtttacccgtttaaaccccggttttccccctttaaccgtttaccccggggtttttaccccggcccggttaaccgggtaaccttacgttaacgggttacggtaaacgttaaaccgtaacggtaaaacccggttaacgtcgggttaaccggacccgttacgaccctaaaccccgttntttacccgttcgttttacccc

SEQ ID NO: 81430 - DNA, 911 bp, Homo sapiens
  misc_feature: GYAE6OF01CRD7L.52.1.A01.1.454.CMB.1.raw
  modified_base (145)..(145): a, c, t, g, unknown or other
  misc_feature (145)..(145): n is a, c, g, or t
  modified_base (309)..(309): a, c, t, g, unknown or other
  misc_feature (309)..(309): n is a, c, g, or t
tcagcgcagtacgacacgaccggtgctcgatttagacgtctcatcaggggggagtcagtctcagtcaggacacagcatggacatgagggtccccgctcagctcctggggctcctgctactctggctcgagtgccagatgtgtcanccagatcgacccagtcctccactccctccctgtccgacatcgtggtaaggagacagatcatcactacgtacttcgggccgggacaagcgaaggacgactaattaaggaaacgtttaatttaaagttaggtaactacaaaacgaagaaaaccgaaggggaaaccncccgtagaaacctccgtagattcctaagttcggtacacttccctaacgttcgtacgtaggtacgggttccggggtaccctaagttaccgtaaaggtttcgaaggttacgggaccgtaagggtttcggaaacgtttcccggtaaggggtaaaccgtaaaggtttaaaacttacccgtaaccgttacccgttaaccaaacccctaacggtttaacccgaaccccttaacggttcccgttacggtaaccgaacgggggttaccgtttaaaggttaaaccgggggttttaatttttacgggtaaaccccgttttaaaacctttttaacccggttttaccttacgggtttaaaacccaaaaccgggtaaacgggtttaaaacccggtttttaaccggtaaacccccgggttttcccctttaaaccccgtttaaccgggtttttacccccgggtaccccgggtttaacccgggtaaaccccgtaaaggttaaacgggttaacggtaaaagttaaacccgttaaaccgaaaaaccggtaacccggtttagggtaccgggtaacttaccgggacccctaaacccgttacttcccgtttacggtttacccc

SEQ ID NO: 81431 - DNA, 848 bp, Homo sapiens
  misc_feature: GYAE6OF01D4793.52.1.A01.1.454.CMB.1.raw
tcagcgcagtacgacacgaccggtgctcgatttagacgtctcatcagggcacagcatggacatgagggtccccgctcagctcctggggctcctgctactctggctccgaggtgccagatgtgtcatccagatgacccagtctccatccctccctgtccgcatctgtaggagacagagtcatcactcacgttcggccgggacaagtcagacgactagtttaacgaacgttaattttaaagttggtaatacaaacgaacggtaaaaccgaacgggaaaccgtccccgtagaacccttccgtagtattacgtagttcggttactacttaccctaacgtttgtaccgttgggtacgggttccggggtaccctagttaccgtaagggttacgtaggttcggacgtagggtaggtacgttaccggtaggggtaaacctaagtaacgtttacctaccttaccctaccaacctaccgtacccaaaccgtacggttcgttcggacggtaggttacgttacggtaagggtttactttttaccgaacctttaaaccgttttacgtttaccgttaacggttaaccgtaaacgtaaccgttaacggtttacccttacccggttttaccccttaccggttacccgggtttttacccgggaccccggtttaacggggaaccccttaaaggttacgggttacgtaaactttaccgtaaaccggtaaaaccggtaccgtttagggtccgggttacccttaggaaccccgttaacccttaacggttttcccgtaaccggttttccctttaaaccgttccccttttcccccggttaaccccgtaccccttcggttaaccggttaacc

SEQ ID NO: 81432 - DNA, 545 bp, Homo sapiens
  misc_feature: GYAE6OF01DJ2JP.52.1.A01.1.454.CMB.1.raw
  modified_base (273)..(273): a, c, t, g, unknown or other
  misc_feature (273)..(273): n is a, c, g, or t
  modified_base (296)..(296): a, c, t, g, unknown or other
  misc_feature (296)..(296): n is a, c, g, or t
  modified_base (307)..(307): a, c, t, g, unknown or other
  misc_feature (307)..(307): n is a, c, g, or t
  modified_base (326)..(326): a, c, t, g, unknown or other
  misc_feature (326)..(326): n is a, c, g, or t
  modified_base (329)..(329): a, c, t, g, unknown or other
  misc_feature (329)..(329): n is a, c, g, or t
  modified_base (352)..(352): a, c, t, g, unknown or other
  misc_feature (352)..(352): n is a, c, g, or t
  modified_base (376)..(376): a, c, t, g, unknown or other
  misc_feature (376)..(376): n is a, c, g, or t
tcagcgcagtacgacacgaccggtgctcgatttagacgtctcatcaggggggagtcagtctcagtcaggacacagcatggacatgagggtccccgctcagctccgtggggctcctgctactctggctccgaggtgccagatgtgtcatccagatcgacccagtctccatccctccctgtccgcatctgtaggagacagagtcatcatcacgttgccgggcaagtcagagcaattagaacgttatttaatgtatacaacaagaaaccaggaacncccctgaactctgatctatgtcntctattgctgngtcggccatcgaggtcagngangtgagtcgtaggcaagtacttcnctactccacactccaaccgagtcncgcgaggctaggagttatttcgactaactttccttatcgttacaatagtacgttacgtcgttcccttccgtaccgtttcccggccgtacggaaccttacgaggttaggaacttaacgtaccgtaaaacgcgttggtcgtaccgtcgtacgaccttacgtctcgttaccg

SEQ ID NO: 81433 - DNA, 661 bp, Homo sapiens
  misc_feature: GYAE6OF01BUJKG.52.1.A01.1.454.CMB.1.raw
tcagcgcagtacgacacgaccggtgctcgatttagacgtctcatcagggcgacagcatggacatgagggtccccgctcagctcctggggctcctgctactctggctccgaggtgccagatgtgtcagtccagatcgacccagtctccatccctcctgtccgcatcgtgtaggagacaggagtcagtcatcacgttcggccggacaagtccaggacgactaagttaagtaacgttaattttaaagttggtactacgaaacaagaaaccgagggaaacgcccctagaacctcctagactactagtcggtcactcctacgtttcgacgtggacggtcgggtacctagtacgtaaggtcaggtgcgagtgacgtgtaggacagtactcacgtctacactactccgactagtaccgtcgacctaggtctagtagttacgtttaccggacttaaaccgttcgttcgtacgtacgaacgttacgtacctttacgtaccgtttcccttacttaccgggttcccgaccggtacgtacgtacgttacggtacgtaactacgtaacgaaccgtaggtcgtacgtcctacggaccctaaccgttcgttaccgttaccgttactttacccgaccttttccccggtaccgtaaccttaccggttccgttaaaccg

SEQ ID NO: 81434 - DNA, 697 bp, Homo sapiens
  misc_feature: GYAE6OF01ERLE1.52.1.A01.1.454.CMB.1.raw
  modified_base (266)..(266): a, c, t, g, unknown or other
  misc_feature (266)..(266): n is a, c, g, or t
  modified_base (687)..(687): a, c, t, g, unknown or other
  misc_feature (687)..(687): n is a, c, g, or t
tcagcgcagtacgacacgaccggtgctcgatttagacgtctcatcagggcacagcatggacatgagggtccccgctcagctcctggggctcctgctactctggctccgaggtgccagatgtgtcatccagatgacccagtctccatcctccctgtccgcatctgtaggagacagagtcatcatcacttgccggacaagtcagagacattaacgaacgtttaatttaaagttggtaactacaaacgaagaaaaccgaagggaaaacncccctagaacctcctagtatctagtggttaccatcctactttgcgtggacggtcgggtaccctagtcgtaaggttcaggttcggacgtaggtaggactacggtagggaactaagtaactttcaaccttcctaccgaacctacgtacccgtaacccgtagtccgtcggtacgtacgggtcttaggtaaggtttactttttcggaacctttaaaccgtttactttacgttagtaacctaaacggtaacgttaacgtttaacctacccgttttcccctacgttacccggtttaccggtacccgttaacgggtaaccctaaggttaacggttagggaactttaactaaccgtaaaacgtacgttacggtcggtactcggacctaccgttaacttccgttacgttcttacctcttccctaccccgntcgtctaacg

SEQ ID NO: 81435 - DNA, 734 bp, Homo sapiens
  misc_feature: GYAE6OF01BSD2G.52.1.A01.1.454.CMB.1.raw
tcagcgcagtacgacacgaccggtgctcgatttagacgtctcatcagggcacagcatggacatgagggtccccgctcagctcctggggctcctgctactctggctccgaggtgccaggatgtgtcatccagatcgaccctagtcctccatcccctcccgtgtccgcattcgtaggtaggagacagagtcatcatccacgttggccgggataagtcagagtactaagttaacggaactttaatttaaagttggtaactaacgaaaacgaacggaaaaccgaagggggaaaacctccccgtaaggaaccttccgtagtacttacttaagtcgggttactacctccgtaacgttttcgacgttagggacggttccggggtacccagtacgtaacgggttcaaggggtggtaccgaggtaggtacgttcgagggtaactacggtaaacttctacttaccactaacccacgtaacacccgtacggtctacggcgtacggttcgtaggtaaggtttacgtttacgaaccctttaactttacggttacttaccggtaaacctagtaacggttaaaccggtttaacctacctttacccggttacttaccggtttacccgggaccgtacgggtaacctaggttaaccgaggtaacttacgaaacgtaacgtacgtggtacgtctacgcctatacttcggtacttccttacgtaccctccggttaccccattccgtcttaaacg

SEQ ID NO: 81436 - DNA, 802 bp, Homo sapiens
  misc_feature: GYAE6OF01B9SAD.52.1.A01.1.454.CMB.1.raw
  modified_base (99)..(99): a, c, t, g, unknown or other
  misc_feature (99)..(99): n is a, c, g, or t
  modified_base (137)..(137): a, c, t, g, unknown or other
  misc_feature (137)..(137): n is a, c, g, or t
  modified_base (233)..(233): a, c, t, g, unknown or other
  misc_feature (233)..(233): n is a, c, g, or t
  modified_base (244)..(244): a, c, t, g, unknown or other
  misc_feature (244)..(244): n is a, c, g, or t
tcagcgcagtacgacacgaccggtgctcgatttagacgtctcatcgagggggggagtcagtctcagtcaggacacagcatggacatggacgggtccccntcagctccgtgggctcctgctactctggctcggaggtnaccagatgtgtcatccagactcgacccatcctcactcccgtccctggtccactatcgtggaaggacacgagtactcatcattcacgtcggccgganaagtcaagganctaaattagtaaacgttaatttaaagttgtaacaacgaaacaaaggaaaccgtaaggaaacctccccgtagaaccttccgatactcgttagtcggtacaccttcttacgttcgagtggtacgggtccggtacctagtacggtaaggtcgtagggtcgacgttaggtacggtacgttacggtacgggaactaaacgttactaaaccgtcccgtaactaccctaacctaacctcccggtaaccgtacggtaccgtacgtacggaacggtccgttaagggtaacgtttaacgttttaccgaaaccttttaaccgttaccgtttaacgttacctaaaccgtaacgttaacgttaacgtttacccgtaccgttttaccccttaacggtttaccccgtttacccggacccggttaaccgggtaaacgttaacgttaaaccgggtaacgtttaaaacgtaaacccgttaaacccgggtaaaacgttaccgggttacggtaaccccggtacgttacccggtaaacccttaacccggttaagtttaccccggtttactttaccccgg

SEQ ID NO: 81437 - DNA, 853 bp, Homo sapiens
  misc_feature: GYAE6OF01DIEXZ.52.1.A01.1.454.CMB.1.raw
  modified_base (162)..(162): a, c, t, g, unknown or other
  misc_feature (162)..(162): n is a, c, g, or t
  modified_base (175)..(175): a, c, t, g, unknown or other
  misc_feature (175)..(175): n is a, c, g, or t
  modified_base (270)..(270): a, c, t, g, unknown or other
  misc_feature (270)..(270): n is a, c, g, or t
tcagcgcagtacgacacgaccggtgctcgatttagacgtctcatcagggcacagcatggacatgagggtccccgctcagctcctggggctcctgctactctggctccgaggtgccagatgtgtcatccagatcgacccagttctccactcctccctgtccgntatctggtagganacagacgtcatcatcacgttcggccgggacaaggtcagagctaagtagtaacgttatttaagtggtactacgaaagaacgaaccgaagggaaccnccctagaaccttccgtagtactactagtcggtacctatccgtacttgcgtggtacggtccgggtacctaggtacgtaagttcgaaggtcggacgtaggtcggtaactttcggaacgggtaactaaacgttacgttacctaacccgttccgtaacccgtaccctacgtaccgtaacccgtaggttccgtacggtaccggtaacgggttacgttacggggttaaacggttttcgttttaaaccggtaacccttttaaaaccttttacccgtttaccgtaaccggtttaaacccgaaacggtttaacccggtttaacccgtttaacccgtttaccccgttttacccccggttaacccgttttcccggggttttaccccgggaacccggttacgggttaaaccgttaaggtttaacgggttacgttaaactttaaacccggtaacgtaaaacccgggttaacgttcgggggtaaccttacgtaaccccggtaacccgttaacccgtttacgttcccgggtttactttaaccggttacccttacccgttacccccgtttccgaaaccctttgttaacccgttaaaccg

SEQ ID NO: 81438 - DNA, 671 bp, Homo sapiens
  misc_feature: GYAE6OF01AHGE9.52.1.A01.1.454.CMB.1.raw
tcagcgcagtacgacacgaccggtgctcgatttagacgtctcatcagggcacagcatggacatgagggtccccgctcagctcctggggctcctgctactctggctccgaggtgccagatgtgtcatccagatcgacccagtcctccactccctccctgtccgcatctggtaggagacagagtcatcatcacgttcggccggacaagtcagagactaagttacgtaacgttaatttaaagttggtatacgaacacgaaaaccgagggaaacgcccctagaactccgtagattctagtcggttacacttcctactttcgcgttggacgggtcgggtaccagtacgtaaggttctaggtggacgtaggtggacgtcggtacgggaactagtaacttccgtaccttccgtaccaacctactaccgtaccgtaggtcctcggacgtggtcttagggtacggttactttacggacccttaaccttttacgttctaaccgtcaaaccgttaggtaccgttaccgttacgttaccccgtcgttacccgtttccggcccggttaacgggtaacctggttaaggtcgtaaacttacgttaacgaaacgtcgtggtaccgtctacgtcctaccttgtccttattcccttacgttcctcccttaccgacttcgtcgttaacgg

SEQ ID NO: 81439 - DNA, 653 bp, Homo sapiens
  misc_feature: GYAE6OF01BHZFC.52.1.A01.1.454.CMB.1.raw
tcagcgcagtacgacacgaccggtgctcgatttagacgtctcatcaggggggagtcagtctcagtcaggacacagcatggacatgagggtccccgctcagctcctggggctcctgctactctggctccgaggtgccagatgtgtcatccagatgacccagtctccatccctcctgtccgcatctgtaggagacagatcatcatcacttgccgggcaagtcagagctaattaagtaacgttaattttaaagttggtactacaaacaacgaaaccgaagggaaaccgtccccgtagaacctcctagattctagttgttacactctactttgcgtggtacggtcgggtcccacgtacgtaaggttcgtaggtgggactaggtggtacgtcgtacgggaactagtaacttcacttccacaccctataccctacctacgttactcggacgtacggtcgtagggtacgtttagtttcgaacctttaacctttaccgttccttacgttaccaacgttacgttaaccgtttaccgttaccgtttaccccttaccgttaccgtttcccggacccggttacggtaccctagttacggtacggtaacttacgtaaccgaaacggttacgtggtacgtccgtgaccacctgtccgttcgttaccc

SEQ ID NO: 81440 - DNA, 755 bp, Homo sapiens
  misc_feature: GYAE6OF01BVSXH.52.1.A01.1.454.CMB.1.raw
  modified_base (183)..(183): a, c, t, g, unknown or other
  misc_feature (183)..(183): n is a, c, g, or t
  modified_base (224)..(224): a, c, t, g, unknown or other
  misc_feature (224)..(224): n is a, c, g, or t
  modified_base (231)..(231): a, c, t, g, unknown or other
  misc_feature (231)..(231): n is a, c, g, or t
  modified_base (287)..(287): a, c, t, g, unknown or other
  misc_feature (287)..(287): n is a, c, g, or t
  modified_base (441)..(441): a, c, t, g, unknown or other
  misc_feature (441)..(441): n is a, c, g, or t
tcagcgcagtacgacacgaccggtgctcgatttagacgtctcatcaggggggagtcagtctcagtcaggacacagcatggacatgagggtccccgctcagctccgtggggctcctgctactctggctccgaggtgccagatgtgtcatccagatcgacccagtctccactccctccctgtccncattctgtaggagacaggactcatcatcacgttcgccgganagtcagngctaagttagtaacgttaatttaattggtactacgaacaacgaaaccgaaggaacncccgtagaactcctagatactagtggttctacgtcctaccgttttgcgttaggtcggttaccgggtcccaagttacgaaacggttccgtagtcggtacggtacggtcggacgttcggtacggggtactaacggttaacttcccgaaaccctttntaacccctaaccgtaccttacccgtaaccgttacggtcgtacgaccggtaggttcggttaaggttacggtttacgtttacgtaacctttaacgttttacgttacgttaacgtaacctaacggtaacgtttaaccgtttaacccgtacccgtttacccgtttaccgtttacccggttcccggtacccggttaaccgggtaaccttaacgttacgggttaaacgttaacgttaaacccgtaaaccgtaaaccggtaccggttacgggttaccggtccgttaccggacccttaacctttcgttaccgtttcgttacc

SEQ ID NO: 81441 - DNA, 776 bp, Homo sapiens
  misc_feature: GYAE6OF01BHRGE.52.1.A01.1.454.CMB.1.raw
  modified_base (97)..(97): a, c, t, g, unknown or other
  misc_feature (97)..(97): n is a, c, g, or t
  modified_base (751)..(751): a, c, t, g, unknown or other
  misc_feature (751)..(751): n is a, c, g, or t
tcagcgcagtacgacacgaccggtgctcgatttagacgtctcatcagggggggagtcagtctcagtcaggacacagcatggacatgacgggtccccntcagctccgtgggcctcctgctactctcggctccggaggtgccagatgtgtcatccagatcgaccctagtcctaccacttcccgtcctcgtccgatactcgtaggtaaggacgacagtacgtcattcgacttccgtacgttcggaccggtactaagtcgaagtacgtacttaagttaacgtaaacgtttaatttaaaacgttcggtaactaacgtaaacgaaacggaaaccggtaacgggtaaaccctccccgttaacgtaaccttccgtaacgttaacttaccgtttaacggttcggttacctaaccgttccgtttaacgtttcggtacgttacgggttaccgggttacccggttaccctaacgtttaccggtaaacggttccgtaagggtacggtacgtaggttacggtacgttacgggacggtaaacaaggttacttaccgacttaccgtacctaccgtacgtaccgtaacgtgtactacggacgtggttaccgtaggttaccgttttacgttaaccgtactttaaccttcgttcgtaacgtaactacggtaacgtttaacgttaacccggttaccctttcgtaccgtttaccggtcccgtaacggtaccgtatacgttagacgtaactacgtaacgaacgtgtcgtacgntaaccactacgtcttcgtcttaccg

SEQ ID NO: 81442 - DNA, 726 bp, Homo sapiens
  misc_feature: GYAE6OF01DRF9C.52.1.A01.1.454.CMB.1.raw
  modified_base (168)..(168): a, c, t, g, unknown or other
  misc_feature (168)..(168): n is a, c, g, or t
  modified_base (276)..(276): a, c, t, g, unknown or other
  misc_feature (276)..(276): n is a, c, g, or t
  modified_base (715)..(715): a, c, t, g, unknown or other
  misc_feature (715)..(715): n is a, c, g, or t
tcagcgcagtacgacacgaccggtgctcgatttagacgtctcatcagggcacagcatggacatgagggtcccgctcagctcctggggctcctgctactctggctccgaggtgccagatgtgtcatccagatgacccagtctccatcctcctgtccgcatctgtagganacagagtctatcaatcacgttcggaccgggacaagtcaggagctaattaaggtaacgttaattttaaaagttggtactacaaactaacggaaaccgaaggggtaaacnccccgtagtaacctcctagagttactagttacggttcacttaccgtaacgttttcggaccgttaggaacggttaccgggggtaccctagtaacgtaacgggttactaaggttcggacgtagtcggtacttcggtagggaactaacggtaatttccgaacttaccacgtaaccacgtacacgtacgttcgagtacgaacggtactggtaaggttatttttacgactttaaaccgttaacgtttcgtacggtaactaaaccggttagtaaccggttttaacgtaccgtttaccccttaccggttaccgtttcggtaaccccgtacggggtaaccctaagggttagtacggttaacttacgtaacgtaaacgtaccgtaggttcgactacgaaccgacttatccggttaacttcttaacgtacccgttacgttccccgtacngttcgtaacgg

SEQ ID NO: 81443 - DNA, 747 bp, Homo sapiens
  misc_feature: GYAE6OF01APMUN.52.1.A01.1.454.CMB.1.raw
  modified_base (189)..(189): a, c, t, g, unknown or other
  misc_feature (189)..(189): n is a, c, g, or t
tcagcgcagtacgacacgaccggtgctcgatttagacgtctcatcagggggggagtcagtctcagtcaggacacagcatggacatgagggtcccccgctcagctccgtggggctcctgctactctggctccggaggtgccagatgtgtcatccagatcgacccagtcctccactccctccctgtcccgntatctggtaggagacagagtccatctatccacttcggccgggacaagtcagagactaattagtaacgttaatttaaattggtaactacaaacaacggaaaccgtaagggaaccgtcccctagaacctctgactctagtcgttacactcctaacttgaccgtggtacggtacggggtaccctagtacgtaaacggtttccgacggtaggtaccgtaggtagggtacgtacggttagggaacctaaggttaaccttacctacccttaccgttaacccgaccctaagttacccaaccgtaggttcccgttacggacgtaaggttaccggttacgggtacggtttaactttttaccgggtaacctttaaacgtttacctttaccgttacgttaaaccaaacggttacgtttaaccgttaccttaaccggtttccccttaacggttaacccgtttccccgggtacccgtacgggtaaccctaaggttccggtaagtaacgtaacctaaccgaaacggtcgtagtaccggcttacaccctaaaccgtcttacgtgtttaacccg

SEQ ID NO: 81444 - DNA, 655 bp, Homo sapiens
  misc_feature: GYAE6OF01AXR5I.52.1.A01.1.454.CMB.1.raw
  modified_base (168)..(168): a, c, t, g, unknown or other
  misc_feature (168)..(168): n is a, c, g, or t
  modified_base (193)..(193): a, c, t, g, unknown or other
  misc_feature (193)..(193): n is a, c, g, or t
  modified_base (611)..(611): a, c, t, g, unknown or other
  misc_feature (611)..(611): n is a, c, g, or t
tcagcgcagtacgacacgaccggtgctcgatttagacgtctcatcagggcacagcatggacatgagggtccccgctcagctcctggggctcctgctactctggctccgaggtgccagatgtgtcatccagatgaccagtctccatcctcctgtccgcatctgtagganacagagtcatcatcactggccgganaagtcagagactatagtaacgtatttaagtgtatacaacgaagaaaccaggaactcccagtaactccgtagtactacttagtcggttctactaccttagtttcgcgttggtacggggttccgggtacccagttaacgtaacggttcgagggtcggacgtagggtaccggtagttacggtacgggaactaacggttaacttccaccgtaccttaccgaactaccctacctaaccgtacggttccgttacggaccgacggtcggttaaggtaggttactttacggaacctttaactttcgtactacgtaacgactaagttaccttactacctttcccgtacttaccgttccgaccgtaggaccttagtacggtactagtactaccgtaaacgtacgtcggacgtacctacggacctaacncgttcttagttccgttactccttacccgtacccacttctgtaac

SEQ ID NO: 81445 - DNA, 568 bp, Homo sapiens
  misc_feature: GYAE6OF01BKJEO.52.1.A01.1.454.CMB.1.raw
  modified_base (282)..(282): a, c, t, g, unknown or other
  misc_feature (282)..(282): n is a, c, g, or t
  modified_base (542)..(542): a, c, t, g, unknown or other
  misc_feature (542)..(542): n is a, c, g, or t
  modified_base (561)..(561): a, c, t, g, unknown or other
  misc_feature (561)..(561): n is a, c, g, or t
  modified_base (566)..(566): a, c, t, g, unknown or other
  misc_feature (566)..(566): n is a, c, g, or t
tcagcgcagtacgacacgaccggtgctcgatttagacgtctcatcagggggggagtcagtctcagtcaggacacagcatggacatgagggtccccgctcagctcctggggctcctgctactctggctccgaggtgccagatgtgtcatccagatgacccagtcctccatccctccctcgtccgcatctgtaggagacagagtcatcatcacttgccgggcaagtcagagacattagaacgttaattttaaattggtatacaaacaagaaaccgagggaaacncccctagaacctcctagatctatggttacatcctactttgctggtaggtcgggtcctagtcgtaacggttcaggtgcgtaggtggatcgtaggacagtattcactctacacctataccacgtagtcgtacgcgtacggtctaggtacgttatttacgacttaactttacttcgtagtaccaagtagtacgttactaccgtttacccctacttaccggttccgcccgttaggacctagtcgtaggactacgtactaaacgngttgtcgtactgaccactntcgtntc

SEQ ID NO: 81446 - DNA, 793 bp, Homo sapiens
  misc_feature: GYAE6OF01ANIW6.52.1.A01.1.454.CMB.1.raw
  modified_base (199)..(199): a, c, t, g, unknown or other
  misc_feature (199)..(199): n is a, c, g, or t
tcagcgcagtacgacacgaccggtgctcgatttagacgtctcatcagggcacagcatggacatgagggtcccgctcagctcctggggctcctgctactctggctccgaggtgccagatgtgtcatccagatgacccagtcctccatccctccctgtccgcatctggtaggagacagagtcatcgatcacgttgccgganaagtcagacgcattagtaacgttattttaaagtggtataccaaacgaagaaaaccgaaggggaaacgtcccctaggaaaccttccgtagacttactaacgttcgggtttacaaccttcccgtacgttttacgcgttagtacggttccgggggttaccccaagttaccggtaaacgggtttcgtaacggttcgggaccgtaaggtcgggtaacttcgggttacgggaacctaaggtaactttaccgtacgttcctacctaaccctaactacccgtaacccgtacggttacccgtacggtaccggtaacgggtccgttaagggtaacggggtttactttttaggtaacccgtttaaaccttttaccgtttaccgtacggttaaccctaaacgttaacgtaaccgttttaaccgtaacccggttttcccctacgttacccggttttcccgggtaccccgtaacgggtaaccctagttacggtacggaacttaaccgtaacgtaaaccgtagtcggtcgtacccgtaggtacccacgttagtccgttacggttctttactacccgtttccctacccccggtacttccgtaccgttacg

SEQ ID NO: 81447 - DNA, 596 bp, Homo sapiens
  misc_feature: GYAE6OF01CK0SH.52.1.A01.1.454.CMB.1.raw
  modified_base (159)..(159): a, c, t, g, unknown or other
  misc_feature (159)..(159): n is a, c, g, or t
  modified_base (197)..(197): a, c, t, g, unknown or other
  misc_feature (197)..(197): n is a, c, g, or t
  modified_base (206)..(206): a, c, t, g, unknown or other
  misc_feature (206)..(206): n is a, c, g, or t
  modified_base (258)..(258): a, c, t, g, unknown or other
  misc_feature (258)..(258): n is a, c, g, or t
tcagcgcagtacgacacgaccggtgctcgatttagacgtctcatcagggcacagcatggacatgagggtccccgctcagctcctggggctcctgctactctggctccgaggtgccagatgtgtcatccagatgacccagtctccatccctccctgtccncatcgtgtaggagacagagtcatcatcactggccgganaagtcaganctaattagtaacgttaatttaatggtatacaaacagaaaccgaagggaaccnccctaagtaactcctagtattcctagtcgttacacttccgtactttcgcgtaggtacggtccgggtacctagtacgtaaggttcgaggtcgacgtaggtagtacgtcgtaggactagtactcactcacacatacactatcgtagccgtaggtcgtagtaggttactttcaacgttaacttcgttactcgtactaagtacgttacgtacgtaccttcctactttaccgtcggaccctaggactagtagtagattaacacgaacgtgtcgtaggtctacgtacctacgtattccgttagttcccttactaccgttccccttacccgattccgtacgtacg

SEQ ID NO: 81448 - DNA, 703 bp, Homo sapiens
  misc_feature: GYAE6OF01DHJAA.52.1.A01.1.454.CMB.1.raw
  modified_base (451)..(451): a, c, t, g, unknown or other
  misc_feature (451)..(451): n is a, c, g, or t
  modified_base (650)..(650): a, c, t, g, unknown or other
  misc_feature (650)..(650): n is a, c, g, or t
  modified_base (689)..(689): a, c, t, g, unknown or other
  misc_feature (689)..(689): n is a, c, g, or t
tcagcgcagtacgacacgaccggtgctcgatttagacgtctcatcgagggggggagtcagtctcagtcaggacacagcatggacatggacgggtcccccgctcagctccgtgggctcctgctactctggctccgaggtcgccagatgtcgtcatccagatcgacccagtcctccacttccctcccgttgtcccgactacgttcgtggtaacggagaccgagtacgtacacttacactaccgtaccgttcggaccgggaataacgtacgaagacgtactaaagttaacgttaacgtttaaatttaaggttacggtaactaaccgaaaacgaaacggtaaaccgaacgggaaacctcccgtacgtaaccttccgtagtatcgtaaggttcgtacctacttccttacgtttcgcgtagggtacggtcggtaacctaggtaaccgtaggttacgngtacggcgtaggtgtaacgtcggtaaggtaactacgtaactccgtacctaccaccgaccttacgaccgtaactcgtactggacctggtacgtacggttactttcttacgaacctttacgttcctgtacgtaactaagtacgttacttaccgttccgtacgttaccgttcccgtacgtaccgtagtacctaaggtcgtanaacgttaaccgaactaacgtcgagtcgttcactaacgtntacgtcgttcgtac

SEQ ID NO: 81449 - DNA, 794 bp, Homo sapiens
  misc_feature: GYAE6OF01BAXB8.52.1.A01.1.454.CMB.1.raw
  modified_base (96)..(96): a, c, t, g, unknown or other
  misc_feature (96)..(96): n is a, c, g, or t
tcagcgcagtacgacacgaccggtgctcgatttagacgtctcatcaggggggagtcagtctcagtcaggacacagcatggacatgagggtccccgntcagctcctggggctcctgctactctggctccggaggtcgccagatgtgtcatccagatcgaccctagtctccactccctcctgtccgcattctgtaggagacagtactcatcatcacgttcggaccggacaagtcgaagagtacctaagttaacgtaaacgtttaagttttaaaacgttcggtaactaccgaaaaccgaaacgaaaacccggtaaacggggaaaaccctacccccgttaagtaacccgttacctacggtaacttcgttaacgttcggttacctacttacccttagttttcgacgttacgggtacgggttaccggggtaccctacggttaacggtaaacggtttccgtaagggtcgggtaacgtacgggtacggtaacgttcggtaacggggtaactaaacgttaaccgtttacctaccgttacctaccgtaccctaacgtaccctacgtacgttcgtacgacggtaacggtcgtagggtacgtttacgtttaccgactttaaccgtttcgttcgttaacgttaaaccagttaccggtttaacgttcccgtaccggtttaccctaccgttaccggttcccgaccggttacggtaccgttagtacggtaagtaccgttacgtaaacgaaacggttccggttagtcccggttaacgtctacccgtaacttaccgttcgttcgtttaaccc

SEQ ID NO: 81450 - DNA, 740 bp, Homo sapiens
  misc_feature: GYAE6OF01BKL3P.52.1.A01.1.454.CMB.1.raw
tcagcgcagtacgacacgaccggtgctcgatttagacgtctcatcagggcacagcatggacatgagggtccccgctcagctcctggggctcctgctactctggctccgaggtgccagatgtgtcatccagatcgacccagtcctccatccctccctgtccgcatctaggtaggagacagagtcatcatcctacgttcggccgggactaagtcaggacgactaagtttaaggtaaacgtttaaattttaaagttggttaactaaccgaaacgaacggaaaacccgaacggggtaaaaccgacccccgttagaaaccttaccgtagtacttacgttagttacggttacctacgtttacccttacgttttcggtcgttacgggtacgggttccggggtaccctaggttacgtaacgggtttacgagggttcggtcgtaggttcggacgttacggtacgggtaactagtaacttcctaaccgtcctaccaacctactacccgtacgtacgttcgtacggaccgacggtacgtaggtacggtttacgtttacgtacccttaacgtttaccgttcgttacgtaactaacgtaacgttaacgtttaccgttaccgttacccttcgttacccgtttccggtcccgtacgggtaccgtagttacgtagtaactacgtaacgaacgtacgtggtcgtacgtcgcctactcgttctagttcctacctctcccttaacccgcttacgtgtag

SEQ ID NO: 81451 - DNA, 768 bp, Homo sapiens
  misc_feature: GYAE6OF01AMPGF.52.1.A01.1.454.CMB.1.raw
  modified_base (171)..(171): a, c, t, g, unknown or other
  misc_feature (171)..(171): n is a, c, g, or t
  modified_base (198)..(198): a, c, t, g, unknown or other
  misc_feature (198)..(198): n is a, c, g, or t
  modified_base (264)..(264): a, c, t, g, unknown or other
  misc_feature (264)..(264): n is a, c, g, or t
  modified_base (320)..(320): a, c, t, g, unknown or other
  misc_feature (320)..(320): n is a, c, g, or t
tcagcgcagtacgacacgaccggtgctcgatttagacgtctcatcagggcacagcatggacatgagggtccccgctcagctcctggggctcctgctactctggctccgaggtgccagatgtgtcatccagatcgacccagtctccatcctccctgtccgcatctgtagganacagagtcatcatcacgttggccgggnaagtcagagctagttaacgaacttatttaaattggtatacaaacgaacgaaaccgaagggaaaccnccccgtacgtaacctcctagtacttctagttcggtactacttaccgtacgtttcgngtacggtacggtcgggtaccctagtacgtaacggttacgaggttcggtaccgtaggttcggtaacgtcggtaagggaacgtaaggtaacttccgtaacctacctacctaacccacttacccgaccgtacgtacgttaccggacgtacggtacgttacggtaacggtttacgttttcgaacctttaaccgtttaaccttaccgttaacgttaaccgtaacgtacggttaacgtttaacccgttacccgtttccccttacgtttacccggtttcccggtaacccggtaccgggtaacccttagggttaacgtaacggtaactttaacgtaaaccgtaacggtaacgttacggtaccggtaccgtacgtacccgtaaccttacgttccgttacggttaacccttaccgttaaccttcccccggttaaccctccgttacgttcgttaaaccg

SEQ ID NO: 81452 - DNA, 813 bp, Homo sapiens
  misc_feature: GYAE6OF01AOI1I.52.1.A01.1.454.CMB.1.raw
  modified_base (127)..(127): a, c, t, g, unknown or other
  misc_feature (127)..(127): n is a, c, g, or t
  modified_base (438)..(438): a, c, t, g, unknown or other
  misc_feature (438)..(438): n is a, c, g, or t
  modified_base (569)..(569): a, c, t, g, unknown or other
  misc_feature (569)..(569): n is a, c, g, or t
  modified_base (759)..(759): a, c, t, g, unknown or other
  misc_feature (759)..(759): n is a, c, g, or t
  modified_base (772)..(772): a, c, t, g, unknown or other
  misc_feature (772)..(772): n is a, c, g, or t
  modified_base (782)..(782): a, c, t, g, unknown or other
  misc_feature (782)..(782): n is a, c, g, or t
tcagcgcagtacgacacgaccggtgctcgatttagacgtctcatcagggcacagcatggacatgacgggtccccgctcagcctccgtggggctcctgctactctggcctccgaggtcgccagatgtntacatccagatacgacccctagttcctccctacttccccttcccttggtcccgctacttcgtaggtaagggaagacctaaggagtacctacttacctaacttaccgtaccggttccgggaccggggactaaacggtcgaaggtactacttaagttaacgtaacgttttaagtttaaacgttggtaactaacgaaacgaacggaaaccggttaacggtaacctcccctaggtaacctccgttagctttacgtacggtttacgttacctactccgtttacttcggacgtgggtaacggggttcccggtaaccngttaacggtacggttggaggtacggtacgtaggttcgtaacggtacggtacggtaaacttaaaccggttctacccgttaccgtacccttaacctaaacccggtactacccccggtttaactcgggttaccncggtttaaccgggacggttcgggttaacgggttaacgttttaacggttttaacctaccccgtttaaacgttttccgttacgtaaccgttactaaccggttaacttaaccggtttccttaacccgtttccttaccggttacccgttccggtaccgtacgtaacgtagttacggtatacttacgaataccgngtgtactcgaacncgtacttacncttctctaccgtctccgactactcgtgtacg

SEQ ID NO: 81453 - DNA, 722 bp, Homo sapiens
  misc_feature: GYAE6OF01C19P2.52.1.A01.1.454.CMB.1.raw
  modified_base (162)..(162): a, c, t, g, unknown or other
  misc_feature (162)..(162): n is a, c, g, or t
  modified_base (202)..(202): a, c, t, g, unknown or other
  misc_feature (202)..(202): n is a, c, g, or t
  modified_base (658)..(658): a, c, t, g, unknown or other
  misc_feature (658)..(658): n is a, c, g, or t
tcagcgcagtacgacacgaccggtgctcgatttagacgtctcatcagggcacagcatggacatgagggtccccgctcagctccgtggggctcctgctactctggctccgaggtgccagatgtgtcatccagatcgacccagtctccactccctcctgtccgnatctgtaggagacagagtcatcaatccacttggacccggnaaaggtcaggacgcctaattaacgaacgtttaagttttaaagttggtactacgaaacgaacggtaaaaccgaaggggaaacctccccgtaagtaaccttaccgtacgtaacgttccttaaggttcggttcctaacttaccccgtttacgtttggacccgttacgggaacgggttccggggttacccctaataccggttaaagggttttcaagggtcgggtacgaggttacggtagtcggttaacggggaacctaggtaaacctttcgaactttccccgaactaaccctacttacccaacggttacgtccgtaggacccgaggtccgtaggtacgtttagtttacgaacctttacgttacttcgtactacaacgttaagtacttacgtaccgttcccgttaccttacggttcccgccgtacgacgtagtgtacgacgtactacgaaactcgttacgngtccacgtccgacttacctcgtacttaccgttcttaccgttccctaccccagttactcgtaacg

SEQ ID NO: 81454 - DNA, 676 bp, Homo sapiens
  misc_feature: GYAE6OF01CXCD9.52.1.A01.1.454.CMB.1.raw
  modified_base (96)..(96): a, c, t, g, unknown or other
  misc_feature (96)..(96): n is a, c, g, or t
  modified_base (181)..(181): a, c, t, g, unknown or other
  misc_feature (181)..(181): n is a, c, g, or t
  modified_base (225)..(225): a, c, t, g, unknown or other
  misc_feature (225)..(225): n is a, c, g, or t
  modified_base (234)..(234): a, c, t, g, unknown or other
  misc_feature (234)..(234): n is a, c, g, or t
  modified_base (454)..(454): a, c, t, g, unknown or other
  misc_feature (454)..(454): n is a, c, g, or t
tcagcgcagtacgacacgaccggtgctcgatttagacgtctcatcaggggggagtcagtctcagtcaggacacagcatggacatgagggtccccgntcagctccgtgggctcctgctactctggctccggaggtgccagatgtgtcatccagatcgacccagtctccatccctcctgtccnctatctaggtaggagacagagtcatcaatcacgttggaccgggnaagtcaganactaagttaagtaacgttaatttaaagttggtaatacgaaacgaacgtaaaccgaagggtaaaccgcccctagaccttccgtatacgtacttagtacggtctacttaccttactttgacgttgggtacggttacggggacccctaagtaccgtaaggttccgaggttcggacgtaggtggtacgtcggtaggaacgtaagtaacgttctactacccgtanaaccctactaccaaccgtacgttccgacgtcgaacgggtactagggttagttacgtttacggtaacttaacctttacgtttcgtagtaacccgaagttacggttaacttcgttaccgttcccttaccggttaccgtttccggacgttacggtaacctgtacgtagtaactacgtaactaacgtaacgttcgagttacgactaccgacttgtccctgttaacc

SEQ ID NO: 81455 - DNA, 824 bp, Homo sapiens
  misc_feature: GYAE6OF01A7Q4K.52.1.A01.1.454.CMB.1.raw
tcagcgcagtacgacacgaccggtgctcgatttagacgtctcatcagggcacagcatggacatgagggtccccgctcagctcctggggctcctgctactctggctccgaggtgccagatgtgtcatccagatcgacccagtctccatccctccctgtccgctatctggtaggagacaggagtctatcgatcgtacgttcggccgggtacaaggtccaagacgactagttaacgtaacgtttattttaaagtggtactacgaaacgtaacggaaaccgaaggggtaaaccgtccccgtagtaaccttccgtaacgtactacgttaacgttcggttacctaacgttccttacgtttcgtaccgtagggtacggttccggggtaccctagttaccgtaacggttcgagggtaccggacgtgggtacggtacgtacggtacgggtaacgtaacggttaaccttccgtacccttaccgtaccgtaacctaccgtacctaaccgtacgtccgtacggtaccgtacggtcgtaggttacgttacgtttacgtaaccctttaaacgtttcgtaccgttaacgtacctaaacggtacgttaacgtttacccgttaaccgtttccccgttacgttacccggtttacccggtaccgttaaccggaaccgttaaggttacggttaacggtaacttaaccggtaaccgtaaaaccggtcgttacgggtacggttacccgtacgtacccgtaaccttacgtttcggttaccctttacccgttaacccttaacccgtttaccccccggttaccgtaacctttcggttaaccgttaaacg

SEQ ID NO: 81456 - DNA, 910 bp, Homo sapiens
  misc_feature: GYAE6OF01C4TI3.52.1.A01.1.454.CMB.1.raw
  modified_base (76)..(76): a, c, t, g, unknown or other
  misc_feature (76)..(76): n is a, c, g, or t
  modified_base (171)..(171): a, c, t, g, unknown or other
  misc_feature (171)..(171): n is a, c, g, or t
tcagcgcagtacgacacgaccggtgctcgatttagacgtctcatcagggcacagcatggacatggagggtccccgntcagctcctggggctcctgctactctggctccggaggtcgccagtatgtcgtcatccaagactcgacccagtcctccactccctcccgtgtccgnatcgtaggtacggagacgaggtctcatcactctacgttcgggccggacaagtcgagacgtacctaagttaacggtaacttttaagttttaagtggtaactaccgaaaacgtaaacggaaacccggaaaggggtaaaccctccccgttacggtaaacctttccgtagtaactttacgttaaggtttccggttaccttaaccgttcccgtttaaacggtttcgtaccggggttaggggttaacccgggggtccccggggttaacccttaaacggttaccgggtttaaaacggggtttccggaacgggggttacggtaaccggttaacgggttcggggttaaacgttccggggtaaaccggggaaactttaaccggtaacctttcccttaaaccccgttacccctaaccgtaaccccgtacgttaaccccgtacggttaccgtaccggtacggaccggggttaaccgtttgggtaacggtttaacgggttttcttttaaacccggacccttttaacgttaccgtttaaccggtaccttaaccgtaaacggttacgtttaaaccccggtttcgtttaccccgtttaccgtttacccgtcccgggtttacccgtaccggttaccggtacggtacgttaggaacgttaacttaacgaaccgtcgttaaccggtgtccgtaacgtcgtacccgatttcgtccgttacgtttctaccgttcccttaccctacgactggttctaaacg

SEQ ID NO: 81457 - DNA, 700 bp, Homo sapiens
  misc_feature: GYAE6OF01AZGSK.52.1.A01.1.454.CMB.1.raw
  modified_base (198)..(198): a, c, t, g, unknown or other
  misc_feature (198)..(198): n is a, c, g, or t
tcagcgcagtacgacacgaccggtgctcgatttagacgtctcatcagggcacagcatggacatgagggtccccgctcagctcctggggctcctgctactctggctccgaggtgccagatgtgtcatccagatgacccagtctccatccctccctgtccgctatctgtaggagacagagtcatcatcacttgccggganaagtcagacgctattagaacttaatttaaattggtatcaacgaagaaaccgagggaaacgcccctagaacctcctagatctatcggtcactcctactttgctgacggtcgggtaccatacgaaggttcaggtgctaggtggacgttcgtagggactaggtaacttccacgttctacacccgactaccgaccagttctacgtcgaggtccgtaggtacggttattttacgaaccctttaactttaccgttaccgttacgtaacctaaaccgtaggttaaccgtttaacccgtaccgtttaccccgttacgttacccggttttcccgggtaccccgttacggggtacccttaagggttacggttacggtaacttaaccgtaacctaaaccggttaccgttacgggttacggccttacggacccttacccgtaacgtttccgttacgttacctttaccgttacccttaccccggtttaccccgacccttaccgttccggttaacg

SEQ ID NO: 81458 - DNA, 714 bp, Homo sapiens
  misc_feature: GYAE6OF01EQTXU.52.1.A01.1.454.CMB.1.raw
  modified_base (198)..(198): a, c, t, g, unknown or other
  misc_feature (198)..(198): n is a, c, g, or t
  modified_base (594)..(594): a, c, t, g, unknown or other
  misc_feature (594)..(594): n is a, c, g, or t
tcagcgcagtacgacacgaccggtgctcgatttagacgtctcatcagggcacagcatggacatgagggtccccgctcagctcctggggctcctgctactctggctccgaggtgccagatgtgtcatccagatcgacccagtctccatcctccctgccgcatctgtaggagacagagtcatcactcacttggccggganaagtcaggagtctaagttaacgaaacgtttaatttaaagtttggtaactaccgaaaaccgtaaggaaaaacccgaagggaaaaccgtccccgtagtaaaccttcctagtaacttcctagttcggttactactcctaacgtttgcgtgggtacggttccggggtaccctagtaccgtaaggttccaggtcggacgtggtaggtacgtggacggtactagtaactacctcgtaccaccgacctacaccgtacctcgtctacgtacgcggtacgtaaggtcgttagtttaccgactttaacgtctttggaactaacgtacgtagttacgtacttacccgttcccttacgttacccggttccggtccggtacggtaacaacggtttgggtaaccgttaanacccgttaaacggaaccttacgggtcggttacccgaccgtcgtaaccccgtattaccgttcggttaaaccttccttacgtacccctttcccggtaaccccactttaacgtccgttaaaag

SEQ ID NO: 81459 - DNA, 900 bp, Homo sapiens
  misc_feature: GYAE6OF01D9HXF.52.1.A01.1.454.CMB.1.raw
tcagcgcagtacgacacgaccggtgctcgatttagacgtctcatcaggggggagtcagtctcagtcaggacacagcatggacatgagggtccccgctcagctccgtggggctcctgctactctggctccggaggtcgccagagtgtgtcatccagatcgaccctagtcctaccacttccctcccgtacgtccgactacttcgtaggtacggacgtacgagtacgtcaactctaacttaccgtacgttacgggacccggggactaaggtacgtaacggaacgtaccgttaaagtttaaacggtaaaacgttttaaagttttaaaacggtttacggttaacaaaccgtaaaaccggaaaaccggtaaaaaccggaacggggaaaacccccgtccccttaaacggtaacccgttcgtacgttaaccttccggtttaaggtccgtttaacctacgttacccgttacgtttcggtacgttcgggtagggttacccggtacgtaacgtcgtaacggtcgtaacgggtgtacgtacgggtgttacggtacggtaacggggaaacttaacgttacttacctaccgttaccgtaacccgtaaccctaacgttaccctaaccgtttaacggtccggtaacggtaccgttagggacgtttaaaggtaaccgggttttctttaaccggttaaacccgtttaacgtttttccggttaattaaccgtaaggtaaacggttaacgtaccgtttaacccggttctttaaccccggttcggtttaacccccggttcccggtaccgggtttaaccgaacgggttacgttaaacgggtaacttaaccggttaaactaaacggtacggttacggttccgacggtacttacccggactttaccgtcgtttgtcccgtttcg

SEQ ID NO: 81460 - DNA, 765 bp, Homo sapiens
  misc_feature: GYAE6OF01CL4NN.52.1.A01.1.454.CMB.1.raw
  modified_base (132)..(132): a, c, t, g, unknown or other
  misc_feature (132)..(132): n is a, c, g, or t
  modified_base (293)..(293): a, c, t, g, unknown or other
  misc_feature (293)..(293): n is a, c, g, or t
  modified_base (457)..(457): a, c, t, g, unknown or other
  misc_feature (457)..(457): n is a, c, g, or t
  modified_base (512)..(512): a, c, t, g, unknown or other
  misc_feature (512)..(512): n is a, c, g, or t
tcagcgcagtacgacacgaccggtgctcgatttagacgtctcatcagggcacagcatggacatggacgggtccccgctcagcctccgtggggcctcctgcctactctggcctccggaggtcgccagatggtntcactaccagtactaccgaaccctagtcctaccacctcccctcccgtcgtcccgacactcggtaggtaaggaacggaacagtacgtacactacactcgtacgttcgggccggacaagtacgagacgactaaagtaaggtaaatttaatttaagtacggtanaaccgaaacgaaacggaaaccggaacggaaaccgtccgtaacgtaacccttcgtaagcttaacgttaggtacgttaccaccgtttacccctagttcgacgggtaggtaccgggtccgggtaacccttagtaacgggtaaccgtgtaacgggtcggagtaacggnggtacgttacgggaacgaacgtaatactcctaccgacctacacgtacaccacgtntacctcggacgtaggacgttagggtacttaagtttccgaactttaaccgttactacgtaccgtaacaacgtagttactcctacctttacccgtccgtttaccggccgtaaccgtaacggtctaaggtacgtaacgtaattaacctaacgggaaacctcggttcgaggttacctacggcccctaaattcccggtttgtacccggttccctttactacccccggtacccttaacggtacctccttaaagtaccgg

SEQ ID NO: 81461 - DNA, 836 bp, Homo sapiens
  misc_feature: GYAE6OF01CFY63.52.1.A01.1.454.CMB.1.raw
tcagcgcagtacgacacgaccggtgctcgatttagacgtctcatcgagggggggagtcagtctcagtcaggacacagcatggacatgagggtccccgctcagctccgtggggctcctgctactctggctccggaggtgccagatgtgtcatccagatcgacccagtcctccacttccccttccctcgtcccgactactcgtaggtaggaacgacgagagtcaatcatcctacgttcggccgggacaagtcagagtactaagttagtaacgtttaatttaaacgttaggtaactaacaaacgaaacgaaaaccggaacgggaaaccgcccgtagaaccttcgtcgtacttcttacgtcggttactacgttccttacgtttgcgtacgggtacgggtccgggtaccctaagtacgtaacggttacgacgggttcggacgtacgggtacggtacgttacgggtacggggaaactaacgttaacttaccgtaccttaccgtacctaaccctaaccgttacccgtaaaccgttacgttcggtacgtaaccgggtacggttccggttaagggttaacggtttacgttttaccgtaaccgttttaaaccgtttaccgtttacgttaccgtaaaccgtaacgttaacggtttaacgtttaaccccgtttacccgtttaccccttaccggttttacccgttacccgggtacccgggttaaacggttaccgttaacgggttaccggtaaaggtaaaccgtttaaccgtaaaaccggttaaccggttacgggttacggtacggtccgttaccggacccttaaccgttcgttccgttacgtttacccg

SEQ ID NO: 81462 - DNA, 744 bp, Homo sapiens
  misc_feature: GYAE6OF01EQMT5.52.1.A01.1.454.CMB.1.raw
tcagcgcagtacgacacgaccggtgctcgatttagacgtctcatcagggggggagtcagtctcagtcaggacacagcatggacatgagggtccccgctcagctcctggggctcctgctactctggctccgaggtgccagatgtgtcatccagatgacccagtctccactccctccctgtccgcatcgtggtaggagacagagtcatcatcacgttcggccgggacaagtcagagactaagttaacgaaacgtttaatttaaagttggtaatacaaacaacgaaaccgaagggaaacgtcccctaggtaacctcctaggtacttacgtagtcggttacctacttaccctacgttttcgacgttagggtaccgggttaccggggtaccctaagttaccggtaaacggtttccgtaagggttcgggtacgtaggggttacggacgttccgggtaagggtaaacccgtaaaggttaactttaccgtaccttaccgtacccgaaccctactaccccgtaaccgtcggtttaaccgtcggaacggtacgggtccttaagggtaggtttacttttacgaccgtttaaccttttcgttcgttactaacgaattaacgggttacttaccgtaccgtttccctacttacccggttccggacccggttacggactaaggttggtacgtaacgttacaacgtaaacggttgtaccgggtgtaccgtcgtaaccctacgttcgttcgttcgttaccc

SEQ ID NO: 81463 - DNA, 671 bp, Homo sapiens
  misc_feature: GYAE6OF01CW0EH.52.1.A01.1.454.CMB.1.raw
  modified_base (239)..(239): a, c, t, g, unknown or other
  misc_feature (239)..(239): n is a, c, g, or t
  modified_base (301)..(301): a, c, t, g, unknown or other
  misc_feature (301)..(301): n is a, c, g, or t
  modified_base (436)..(436): a, c, t, g, unknown or other
  misc_feature (436)..(436): n is a, c, g, or t
tcagcgcagtacgacacgaccggtgctcgatttagacgtctcatcgaggggggagtcagtctcagtcaggacacagcatggacatgaggtccccgctcagctccgtgggctcctgctactctggctccggaggtcgccagatgtgtcatccgagactcgaccctagtcctccacttccctccgtacggtccgctactcgtaggtaggacgacagtagtcatcatctacgtcgccggganaacgcagatactattagtaacgttaatttaagttgtatacaacgaacgtaacgaacggaacncccgtacgtacctaccgtgactccgtcgtagtcgactacgtactaagtttacggaacgtacgggtacctagtacgtacggtgaggtaggtaggtcgcgtcggaggtacgtattacgttttacttaccacgttacncgaccgtacgaccgtcgcgtacgtaccgtagtaaacgtcgtaatacgtaccgtaatagttacctacgtacttacctaagtacgtaacgttcgtaactaaccttccgtaccctttaccgtacccgtttaccggtacggggtaaccgggtaccgggtacggtaaccggggtagacggtaacgtacggtaacggtaacgaccggttaggtcgaccgtacaccttactcgttcgttccg

SEQ ID NO: 81464 - DNA, 651 bp, Homo sapiens
  misc_feature: GYAE6OF01BLBGX.52.1.A01.1.454.CMB.1.raw
  modified_base (323)..(323): a, c, t, g, unknown or other
  misc_feature (323)..(323): n is a, c, g, or t
  modified_base (326)..(326): a, c, t, g, unknown or other
  misc_feature (326)..(326): n is a, c, g, or t
  modified_base (346)..(346): a, c, t, g, unknown or other
  misc_feature (346)..(346): n is a, c, g, or t
  modified_base (363)..(363): a, c, t, g, unknown or other
  misc_feature (363)..(363): n is a, c, g, or t
  modified_base (395)..(395): a, c, t, g, unknown or other
  misc_feature (395)..(395): n is a, c, g, or t
tcagcgcagtacgacacgaccggtgctcgatttagacgtctcatcaggggggagtcagtctcagtcaggacacagcatggacatgagggtccccgctcagctcctggggcctcctgctactctggctccgaggtgccagatgtgtcatccagatgacccagtctccatccctccctgtccgcatctgtaggagacagagtcatcatcacgttcgccgggcaagtcagagctaattagaacgttatttaaagttggtactacaaacaagaaaccgaagggaacgcccctagtaacctctagatctatcggttcatcctacttgntgnggtcgggccagtcgtaggtngtgcagtgatcgtgganagtactcgacttctacaccatccaacgagtcncgacgacgtcgtggaagtttatttacgaacctttaacctttaccgttacgttacgtaaccgtaacgtaacgttaaccgttaaccttaccgttttacccccgtaccgtttacccggtttaccccgggtaccccggttaacgggtaaccggttaacgttaacgggtacggttaaactaacgtaacccggtaaaacggtaccgttacgggttccggtacgtaccgtacccgaacccttcgttaccgttcggttaccccg

SEQ ID NO: 81465 - DNA, 672 bp, Homo sapiens
  misc_feature: GYAE6OF01EC1LP.52.1.A01.1.454.CMB.1.raw
  modified_base (156)..(156): a, c, t, g, unknown or other
  misc_feature (156)..(156): n is a, c, g, or t
  modified_base (200)..(200): a, c, t, g, unknown or other
  misc_feature (200)..(200): n is a, c, g, or t
  modified_base (657)..(657): a, c, t, g, unknown or other
  misc_feature (657)..(657): n is a, c, g, or t
  modified_base (666)..(666): a, c, t, g, unknown or other
  misc_feature (666)..(666): n is a, c, g, or t
tcagcgcagtacgacacgaccggtgctcgatttagacgtctcatcagggcacagcatggacatgagggtcccgctcagctcctggggctcctgctactctggctccgaggtgccagatgtgtcatcagatcgacccagtctccatcctcctgtccncatctgtaggacgacagacgtcatcatctaccgttggaccgganacgtcgagtacgacgtaagttacgtaacttaatttaacgttgtaactacaacgaagaaaccgaggaactcccgtagaacctctagatcttactcggttacactccctagtttcgcgtaaggtcggttaccgggtacctaagttacgttaaagggttccgtaaggtccggtaggtaggttcggaagtttcggacggtaactaacggtacttcctaaccgtacctccaaactccttaccgaacgttgttaccagacgggtagtcttaacgggatttacgtttacgttaaccttaacgtttacgttacgtacgtaacacgttaagttaccgtttacacccgtttcccgtcttaccgtttccgaccggtagtacctagttagacgtactaacacgtaacgtgtcggtctacgtacgtactacgtacgttcgtactttcgtacccttaccgtcccgttaccncgtaccctntaacgg

SEQ ID NO: 81466 - DNA, 786 bp, Homo sapiens
  misc_feature: GYAE6OF01BR7IO.52.1.A01.1.454.CMB.1.raw
  modified_base (189)..(189): a, c, t, g, unknown or other
  misc_feature (189)..(189): n is a, c, g, or t
  modified_base (233)..(233): a, c, t, g, unknown or other
  misc_feature (233)..(233): n is a, c, g, or t
tcagcgcagtacgacacgaccggtgctcgatttagacgtctcatcagggcacagcatggacatgagggtccccgctcagctccgtggggctcctgctactcgtggctccgaggtgccagatgtgtcatccagatacgacccagtctcccatcccttccctcgtccgcatcgtaggtaggacgacgagtntactactcactaccgtacgttcggcccgggtacaagtcaagganactaagttaaagtaacgttaattttaagtaggtaactacaaacgaaacggaaaccgaacggggaactaccccgtagtaaccgtctagtactactagttcggttacctacgtacctttactttacgtcgtaggtacgggtccgggtacctaggtaacgttaggttactagggtacgacgtaggtaggtacgtcggtacggaataacgtactacgaccttaccaccacgtacctaccgtacgtacgtacgtcgtaccggagtcgttaacggttagggtttacctttaagtaccgtttaactttacccgtagttactaaaccgtaacttaacggttacgtttacccgttaccgtttcccgttaacccttacccggggttacccttaacccgggaccggttaaccttaggggttaaccgtaaggtaccttaaaccggttaactaaacccggggtattaccgggtcgggtaactcccgtacccgtaatacccgtttacgtcctttaaccgttacccgtccgttaacccgttcccggttaacttccgtaacttaaccgg

SEQ ID NO: 81467 - DNA, 687 bp, Homo sapiens
  misc_feature: GYAE6OF01BTTSK.52.1.A01.1.454.CMB.1.raw
tcagcgcagtacgacacgaccggtgctcgatttagacgtctcatcagggggggagtcagtctcagtcaggacacagcatggacatgagggtccccgctcagctccgtggggctcctgctactctggctccgaggtgccagatgtgtcatccagatcgacccagtcctccactccctccctgtccgctatctgtaggacgacagacgtcatcactcgacgttcggccgggctaagtcacgagctaagttaagtaacgttaattttaaagttggtaactacaaacaacgaaaccgaacgggaaaccgcccctacgtaactcctagtactacttagtcgttcacttacctacgtttacgcgtaggtacggtcggtaccctagtacgtaacggttcgacggtgacgtaggtcggtacgtcgtacgggaactaagtaacttctaccgtactacctaacctactacccgtaaccgtacgttccgtacgacggtacggtacgttagggtaggtttactttacgtacctttaaccgtttactttcctacggtaacctaacgttaagttacgttaccgttaccgttaccctaccgtttccgttcccggtaccgtacggtaccgtaagttggtaacgtaactacgtaacgaaacgtcggttacgtcggtctacgactaacgtcttcgttcgttaccc

SEQ ID NO: 81468 - DNA, 724 bp, Homo sapiens
  misc_feature: GYAE6OF01AX8H2.52.1.A01.1.454.CMB.1.raw
  modified_base (199)..(199): a, c, t, g, unknown or other
  misc_feature (199)..(199): n is a, c, g, or t
  modified_base (266)..(266): a, c, t, g, unknown or other
  misc_feature (266)..(266): n is a, c, g, or t
tcagcgcagtacgacacgaccggtgctcgatttagacgtctcatcagggcacagcatggacatgagggtccccgctcagctcctggggctcctgctactctggctccgaggtgccagatgtgtcatccagatgacccagtctccatccctccctgtcccgcatctgtaggagacagagtcatcatcgacttggccgganaagtcagagctaattaagaattgttaattttaaagtggtaactacaaacaagaaaccgagggaaacncccctagaactcctagactctagtgttaccattcctatttgctggaggtcggtaccctagtacgtaaggttcgagtggactaggtcgtacgtcgtagggaactagtaactccgacttactaccacctatccgaaccgtattaccgacgtaccgtaggtcgttaaggacgggtttattttaccggaactttaactttacgttcgtacgtaaaccgtaagtagttaaccgttacgttaacccgtttcccgtacccgtttaacgggtttcccccggtaaccggttaccgggaaccgttaacgttacgggttaacgggtaaccttaaaccggtaaccggtaaaaccgtacggtacgggttaaccggtccgtaaccggtaccctaaccgttaacgttcccgtttaccggttacctttaacccgtaccctttacccccggttaacccgtcctttaacgtacccg

SEQ ID NO: 81469 - DNA, 768 bp, Homo sapiens
  misc_feature: GYAE6OF01C06R8.52.1.A01.1.454.CMB.1.raw
  modified_base (256)..(256): a, c, t, g, unknown or other
  misc_feature (256)..(256): n is a, c, g, or t
tcagcgcagtacgacacgaccggtgctcgatttagacgtctcatcgagggggggagtcagtctcagtcaggacacagcatggacatgagggtccccatcagctccgtgggctcctgctactcgtggctccggaggtgccagatgtgtacatccagatcgacccagtcctccatccctcccgtgtcccgctatcgtaggtacggagaccaggactcactctaacttccacgttcgggacccgggactaagtcaaggngtacctaagttaacgtaacgtttaatttaaagtggttaactacaaccgaagaaaccgaggaaccgccctagacctcgtagtatcgttagtcgtacctacttcctactttcggacgtagggacggtccgggtaccctaggtaccgtaacggttccgaggttaggacgtacggtggtactacggtacggtactagtaattaccagttacccacctaacgacctccaaccttggcctaggaccggtaaggtaccgttacgggtgtttaacgtttaccgtaacccgttactttaccggttaccgtaaccgttaaccgaacgtttaccgggtaattttaccccgttacccgggttcccgtttaccgttaacccgggtttcccgggtaccgtttcgggtaaaccttaccggggtagttaacgttaaacgttaaccgtaaaccggtaacgttccggtaacggttcccggagttaccccgtaacggttccttaaaccggttcccgttcggttaaaccccc

SEQ ID NO: 81470 - DNA, 756 bp, Homo sapiens
  misc_feature: GYAE6OF01AN3T9.52.1.A01.1.454.CMB.1.raw
  modified_base (419)..(419): a, c, t, g, unknown or other
  misc_feature (419)..(419): n is a, c, g, or t
  modified_base (699)..(699): a, c, t, g, unknown or other
  misc_feature (699)..(699): n is a, c, g, or t
tcagcgcagtacgacacgaccggtgctcgatttagacgtctcatcagggcacagcatggacatgagggtccccgctcagctccgtggggctcctgctactctggctccgaggtgccagatgtgtcataccaggatcgacccagtcctcctactcccttccctcgttcccgactagttctaggtaaggacgacgaggagtcctactcacttacctaccgttcggacccggagaacgtacgagtacgacttaagttaacggtaacgtttaattttaagttaggtactacgaaacgaacggtaaaccggaacgggaacctccccgttacgacctccgtagtaccgttcttaaggttccgtacctacttaaccgtcgtttcgacgttcggacggttcccggtaacctgtaacggtcggtacgnggtcggtagtacggtagtcggtacgtaggtaagtacgtacttcgaccctcaacctaccctacgaccgtactacggtcacggtacgtgtacgttaggttaacgtttacctttacgaccttttaacgtttaccttcgttaacgtaccgtaagtaccggttaccgttacccgttaacccgttcctttaacggttaccccgttccggttaacccgtacggtacttagtaccggttagtaacttaccggaattaccggagttcgtaccggtctaacggcccttanacgtccgttccgttaccttacgtccctttacccgtacggttcctcgttaactaccgg

SEQ ID NO: 81471 - DNA, 876 bp, Homo sapiens
  misc_feature: GYAE6OF01CTG7T.52.1.A01.1.454.CMB.1.raw
  modified_base (174)..(174): a, c, t, g, unknown or other
  misc_feature (174)..(174): n is a, c, g, or t
tcagcgcagtacgacacgaccggtgctcgatttagacgtctcatcagggcacagcatggacatgagggtccccgctcagctcctggggctcctgctactctggctccgaggtgccagatgtgtcatccagatcgacccagtctccatccctccctgtccgctatcgtgtagganacagacgtcatcatcctacgttcggccggacaagtcaagacgtactaagttaacgtaaacgtttattttaaagttggtaactaccaaaacgaacggtaaaaccggaaacggggaaacccgtaccccggttaacgtaaacccgttcccgtaaggtactttacgttaacgtttacgggttacctaaccgtttaccccgttaacggttttcgaccggttacggggtacggggtttcccgggggtaacccctaacggttaccggttaaacgggttttacggaacgggtttcgggaacggttacgggtacggttaccgtacggttaacggggaaaccttaacggtaaacgtttccctaaccggttaccctaaccgtaaaccccgtaccgttaacccgtaaacccggtaccggtttacggtacccggaccgggtacgggtaccggtttacgggttaacggtttacgttttaccgtaaccgtttaccgtttacgttacgttacgtaccgtaaacgtacggttaacgttaccgttaccgtttccctacgtttacccccccgttaggtaccccgtacggtaacgtaggttacgtacgtaactacgtaaccgtaacgtacgtacgtcggtactaccgtaccgtacgttactccggtttcgtacccgtttacgtacccgtttaccctacccggttacctacgttacgttaacg

SEQ ID NO: 81472 - DNA, 794 bp, Homo sapiens
  misc_feature: GYAE6OF01EMS0J.52.1.A01.1.454.CMB.1.raw
  modified_base (200)..(200): a, c, t, g, unknown or other
  misc_feature (200)..(200): n is a, c, g, or t
tcagcgcagtacgacacgaccggtgctcgatttagacgtctcatcagggcacagcatggacatgagggtccccgctcagctcctggggctcctgctactctggctccgaggtgccagatgtgtcatccagatgacccagtctccatcctcctagtccgcatctgtaggagtacagagtcgatcaatcacgttgccgggtnaagtcagacgcaatttacgaacgttatttaaattggtactacaaacctagaaaacccgagggtaaacgtcccctaggaaccttcccgtagactacgttacgttacgggttactacgttacccgtaaccgttttgtaccgttacggacggttaccgggggtaccctaagtttacggaaacggtttaccgaaggtttcggaaccgtacggttcggaaccgtttacggtaccgggggaaactaacgggtaacttaccggaccctacttaccaccgtaccgttacaacccgtaagttccgtacgacgtaggtcctaggtaacgttacgttttacggaccttaacgttacgttctacgttacaaacgttaccggaagtttaccgtaccggtttccctaaccgttcggtttaaccccgggtcccgtacgggttaaccccgtagttaacgggttcggttaaacttaacgtaaccgtaaaccgggtacttcgggtaccggtacgtacgggtacccttaaccggtactttccggtaaccgtttcccttaacggtaacccttttacccccgttaccccgggtaaccttacgttaccgttaacgg

SEQ ID NO: 81473 - DNA, 599 bp, Homo sapiens
  misc_feature: GYAE6OF01EDT4V.52.1.A01.1.454.CMB.1.raw
  modified_base (227)..(227): a, c, t, g, unknown or other
  misc_feature (227)..(227): n is a, c, g, or t
  modified_base (236)..(236): a, c, t, g, unknown or other
  misc_feature (236)..(236): n is a, c, g, or t
  modified_base (449)..(449): a, c, t, g, unknown or other
  misc_feature (449)..(449): n is a, c, g, or t
  modified_base (589)..(589): a, c, t, g, unknown or other
  misc_feature (589)..(589): n is a, c, g, or t
tcagcgcagtacgacacgaccggtgctcgatttagacgtctcatcagggggggagtcagtctcagtcaggacacagcatggacatggagggtccccgctcagctccgtggggctcctgctactctggctccggaggtgccagatgtgtcatccagatcgacccagtctccatccctccctgtccgctatcgtaggtaggagacagagtcatcatcactggccggganaagtcaggnactaattaagaacgttaatttaagttggtaatacaaacaacgaaaaccagggaaacgccctagaacctctagtacttctagtcggtacactcctacgttttgcgtaggtaggttaccggggtaccctaagtaccgtaaaggttcgaggttggacgtagtacggatcggtaggacaagtactacactctaccacatccgactagtctgcgtagntacggtaggttattttacgacttaacttacttcgtactaacaacgtagttaacgttactacgttccccttactaccgtttccgaccgtaggacctagtgtagtaactacgtaacaagtacgaggttcgctacgaccactntcgtgttacc

SEQ ID NO: 81474 - DNA, 709 bp, Homo sapiens
  misc_feature: GYAE6OF01CZ6LI.52.1.A01.1.454.CMB.1.raw
  modified_base (99)..(99): a, c, t, g, unknown or other
  misc_feature (99)..(99): n is a, c, g, or t
  modified_base (178)..(178): a, c, t, g, unknown or other
  misc_feature (178)..(178): n is a, c, g, or t
  modified_base (215)..(215): a, c, t, g, unknown or other
  misc_feature (215)..(215): n is a, c, g, or t
  modified_base (296)..(296): a, c, t, g, unknown or other
  misc_feature (296)..(296): n is a, c, g, or t
  modified_base (332)..(332): a, c, t, g, unknown or other
  misc_feature (332)..(332): n is a, c, g, or t
  modified_base (338)..(338): a, c, t, g, unknown or other
  misc_feature (338)..(338): n is a, c, g, or t
  modified_base (478)..(478): a, c, t, g, unknown or other
  misc_feature (478)..(478): n is a, c, g, or t
tcagcgcagtacgacacgaccggtgctcgatttagacgtctcatcgagggggggagtcagtctcagtcaggacacagcatggacatggacgggtccccntcagctccgtggggcctcctgctactcgtggctccggaggtcgccagatgtgtcatccaggatcgacctagtcctaccnctccctcccgtcgtccgctagtcgtaggtacgggaanacgaaggtcttcaacttcactacgtacgtcggaccgggtactagtcgaggacacgtaagttaacgtaagttaagtttaagngttaaacacgaaacgaacgaaccggaaggtaacccnccgtanacctctgtaacttcgtacggttctaacctacttacccttagtggaccgtggttacggtccgggtacctaagtaccggttaacgtcgaggggtactaggtagtacggttagaccggtaagggtaacaaccgttattacccncgttaacgaccaccttacctaccggaaccgtagtcgtaacgtacgacggttcggttaacgtacggtttattacggtaaccttaattccgttcgttacgaacctagttacgtaccgtttaccgtccgttaccgtccgttccggttaccgtccgtaacggtacttcgggaatagtaccggtactaacgtaggtcgtcggtcgacttacggacctacttagttcctaggttccc

SEQ ID NO: 81475 - DNA, 720 bp, Homo sapiens
  misc_feature: GYAE6OF01B30ZB.52.1.A01.1.454.CMB.1.raw
tcagcgcagtacgacacgaccggtgctcgatttagacgtctcatcagggcacagcatggacatgagggtccccgctcagctcctggggctcctgctactctggctccgaggtgccagatgtgtcatccagatgacccagtctccatcctccctgtccgcatctgtaggagacagacgtcactcatcacgttcggccggactaaggtcaggagacaagttaacgaaacgtttaattttaaagttggtactaccaaacgagaaaaccgaggggaaaccgcccctagaacctccgtagacttactagttggttacacttcctacgttttcgacgttggtacgggttcggggtacccctagttaccgtaaagggtttcagggttcggacgtagggttacggtacgttcggtaggggaactaacggtaacttccgtaacctccgtaccaacccgtactaccctaccgtacgttcctacggacgtacgggtacgtacgggtaacggttacttttacggaccctttaaactttaccgtttcgtacgttaaccaaacgtacgttaacgtttaccgttacctttcccgtaccgttacccgtttccggacccgtacgggtaccctaagtcgtaggtaacttacgtaactaaacgtacggtcgtacggacctacggacctacgtcttcgtccgttcttacgtacttccccgtacctcctagtcccgttaag

SEQ ID NO: 81476 - DNA, 768 bp, Homo sapiens
  misc_feature: GYAE6OF01A5LAO.52.1.A01.1.454.CMB.1.raw
  modified_base (190)..(190): a, c, t, g, unknown or other
  misc_feature (190)..(190): n is a, c, g, or t
tcagcgcagtacgacacgaccggtgctcgatttagacgtctcatcagggggggagtcagtctcagtcaggacacagcatggacatggagggtccccgctcagctccgtggggctcctgctactctggctccggaggtgccagatgttgtcactccagtatcgacccagtcctccactccctccctgtccnctatcgtaggtaggagacagagtcatcatcctacgttcggccggacaagtcagtacgactaattaagtaacgtttaattttaaagttggtaactaacgaaacaaacgaaaaccgaacgggtaaaccgccccgtaacggtaaccttccgtagtacttacgtagttcggttactaccttaccgttacgtttcgtcgttacgggtacggtcgggtacctacgtacgtacggttacgtaggtacggtacgtaggtggtacgttacggtacgggtaacgtacgtaacgttaccgaaccttaccgtaccacgttaccaaccgtaaccgtacgtttaccgacggtaccgtaacggtcgttaacgggttaacgtttagtttacgtaaccgtttaactttacccgttcgtaactaaccgtacgtaacgtaacggttaccttaccgttcccttaacggttacccgttacccggccgttacggaaccgttaggttacgtaaacgggtacgttaaccggtaaacgttaaccggtggtacggtacggtacctaacccggaccttaacggttactttccggttcgttaaccc

SEQ ID NO: 81477 - DNA, 707 bp, Homo sapiens
  misc_feature: GYAE6OF01BX2UH.52.1.A01.1.454.CMB.1.raw
  modified_base (180)..(180): a, c, t, g, unknown or other
  misc_feature (180)..(180): n is a, c, g, or t
  modified_base (528)..(528): a, c, t, g, unknown or other
  misc_feature (528)..(528): n is a, c, g, or t
  modified_base (657)..(657): a, c, t, g, unknown or other
  misc_feature (657)..(657): n is a, c, g, or t
  modified_base (694)..(694): a, c, t, g, unknown or other
  misc_feature (694)..(694): n is a, c, g, or t
  modified_base (702)..(702): a, c, t, g, unknown or other
  misc_feature (702)..(702): n is a, c, g, or t
tcagcgcagtacgacacgaccggtgctcgatttagacgtctcatcagggcacagcatggacatgagggtccccgctcagctcctggggctcctgctactctggctccgaggtgccagatgtgtcatccagatcgacccagtcctccactccctcccgtgtccgcatctggaggagacagntcatcatcgattcggcggacaagtcaaggagctaattaagaaacgtttaatttaaaagttggtaactcaaaacgaacggaaaaccgaaggggaaacaccccttaggaaacctccgtagaacttacgtaattcgggttacctactacccttacgttttacgacgtacggtaaggttcggggtaccctaataccggtaagggtccaaggtcggtacgaggttcggtataccgtaggggtaactaaggtaactttaccgaccttacctacgaaccctagttacccaacgtaacgtctacgacgagggtaccttaggtacggttacgttttacggaactaactttaccgttntaagttaccaacgtagttaacgtacttaccggttaccctatacccggttacggtccccgaaggtaccttaaggttaccgaggttaactaactaaccgaaactttaggcgtgacccgttagacctaccgnttccgtcgttacctttcgaaccctttccgttaccccngttaactntaacg

SEQ ID NO: 81478 - DNA, 792 bp, Homo sapiens
  misc_feature: GYAE6OF01BBSKJ.52.1.A01.1.454.CMB.1.raw
  modified_base (97)..(97): a, c, t, g, unknown or other
  misc_feature (97)..(97): n is a, c, g, or t
  modified_base (197)..(197): a, c, t, g, unknown or other
  misc_feature (197)..(197): n is a, c, g, or t
tcagcgcagtacgacacgaccggtgctcgatttagacgtctcatcagggggggagtcagtctcagtcaggacacagcatggacatgagggtccccgntcagctcctgggctcctgctactctggctccgaggtgccagatgtgtcatccagatcgacctagtcctccatccctcctcgtaccgcatctaggtagganacagtgtctagcatcacgttacggccggacaagtcgagacgtactaagttaacgtaacgtttaagtttaaagtggtaactaccaaaacgaacggaaaaccgaaacggggtaaaccctaccccgtaaggtacccttaccgacgtaacttaccgtagttaccggttactaccgttaccgtttacgtttacgacgttacgggttacgggtcccgggttaacctacgttaacggtaaacggttcggtaggtacgggtctaagggtcggtacgttcggtaacgggtacgtaaacgttaacttcgacctttacgacctaaccgtcctacccgtaacgttcgtactacggtaccgaaggttcgtaaggttacgttatttaaccggtaccttaaacccgttttgttacgtacgtaacgtaaaaccggttgtaaccgttaacccgtttcccgttaacccttcctttaaaccgggttccccggtacggtaacggtaaacccttaggtacggttaaccgtaaacgttacgttaaaccgggaacggttaacgttcggaccgggtacctccgggtaccttaactcggtttaaccgtcggtttaacccc

SEQ ID NO: 81479 - DNA, 748 bp, Homo sapiens
  misc_feature: GYAE6OF01ADAHI.52.1.A01.1.454.CMB.1.raw
  modified_base (116)..(116): a, c, t, g, unknown or other
  misc_feature (116)..(116): n is a, c, g, or t
  modified_base (214)..(214): a, c, t, g, unknown or other
  misc_feature (214)..(214): n is a, c, g, or t
  modified_base (225)..(225): a, c, t, g, unknown or other
  misc_feature (225)..(225): n is a, c, g, or t
tcagcgcagtacgacacgaccggtgctcgatttagacgtctcatcgagggcacagcatggacatgacgggtccccgctcagctccgtggggctcctgctactctggctccgaggtncagatgtgtcatccagatcgacccagtcctccactccctccgtgtccgctattcgtaggtaggagacaggatcatcatccgtacgttcggcccggganaagtcgaggancgtaagttaacgtaactttatttaaagtggtaactacaaacgaacggaaaccggagggtaaacctcccctagtaacccttccgtagtacgttacgtagttcggttacctaacttaccgttacgttttcgaccggttgggaccggggttccggggtaccctagttaccgggtaaggttcgtagggttcggacgtaggtacggtacgttacgggtaagggaacttaacggtacttaccgaccctcgtaccaacggtacctaccgaaacgtcgttacgtccgtaggacggtagacggttaagttcgtttcctaaactttaccgtttcgtcgtaacgtactaacgtacgtttaaccggtacccttccggttacccttacgtttaccggtcccgggtaccgtaacgggtaacttagggttacgtacggtaacttaaccggtaacaaaccggttcggtgtaaccgttccgaactaccgtatacgttcgtcccttacttaccgtccttcccgaccttctcgttacgtacg

SEQ ID NO: 81480 - DNA, 618 bp, Homo sapiens
  misc_feature: GYAE6OF01A1KUW.52.1.A01.1.454.CMB.1.raw
  modified_base (180)..(180): a, c, t, g, unknown or other
  misc_feature (180)..(180): n is a, c, g, or t
  modified_base (218)..(218): a, c, t, g, unknown or other
  misc_feature (218)..(218): n is a, c, g, or t
  modified_base (469)..(469): a, c, t, g, unknown or other
  misc_feature (469)..(469): n is a, c, g, or t
tcagcgcagtacgacacgaccggtgctcgatttagacgtctcatcaggggggagtcagtctcagtcaggacacagcatggacatgagggtccccgctcagctcctggggctcctgctactctggctccgaggtgccagatgtgtcatccagatgacccagtctccatccctcctgtccgnatctgtacggagacagagtcatcatcacttgcccgggnaagtcagagctatagaacgttatttaaagttggtatcaacacgtaaaccgagggaacgccctagaactccgtgattctaatcggttacacgtcctatttgctgtacggtcggggtaccctatccgaaggtttccgaggttcgggcgtaggtggagtcgtaggggactagtaacttcactcactaccataccacacgttctagacgtaggctaggtaggtacttttagggaccttaaacgtttctcggttanaccgtaacgtagttacgttaacctcgtttccctattacccgttttcccggacccgttacgggaccttaagtacggtaacggtacttaaacgtacgtaaaaccggtctacgggtagcccgttaggaccctaacctattcgttcttacccg

SEQ ID NO: 81481 - DNA, 721 bp, Homo sapiens
  misc_feature: GYAE6OF01BA7KX.52.1.A01.1.454.CMB.1.raw
tcagcgcagtacgacacgaccggtgctcgatttagacgtctcatcagggcacagcatggacatgagggtccccgctcagctcctggggctcctgctactctggctccgaggtgccagatgtgtcatccagatcgacccagtcctccatccctccctgtccgcatctggtaggagacagagtcatcatccacttggccgggacaagtcagagctaagttaagaaacgttaattttaaattggtaactacaaacaacgaaaccgaagggaaacctcccctagaaccttcctagtactcgtattcggttacctactaccctactttggtccgtacggtacggggttccggggtaccctaagttaccgtaaacgggtttcttaacggttccgggatacgggtcggtaacgttaccggttaggggaacttaaggtaacctttctaacccctaccttaaccaccctaactacccgtaacccgtacggttacttcgggaccgtaggtcgtagggttacgttaactttcgtaaccgttaaactttctacgttgtaacctaaacgtatacgtttaccacccgttcccttacccgttaccgtttcccggtccgtacggtacctagtggtacgtataacgaccgtaaacgtacgcggtcgtactagtacctacctaacgtccttacgtcctttacgtaccctttccccttacccgtcctacggttctaacgg

SEQ ID NO: 81482 - DNA, 974 bp, Homo sapiens
  misc_feature: GYAE6OF01CXKJ8.52.1.A01.1.454.CMB.1.raw
  modified_base (77)..(77): a, c, t, g, unknown or other
  misc_feature (77)..(77): n is a, c, g, or t
tcagcgcagtacgacacgaccggtgctcgatttagacgtctcatcagggcacagcatggacatggacgggtccccgntcagctccgtggggctcctgctactcgtggctccggaggtcacagtatgtgtcatccagatcgacctagtcctcctacttccctccgtcgtccgactacgtcgtaggtaagggaacacgtagtaacgtaccaatactacgtaccgtaccggttcgggacccgggaactaacggtcgaaggacgtaaccgttaaagtttaaaggttaaaacgttttaaagttttaaaggttacggttaactaaaccgaaaacgaaaaccgggaaaacccggtaaaccggggtaaaccccgttcccggtaacggtaaccttccgtaagtaccgtttacgttaggttcccgttactaccgttaccgtttacttcgggtccggttacggtaccggggtttcccggaacccttagttaacggttaacgggttcgaggggtccggaaggttaagggtcgggtacgttacgggtaacggtaaacgttaagttaaaccttctacccgtacccaactaacccgtataaccccgtacggttagtaccgtcggggacgttacgggtacggttaagggtttaacgtttaacggtttaccgtaaaccctttttaacgtttacgtttaccgtaaacggttacccttaaacgggtaacttttaaccgttaaccccgttttaccgttttacccccgtttaaccgggttttaaccccgggttccgggttaaaccccgggttacggttaaaccggttaacggttacgggtaaaccgggtttaaacctaacccgggtttaaacgaaaccgttaaccggggtttacgggaccccgttaagttacccgtaaaccctaagggtttcctttaccggttaccgtttacccttacgttcccttaccggttaccctacgttcgttactaacgg

SEQ ID NO: 81483 - DNA, 833 bp, Homo sapiens
  misc_feature: GYAE6OF01CHLZ0.52.1.A01.1.454.CMB.1.raw
  modified_base (75)..(75): a, c, t, g, unknown or other
  misc_feature (75)..(75): n is a, c, g, or t
  modified_base (203)..(203): a, c, t, g, unknown or other
  misc_feature (203)..(203): n is a, c, g, or t
tcagcgcagtacgacacgaccggtgctcgatttagacgtctcatcagggcacagcatggacatgagggtccccgntcagctcctggggctcctgctactctggctccgaggtgccagatgtgtcatccagatcgaccagtcctccatccctccctgtccgcatcgtgtaggagacagagtcatcatctacgttcggccggganaagtcagagactaagttaacgtaacgtttaattttaaagttggtaactaaccgaaaacgaacggaaaaccggaacggggaaacctcccccgttaaggaacccttcccgttaggtaactttaccgttaaggttcggtttaccaaccgtttaccgtaaccgttttcggaccgttagggtaacggggttccggggtaccctagttaacgttaaacgggtttacgacgggttagggacgtaggtacgggtaacgttcggtacgggtaaactaacggttaaccttccgtaacttcccgtaacctaaacccgtaccttaacccgtaaccgttacgttccgtacgtaccgggtaggttaccgttaggtacggttttaactttaccgactttaaaccgtttacgttacgtaccgtaaccgtaaacgtagttaacccgtttaccttccggtttaccccttacgtttacccgttcccgggaccgttacggggtacctaagggttcggtaaccgtaacttaaccgtacgtaaaaccggttgttacgggtaccgtcgttaccggaccccttaggttacttccggttaccgtttaccctttcctacccgttttacccgaccccgtttacttcgtacgttaacg

SEQ ID NO: 81484 - DNA, 1006 bp, Homo sapiens
  misc_feature: GYAE6OF01DX4BZ.52.1.A01.1.454.CMB.1.raw
  modified_base (158)..(158): a, c, t, g, unknown or other
  misc_feature (158)..(158): n is a, c, g, or t
tcagcgcagtacgacacgaccggtgctcgatttagacgtctcatcagggcacagcatggacatgagggtccccgctcagctcctggggctcctgctactctggctccgaggtgccagatgtgtcatccagatcgaccagtctccatccctcctgtccncatctgtaggagacagatcatcatctacgttcggccggacaacgtctaagagacttaagttaacggtaacgttaatttttaaagttggttaactaccgaaaacgaacgaaaacccggaaacggggtaaaccctcccctaggtaaccttcctagtacttaccttaagtcgttcctaacgtttccgtacgtttcgacgttcgggaacgggttcccgggtacctaagtacggtaaggttcgaacgggtcgaggtaaggtgtacgttcgggtacggaatacgttacttaccggaccttaccctacctaaaccgtaccttacccgtaaacccggttcggtttaccccgaacgggtccggtaacgggttacgggtttacggggttaaaacgggtttttacgtttttaaaccccgttaacccgtttttaaacccgttttaccgttttacccggttaaacgttaaccggttaaaaccgtttaaacgggtttaacccgtttttaacccgttaaccccgttttttacccccggttaaccccgggtttttaaccccgggttcccccggggtttaaccccgggttaaccggggttaaaaccccggtttaaccgtttaaggggttaaaacccgtttaagggtttaaaaacccccgtaaacggggaaaaacccgtttttacccggaaccggggttttcggttaaacccgggttacgtaaacccccgtttaacccgttaaacggtttttccccggttttaaaccccggttttccccttttaaaacttttcccccccggggttaaacccccgttttcccccctttaacttaaaacccccggttttttcgtaaaaaccccggggg

SEQ ID NO: 81485 - DNA, 818 bp, Homo sapiens
  misc_feature: GYAE6OF01CCURU.52.1.A01.1.454.CMB.1.raw
  modified_base (716)..(716): a, c, t, g, unknown or other
  misc_feature (716)..(716): n is a, c, g, or t
  modified_base (774)..(774): a, c, t, g, unknown or other
  misc_feature (774)..(774): n is a, c, g, or t
tcagcgcagtacgacacgaccggtgctcgatttagacgtctcatcagggcacagcatggacatgagggtcccgctcagctccgtggggctcctgctactctggctccgaggtgccagatgtgtcatccagactcgaccagtctccactccctccctgtccgcactcgtggtaggacgacagagtcatcatccgacgttcggccgggactaagtcagacgataagttaacgtaacgtttaaattttaaagttaggtactaacgaaacgaacggtaaaacccggaacgggaacctccccgtaagaacccttcctgtacttacttacgttcgttactactccttacgtttcggcgttacgggtacggtaccgggtacctaacgttacggtaacggttacggtaggtcggacgtaagggtcgtacgtaggttacggaacttaacggtaactcctaccgtttccaaccctaacctacgtaccaaccggtacgttccggtacgacggtacggtacgtacgggttaacgtttacgttcgtaaaccgttttaaccttacgggttactaacggtaacaacgtttaaacggttaccccgttaacttacccggtttccccgttaacgtttaccccggtttacccgggtaccccggtagggttaacccttaaggttaacggaacgttaacgttaacggttaaccgaaaaccgggttcggttaccgggngttacccgtaccggtaacctacggttactttaccggtttactccggtttttaaccccncccgtttaaccccgttaacctaaccgttaacgtaccggttaacg

SEQ ID NO: 81486 - DNA, 721 bp, Homo sapiens
  misc_feature: GYAE6OF01EOJCV.52.1.A01.1.454.CMB.1.raw
  modified_base (97)..(97): a, c, t, g, unknown or other
  misc_feature (97)..(97): n is a, c, g, or t
  modified_base (242)..(242): a, c, t, g, unknown or other
  misc_feature (242)..(242): n is a, c, g, or t
  modified_base (315)..(315): a, c, t, g, unknown or other
  misc_feature (315)..(315): n is a, c, g, or t
  modified_base (691)..(691): a, c, t, g, unknown or other
  misc_feature (691)..(691): n is a, c, g, or t
tcagcgcagtacgacacgaccggtgctcgatttagacgtctcatcgaggggggagtcagtctcagtcaggacacagcatggacatgagggtccccgntcagctccgtgggctcctgctactctggctccgaggtcgccagatgtgtcactccgagatacgaccccagtcctccacttccctccctgtaccgctacttcgtaggtaaggagacgagagtcatctatctacgttcggccggtanagtcagactacaagttaagaacgtttaaattaagttagtaactacgaaacaacgaaaccggtaacggaaaccncccgtaagtaaccttcgtacgtactacgtttgtacgttacaccgttcctacgtttgtctacggtacggttaccgggtcctaagtccggtaaacggttcgacggttggacgttagggtccgtaaggttccggtaacggactaagtttaacctaccgtaccttccaaccgtctaacccgtacaccgttagtcccgtgtaaccgtacggtgttaggttaacttagtttaccgtaccgtttaaccttacgttccgttaagtaccaacgttacgttacctacgttaccctttaccggtacccttacccggttccggtacccgttaggaaccgtttataccggttagtagttaaaccctagtaaaacggtcgtcggtaccgngtaccaccgttactggtttccgtcttaccg

SEQ ID NO: 81487 - DNA, 672 bp, Homo sapiens
  misc_feature: GYAE6OF01BESBU.52.1.A01.1.454.CMB.1.raw
  modified_base (98)..(98): a, c, t, g, unknown or other
  misc_feature (98)..(98): n is a, c, g, or t
  modified_base (226)..(226): a, c, t, g, unknown or other
  misc_feature (226)..(226): n is a, c, g, or t
  modified_base (290)..(290): a, c, t, g, unknown or other
  misc_feature (290)..(290): n is a, c, g, or t
  modified_base (331)..(331): a, c, t, g, unknown or other
  misc_feature (331)..(331): n is a, c, g, or t
tcagcgcagtacgacacgaccggtgctcgatttagacgtctcatcgagggggggagtcagtctcagtcaggacacagcatggacatgagggtccccgntcagctccgtggggctcctgctactctggctccgaggtgccagatgtgtcatccagatcgacccagtcctccactccctcctgtccgcatctggtaggagacagagtcatcatcacgttcggccgganaagtcagacgactagttaagtaacgttaatttaaattggtatacaacaagaaaccgaggaaccnccctagtaactctagactctagtgtacactctattgctagnggtcggtccagtacgtaagttcaggtgacgtagtcggtatacggtgggaactagtaacttcacgtactaccaacgtactaccacgtacgttcacgacgaggtcgtaggtacgtttatttacgtaaccttaacgtttctttacgtacgtaacctaacgttagttaaccgtttaccgtaccgtttaccccttacgttacccggtttccgggaccccgttacggggtaacccttaagggttacgggtaacggttaaacgttaaccgttaaccggtaaaccggttaacgtgggttaaccgtcgtaccgttacccgtaaaccgtttcgttccgttcgtttaacccc

SEQ ID NO: 81488 - DNA, 685 bp, Homo sapiens
  misc_feature: GYAE6OF01AIH9U.52.1.A01.1.454.CMB.1.raw
  modified_base (159)..(159): a, c, t, g, unknown or other
  misc_feature (159)..(159): n is a, c, g, or t
  modified_base (171)..(171): a, c, t, g, unknown or other
  misc_feature (171)..(171): n is a, c, g, or t
tcagcgcagtacgacacgaccggtgctcgatttagacgtctcatcagggcacagcatggacatgagggtcccgctcagctcctggggctcctgctactctggctccgaggtgccagatgtgtcatccagatcgacccagtctccatccctcctgtccgnatctggtagganacagagtcatcatcacgttcggccggacaacgtcaggacgctaattacggaacgtttatttaaagttggtaactacaacaagaaaccgagggaaaccgccctagaacctcctgactactagttcggttacactcctactttcgacgtggtacggtcggggtaccagtacgtaacggttcgaggttcggacgtaggtacggtacgttacggtagggtaacgtacggttaacttccgtaaccgttcctacctaacctactacctacccgtacgttacgtacggacggtacggtcgtaagggtacgtttacgtttcgtaaccttaacgtttaccgttcgttagtacctaacgtacgtacgttaaccgtccgtttacccgtaacttcccggtttaccgtcccgtaacggtaccgtagttacggtacgtactacgtacgtaaccgtacgtaggtaccgtactacgtactacgtcgtccttcgtacttacgtacttcccgtaccctctacgtcgttaacg

SEQ ID NO: 81489 - DNA, 786 bp, Homo sapiens
  misc_feature: GYAE6OF01D856Z.52.1.A01.1.454.CMB.1.raw
tcagcgcagtacgacacgaccggtgctcgatttagacgtctcatcagggcacagcatggacatgagggtccccgctcagctcctggggctcctgctactctggctccgaggtgccagatgtgtcatccagatcgacccagtctccactccctccctgtccgctatctggtacggagacagagtcatcactcacgttcggccgggacgagtcaaggactaattaacatgtatctagagttggtatcagacgaaagtaaaccgaagggaaaccgaccccttaaactccgtagactcctcgatcgactactaccgtaagtttacggaaacggtacggggtaccaatacgtaacggttacgacggtagggtaacggttcggcgttacggtacggggactaaggttacctttttacttaccgaaccgtacgtccgacctacggtactcgaccgacgtcctaagtaaggtaacttagtcgtaactaactaacgttaacttacgtaccgttaacgtaacgtaagttacgttaacgtaacgtttaaccttccccgttaacccgttacttacccggttaaccgggtttaccggggaacccggggtaacggggtaaacccgttaaggggggtaccggtaacgttaaccggtaacggttaaacggggtaaccggtaaaacggtttacgggtacccggggttaacttaccgggacccgtttaaaccccgaagttttccccgttaacggtttccccgtaaccgtttacccgtttccccccggtaacccgtttaaccccg

SEQ ID NO: 81490 - DNA, 726 bp, Homo sapiens
  misc_feature: GYAE6OF01DDSW9.52.1.A01.1.454.CMB.1.raw
  modified_base (120)..(120): a, c, t, g, unknown or other
  misc_feature (120)..(120): n is a, c, g, or t
  modified_base (238)..(238): a, c, t, g, unknown or other
  misc_feature (238)..(238): n is a, c, g, or t
  modified_base (278)..(278): a, c, t, g, unknown or other
  misc_feature (278)..(278): n is a, c, g, or t
  modified_base (306)..(306): a, c, t, g, unknown or other
  misc_feature (306)..(306): n is a, c, g, or t
  modified_base (461)..(461): a, c, t, g, unknown or other
  misc_feature (461)..(461): n is a, c, g, or t
  modified_base (632)..(632): a, c, t, g, unknown or other
  misc_feature (632)..(632): n is a, c, g, or t
  modified_base (659)..(659): a, c, t, g, unknown or other
  misc_feature (659)..(659): n is a, c, g, or t
tcagcgcagtacgacacgaccggtgctcgatttagacgtctcatcagggcacagcatggacatggagggtccccgctcagcctccgtgggctcctgctactctggctccgaggtgccagntgtgtcatccagtatcgaccctagtcctaccacttccctcccgtcgtaccgctatcgtaggtaaggacgagaagtacgtctactacatcacggttcggaccgggataaggtacagaanacgtaagttaaggtaaacgtttaatttaaagtcggttaanaccaaagaacgaaaccggaagggacccnccgtaataccgtctagtctacgtagtcgttctacgttccgtatttcgagtacggtacggttacggacctagtacgtaggttacaggttccgaagtggacgtacgtacggaggaaactataccgtacacgttccaaccttacgactacccgtaacnggttctacggagttacggacgttaggtagttactttacgtactttaacttctacgtacaacgtacgtaaggttaccttaccgttacccgttccgttacctaccggtttaccggacccggttaggtaccttaagggtaccgttacgtactaacgtaacggtaaccgttaagnggggttaacctcgaaccgtacctttanaccgtttcttacccggtttacttacccgttaccttaccccggttaccgaccttacgtgttaaacccg

SEQ ID NO: 81491 - DNA, 809 bp, Homo sapiens
  misc_feature: GYAE6OF01BQ9UF.52.1.A01.1.454.CMB.1.raw
tcagcgcagtacgacacgaccggtgctcgatttagacgtctcatcagggcacagcatggacatgagggtccccgctcagctcctggggctcctgctactctggctccgaggtgccagatgtgtcatccagatcgacccagtctccactccctccctgtccgcatctaggtaggagacagagtcatcatctacgttcggaccggcaacgtcaggactactaattaacggtaacgtttaatttaaagttcggtaataccgaaacgaacggaaaccgaaggggtaaaccgtcccctaggtaaccttccgtagtaacttacgtagttacgttactacttaccttacgtttcgtagttcggtagggttccgggtacccgtagttacgtaacggtttacggacggttacgggtactaagggttcggtacgttacgggtacggtaaacgtaacggttaaaccttactaccccgttaccttacccgaaccttaaccgtacctaacccgttacggtacgttcgaccggtacgggtaaccgttggtaaccggttttacgtttaccgttaccttaaaccgttttacgttcgttaccgtaacctaacgtaacggttaaccgtttacttacccgttccctttaaccgtcccgtttaccggcccgttacggaacgttacgtcgggtaactttaactacgtaaacccgtaacggttacggtacggttcggtaccgttaccgacccgttaaccgcgttttacccgtacggtttaacctttccgtaacgtttcccccttaacccggtccttacggtacgttaaccg

SEQ ID NO: 81492 - DNA, 742 bp, Homo sapiens
  misc_feature: GYAE6OF01AV6RN.52.1.A01.1.454.CMB.1.raw
  modified_base (512)..(512): a, c, t, g, unknown or other
  misc_feature (512)..(512): n is a, c, g, or t
  modified_base (545)..(545): a, c, t, g, unknown or other
  misc_feature (545)..(545): n is a, c, g, or t
tcagcgcagtacgacacgaccggtgctcgatttagacgtctcatcagggggggagtcagtctcagtcaggacacagcatggacatggacgggtcccccgctcagctccgtggggcctcctgctactcgtggctccggaggtcgccagtatgtcgtactactccgagactacgacccctagtcctccgtacttcccctcccgtcgtccgctacgtcgtaggtagggacgacgaaggtattccaatactacttaccgtaccggttcgggacccgggtacaacggtcgaagacgtactaaagttaacgttaaacgtttaatttaaaggttagtaacctaacgaaaccgaaacgaaaaccggaacgggtaacccgtaccccgtagtacctacgtagtacttacgtaacttcggtctaccgttcctagttcgcgtggtacgggttaccgggtcctaagtacggaggttacgaggtcggagtaggtacggtactacgggtacgtagtacgtattaccncgttaccactacctaactcccacgttacgtcgnggacggtacggtcgttaacgtaggtttacctttacctaaccttttaccgtatttaccgtactaacgtaacgtacgttaaccttccgtaaccctttccgtccgttccgttccgggaccgtaacggtactgtaaccgtgtaacacggtaaccacggttagtcggagtcgtaaccgtctacgttcgttcctacgttcccg

SEQ ID NO: 81493 - DNA, 908 bp, Homo sapiens
  misc_feature: GYAE6OF01BZJAX.52.1.A01.1.454.CMB.1.raw
tcagcgcagtacgacacgaccggtgctcgattttagacgtctcatcaggggcacagcatggacatgagggtccccgctcagcctcctggggctcctgctactctggctccgaggtcgccagatgtgtcactccagatcgacccaggttcctcccaacttccctccccgttgtcccgactacttccgttaggtaacgggacgaccgaaggacggttcaacgttccaaattcctaccggtttcggaccccggggtactaaacggttccgaaggtaccgacttaaacggtttaacgggtaaaccgtttaatttttaaaacggttcgggtaactaccctaaaacgaaacggtaaaacccgtaggggaaaacctcccccttaacggaaccgttccgtagaacttacgtaacgttcggttacctacgttcctacttttcggaccgttagggtaccgggttcgggttaccctaacgttaccggtaaggtttccgtaggttacggaacgtaggtaccgtagtccggtaagggaactaaggtaacgtttcctaacccgtcttaccgaactacttaccacgtacggtctacgacggtacgtacgtacgggtaacgtacgttttacgacccgtaaccgtttcgtttaaccgtacgttaaccgtagttaaacgggtacgttttacccgttacggtttccccttaccggtttaccgtttacccgggccccggtttaacgggtaccttaaacgggttacggttaacggttacgttaacggttaaacgaacccggttaaacggtcggttacgggtaaccctcggtaaacccttaggttaaccctttaccggtccccgttttagtaccccttttaaccggttacccccgttacccgtaacccggttaccgttcccggttaaacg

SEQ ID NO: 81494 - DNA, 671 bp, Homo sapiens
  misc_feature: GYAE6OF01ASO2J.52.1.A01.1.454.CMB.1.raw
  modified_base (436)..(436): a, c, t, g, unknown or other
  misc_feature (436)..(436): n is a, c, g, or t
tcagcgcagtacgacacgaccggtgctcgatttagacgtctcatcagggcacagcatggacatgagggtccccgctcagctcctggggctcctgctactctggctccgaggtgccagatgtgtcatccagatcgacccagtcctccactccctccctgtccgcatctggtaggagactagagtcatcatcacttcggccggacaagtcagagcaattaagtaacgttatttaaagtcggtatacaacgaacgaaaccgaagggaaactcccctagtaacctcctagtattacttagtacgttacacttaccgtacttgcgttacggacggtcgggtaccctagttacaacggttagagttaggacgtagtaggtacgtacggtagggaactagtaacctaccaccgtactacaccctactaccgaacctcgttacncgagtacgtgacggtacgttacgtttcgacttaaccttctttacgtagtactaaagtcgtaactttacctaccgttacccttactaccggttccgaccggtaccgtaactacgttaagtcgtaactaaccgtacgtaaaccggtacgtgttacgacgtactaccctaacctgttccccttacgtacccttaacgttccccttacccgttacccccgtacttaccggttcttaaag

SEQ ID NO: 81495 - DNA, 898 bp, Homo sapiens
  misc_feature: GYAE6OF01BY9F4.52.1.A01.1.454.CMB.1.raw
tcagcgcagtacgacacgaccggtgctcgatttagacgtctcatcagggggggagtcagtctcagtcaggacacagcatggacatgagggtccccgctcagctccgtggggctcctgctactctggctccggaggtgccagatgtgtcactccagatcgaccctagtcctacctacttccctcccttcggtcccgtacacgttcgtggtaagggaggaactaggtagtcatctaactctaccgttcggcccggggtactaagtcgaggacgtactaagttaacggtaaacgtttaatttaacgttaggttaactaccgtaaacgaaacggaaaccggaaaggggaaacccgtaccccgtaacggtaacccttaccgtagttaacttcggtttaacgtttcgggttaccttaaccttcccgttaccgtttacggttccggttacgggtcggggttaccgggttaaccctacgttaccggttaacgggttacggtacgggtacggggtacctaggggttacggtaacggttcggtaacggggtaacgttaactaaacgtttaccctaccgttacccgtaccctaaccacgttcccaaccgttcggtactcggtaacggtacggtacgttacggtacggtttacgtttaacgtaccgttttaacccttacgttacccttacggtaaccgtaaacggttacctttaaaccggtttacccggttacccctttacccgttacccggttaacccggtttccccgggtacccgttaaacccggggtaggttaaccggtaaacgggttacgtaaaccgttaacggttaaacccgaaaccgggttagtccgggtttaaccggcgttaacccggactaaccgttacctttacggttcccgtttaacccg

SEQ ID NO: 81496 - DNA, 930 bp, Homo sapiens
  misc_feature: GYAE6OF01DV8VX.52.1.A01.1.454.CMB.1.raw
  modified_base (130)..(130): a, c, t, g, unknown or other
  misc_feature (130)..(130): n is a, c, g, or t
tcagcgcagtacgacacgaccggtgctcgatttagacgtctcatcagggcacagcatggacatggacgggtccccgctcagcctccgtggggctcctgcctactctggcctccgaggtcgccagatggtntcactccagatcgaccctagtcctccactcccgtccctcgtccgactactcgtaggtacggacgactagtacgtactactctactcctacggttaccgggaccgggtaactaaggtccgaagtacgtacgttaaagttaacgtaaaacggttttaattttaaaaggttacggtaactaaaccgaaacggaaaacggtaaaacccgaagggtaaacccgtacccctaacggtaaccttccgtaggtaacttacgtaacggtttcggttaacctacttacccgtttaggtttcggtacggttacggggtacggggtttacccgggtacctaaggtaaaccgggtttacggtactaggggtacgtacgggtaacggttacggacgttacgggaacggtactaaacggtaaccttcgaaccctctaaccgaacctactaacccgtacgtcgtaccgtaggtaaccaggttacggtagttaacgtttaaccggttttcgaaaaccccttttaaaggttttacccgtttacgtaacccggttaactaaaaccggtttaccggttaacgtttaacccttttaccccgggttttacccctaacggggttccccgttttacccggggacccgtttaaagggtaccgttacgttaaacgggttacgttaacgttaaacccctaaaccgggtaaaccttccgggttagggcccgttaacttaacgtaacccgtacgttacccgttaggtttcccctttacgtaaccgttaccccttccgttaaaccccgttactcggttactttaaaccgg

SEQ ID NO: 81497 - DNA, 695 bp, Homo sapiens
  misc_feature: GYAE6OF01BA4Y6.52.1.A01.1.454.CMB.1.raw
  modified_base (188)..(188): a, c, t, g, unknown or other
  misc_feature (188)..(188): n is a, c, g, or t
  modified_base (199)..(199): a, c, t, g, unknown or other
  misc_feature (199)..(199): n is a, c, g, or t
  modified_base (224)..(224): a, c, t, g, unknown or other
  misc_feature (224)..(224): n is a, c, g, or t
tcagcgcagtacgacacgaccggtgctcgatttagacgtctcatcagggggggagtcagtctcagtcaggacacagcatggacatgagggtcccccgctcagcctccgtggggcctcctgctactctggctccggaggtgccagatgtgtcatccagatcgacccagtcctccatccctccctgtccnatctgtagganacagatcatcatcacgttggccggnaagtcagatctaattaagaacgttaatttaaattggtaactacaaacgaacgaaaccgaagggaaacctcccccgtagaacctccgtagtactacttagttcggtactacttcctaagtttgaccgtaggtacggtcgggtaccctaagtaccggtaaggtcgaggtacggacgtaaggtcggtaacgtccggtagggaacctaagtaacttccaacgtcctaccacctacgtacccacgtacgtctacgcgtacgtcgtaggtagtttacgttactaaccgttaaccgtttcttaccgtagttaaacctacgtaagtaaccgtttacctaccgttaccccttacgttacccggtttaccgacccggttacgaaccgttagtacgggtacgtaaacgtaacgttaacccgaaacggtcttcgggtacggttcccgaacgttacccaacccgttcttaccgttccgttaccc

SEQ ID NO: 81498 - DNA, 906 bp, Homo sapiens
  misc_feature: GYAE6OF01BT4D6.52.1.A01.1.454.CMB.1.raw
tcagcgcagtacgacacgaccggtgctcgatttagacgtctcatcagggggggagtcagtctcagtcaggacacagcatggacatgacgggtccccgctcagcctccgtggggctcctgctactctggctccggagtcgccagatgtgtcactccagatcgacctagtcctccactcccctccctgtcccgactacttcgtagggtaaggagtaaccgaaggtatacaacttacaacgtaccgtaccgttacgggaccgggtaactaacggtacgaaggtacgtacgtaaagtttaaaccggttaaacgttttaaattttaaaaggttcggtaaactaaccgaaaaacgaaaccggtaaaacccgggaaacgggaacccgtacccctaaggtaaccccgtaccgttatactttaccgtagttacgtaccttaactccttaacgttcgacggtacgggtaccggtacgggtaccctaaggttaaccgtaacgggttaccggtaggtacgggaacggttacggttacgggtaaccgttacggggtaaaggtaaacccgtaaaggttaaccctttacccgttaccctacccttaaacccggaaccccttaacctaacccggtaaccgtacccggtttacgccggtaaaccgggtaacggttacccggtttaagggttaaccggtttaaacgttttacccggtaaaccttttaaccgtttaccgtttaaccgttaacggtaaaccctaaacggttacgttttaaacccggtaaccccgtttcgtttaacccccgttaccgttacccgggttcccgggtacccgtacggtacgtaagggtaaccgttagtaaacgtacgtaaaccgtaaaggtacgtggtcctaacgcgtaccaggttctcgttcctaccg

SEQ ID NO: 81499 - DNA, 891 bp, Homo sapiens
  misc_feature: GYAE6OF01EPIWS.52.1.A01.1.454.CMB.1.raw
tcagcgcagtacgacacgaccggtgctcgatttagacgtctcatcagggcacagcatggacatgacgggtccccgctcagctaccgtgggctcctgctactctggctccgaggtgccaggatcgtagtccagtcagatcgaccctagtcctaccgacttccctcccgtggtccgactacgttcggtaggtaacggagtaaccaaggtagttacctaattaccgtaacttccgaaccgtttccggggacccgggtaactaaacgttccgaaaggtaccggtaccttaaaagtttaaaccgggtaaaacgttttaagtttttaaaacggttacggttaacctaaaccgaaaaccggtaaacggaaaaaccccggtaaggggtaaaaccccgtaccccggtaaggttaaacccttacccgttagttaacgttaccgttaacggttacggttaaccttaccgtttaacccgttacggttttaggtaccggtacgggtacgggtttaccggggtacccctaaggttaccggttaaaggttccgaagggtcggtacgtaaggttccggacgttacggtacgggtaactaagttaccttacctaacgtccgtaccaacgtactaccgaacgtcgtacgtcgaacggtcggtaccgtaggttaaggttactttacgaaccctttaacttcgttacgaaaccgttactaaacggttaacgtttaaccgttaccgttaccgtttcccttaccgttaaccgttcccggacgttacgaaccgtgttaccgtagtactaaccgaacttaaacggtccgtaggtacctacgtactaacccgacttaggtcctttacgtacgtttaccgttcccgttaccctaaccccgttagtcctgttaaaacg

SEQ ID NO: 81500 - DNA, 913 bp, Homo sapiens
  misc_feature: GYAE6OF01BEE46.52.1.A01.1.454.CMB.1.raw
tcagcgcagtacgacacgaccggtgctcgatttagacgtctcatcagggcacagcatggacatggacgggtccccgctcagctcctggggctcctgctactctggctccgaggtcgccagatgtgtcactccagatcgaccagtcctaccactccctcccgtcgtccgctactcgtaggtaggacgacagtagtacatctactactacgttacggccgggtacaacgtcgaaggacacgttaaagttaacggtaaaacgtttaaagttttaaaacgtttaggtaaactaacgaaaaaccgaaacggaaaaacccgggtaaacgggtaaaacccgtaccccgtaacgtaacccgttacccgtagtaaccgtttacgtaccggtttacggttacctaacccgttaccgtttaacgttttcggtaccgggttacggtaaccggggttacccggggtaacctacggtaaaccggttaacgggtttaccggtaagggtacgggttacgggtacgggttaacggacgttaccgggtaacgaggtaaacgttaacttacccgacttacccttaacccgaaccttaacgacccgtaccgtacgttaccgtacgggaccgttacggtccggttaaggtacggtttaatttacccgtaacctttaaaccgtttccgttacggtaaccttaaccggtaaaccgttaagggtaccctttaaacgggttccccttacgtttaacccggtaccggttcccggtttaaccgacggtttaaaccggtacggttacgtttaaaccgaaattaccggtaaaccgtaaacgtttagggccgttaacgggactaccggtaactacgttaccgttaacgttcgttaaccctacttaccggtttacccccaggttacccttaaggttctaaaccg

SEQ ID NO: 81501 - DNA, 669 bp, Homo sapiens
  misc_feature: GYAE6OF01AIXU3.52.1.A01.1.454.CMB.1.raw
  modified_base (457)..(457): a, c, t, g, unknown or other
  misc_feature (457)..(457): n is a, c, g, or t
  modified_base (657)..(657): a, c, t, g, unknown or other
  misc_feature (657)..(657): n is a, c, g, or t
tcagcgcagtacgacacgaccggtgctcgatttagacgtctcatcagggcacagcatggacatgagggtccccgctcagctcctggggctcctgctactctggcctccgaggtgccagatgtgtcatccagatcgacccagtcctccactccctccctgtccgctatcgtgtaggagacagagtcatcatctactcggccggacaagtcagagctaagttaagaaactttattttaaagttggtaactaccaaacgtaaacgaaaaccggaacgggaaaccctcccctaagtaacctccgtagacttcgttagttggttcctacttaccttacgtttcggcgtaggtaacgggttccggggtaccctagttacgtaacgggttcgaggtcggacgtacggtggaacgttcggtagggaactagtaacctcactctaccaactcaccgtactcgtccnggacgtacggtacgtaggtacgttattacgaacctttaacttccgttctagtaaccgaacgtagtacgttacctaccgtcccttagtcccgttaccggccgtacggtacgtaacgtaggtagtaacctataaccgtaagtactcgggtacacgtcgacctactcgttcgttcgttacttaccgtaccctacccgttaccncctcgtcgtaag

SEQ ID NO: 81502 - DNA, 691 bp, Homo sapiens
  misc_feature: GYAE6OF01BRMWA.52.1.A01.1.454.CMB.1.raw
  modified_base (166)..(166): a, c, t, g, unknown or other
  misc_feature (166)..(166): n is a, c, g, or t
  modified_base (307)..(307): a, c, t, g, unknown or other
  misc_feature (307)..(307): n is a, c, g, or t
  modified_base (372)..(372): a, c, t, g, unknown or other
  misc_feature (372)..(372): n is a, c, g, or t
  modified_base (422)..(422): a, c, t, g, unknown or other
  misc_feature (422)..(422): n is a, c, g, or t
  modified_base (474)..(474): a, c, t, g, unknown or other
  misc_feature (474)..(474): n is a, c, g, or t
  modified_base (511)..(511): a, c, t, g, unknown or other
  misc_feature (511)..(511): n is a, c, g, or t
  modified_base (638)..(638): a, c, t, g, unknown or other
  misc_feature (638)..(638): n is a, c, g, or t
tcagcgcagtacgacacgaccggtgctcgatttagacgtctcatcagggcacagcatggacatgacgggtccccgctcagctcctggggctcctgctactctggctccgaggtcgcagatgtgtcatcctagatcgacccagtctccactccctccctggtcccgntacttcgtaggtaggagaccagacgttacatcctaagtcctacgttcggacccgggataacgtcgagacgtcgtaagttaagtaacgtttaattttaagttagtaactacgaaacgaaggtaaacccggaagggtaaaccncccgtagaaccttccgtagtaccgttacgttcggttaggttccaccgtttccgtacttttacggngttacgggtacgggtccgggtaaccctagtacgtaaggttcgaggtcggngttaggcggtacgtcggtacgggaatacgttactccgctaccaccaccgtanccctaacgtcgtcacgtcgacggtctaggttacgttnttaccgtaacttactttcgtcgtaacgtctaacgttagtaaccttccgtaacctcccgttacgtccgttaccggccggtaacgtacgttacggtggtactaactacgtaacgaacttgggacgtcgngaaccgctactcttagcccgtttcaacgtccttccgacctctacgttgtaacg

SEQ ID NO: 81503 - DNA, 745 bp, Homo sapiens
  misc_feature: GYAE6OF01CSN3U.52.1.A01.1.454.CMB.1.raw
  modified_base (172)..(172): a, c, t, g, unknown or other
  misc_feature (172)..(172): n is a, c, g, or t
  modified_base (696)..(696): a, c, t, g, unknown or other
  misc_feature (696)..(696): n is a, c, g, or t
  modified_base (717)..(717): a, c, t, g, unknown or other
  misc_feature (717)..(717): n is a, c, g, or t
  modified_base (733)..(733): a, c, t, g, unknown or other
  misc_feature (733)..(733): n is a, c, g, or t
  modified_base (739)..(739): a, c, t, g, unknown or other
  misc_feature (739)..(739): n is a, c, g, or t
tcagcgcagtacgacacgaccggtgctcgatttagacgtctcatcagggcacagcatggacatgagggtccccgctcagctcctggggctcctgctactctggctccgaggtgccagatgtgtcatccagatgacccagtctccattcctccctgtccgcattctgtagganacagagtcaatcactacacttgccaggccaaagtcaagacgtactaattaacgtaaacggtttaatttaaaacgttggtaactaccgaaaacaacggaaaaccgaagggaaaccgccccgttaacgtaacccttaccgtaggtaacttacgttaacgttacgggtttacctaacctttaccttaacgttttacgcgttacggtaaccgggttacgggggttaccctagttacgtaacggttacggagttacgggactaggtaacgtagttacgtagaaccgaattaacgtcctaactcctaccacgtactccaacctgtacgtcgacggtacggtctaacggtagtttaacgtttaggtaacccttaaactttaccgttacgtttacgtaacctaacgtacgttaagtttacccttaacggtttcccctaccgtttaaccgtttcccgaccgttaacgggtacctaagtaggttacgattaccaacggtaaactacgttggacgtactaacggtcccaaccttntaccgttagttccctttaacnccctttaccgtacccnccgttnttaacg

SEQ ID NO: 81504 - DNA, 806 bp, Homo sapiens
  misc_feature: GYAE6OF01DL1VX.52.1.A01.1.454.CMB.1.raw
  modified_base (98)..(98): a, c, t, g, unknown or other
  misc_feature (98)..(98): n is a, c, g, or t
  modified_base (116)..(116): a, c, t, g, unknown or other
  misc_feature (116)..(116): n is a, c, g, or t
  modified_base (178)..(178): a, c, t, g, unknown or other
  misc_feature (178)..(178): n is a, c, g, or t
  modified_base (188)..(188): a, c, t, g, unknown or other
  misc_feature (188)..(188): n is a, c, g, or t
  modified_base (216)..(216): a, c, t, g, unknown or other
  misc_feature (216)..(216): n is a, c, g, or t
  modified_base (258)..(258): a, c, t, g, unknown or other
  misc_feature (258)..(258): n is a, c, g, or t
tcagcgcagtacgacacgaccggtgctcgatttagacgtctcatcgaggggggggatcagtctcagtcaggacacagcatggacatggacgggtcccntcagctcgagggctcctnctactgtggctcgagtcacgagtctgtctacataccgaagactaccgaccctagtcctaccncctcccgtcncgtccatactcggtaaggacagacgatnacctagtctaatcctacggtcggggactaaacgtggacgganagtaccgttaagtaataaacgtttaattaaggtactaacgtaaccgaaataccgaaaggacggtaacctccgaacttaacgtacttacgacggtttactacgttacgtaccgtacttaccgttagttcggtaggttacggggtaaccgggtaccgggtaacccttaaggggtaacgttacgggttaaccggtttacgggacggtaaaccgttagggggtaacggttaccggtaaccggggttaggggaaaaccttttacgggactttaactacccggtttacccaacgttaacccgaactaacgggttaacctcggttaccgttagggaaccggtacgttacgggtacggttacgtttaacgtttaccgttaccgttaaccgtttacgttaacctaacgggtaactaacgttaacggtaacttccgttacgtaccttacgtaccgtacgttacgaacgtacgtaggtataaacgtacgtaacgtagaaccggtacgtacgtaccgacgtacggttacctaaaggcctttaaaccggtgtttaaccccg

SEQ ID NO: 81505 - DNA, 816 bp, Homo sapiens
  misc_feature: GYAE6OF01EJCN2.52.1.A01.1.454.CMB.1.raw
  modified_base (182)..(182): a, c, t, g, unknown or other
  misc_feature (182)..(182): n is a, c, g, or t
  modified_base (240)..(240): a, c, t, g, unknown or other
  misc_feature (240)..(240): n is a, c, g, or t
tcagcgcagtacgacacgaccggtgctcgatttagacgtctcatcagggcacagcatggacatggacgggtccccgctcagctccgtggggctcctgcctactctggcctccggaggtcgccagatgtcgtctactccagtatccgacccgtagtcctacctaccttccctccctcgtccgntacgtacgtggtaaggaacgagagtacgtcactcgtacgtccgtacggtcggccgganagtcgaagactataagttaacgtaatttaattaagtacgtacaaccgaaacgaacggaaaccggaacggtaccctaccctaagtacctcgtagtacgttctagttccgtaccttacttaccgtaggttcgacggtacgggtaccgggtaccgtaaccgtacgttaagggttaacggtcggtagggtacggtaaggttcggtacgtaccgttagggtaaccgtaactacgttaacctcctaactacccgtaaccacgttacccgtaacctacggtgtacctgggtaacggttacggttacgttacgttaacgtttaacgttacctttaaccgtttaaccgttacttaaccgtaacgtaaccgttacgttaaccgttacccgttacccttcccgttaccgtttacccgtttacccggtaccgtaccgttacggtaacgtaacggttacgtaacgtaacgtaacggttaaccgtaacgtccgtacgtaccgtcctaccgttaccgttacgttaccttaccgggttaccttacccgttacccgttaccctacccgttacctacgttacgtaacgtaaccg

SEQ ID NO: 81506 - DNA, 765 bp, Homo sapiens
  misc_feature: GYAE6OF01BEB84.52.1.A01.1.454.CMB.1.raw
  modified_base (96)..(96): a, c, t, g, unknown or other
  misc_feature (96)..(96): n is a, c, g, or t
tcagcgcagtacgacacgaccggtgctcgatttagacgtctcatcagggggggagtcagtctcagtcaggacacagcatggacatgagggtccccnctcagctccgtggggcctcctgctactcgtggctccggaggtcgccagatgtcgtacatccaagtactcgaccctagtcctaccacttccctcccgtgtccgctatcgtaggtaaggacgaacgagtacgtactaactaccgtaactcctaacggttcgggacccgggtactaagtacgaggacgtactaagttaacgtaaacgttttaatttaaaggttcggtaactaacgaaacgaaacggaaaccgtaaggggaaccctccgtaacgtacctcgtagtaacttcttacggtcgttactactccttcgttacgcgttaggtacggtacggtacctagtacggtaacggttgaacgggttcggagtacggtgtacggtaggtaacggactaacgtacttccgactacccgtacaccttacgacccttacggctcggtacgaggtcggtaacgtggttaacgtttcttaaccgtacgtttaaaccttgtttacggaacctacgtaacgggttataacccgtttaccgttacccgttaccgttaccgtacccggttaccgggtaccggtacggttaactacggttacggttaacgttacaaaaccggttaacgttaacggtcggtggtaaccgtaccggctaacccttacgtcgttaactcctttaccgg

SEQ ID NO: 81507 - DNA, 491 bp, Homo sapiens
  misc_feature: GYAE6OF02GHABW.52.1.A01.1.454.CMB.1.raw
tcagcgcagtacgacacgaccggtgctcgatttagacgtctcatcagggggagtcagtctcagtcaggacacagcatggacatgagggtccccgctcagctcctggggctcctgctactctggctccgaggtgccagatgtgtcatccagattacccagtctccatcctccctgtccgcatctgtaggagacagagtcatcatcacttgccgggcaagtcagagcattagaacgtattaaattggtatcaacagaaaccagggaaagcccctgaactcctgatctatggttcatccactttgctgagtgggtcccatcaaggttcagtggcagtggatctgggacagaattcactctcaccatcaccagtctgcagctgagtattttgctaacttacttctgtacaacagtagttactacgttccctctacctttccgccctgggaccagtacgtgatatacaaacgactagtgctgcaccatctgtcttc

SEQ ID NO: 81508 - DNA, 481 bp, Homo sapiens
  misc_feature: GYAE6OF02IQBWK.52.1.A01.1.454.CMB.1.raw
tcagcgcagtacgacacgaccggtgctcgatttagacgtctcatcagggcacagcatggacatgagggtccccgctcagctcctggggctcctgctactctggctccgaggtgccagatgtgtcatccagatgacccagtctccatcctccctgtccgcatctgtaggagacagagtcatcatcacttgccgggcaagtcagagcattagaacgtatttaaattggtatcaacagaaaccagggaaagcccctgaactcctgatctatggttcatccactttgctgagtggggtccatcaaggttcagtggcagtggatctgggacagaattcactctcaccatcaccagtctgcaggctgaggattttgctacttacttctgtcaacagtagttacagttccctcactttcgccctggaccatagtgatagtcaaacgactgtggctgcaccatctgtcttcatccttcccgctatctag

SEQ ID NO: 81509 - DNA, 491 bp, Homo sapiens
  misc_feature: GYAE6OF02JLCNC.52.1.A01.1.454.CMB.1.raw
  modified_base (414)..(414): a, c, t, g, unknown or other
  misc_feature (414)..(414): n is a, c, g, or t
  modified_base (431)..(431): a, c, t, g, unknown or other
  misc_feature (431)..(431): n is a, c, g, or t
  modified_base (481)..(481): a, c, t, g, unknown or other
  misc_feature (481)..(481): n is a, c, g, or t
tcagcgcagtacgacacgaccggtgctcgatttagacgtctcatcagggggagtcagtctcagtcaggacacagcatggacatgagggtccccgctcagctcctgggctcctgctactctggctccgaggtgccagatgtgtcatccagatgacccagtctccatcctccctgtccgcatctgtaggagacagagtcatcatcacttgccgggcaagtcagagcattagaacgtatttaaattggtattcaacagaaaccagggaaagccctgaactccctgatctatggttcatccactttgctgagtggggtcccatcaaggttcagtgcagtggatctgggacagaagttcacgtctcaccatacaccagtctgtcaggctgacgtatttgctaacttacttctgtcaacngagttaccagttccctnactttcggcctgggaccatagtggatatcaaacgtactgttgcttgcacntactgttacg

SEQ ID NO: 81510 - DNA, 481 bp, Homo sapiens
  misc_feature: GYAE6OF02I66TL.52.1.A01.1.454.CMB.1.raw
  modified_base (351)..(351): a, c, t, g, unknown or other
  misc_feature (351)..(351): n is a, c, g, or t
  modified_base (405)..(405): a, c, t, g, unknown or other
  misc_feature (405)..(405): n is a, c, g, or t
tcagcgcagtacgacacgaccggtgctcgatttagacgtctcatcagggcacagcatggacatgagggtccccgctcagctcctggggctcctgctactctggctccgaggtgccagatgtgtcatccagatgacccagtctccatcctccctgtccgcatctgtaggagacagagtcatcatcacttgccgggcaagtcagagcattagaacgtatttaaattggtatcaacagaaaccagggaaagcccctgaactcctgatctatggttcatccacttgctgagtgggtccatcaaggttcagtggcagtggatctgggacagaattcactctcaccatcaccagtcngcaggctgaggtattttgctaacttacttctgtcaacagagttacagttccctntacctttcggccctgggaccagtagtgatatcaaacgactgtgctgcacatctgtcttcactcttcccgctatctg

SEQ ID NO: 81511 - DNA, 475 bp, Homo sapiens
  misc_feature: GYAE6OF02IU0GA.52.1.A01.1.454.CMB.1.raw
  modified_base (458)..(458): a, c, t, g, unknown or other
  misc_feature (458)..(458): n is a, c, g, or t
tcagcgcagtacgacacgaccggtgctcgatttagacgtctcatcagggcacagcatggacatgagggtccccgctcagctcctggggctcctgctactctggctccgaggtgccagatgtgtcatccagatgacccagtctccatcctccctgtccgcatctgtaggagacagagtcatcatcacttgccgggcaagtcagagcattagaacgtatttaaatggtatcaacagaaaccagggaaagcccctgaactcctgatctatggttcatccactttgctgagtgggtccatcaaggttcagtgcagtgatctgggacagattcactctcacatcacagtctgcaggctgagtatttgctaacttactctgtcaactagagttacagttccctctactttcggccctgggaccagtacgtgatatcaaacgactgtgctgcaccatctgtctcncttctcccgctatctag

SEQ ID NO: 81512 - DNA, 482 bp, Homo sapiens
  misc_feature: GYAE6OF02IJCKB.52.1.A01.1.454.CMB.1.raw
  modified_base (429)..(429): a, c, t, g, unknown or other
  misc_feature (429)..(429): n is a, c, g, or t
  modified_base (478)..(478): a, c, t, g, unknown or other
  misc_feature (478)..(478): n is a, c, g, or t
tcagcgcagtacgacacgaccggtgctcgatttagacgtctcatcagggcacagcatggacatgagggtccccgctcagctcctggggctcctgctactctggctccgaggtgccagatgtgtcatccagatgacccagtctccatcctccctgtccgcatctgtaggagacagagtcatcatcacttgccgggcaagtcagagcattagaacgtattaaattggtatcaacagaaaccagggaaagcccctgaactcctgatctatggttcatccactttgctgagtgggtccatcaagttcagtggcagtgatctgggacagaattcactctcaccatcacatctgcaggctgagatttgctaacttacttctgtcaactagagttacagttccctcactttcggccctgggaccagtacgtgatanacaaacgtactgtgctgctaccatctgtcttcattccttcccgctactntacg

SEQ ID NO: 81513 - DNA, 493 bp, Homo sapiens
  misc_feature: GYAE6OF02IL7HX.52.1.A01.1.454.CMB.1.raw
tcagcgcagtacgacacgaccggtgctcgatttagacgtctcatcaggggggagtcagtctcagtcaggacacagcatggacatgagggtccccgctcagctcctggggctcctgctactctggctccgaggtgccagatgtgtcatccagatgacccagtctccatcctccctgtccgcatctgtaggagacagagtcatcatcacttgccgggcaagtcagagcattagaacgtatttaaattggtatcaacagaaaccagggaaagcccctgaactcctgatctatggttcatccactttgctgagtggggtcccatcaaggttcagtggcagtggatctgggacagaattcactctcaccatcaccagtctgcaggctgaggtattttgcaactttacttctgtcaacagtagttacagtttccctctactttccggacccttgggaccatagtggatatcaaacgactgtggctgcaccatctgttcc

SEQ ID NO: 81514 - DNA, 535 bp, Homo sapiens
  misc_feature: GYAE6OF02HNYH7.52.1.A01.1.454.CMB.1.raw
  modified_base (178)..(178): a, c, t, g, unknown or other
  misc_feature (178)..(178): n is a, c, g, or t
  modified_base (213)..(213): a, c, t, g, unknown or other
  misc_feature (213)..(213): n is a, c, g, or t
  modified_base (382)..(382): a, c, t, g, unknown or other
  misc_feature (382)..(382): n is a, c, g, or t
tcagcgcagtacgacacgaccggtgctcgatttagacgtctcatcaggggagtcagtctcagtcaggacacagcatggacatgagggtccccgctcagctcctggggctcctgctactctggctccgaggtgccagatgtgtcatccagatgacccagtctccatcctccctgtccgnatctgtaggagacagagtcatcatcacttgccggnaagtcagagcattagaacgtatttaaaattggtatcaacagaaaccagggaaagccctagaactcctgatctatgttcatccactttgctgagtgggtccatcaagtcagtggcagtggatcgtgggacagaattcactctacacatcacagtctgcaggctaggagtntttagctaaactttcttctgtacaacgagtaagttacacgttaccctacgtaaccgttttccggccctagggtaaccctataggttacggattaactaccgaaaacgtaacgttggtaggtccttacggcctaaccgtacttcgtagtttacc

SEQ ID NO: 81515 - DNA, 605 bp, Homo sapiens
  misc_feature: GYAE6OF02GR9YY.52.1.A01.1.454.CMB.1.raw
  modified_base (212)..(212): a, c, t, g, unknown or other
  misc_feature (212)..(212): n is a, c, g, or t
tcagcgcagtacgacacgaccggtgctcgatttagacgtctcatctagggtcgacagacatggacatgagggtcccgctcagctcctggggctcctgcgtaccctctggctccgacggtggccacgatgtgtcatccagactgacccagtctccatcctccctgtcccgcatctcgtaggtacgacagacgtccatccatcacttgccgggnaagtcagagcaattagaacgttattaacgtggtatcaacgagaaacctagggaaagtcccttagaaccttccgtgatctatggttcatccacgtttagcctagacgtcgggtccatctaaggttcagtggcagtgattctggactagagttcactctcacatcacagtctgcgagctgagtattttcgactaacttacttctagtcaacgtacgtagttacacgtttccctacgtaactttcggcccgttaggaccctaagttacgtacggtaacttaacgtaacgtaaaacgtaccgtagttacgggaccttaggtacctaacccgttacgttaccttacgggtcctttaacgacttccggtttaaccccgtaccttaacgttcccttacgg

SEQ ID NO: 81516 - DNA, 497 bp, Homo sapiens
  misc_feature: GYAE6OF02ISTHR.52.1.A01.1.454.CMB.1.raw
  modified_base (442)..(442): a, c, t, g, unknown or other
  misc_feature (442)..(442): n is a, c, g, or t
  modified_base (469)..(469): a, c, t, g, unknown or other
  misc_feature (469)..(469): n is a, c, g, or t
  modified_base (493)..(493): a, c, t, g, unknown or other
  misc_feature (493)..(493): n is a, c, g, or t
tcagcgcagtacgacacgaccggtgctcgatttagacgtctcatcagggcacagcatggacatgagggtccccgctcagctcctggggctcctgctactctggctccgaggtgccagatgtgtcatccagatgacccagtctccatcctccctgtccgcatctgtaggagacagagtcatcatcacttgccgggcaagtcagagcattagaacgtatttaaattggtatcaacagaaaccagggaaagcccctgaactcctgatctatggttcatccactttgctgagtggggtcccatcaaggttcagtgcagtggatctgggacagaattcactctcacatcaccagtctgcaggctagaggtattttgctaacttacttctgtcaacagtagttacagttccctctacctttcggccctagggaccagtagtgattaancgaaaacgactgtgctagcaaccatcngttcttcacttcctcccgctactntacg

SEQ ID NO: 81517 - DNA, 491 bp, Homo sapiens
  misc_feature: GYAE6OF02HOY4F.52.1.A01.1.454.CMB.1.raw
  modified_base (408)..(408): a, c, t, g, unknown or other
  misc_feature (408)..(408): n is a, c, g, or t
tcagcgcagtacgacacgaccggtgctcgatttagacgtctcatcagggggagtcagtctcagtcaggacacagcatggacatgagggtccccgctcagctcctggggctcctgctactctggctccgaggtgccagatgtgtcatccagatgacccagtctccatcctccctgtccgcatctgtaggagacagagtcatcatcacttgccgggcaagtcagagcattagaacgtatttaaattggtatcaacagaaacccagggaaagcccctgaactcctgatctatggttcatccactttgctgagtggggtcccatcaaggttcagtggcagtggatctgggacagaattcactctcacatcaccagtctgcaggctgaggattttgcaacttactctgtcaanagagttacagttccctctacgtttccggccctgggtaccagtagtggaattatacaaacgtaactgtgctgcaccatctgtcc

SEQ ID NO: 81518 - DNA, 488 bp, Homo sapiens
  misc_feature: GYAE6OF02IYL2R.52.1.A01.1.454.CMB.1.raw
  modified_base (470)..(470): a, c, t, g, unknown or other
  misc_feature (470)..(470): n is a, c, g, or t
tcagcgcagtacgacacgaccggtgctcgatttagacgtctcatcagggcacagcatggacatgagggtccccgctcagctcctggggctcctgctactctggctccgaggtgccagatgtgtcatccagatgacccagtctccatcctccctgtccgcatctgtaggagacagagtcatcatcacttgccgggcaagtcagagcattagaacgtatttaaatggtatcaacagaaaccagggaaagcccctgaactcctgatctatggttcatccactttgctgagtgggtcccatcaaggttcagtggcagtgatctgggacagaattcactctcacatcaccagtctgcaggctgaggtattttgctaacttacttctgtacaacagtagttacagttccctctacctttcggccctgggacctagtagtgtactatacaaacgatgtgctgcaccatctgtcttcncttcctcccgctatctag

SEQ ID NO: 81519 - DNA, 500 bp, Homo sapiens
  misc_feature: GYAE6OF02IQ4E0.52.1.A01.1.454.CMB.1.raw
tcagcgcagtacgacacgaccggtgctcgatttagacgtctcatcagggcacagcatggacatgagggtccccgctcagctcctggggctcctgctactctggctccgaggtgccagatgtgtcatccagatgacccagtctccatcctccctgtccgcatctgtaggagacagagtcatcatcacttgccgggcaagtcagagcattagaacgtatttaaattggtatcaacagaaaccagggaaagcccctgaactcctgatctatggttcatccactttgctgagtggggtcccatcaaggttcagtggcagtggatctgggacagaattcactctcacatcaccagtctgcaggctgaggtattttgctaactttcttctgtacaacgtgtaagttacagtttccctctacctttcggccctgggacccagttacggtggtatatacaaacgtactgtgctgcaccatctgtcttcatccttcccgctactctacg

SEQ ID NO: 81520 - DNA, 484 bp, Homo sapiens
  misc_feature: GYAE6OF02HTJF6.52.1.A01.1.454.CMB.1.raw
  modified_base (339)..(339): a, c, t, g, unknown or other
  misc_feature (339)..(339): n is a, c, g, or t
tcagcgcagtacgacacgaccggtgctcgatttagacgtctcatcagggggagtcagtctcagtcaggacacagcatggacatgagggtccccgctcagctcctggggctcctgctactctggctccgaggtgccagatgtgtcatccagatgacccagtctccatcctccctgtccgcatctgtaggagacagagtcatcatcacttgccgggcaagtcagagcattagaacgtatttaaattggtatcaacagaaacccaggaaagcccctgaactcctgatctatggttcatccactttgctgagtggggtccatcaggttcagtggcagtggatntgggacagattcactctcacatcacagtctgcaggctgaggtatttgctaactttacttctgtacaacagagttacagttccctactacctttcggccctgggaccagtagtgatatacaaacgactgtggctgacacatctgtc

SEQ ID NO: 81521 - DNA, 515 bp, Homo sapiens
  misc_feature: GYAE6OF02G0CA5.52.1.A01.1.454.CMB.1.raw
  modified_base (351)..(351): a, c, t, g, unknown or other
  misc_feature (351)..(351): n is a, c, g, or t
tcagcgcagtacgacacgaccggtgctcgatttagacgtctcatcagggcacagcatggacatgagggtccccgctcagctcctggggctcctgctactctggctccgaggtgccagatgtgtcatccagatgacccagtctccatcctccctgtccgcatctgtaggagacagagtcatcatcacttgccgggcaagtcagagcattagaacgtatttaaatggtatcaaacagaaaccagggaaagcccctgaactcctgatctatggttcatccactttgctgagtgggtcccatcaaggttcagtggcagtgatctgggacagaattcactctcaccatcaccatcngcaggctgaggtatttgctaacttacttctgtcaactagtagttacacgtttcccctctacctttccggacccttcggggaccctagtacgtggattaacgtacaaacgaactgtcgctaggcaccatcctgtccttcgtacttccttacccgcctactctacg

SEQ ID NO: 81522 - DNA, 494 bp, Homo sapiens
  misc_feature: GYAE6OF02IILIY.52.1.A01.1.454.CMB.1.raw
  modified_base (269)..(269): a, c, t, g, unknown or other
  misc_feature (269)..(269): n is a, c, g, or t
  modified_base (487)..(487): a, c, t, g, unknown or other
  misc_feature (487)..(487): n is a, c, g, or t
tcagcgcagtacgacacgaccggtgctcgatttagacgtctcatcaggggggagtcagtctcagtcaggacacagcatggacatgagggtccccgctcagctcctggggctcctgctactctggctccgaggtgccagatgtgtcatccagatgacccagtctccatcctccctgtccgcatctgtaggagacagagtcatcatcacttgccgggcaagtcagagcattagaacgtatttaaattggtatcaacagaaaccagggaaancccctagaactcctgatctatggttcatccactttgctgagtgggtccatcaagttcagtggcagtggatctgggacagaattcactctcacatcaccagtctgcaggctgaggtattttgactaactttacttctgtacaactagagttacacgtttccctctactttccggcctcgggaccagtagtggtatataccaacgtactgtgctgcaccntctgttc

SEQ ID NO: 81523 - DNA, 497 bp, Homo sapiens
  misc_feature: GYAE6OF02JCMBD.52.1.A01.1.454.CMB.1.raw
tcagcgcagtacgacacgaccggtgctcgatttagacgtctcatcagggcacagcatggacatgagggtccccgctcagctcctggggctcctgctactctggctccgaggtgccagatgtgtcatccagatgacccagtctccatcctccctgtccgcatctgtaggagacagagtcatcatcacttgccggcaagtcagagcattagaacgtatttaaattggtatcaacagaaaccaggaaagcccctgaactcctgatctatggttcatccactttgctgagtggggtcccatcaaggttcagtggcagtgatctgggacagattcatctcacatcacagtctgcaggctgagtatttgctacttacttctgtacaacagagttacattccctctacgtttcgcctgggacccagttagtcggatatacaaacgaacttgtggtacctggacacctatcctgttcttcacttccttaccccggctactctacg

SEQ ID NO: 81524 - DNA, 487 bp, Homo sapiens
  misc_feature: GYAE6OF02GOOGR.52.1.A01.1.454.CMB.1.raw
  modified_base (407)..(407): a, c, t, g, unknown or other
  misc_feature (407)..(407): n is a, c, g, or t
tcagcgcagtacgacacgaccggtgctcgatttagacgtctcatcagggggagtcagtctcagtcaggacacagcatggacatgagggtccccgctcagctcctggggctcctgctactctggctccgaggtgccagatgtgtcatccagatgacccagtctccatcctccctgtccgcatctgtaggagacagagtcatcatcacttgccgggcaagtcagagcattagaacgtatttaaattggtatcaacagaaaccaggaaagcccctgaactcctgatctatggttcatccactttgctgagtggggtccatcaaggttcagtggcagtggatctgggacagaattcactctcaccatcaccagtctgcaggctgagtatttgctaacttacttctgtcaanagagttacagttccctactactttcggccctgggaccatagtggatatacaaacgactgtggcttggccacatctagttc

SEQ ID NO: 81525 - DNA, 496 bp, Homo sapiens
  misc_feature: GYAE6OF02GS19N.52.1.A01.1.454.CMB.1.raw
tcagcgcagtacgacacgaccggtgctcgatttagacgtctcatcagggggagtcagtctcagtcaggacacagcatggacatgagggtccccgctcagctcctggggctcctgctactctggctccgaggtgccagatgtgtcatccagatgacccagtctccatcctccctgtccgcatctgtaggagacagagtcatcatcacttgccggcaagtcagagcattagaacgtatttaaattggtatcaacagaaaccagggaaagcccctgaactcctgatctatggttcatccactttgctgagtggggtcccatcaaggttcagtggcagtggatctgggacagaattcgactctcaccatcaccagtctgcaggctgaggatttgactaacttacttctgtacaacagagttacagttccctctactttcggccctgggacctagtagtgatatacaaacgtactagtggctggccaacgattctgttacc

SEQ ID NO: 81526 - DNA, 696 bp, Homo sapiens
  misc_feature: GYAE6OF02J2R7Z.52.1.A01.1.454.CMB.1.raw
  modified_base (295)..(295): a, c, t, g, unknown or other
  misc_feature (295)..(295): n is a, c, g, or t
tcagcgcagtacgacacgaccggtgctcgatttagacgtctcatcagggggagtcagtctcagtcaggacacagcatggacatgagggtccccgctcagctcctgggctcctgctactctggctccgaggtgccagatgtgtcatccagatcgacccagtcctccactccctccctgtccgcatctaggtaggagacagatcatcatcacgtcggccggacaagtcagacgactaagttaacgtaacgttaatttaaagtggtaacaacgaaacgaacgaaaccgagggtaaccnccctagaaccttcgagtacttaccgtagttcgttacctaacttcccgttagttcggtcgtacgggtacggttaccggtaacctagttacggtaacggtcgtaggtacggtacgtaggtcgtaacgtacggacgtaactaacgtactcctactaccacctactcaccgtagtcgtcggtgtacgtaggttctaaggttacttacttacctaacgtttacgttcgtaacgtacgtaaccgtaacgttacgttacccgttacgtttcccgtaaccgttccgttaccgggttaccgacggttaacgtaatacggtacgttaacgtacgttaaacggtacgtaacgttcggtaccgtacgttaccaaccgttaccgttcgtttaccgttacccgttattaaccccg

SEQ ID NO: 81527 - DNA, 554 bp, Homo sapiens
  misc_feature: GYAE6OF02GA51G.52.1.A01.1.454.CMB.1.raw
tcagcgcagtacgacacgaccggtgctcgatttagacgtctcatcagggggagtcagtctcagtcaggacacagcatggacatgagggtccccgctcagctcctggggctcctgctactctggctccgaggtgccagatgtgtcatccagatgacccagtctccatcctccctgtccgcatctgtaggagacagagtcatcatcacttgccgggcaagtcagagcattagaacgtatttaaattggtatcaacagaaaccagggaaagcccctgaactcctgatctatggttcatccactttgctgagtggggtcccatcaaggtcagtggcagtgatcgtgggacagaattcactctcaccatcacagtctgcaggctgaggtattttgactaacttacttctcgtacaacgagtaagttactacgttcccctactaaccgttttccggaccccttagggaaccctagttacggtaggtaacttaactaccgtaaaacgtaacgttggttacgggtaccttagggaccctaaccgtattaccgtcggttaccc

SEQ ID NO: 81528 - DNA, 477 bp, Homo sapiens
  misc_feature: GYAE6OF02GTEGX.52.1.A01.1.454.CMB.1.raw
tcagcgcagtacgacacgaccggtgctcgatttagacgtctcatcagggcacagcatggacatgagggtccccgctcagctcctggggctcctgctactctggctccgaggtgccagatgtgtcatccagatgacccagtctccatcctccctgtccgcatctgtaggagacagagtcatcatcacttgccgggcaagtcagagcattagaacgtatttaaatggtatcaacagaaaccaggaaagcccctgaactcctgatctatggttcatcactttgctgagtgggtccatcaagttcagtgcagtggatctgggacagaattcactctcaccatcaccagtctgcaggctgaggattttgctaaacttacttctgtacaacagagttacagttccctctactttcggccctgggaccatagtgatatacaaacgactgtagctgcacatctgtctcatccttccgctatctag

SEQ ID NO: 81529 - DNA, 640 bp, Homo sapiens
  misc_feature: GYAE6OF02G3W5U.52.1.A01.1.454.CMB.1.raw
tcagcgcagtacgacacgaccggtgctcgatttagacgtctcatctagggtcggacagacatggacatgacgggtcccgctcagctcctggggctcctgcgtaccctctggctccgacggtggccacgatgtgtcatccgagactgacccagtctccatcctccctgtcccgcatctcgtaggagacagacgtccatcatcacttgccgggcaagtcagagcaattagaacgttatttaaacgtggtatcgaaacgagaaaccgaaggaaactcccgttagaacctcgtagactctatcggttcactccacgttgtctagacgtcgggtccatctaggttcagtggcagtgacttcgtaggactagtaacgttcactctcacagtcgacgtagtctagcgagtcgtagtacggtatttcgactaactttacttcgtagtacaactacgtacgttactacgtttaccctcgtaccgtttccggtacccgtacgggaacccttagttacgttacgtaacttaacgtaacgtaaacgtaccgttcgttacggaccctacggtaccctaaccgttacgtaccgttacggttacccttaacgtaccgtttacccggttaaccccgtacttaccgttcttaaccgg

SEQ ID NO: 81530 - DNA, 564 bp, Homo sapiens
  misc_feature: GYAE6OF02HYBA7.52.1.A01.1.454.CMB.1.raw
  modified_base (267)..(267): a, c, t, g, unknown or other
  misc_feature (267)..(267): n is a, c, g, or t
  modified_base (368)..(368): a, c, t, g, unknown or other
  misc_feature (368)..(368): n is a, c, g, or t
  modified_base (397)..(397): a, c, t, g, unknown or other
  misc_feature (397)..(397): n is a, c, g, or t
  modified_base (418)..(418): a, c, t, g, unknown or other
  misc_feature (418)..(418): n is a, c, g, or t
tcagcgcagtacgacacgaccggtgctcgatttagacgtctcatcagggggagtcagtctcagtcaggacacagcatggacatgagggtccccgctcagctcctggggctcctgctactctggctccgaggtgccagatgtgtcatccagatgacccagtctccatcctccctgtccgcatctgtaggagacagagtcatcatcacttgccgggcaagtcagagcattagaacgtatttaaatggtatcaacagaaaccagggaaancccctgaaactcctagatctaatggttcatccactttgctgagtcgggtcctagtcaaggttcacgtagcagtcgagtctgggactaggaattcactctanaccatcacagtcctgcaggtctaggtagntttagctaaagttcttacgtnacctaaacgtagtagttaacctacggttccctacaccgtttttcccgggacccttcggggtaacctagtacgtacggtattaactacgtaaacggtaaaccttcgtggaccgttacggacctacccgtaacgttaccgtcgttacc

SEQ ID NO: 81531 - DNA, 356 bp, Homo sapiens
  misc_feature: GYAE6OF02IGAH9.52.1.A01.1.454.CMB.1.raw
  modified_base (289)..(289): a, c, t, g, unknown or other
  misc_feature (289)..(289): n is a, c, g, or t
  modified_base (295)..(295): a, c, t, g, unknown or other
  misc_feature (295)..(295): n is a, c, g, or t
  modified_base (303)..(303): a, c, t, g, unknown or other
  misc_feature (303)..(303): n is a, c, g, or t
  modified_base (308)..(356): a, c, t, g, unknown or other
  misc_feature (308)..(356): n is a, c, g, or t
tcagcgcagtacgacacgaccggtgctcgatttagacgtctcatcagggcacagcatggacatgagggtccccgctcagctcctggggctcctgctactctggctccgaggtgccagatgtgtcatccagatgacccagtctccatcctccctgtccgcatctgtaggagacagagtcatcatcacttgccgggcaagtcagagcattagaacgtatttaaatggtatcaaacagaaaccagggaaagcccctgaactcctgatctatggttcatccactttgctgagngggccngcaaggcnagagnnnnnnnnnnnnnnnnnnnnnnnnnnnnnnnnnnnnnnnnnnnnnnnnn

SEQ ID NO: 81532 - DNA, 584 bp, Homo sapiens
  misc_feature: GYAE6OF02HBAHN.52.1.A01.1.454.CMB.1.raw
tcagcgcagtacgacacgaccggtgctcgatttagacgtctcatcagggcacagcatggacatgagggtccccgctcagctcctggggctcctgctactctggctccgaggtgccagatgtgtcatccagatgacccagtctccatcctccctgtccgcatctgtaggagacagagtcatcatcacttgccgggcaagtcagagcattagaacgttatttaaattggtatacaacagaaaccgagggaaacgcccctagaactcctgatctagtgtcatccatttgctgaggtcgggtccatcgaaggttcaggtgcagtggatcgtgggacagtatcactctacacatcaccagtctgcaggctggaggttatttcgacttaactttcttctagtaccaacgtagtagttacctcgtttccctctaccgtttccggcccgttagggaccctaagttacggtaggtaacttacgtacgaaaccggtacgttggtcggtactcggtaacctaacccgtattcccgttcggttacctttaccgtaccgtttccccgttacccccggaccttacgttcccgtaacgg

SEQ ID NO: 81533 - DNA, 496 bp, Homo sapiens
  misc_feature: GYAE6OF02FGCLO.52.1.A01.1.454.CMB.1.raw
  modified_base (477)..(477): a, c, t, g, unknown or other
  misc_feature (477)..(477): n is a, c, g, or t
  modified_base (492)..(492): a, c, t, g, unknown or other
  misc_feature (492)..(492): n is a, c, g, or t
tcagcgcagtacgacacgaccggtgctcgatttagacgtctcatcagggcacagcatggacatgagggtccccgctcagctcctggggctcctgctactctggctccgaggtgccagatgtgtcatccagatgacccagtctccatcctccctgtccgcatctgtaggagacagagtcatcatcacttgccgggcaagtcagagcattagaacgtatttaaattggtatcaacagaaaccagggaagcccctgaactcctgatctatggttcatccactttgctgatggggtccatcaaggttcagtggcagtggatctgggacagaattcactctcaccatcaccagtctgcaggctgagatttgctaacttacttctgtcaacagagttacacgttccctctaccgtttcggcccttgggacctagttaggtggtaatactacaaacgtactgtcgctggcacactctgtcttcncttctcccgctactntacg

SEQ ID NO: 81534 - DNA, 500 bp, Homo sapiens
  misc_feature: GYAE6OF02I9VFU.52.1.A01.1.454.CMB.1.raw
  modified_base (413)..(413): a, c, t, g, unknown or other
  misc_feature (413)..(413): n is a, c, g, or t
  modified_base (494)..(494): a, c, t, g, unknown or other
  misc_feature (494)..(494): n is a, c, g, or t
tcagcgcagtacgacacgaccggtgctcgatttagacgtctcatcagggcacagcatggacatgagggtccccgctcagctcctggggctcctgctactctggctccgaggtgccagatgtgttatccagatgacccagtctccatcctccctgtccgcatctgtaggagacagagtcatcatcacttgccgggcaagtcagagcattagaacgtatttaaattggtatcaacagaaaccagggaaagcccctgaactcctgatctatggttcatccactttgctgagtggggtcccatcaaggttcagtggcagtgatctgggacagaattcactctcaccatcaccagtctgcaggctgaggtattttgactaacttacttctagtcaaactagtattaccagttcccctntacctttccggccctgggaccatagtggatactacaaacgtactgtgctagcaccatctgtcttcacttcctcccgctctntgtaac

SEQ ID NO: 81535 - DNA, 496 bp, Homo sapiens
  misc_feature: GYAE6OF02JIUUZ.52.1.A01.1.454.CMB.1.raw
  modified_base (402)..(402): a, c, t, g, unknown or other
  misc_feature (402)..(402): n is a, c, g, or t
  modified_base (475)..(475): a, c, t, g, unknown or other
  misc_feature (475)..(475): n is a, c, g, or t
  modified_base (491)..(491): a, c, t, g, unknown or other
  misc_feature (491)..(491): n is a, c, g, or t
tcagcgcagtacgacacgaccggtgctcgatttagacgtctcatcagggggagtcagtctcagtcaggacacagcatggacatgagggtccccgctcagctcctggggctcctgctactctggctccgaggtgccagatgtgtcatccagatgacccagtctccatcctccctgtccgcatctgtaggagacagagtcatcatcacttgccgggcaagtcagagcattagaacgtatttaaattggtatcaacagaaaccagggaaagcccctgaactcctgatctatggttcatcctactttgctgagtggggtcccatcaaggtcagtgcagtgatcgtggacagaattcactctcacatcaccagtctgcaggctgaggtatttgactaacgttacttntgtacaacagagttaccacgttccctctaactttcggccctgggaccattagtaggatctacaaacgtactgngtcgtcgccactactntgttc

SEQ ID NO: 81536 - DNA, 494 bp, Homo sapiens
  misc_feature: GYAE6OF02G0QNW.52.1.A01.1.454.CMB.1.raw
tcagcgcagtacgacacgaccggtgctcgatttagacgtctcatcagggggagtcagtctcagtcaggacacagcatggacatgagggtccccgctcagctcctggggctcctgctactctggctccgaggtgccagatgtgtcatccagatgacccagtctccatcctccctgtccgcatctgtaggagacagagtcatcatcacttgccgggcaagtcagagcattagaacgtatttaaattggtatcaacagaaaccagggaaagcccctgaactcctgatctatggttcatccactttgctgagtggggtcccagtcaaggttcagtggcagtggatcgtgggacagaattcactctcaccatcaccagtctgcaggctgaggtattttgctaacttcttctgtacaacagatttacagttccctctacctttccggccctgggaccagtagtggatactacaaacgtactgtggctgccacatctgtcc

SEQ ID NO: 81537 - DNA, 385 bp, Homo sapiens
  misc_feature: GYAE6OF02I139K.52.1.A01.1.454.CMB.1.raw
  modified_base (228)..(228): a, c, t, g, unknown or other
  misc_feature (228)..(228): n is a, c, g, or t
  modified_base (257)..(257): a, c, t, g, unknown or other
  misc_feature (257)..(257): n is a, c, g, or t
  modified_base (325)..(325): a, c, t, g, unknown or other
  misc_feature (325)..(325): n is a, c, g, or t
  modified_base (331)..(331): a, c, t, g, unknown or other
  misc_feature (331)..(331): n is a, c, g, or t
  modified_base (333)..(333): a, c, t, g, unknown or other
  misc_feature (333)..(333): n is a, c, g, or t
  modified_base (335)..(385): a, c, t, g, unknown or other
  misc_feature (335)..(385): n is a, c, g, or t
tcagcgcagtacgacacgaccggtgctcgatttagacgtctcatcgaggggggagtcagtctcaagtcaggacacagcatggacatgagggtccccgctcaggctcctggggctcctgctactctggctccgaggtgccagatgtgtcatcccagatgacccagtctccatccctcctgtccgcatctgtaggagacagagtcatcatcacttgccgggcaagtcagngcattagaacgtatttaaatggtatcaanagaaacaggaaagcccctagaacctcctgatctatggttcatccatttgctgagcggcagcaaggcgnactagntnannnnnnnnnnnnnnnnnnnnnnnnnnnnnnnnnnnnnnnnnnnnnnnnnnn

SEQ ID NO: 81538 - DNA, 495 bp, Homo sapiens
  misc_feature: GYAE6OF02G8EUE.52.1.A01.1.454.CMB.1.raw
  modified_base (268)..(268): a, c, t, g, unknown or other
  misc_feature (268)..(268): n is a, c, g, or t
  modified_base (394)..(394): a, c, t, g, unknown or other
  misc_feature (394)..(394): n is a, c, g, or t
  modified_base (421)..(421): a, c, t, g, unknown or other
  misc_feature (421)..(421): n is a, c, g, or t
tcagcgcagtacgacacgaccggtgctcgatttagacgtctcatcaggggggagtcagtctcagtcaggacacagcatggacatgagggtccccgctcagctcctggggctcctgctactctggctccgaggtgccagatgtgtcatccagatgactcagtctccatcctccctgtccgcatctgtaggagacagagtcatcatcacttgccggcaagtcagagcattagaacgtatttaaatggtatcaacagaaaccagggaaacnccctagaactcctgatctatgtcatccatttgctgagtgggtccatcagttcagtggcagtggatctggacagaatcactctacacatcacagtctgcaggctgaggtattttgctaacttacttntgtacaactagagttacagttcccttntacctttcggccctagggacctagtagtacggtaatactaccaaacgtactcggtgtcgtagccactatcttcg

SEQ ID NO: 81539 - DNA, 489 bp, Homo sapiens
  misc_feature: GYAE6OF02H1X9C.52.1.A01.1.454.CMB.1.raw
  modified_base (473)..(473): a, c, t, g, unknown or other
  misc_feature (473)..(473): n is a, c, g, or t
tcagcgcagtacgacacgaccggtgctcgatttagacgtctcatcagggggagtcagtctcagtcaggacacagcatggacatgagggtccccgctcagctcctggggctcctgctactctggctccgaggtgccagatgtgtcatccagatgacccagtctccatcctccctgtccgcatctgtaggagacagagtcatcatcacttgccgggcaagtcagagcattagaacgtatttaaattggtatcaacagaaaccaggaagccctgaactcctgatctatggttcatccactttgctgagtgggtcccatcaagttcagtggcagtgatctggacagattcactctcaccatcaccagtctgcaggctgaggtattttgactaacgtttacttctgtactaacagtagttacagtttccctctacctttcggacccttggacctagtagtggatatacaaacgactgngctcgcaccatctgtc

SEQ ID NO: 81540 - DNA, 577 bp, Homo sapiens
  misc_feature: GYAE6OF02FZ92Z.52.1.A01.1.454.CMB.1.raw
tcagcgcagtacgacacgaccggtgctcgatttagacgtctcatcagggcacagcatggacatgagggtccccgctcagctcctggggctcctgctactctggctccgaggtgccagatgtgtcatccagatgacccagtctccatcctccctgtccgcatctgtaggagacagagtcatcatcacttgccgggcaagtcagagcattagaacgtatttaaattggtatcaacagaaatcagggaaagcccctgaactcctgatctatggttcatccactttgctgagtgggtccatcaagttcagtggcagtggatcgtggacagaattcactctcaccatcacagtctgcaggctgaggtatttgactaacttacttctgtacaactagtacgttactacgttcccctacgtaccgttttccggacccgttggggaaccctagttacggttggaacttaacgtaccgtaaaaccgtacgttaggtacggtccgttcggaccctaacccgtagtttacccgttcgtttcctttaccgtaacctttccccgtttccccggtacccttacgttacccg

SEQ ID NO: 81541 - DNA, 606 bp, Homo sapiens
  misc_feature: GYAE6OF02IQNWP.52.1.A01.1.454.CMB.1.raw
  modified_base (236)..(236): a, c, t, g, unknown or other
  misc_feature (236)..(236): n is a, c, g, or t
  modified_base (251)..(251): a, c, t, g, unknown or other
  misc_feature (251)..(251): n is a, c, g, or t
  modified_base (410)..(410): a, c, t, g, unknown or other
  misc_feature (410)..(410): n is a, c, g, or t
  modified_base (566)..(566): a, c, t, g, unknown or other
  misc_feature (566)..(566): n is a, c, g, or t
  modified_base (591)..(591): a, c, t, g, unknown or other
  misc_feature (591)..(591): n is a, c, g, or t
  modified_base (598)..(598): a, c, t, g, unknown or other
  misc_feature (598)..(598): n is a, c, g, or t
tcagcgcagtacgacacgaccggtgctcgatttagacgtctcatcagggcacagcatggacatgagggtcccgctcagctcctgggctcctgctactctggctccgaggtgccagatgtgtcatccagatgacccagtctccatcctccctgtccgctatctggtaggagacagagtcatcatcacgttgccgggcaaggtcagagcattagaacgttatttaaattggtatcaanagaaaccaggaaacnccctagaactctgatctatgtcatctacttgctgaggtcggtccagtcaaggtcaggtgactagtcgatcggtgggaactagaattcgactactacaacctagtaccactagtctggacgacggctagaacggttattttcgacttaaactttcgttanacgtacaaacgtaggttaaatttaccgtcgtttaccctcgtaacgttttcccgggaccgttacgggaacctataaacggttcggaaacttctaaaccgaaaaaccgttactcggtacggtcgttaccgcctaaacctcggttaccttaccgtttanaccgttttccccgtacccgtaccgntttacgngttaaacg

SEQ ID NO: 81542 - DNA, 526 bp, Homo sapiens
  misc_feature: GYAE6OF02JE906.52.1.A01.1.454.CMB.1.raw
tcagcgcagtacgacacgaccggtgctcgatttagacgtctcatcagggcacagcatggacatgagggtccccgctcagctcctggggctcctgctactctggctccgaggtgccagatgtgtcatccagatgacccagtctccatcctccctgtccgcatctgtaggagacagagtcatcatcacttgccgggcaagtcagagcattagaacgtatttaaattggtatcaacagaaaccagggaaagcccctgaactcctgatctatggttcatccacttgctgagtggggtcccatcaaggttcagtggcagtggatcgtgggacagaattcactctcaccatcaccagtctgcaggctgagtattttgctaacttcttctgtacaagtagtagttacacgttccctctacgtttccggcccttacgggacctattacggtggtaacttactacaaacgtaacgttggtacgctcgtactacctattctgttacctcgtacttcccttacccgccttatctacg

SEQ ID NO: 81543 - DNA, 523 bp, Homo sapiens
  misc_feature: GYAE6OF02HDFGE.52.1.A01.1.454.CMB.1.raw
tcagcgcagtacgacacgaccggtgctcgatttagacgtctcatcaggggggagtcagtctcagtcaggacacagcatggacatgagggtccccgctcagctcctggggctcctgctactctggctccgaggtgccagatgtgtcatccagatgacccagtctccatcctccctgtccgcatctgtaggagacagagtcatcatcacttgccgggcaagtcagagcattagaacgtatttaaattggtatcaacagaaaccagggaaagcccctagaactcctgatctatggttcatccactttgctgagtggggtcccatcaaggttcagtggcagtggatcgtgggacagaattcactctcaccatcaccagtctgcaggctgagtatttgactaacttcttctgtacaacgagtagttacacgttccctactacgtttccggcctagggaccctagtacgtacggtatactaccaaacgtaacttcggtaggcttacgacctaacctagttcctgttacc

SEQ ID NO: 81544 - DNA, 480 bp, Homo sapiens
  misc_feature: GYAE6OF02FH7RY.52.1.A01.1.454.CMB.1.raw
  modified_base (446)..(446): a, c, t, g, unknown or other
  misc_feature (446)..(446): n is a, c, g, or t
tcagcgcagtacgacacgaccggtgctcgatttagacgtctcatcaggggggagtcagtctcagtcaggacacagcatggacatgagggtccccgctcagctcctggggctcctgctactctggctccgaggtgccagatgtgtcatccagatgacccagtctccatcctccctgtccgcatctgtaggagacagagtcatcatcacttgccgggcaagtcagagcattagaacgtatttaaattggtatcaacagaaaccagggaaagcccctgaactcctgatctatggttcatccactttgctgagtggggtcccatcaggttcagtgcagtgatctgggacagattcactctcaccatcaccagtctgcaggctgaggtattttgctaacttacttctgtcaacagagttacagttccctctacttcgcctgggaccatagnggatatacaaacgactgtgctgcaccatctgttc

SEQ ID NO: 81545 - DNA, 498 bp, Homo sapiens
  misc_feature: GYAE6OF02HCHXJ.52.1.A01.1.454.CMB.1.raw
tcagcgcagtacgacacgaccggtgctcgatttagacgtctcatcagggcacagcatggacatgagggtccccgctcagctcctggggctcctgctactctggctccgaggtgccagatgtgtcatccagatgacccagtctccatcctccctgtccgcatctgtaggagacagagtcatcatcacttgccgggcaagtcagagcattagaacgtatttaaattggtatcaacagaaaccagggaaagcccctgaactcctgatctatggtcatccacttgctgagtgggtccatcaagttcagtggcagtgatcgtgggacagaattcactctcacatcaccagtctgcaggctggacgtattttgactaactttacttctgtacaactagtagtttacacgttccctactacgtttccggcccttagggacctagtagtgactatacaaacgatgtgctgccacctatctgtcttcactccttcccgctatctacg

SEQ ID NO: 81546 - DNA, 551 bp, Homo sapiens
  misc_feature: GYAE6OF02IAH4G.52.1.A01.1.454.CMB.1.raw
  modified_base (244)..(244): a, c, t, g, unknown or other
  misc_feature (244)..(244): n is a, c, g, or t
tcagcgcagtacgacacgaccggtgctcgatttagacgtctcatcagggcacagcatggacatgagggtccccgctcagctcctggggctcctgctactctggctccgaggtgccagatgtgtcatccagatgacccagtctccatcctccctgtccgcatctgtaggagacagagtcatcatcacttgccgggcaagtcagagcattagaacgtattaaatggtatcaacagaaaccaggaancccctgaactctgatctatgttcatccacttgctgagtcgggtccagtccaaggttcagtgcgagtggatcgtgggacagattcactctcacatcaccagtctgcagctagagtatttgactaacttacttctcgtacaacgtgtacgttaccagttaccctactaccgtttccggacccttagggaccagttacgtggtaacttactacgaaaacgtacgttggtacggtctacggcctaaccgtattccgttcggttacctttaccgtaacttcccgtttaccccggaccttaagtcccttaagg

SEQ ID NO: 81547 - DNA, 711 bp, Homo sapiens
  misc_feature: GYAE6OF02ILUAM.52.1.A01.1.454.CMB.1.raw
tcagcgcagtacgacacgaccggtgctcgatttagacgtctcatcagggggaggtcagtctcagtcaggacacagcatggacatgagggtccccgctcagctcctgggctcctgctactctggctccgaggtgccagatgtgtcatccagatgacccagtcctccactcctccctgtccgcatctgtaggagacagagtcatcatcacttcggccggactaagtcagagctaattagaacgttaatttaaagttggtattacaactaagaaaacgaaggaaaccgccctagtaacctcctagtatactagtaggttcactcctaactttcgctgtacggtcgggtacctagttacgaaggtttcgaaggttcggacgtaggtggtacgttcgtacggggtaactaacggtaaactttccgtaacctttaccgtaccaacccgttactaacctaacccgtacgttaccgtcgtaccggtacggtaccggttagggtaacgggtttaacgttttacggtacccttaaaccgttttactttacgttacgtaacctaaacgttaacgttaacgtttaacccttacggtttaccccctacgtttaccgtttcccggtacccgtacgggtaacctacgtttacgtaaggtacttaacgtaccgtaaacgtaacgttcggtagtaccgtacgcctaaccgtacttcgttgtttacccg

SEQ ID NO: 81548 - DNA, 499 bp, Homo sapiens
  misc_feature: GYAE6OF02I5XUA.52.1.A01.1.454.CMB.1.raw
  modified_base (214)..(214): a, c, t, g, unknown or other
  misc_feature (214)..(214): n is a, c, g, or t
  modified_base (300)..(300): a, c, t, g, unknown or other
  misc_feature (300)..(300): n is a, c, g, or t
  modified_base (399)..(399): a, c, t, g, unknown or other
  misc_feature (399)..(399): n is a, c, g, or t
tcagcgcagtacgacacgaccggtgctcgatttagacgtctcatcagggggagtcagtctcagtcaggacacagcatggacatgagggtccccgctcagctcctggggctcctgctactctggctccgaggtgccagatgtgtcatccagatgacccagtctccatcctccctgtccgcatctgtaggagacagagtcatcatcacttgccggnaagtcagagcattagaacgtattaaatgtatacaacagaaaccaggaaagccctagaactcctagatctatggtacatccactttnctgagtggccatcaagtcagtgctagtggatcgtagggacagtaattcgactcgtacacatcaccagtctgcgagctgagtattgactaacttattctntcaacagtagttacagttccctactacgttccgctacggtacctaatagtacgtatagtacctaaacgaacttgtcgactcgccactaatctaggttacc

SEQ ID NO: 81549 - DNA, 587 bp, Homo sapiens
  misc_feature: GYAE6OF02GXF2Y.52.1.A01.1.454.CMB.1.raw
tcagcgcagtacgacacgaccggtgctcgatttagacgtctcatcagggcacagcatggacatgagggtccccgctcagctcctggggctcctgctactctggctccgaggtgccagatgtgtcatccagatgacccagtctccatcctccctgtccgcatctgtaggagacagagtcatcatcacttgccgggcaagtcagagcattagaacgttatttaaattggtatcaacagaaaccagggaaacgcccctagaactcctgatctatgttcatcctacttgctgaggtgggtcccatcgagttcagtggcagtggatcgtagggacagtattcactctacacatcaccagtctgcgaggctagaggtattttcgactaactttacttctagtaccaaacgtagtacgtttacgacgtttccctacttaccgtttccggcccgttacgggacctaagttaggttacggtaacttaacgtaaccaaaacggtaacgttaggtcggtacttacggacctaaccgtacgttccgtttacgttacctttccgtaactttccctttacccccggacttacttcgtaacg

SEQ ID NO: 81550 - DNA, 583 bp, Homo sapiens
  misc_feature: GYAE6OF02ICTHE.52.1.A01.1.454.CMB.1.raw
  modified_base (270)..(270): a, c, t, g, unknown or other
  misc_feature (270)..(270): n is a, c, g, or t
  modified_base (413)..(413): a, c, t, g, unknown or other
  misc_feature (413)..(413): n is a, c, g, or t
tcagcgcagtacgacacgaccggtgctcgatttagacgtctcatcaggggggagtcagtctcagtcaggacacagcatggacatgagggtccccgctcagctcctggggctcctgctactctggctccgaggtgccagatgtgtcatccagatgacccagtctccatcctccctgtccgcatctgtaggagacagagtcatcatcacttgccgggcaagtcagagcaattagaacgtatttaaattggtatacaacagaaaccagggaancccctagaactcctgatctatggttcatcctactttgctgagtggggtcccagtcaaggttcagtggcagtggatcgtgggacagtaattcactctacaccatccaccagtctgcaggctgaggtatttgactaactttcttntgtcaaactagtaacgtttacacgtttcccctacgttaccgttttccggacccgtcgggtaaccctagttacggttacgggtaacttaacgtaacccgtaaaaccggtaacgtttacggttcggtaccgttacggaccctaacccgtaactttcccgttaggtttacccc

SEQ ID NO: 81551 - DNA, 493 bp, Homo sapiens
  misc_feature: GYAE6OF02HR7L3.52.1.A01.1.454.CMB.1.raw
  modified_base (490)..(490): a, c, t, g, unknown or other
  misc_feature (490)..(490): n is a, c, g, or t
tcagcgcagtacgacacgaccggtgctcgatttagacgtctcatcagggcacagcatggacatgagggtccccgctcagctcctggggctcctgctactctggctccgaggtgccagatgtgtcatccagatgacccagtctccatcctccctgtccgcatctgtaggagacagagtcatcatcacttgccgggcaagtcagagcattagaacgtatttaaattggtatcaacagaaaccagggaaagcccctgaactcctgatctatggttcatccactttgctgagtgggtcccatcaaggttcagtggcagtggatctgggacagaattcactctcaccatcaccagtctgcaggctgaggtatttgactaacttacttctagtcaacagtagttactagttccttctacctttcggccctgggaccagtagtgtatatacaaacgtactgtcgctgcacctatctgtcttcactccttccgctatntag

SEQ ID NO: 81552 - DNA, 493 bp, Homo sapiens
  misc_feature: GYAE6OF02GT2O4.52.1.A01.1.454.CMB.1.raw
  modified_base (489)..(489): a, c, t, g, unknown or other
  misc_feature (489)..(489): n is a, c, g, or t
tcagcgcagtacgacacgaccggtgctcgatttagacgtctcatcaggggggagtcagtctcagtcaggacacagcatggacatgagggtccccgctcagctcctggggctcctgctactctggctccgaggtgccagatgtgtcatccagatgacccagtctccatcctccctgtccgcatctgtaggagacagagtcatcatcacttgccgggcaagtcagagcattagaacgtatttaaattggtatcaacagaaaccagggaaagcccctgaactcctgatctatggttcatccactttgctgagtggggtcccatcaaggttcagtggcagtgatctgggacagaatcactctcaccatcaccagtctgcaggctgaggattttgctaacttacttctgtcaacagagttacagtttccctctacctttcggcccttggacctatagtgattactacaaacgacttgtggctggcaccgatctnttcc

SEQ ID NO: 81553 - DNA, 505 bp, Homo sapiens
  misc_feature: GYAE6OF02H5XDN.52.1.A01.1.454.CMB.1.raw
  modified_base (255)..(255): a, c, t, g, unknown or other
  misc_feature (255)..(255): n is a, c, g, or t
tcagcgcagtacgacacgaccggtgctcgatttagacgtctcatcgaggggggagtcagtctcagtcaggacacagcatggacatgagggtccccgctcagctcctggggctcctgctactctggctccgaggtgccagatgtgtcatccagatgacccagtctccatcctccctgtccgcatctgtaggagacagagtcatcatcacttgccgggcaagtcagagcattagaacgtatttaaattggtatcaanagaaacaggaaagcccctagaactcctagatctatggttcatcctactttgctgagttggggtcccatcaaggttcagtggcagtggatcgtgggacagattcactctcacatccacctagtctgcaggctggaggtatttggactaacttacttctgtactaacagtagttacacgttccctctacgtttcggcctggacctagtacgtagactatacaacgtactgtcgctcgccactcttctgttcc

SEQ ID NO: 81554 - DNA, 481 bp, Homo sapiens
  misc_feature: GYAE6OF02GYZV4.52.1.A01.1.454.CMB.1.raw
  modified_base (363)..(363): a, c, t, g, unknown or other
  misc_feature (363)..(363): n is a, c, g, or t
tcagcgcagtacgacacgaccggtgctcgatttagacgtctcatcagggcacagcatggacatgagggtccccgctcagctcctggggctcctgctactctggctccgaggtgccagatgtgtcatccagatgacccagtctccatcctccctgtccgcatctgtaggagacagagtcatcatcacttgccgggcaagtcagagcattagaacgtatttaaattggtatcaacagaaaccagggaagcccctgaactcctgatctatggttcatccactttgctgagtggggtcccatcaaggttcagtggcagtggatctgggacagaattcactctcaccatcaccagtctgcagctgagntttgcaacttacttctgtcacagagttacagttccctcactttcggccctgggaccagtagtggatatcaaacgtactgtggctgcaccatctgtcttcacttcttcccgctatctag

SEQ ID NO: 81555 - DNA, 485 bp, Homo sapiens
  misc_feature: GYAE6OF02HD9DM.52.1.A01.1.454.CMB.1.raw
tcagcgcagtacgacacgaccggtgctcgatttagacgtctcatcagggcacagcatggacatgagggtccccgctcagctcctggggctcctgctactctggctccgaggtgccagatgtgtcatccagatgacccagtctccatcctccctgtccgcatctgtaggagacagagtcatcatcacttgccgggcaagtcagagcattagaacgtatttaaattggtatcaacagaaaccagggaaagcccctgaactcctgatctatggttcatccactttgctgagtggggtccatcaaggttcagtgcagtgatctgggacagaattcactctcaccatcacagtctgcaggctgaggattttgactaacttacttctgtcaactagagttacagttccctctacgtttcggccctgggaccatagtgatatacaaacgactgtgctgcaccatctgtcttcactccttcccgctatctacg

SEQ ID NO: 81556 - DNA, 479 bp, Homo sapiens
  misc_feature: GYAE6OF02FJ869.52.1.A01.1.454.CMB.1.raw
  modified_base (369)..(369): a, c, t, g, unknown or other
  misc_feature (369)..(369): n is a, c, g, or t
tcagcgcagtacgacacgaccggtgctcgatttagacgtctcatcagggggagtcagtctcagtcaggacacagcatggacatgagggtccccgctcagctcctggggctcctgctactctggctccgaggtgccagatgtgtcatccagatgacccagtctccatcctccctgtccgcatctgtaggagacagagtcatcatcacttgccgggcaagtcagagcattagaacgtatttaaattggtatcaacagaaaccagggaaagcccctgaactcctgatctatggttcatccactttgctgagtggggtccatcaagttcagtgcagtgatctgggacagattcactctcaccatcaccagtcngcaggctgaggtatttgctaacttacttctgtcaacagattacagttccctctactttcggccctgggacctatagtggatatcaaacgtactgtgctgcaccatctgtc

SEQ ID NO: 81557 - DNA, 519 bp, Homo sapiens
  misc_feature: GYAE6OF02FYGJG.52.1.A01.1.454.CMB.1.raw
  modified_base (370)..(370): a, c, t, g, unknown or other
  misc_feature (370)..(370): n is a, c, g, or t
tcagcgcagtacgacacgaccggtgctcgatttagacgtctcatcaggggggagtcagtctcagtcaggacacagcatggacatgagggtccccgctcagctcctggggctcctgctactctggctccgaggtgccagatgtgtcatccagatgacccagtctccatcctccctgtccgcatctgtaggagacagagtcatcatcacttgccgggcaagtcagagcattagaacgtattaaattggtatcaacagaaaccaggaaagcccctgaactcctgatctatggttcatccacttgctgagtgggtcccatcaagttcagtgcagtgatctgggacagaattcactctcaccatcaccagtctgnaggctgagtattttcgactaacttactctcgtacaactagtagttacagttccctactacgttccgccctgggtaccagttacgtaggtactaagtacctaaacggtaacttggtacggtactcggaccgtaccctattccgtgttacc

SEQ ID NO: 81558 - DNA, 658 bp, Homo sapiens
  misc_feature: GYAE6OF02JIF4A.52.1.A01.1.454.CMB.1.raw
  modified_base (292)..(292): a, c, t, g, unknown or other
  misc_feature (292)..(292): n is a, c, g, or t
  modified_base (454)..(454): a, c, t, g, unknown or other
  misc_feature (454)..(454): n is a, c, g, or t
tcagcgcagtacgacacgaccggtgctcgatttagacgtctcatcaggggcacaggcatgggacgatgagggtcccgctcgaagctcctcgggctccgtcgcgtacctctcggctccgaccggtcgccagtatggtcgtcatccagatggaccctacgtctccatccctccctgtccgcactcctggtaggagacagaccgtcgaactacgactcgaacttcgccgggtcaagtcaggagctattagtaacgtacttaaaagtggtatactaactaggtaaaccagggaacnccccgtaggaacctccgtcgaacgtccctagtacggttcactcctacctttgcgtaggacggtacggggtcccagttaccgaaacgggtttcccgaagttccggtcgaaggtggacttcgtagggacacgtaacttcacttcacgaccatccgacctagtcngacgagtcgtcggacggtagtttgactaacttacgtactcgtacaactagtacgttacgtacgttcctacgtacgttacggaccgtaggtaccgtagtacgtcggtaagttacgtacgaacggtacgtacgtaggtacgtcggtacctacgtactccgtaccgttcgttactacgttcccgttcccgaccttactccgttaccg

SEQ ID NO: 81559 - DNA, 535 bp, Homo sapiens
  misc_feature: GYAE6OF02H4G9I.52.1.A01.1.454.CMB.1.raw
  modified_base (355)..(355): a, c, t, g, unknown or other
  misc_feature (355)..(355): n is a, c, g, or t
tcagcgcagtacgacacgaccggtgctcgatttagacgtctcatcagggcacagcatggacatgagggtccccgctcagctcctggggctcctgctactctggctccgaggtgccagatgtgtcatccagatgacccagtctccatcctccctgtccgcatctgtaggagacagagtcatcatcacttgccgggcaagtcagagcattagaacgttatttaaattggtatcaacagaaaccagggaaacgcccctgaactcctgatctatggttcatcccatttgctgagtcgggtcccagtcaaggttcagtggcagtggatcgtgggacagaattcactctacaccatcaccngtctgcaggctgaggtattttgactaacttcttctgtacaacagtacttacacgtttccctctaccgtttcggcccttgggacctagtagtggacttatacgaaacgacgttgtacggtctaggcctaacctatccttagtccctttacacttcccgtttaccccggctacgttctaacg

SEQ ID NO: 81560 - DNA, 552 bp, Homo sapiens
  misc_feature: GYAE6OF02F849R.52.1.A01.1.454.CMB.1.raw
tcagcgcagtacgacacgaccggtgctcgatttagacgtctcatcagggcacagcatggacatgagggtccccgctcagctcctggggctcctgctactctggctccgaggtgccagatgtgtcatccagatgacccagtctccatcctccctgtccgcatctgtaggagacagagtcatcatcacttgccgggcaagtcagagcattagaacgtatttaaattggtatcaacagaaaccagggaaagcccctgaactcctgatctatggttcatccacttgctgagtgggtccatcaagttcagtggcagtgatctgggacagattcactctcacatcacagtctgcaggctggagtatttgactaactttacttctagtaccaaacgtagtaacgtttacacgttccctacttaccgtttccggcccgtagggaccctaagttacggtaggtaacttaagtaacctaaaacgtaacgttgtcggtactcggaccaacctagttccttagtttccttactactttcccgttaccccgccttactcctaacg

SEQ ID NO: 81561 - DNA, 516 bp, Homo sapiens
  misc_feature: GYAE6OF02HKM8K.52.1.A01.1.454.CMB.1.raw
  modified_base (483)..(483): a, c, t, g, unknown or other
  misc_feature (483)..(483): n is a, c, g, or t
  modified_base (507)..(507): a, c, t, g, unknown or other
  misc_feature (507)..(507): n is a, c, g, or t
tcagcgcagtacgacacgaccggtgctcgatttagacgtctcatcagggcacagcatggacatgagggtccccgctcagctcctggggctcctgctactctggctccgaggtgccagatgtgtcatccagatgacccagtctccatcctccctgtccgcatctgtaggagacagagtcatcatcacttgccgggcaagtcagagcattagaacgttatttaaattggtatcaacagaaaccagggaaacgcccctgaactcctgatctatggttcatccatttgctgaggtggggtcccatcgaaggttcagtggcagtggatcgtgggacaggtaattcactctcaccatcaaccagtctgcaggccttggaggtattttgacctaactttacttctgtacaataggtattactacgttccctctaccgttcggccctgggacctataggtgactagtacaaacgtatggtgtctagcactntcttcgtcttcacttccgtacccnctactctag

SEQ ID NO: 81562 - DNA, 549 bp, Homo sapiens
  misc_feature: GYAE6OF02G5FRY.52.1.A01.1.454.CMB.1.raw
  modified_base (274)..(274): a, c, t, g, unknown or other
  misc_feature (274)..(274): n is a, c, g, or t
tcagcgcagtacgacacgaccggtgctcgatttagacgtctcatcaggggggagtcagtctcagtcaggacacagcatggacatgagggtccccgctcagctcctggggctcctgctactctggctccgaggtgccagatgtgtcatccagatgacccagtctccatcctccctgtccgcatctgtaggagacagagtcatcatcacttggccggcaagtcagagcattagaacgttatttaaattggtatacaacaagaaaccgagggaaacncccctagaactcctagactctatggtcactcctatttgctgtaggtcgggtccatcgtaagttcagtggcaggtgatcgtggacagtaacttcactctacactactaccaacctagtctgcgaggtctaggaggttatttcgaccttaacttcgttctacgtacaactagtacgttactaccgtttccctacttaccgtttccggacccgttacggacctagtaggtgaatactacgaaacgtactggtacgactcgacctactatcttcgtacc

SEQ ID NO: 81563 - DNA, 550 bp, Homo sapiens
  misc_feature: GYAE6OF02J2G4M.52.1.A01.1.454.CMB.1.raw
  modified_base (191)..(191): a, c, t, g, unknown or other
  misc_feature (191)..(191): n is a, c, g, or t
  modified_base (282)..(282): a, c, t, g, unknown or other
  misc_feature (282)..(282): n is a, c, g, or t
  modified_base (287)..(287): a, c, t, g, unknown or other
  misc_feature (287)..(287): n is a, c, g, or t
  modified_base (334)..(334): a, c, t, g, unknown or other
  misc_feature (334)..(334): n is a, c, g, or t
  modified_base (475)..(475): a, c, t, g, unknown or other
  misc_feature (475)..(475): n is a, c, g, or t
  modified_base (490)..(490): a, c, t, g, unknown or other
  misc_feature (490)..(490): n is a, c, g, or t
  modified_base (498)..(498): a, c, t, g, unknown or other
  misc_feature (498)..(498): n is a, c, g, or t
  modified_base (536)..(536): a, c, t, g, unknown or other
  misc_feature (536)..(536): n is a, c, g, or t
tcagcgcagtacgacacgaccggtgctcgatttagacgtctcatcagggggaggtcagtctcagtcaggacacagcatggacatgagggtccccgctcagctcctgggctcctgctactctggctccgaggtgccagatgtgtcatccagatgacccagtctccatcctccctgtccgcattctgtagganacagagtcatcattcaccttgccgggcaagtcagagcattagaacgtatttaaattggtatcaacagaaaccagggaagccctcgaactcngactntatggttcatccatttgctgaggttggtcccatcaagttcagtgacngtgatcgtggacagaatctactctcacacgtacacctagtctgtccaggacgttcgagggtatttacgtccgtaacctttacttcctaggtaccaacgtagtacgttactacgttcccttcctacgtttacccggtcccgnggttacccattacgngggttaancttacgtaataaccgttgtagtacgtcacttaacccgnttaccgtattcccg

SEQ ID NO: 81564 - DNA, 516 bp, Homo sapiens
  misc_feature: GYAE6OF02HWHGM.52.1.A01.1.454.CMB.1.raw
tcagcgcagtacgacacgaccggtgctcgatttagacgtctcatcagggcacagcatggacatgagggtccccgctcagctcctggggctcctgctactctggctccgaggtgccagatgtgtcatccagatgacccagtctccatcctccctgtccgcatctgtaggagacagagtcatcatcacttgccgggcaagtcagagcattagaacgttatttaaattggtatcaacagaaaaccagggaaagcccctgaactcctgatctatggttcatccatttgctgagtgggtccatcaaggttcagtggcagtggatcgtgggacagaattcactctcaccatcaccagtctgcagctgaggtatttggggtactaactttacttcttgtactaactagtagttactacgttccctctacttcggcccgtcggacctatagtagtatatacaaacgacgtgtcgcgtcgcacctactctcgttacttctacttccttcccgtacctactctacg

SEQ ID NO: 81565 - DNA, 549 bp, Homo sapiens
  misc_feature: GYAE6OF02GNNUV.52.1.A01.1.454.CMB.1.raw
  modified_base (269)..(269): a, c, t, g, unknown or other
  misc_feature (269)..(269): n is a, c, g, or t
tcagcgcagtacgacacgaccggtgctcgatttagacgtctcatcaggggggagtcagtctcagtcaggacacagcatggacatgagggtccccgctcagctcctggggctcctgctactctggctccgaggtgccagatgtgtcatccagatgacccagtctccatcctccctgtccgcatctgtaggagacagagtcatcatcacttgccgggcaagtcagagcattagaacgtatttaaattggtatcaacagaaaccagggaaancccctgaactcctgatctatggttcatccactttgctgagtggggtcccatcaaggttcagtggcagtggatcgtgggacagaattcactctcaccatcaccagtctgcaggctggaggtattttgctaacttacttctgtacaactagtaacgtttacacgtttccctaccttacgttttcccggacccttagggaccctacgttaggtaggtaagttaactaactaaaccggtaacttcggttaggtctcggacctaaccctagttcctaggttaccc

SEQ ID NO: 81566 - DNA, 523 bp, Homo sapiens
  misc_feature: GYAE6OF02HH5ZO.52.1.A01.1.454.CMB.1.raw
tcagcgcagtacgacacgaccggtgctcgatttagacgtctcatcaggggggagtcagtctcagtcaggacacagcatggacatgagggtccccgctcagctcctggggctcctgctactctggctccgaggtgccagatgtgtcatccagatgacccagtctccatcctccctgtccgcatctgtaggagacagagtcatcatcacttgccgggcaagtcagagcattagaacgtattaaattggtatcaacagaaaccagggaaagcccctgaactcctgatctatggttcatcctactttgctgagtggggtccatcaaggttcagtggcagtggatcgtgggacagattcactctcaccatcacagtctgcaggctgagtattttcgctaactttcttctctacaaactagtagttacctacgttccctactaccttttccggcccttgggaccctagttacgtggacttaactaccgaaacgtaacgtgtaggtctgaccacctagtcctagttaccg

SEQ ID NO: 81567 - DNA, 543 bp, Homo sapiens
  misc_feature: GYAE6OF02HWKZY.52.1.A01.1.454.CMB.1.raw
  modified_base (195)..(195): a, c, t, g, unknown or other
  misc_feature (195)..(195): n is a, c, g, or t
  modified_base (250)..(250): a, c, t, g, unknown or other
  misc_feature (250)..(250): n is a, c, g, or t
tcagcgcagtacgacacgaccggtgctcgatttagacgtctcatcagggcacagcatggacatgagggtccccgctcagctcctggggctcctgctactctggctccgaggtgccagatgtgtcatccagatgacccagtctccatcctccctgtccgcatctgtaggagacagagtcatcatcacttgccgggnaagtcagagcattagaacgttatttaaattggtatcaacagaaaaccagggaaancccctgaactcctgatctatggttcatccatttgctgagtgggtccatcaagttcagtgcagtgatctgggacagattcactctacaccatcaccagtctgcagctgagtattttgctaacttactctgtacaacagtagttacagttccctctaccgtttccggcccgttagggaccctagttacggtaggtaattaacgtacgaaaacgtaactgggttcggacttcggacctaacctattccgttcgttcctttactacttcccgtttccccggaccttacttccttacg

SEQ ID NO: 81568 - DNA, 583 bp, Homo sapiens
  misc_feature: GYAE6OF02GC9U5.52.1.A01.1.454.CMB.1.raw
  modified_base (269)..(269): a, c, t, g, unknown or other
  misc_feature (269)..(269): n is a, c, g, or t
tcagcgcagtacgacacgaccggtgctcgatttagacgtctcatcagggggagtcagtctcagtcaggacacagcatggacatgagggtccccgctcagctcctggggctcctgctactctggctccgaggtgccagatgtgtcatccagatgacccagtctccatcctccctgtccgcatctgtaggagacagagtcatcatcacttgccgggcaagtcagagcattagaacgtatttaaattggtatcaacagaaaccagggaaacncccctagaacctcctgactctatggttcatccactttgctgagtcgggtccatcaaggttcagtggcagtgatcgtgggacagtaattcactctcaccatcacagtctgcagctagagtattttgacttaacttacttctagtacaaactagtacgtttacgtacgtttcccttacgttaaccgttttccggaccccgtacggggtaaccctagttacggtacggtaacgttaacgttaaccgtaaaaccggtaacgtttacggttacggtaccgttacggtaccctaaccgtaacttccgttacggtttaccc

SEQ ID NO: 81569 - DNA, 537 bp, Homo sapiens
  misc_feature: GYAE6OF02IJSAV.52.1.A01.1.454.CMB.1.raw
  modified_base (216)..(216): a, c, t, g, unknown or other
  misc_feature (216)..(216): n is a, c, g, or t
  modified_base (273)..(273): a, c, t, g, unknown or other
  misc_feature (273)..(273): n is a, c, g, or t
  modified_base (404)..(404): a, c, t, g, unknown or other
  misc_feature (404)..(404): n is a, c, g, or t
tcagcgcagtacgacacgaccggtgctcgatttagacgtctcatcagggggggagtcagtctcagtcaggacacagcatggacatgagggtccccgctcagctcctggggctcctgctactctggctccgaggtgccagatgtgtcatccagatgacccagtctccatcctccctgtccgcatctgtaggagacagagtcatcatcacttgccggnaagtcagagcattagaacgttatttaaattggtatacaacaagaaaccagggaaacncccctagaactcctgatctatggttcatcctactttgctgaggttcggggtcccatacgaaggttcaggtggcagtggatcgtgggacagtatcactctacacctatccactagtctgcaggctaggagtnttttgactaactttacttctcgtacaacgtagtaacgttacctacgtttccctacgtaccgtttccggcccgttgggaacctagtagtgatacaacgaaacgtatggtagctacgaccacctattctgttacc

SEQ ID NO: 81570 - DNA, 521 bp, Homo sapiens
  misc_feature: GYAE6OF02JF8WC.52.1.A01.1.454.CMB.1.raw
  modified_base (248)..(248): a, c, t, g, unknown or other
  misc_feature (248)..(248): n is a, c, g, or t
tcagcgcagtacgacacgaccggtgctcgatttagacgtctcatcagggcacagcatggacatgagggtccccgctcagctcctggggctcctgctactctggctccgaggtgccagatgtgtcatccagatgacccagtctccatcctccctgtccgcatctgtaggagacagagtcatcatcacttgccgggcaagtcagagcattagaacgtatttaaattggtatcaacagaaaccagggaaanccctgaactcctgatctatggtcatccacttgctgagtgggtccatcaagttcagtgcagtgatcgtggacagatcactctcacatcacagtctgcaggctgaggtattttgactaacttacttctgtacaacagtattactacgttcccttctaccgtttccggcccgtagggaccctaagttacggtacggtaattacgtaacaaacgtacgtgtaggctcggaccacctattccgtgttccttctacttcccttacccgcctatctaacg

SEQ ID NO: 81571 - DNA, 488 bp, Homo sapiens
  misc_feature: GYAE6OF02FT8HL.52.1.A01.1.454.CMB.1.raw
  modified_base (338)..(338): a, c, t, g, unknown or other
  misc_feature (338)..(338): n is a, c, g, or t
  modified_base (453)..(453): a, c, t, g, unknown or other
  misc_feature (453)..(453): n is a, c, g, or t
tcagcgcagtacgacacgaccggtgctcgatttagacgtctcatcaggggggagtcagtctcagtcaggacacagcatggacatgagggtccccgctcagctcctggggctcctgctactctggctccgaggtgccagatgtgtcatccagatgacccagtctccatcctccctgtccgcatctgtaggagacagagtcatcatcacttgccgggcaagtcagagcattagaacgtatttaaattggtatcaacagaaaccagggaaagcccctagaactcctgatctatggttcatccacttgctgagtgggtccatcaagttcagtgcagtgatcngggacagatcactctcacatcacagtctgcaggctggagtatttgactaacttacttctgtacaactagagttacagttccctctactttccggcctaggacctagtagtgattntacaaacgtactgtcgctcgacacacttcgtgttc

SEQ ID NO: 81572 - DNA, 570 bp, Homo sapiens
  misc_feature: GYAE6OF02H22NG.52.1.A01.1.454.CMB.1.raw
tcagcgcagtacgacacgaccggtgctcgatttagacgtctcatcagggcacagcatggacatgagggtccccgctcagctcctggggctcctgctactctggctccgaggtgccagatgtgtcatccagatgacccagtctccatcctccctgtccgcatctgtaggagacagagtcatcatcacttgccggcaagtcagagcattaagaacgttatttaaattggtatacaacagaaaccgagggaaacgcccctgaactcctgatctagtggttacatcctacttttgacttggagtcgggtacccagtacgtaaggttcgagtggctaggtgactcgtagggacagtattcactctacacctataccactagtctcgcaggctaggtagttatttcgacttaacttcttctagtacaactgtaacttacacgttcctctaccgtttcggcccttaggacctagttacggtagtatacgtacaaacgtacgtgtacgcttcggacctaaccctattaccgttcgttcctttacgacctttcccttccccggacttacgttccgtaag

SEQ ID NO: 81573 - DNA, 557 bp, Homo sapiens
  misc_feature: GYAE6OF02GG8XJ.52.1.A01.1.454.CMB.1.raw
tcagcgcagtacgacacgaccggtgctcgatttagacgtctcatcagggcacagcatggacatgagggtccccgctcagctcctggggctcctgctactctggctccgaggtgccagatgtgtcatccagatgacccagtctccatcctccctgtccgcatctgtaggagacagagtcatcatcacttgccgggcaagtcagagcattagaacgttatttaaattggtatcaacagaaaccagggaaacgcccctagaacctcctgatctatggttcatcctatttgctgaggtcggggtcccagtcaaggttcaggtggcaggtggatcgtagggacagtaacttcactctcaccatccacctagtctgcgaggtctaggtaggttacttttcgaccttaactttacttctacgtacaacgtagtacgttactacgttccctactaccgttccggcccgttagggacctagtagtagtaactacgtaccgaaacgtacgtgtcgctacgcctactattcttcgttacttctacttcccttcccgactagtctaacg

SEQ ID NO: 81574 - DNA, 615 bp, Homo sapiens
  misc_feature: GYAE6OF02IOAMR.52.1.A01.1.454.CMB.1.raw
  modified_base (180)..(180): a, c, t, g, unknown or other
  misc_feature (180)..(180): n is a, c, g, or t
  modified_base (191)..(191): a, c, t, g, unknown or other
  misc_feature (191)..(191): n is a, c, g, or t
  modified_base (216)..(216): a, c, t, g, unknown or other
  misc_feature (216)..(216): n is a, c, g, or t
  modified_base (254)..(254): a, c, t, g, unknown or other
  misc_feature (254)..(254): n is a, c, g, or t
tcagcgcagtacgacacgaccggtgctcgatttagacgtctcatcaggggggagtcagtctcagtcaggacacagcatggacatgagggtccccgctcagctcctggggctcctgctactctggctccgaggtgccagatgtgtcatccagatgacccagtctccatccctccctgccgnatctgtagganacagagtcatcatcacttggccggnaagtcagagcattagaacgtatttaaattggtatcaanagaaacgagggaaacgccctagaactcctagacttctattggttacactacctactttgctgaggttcggggtaccagttcgaaggttcaggtcgcgagtggatcgtagggactagaagtcactcgtacacctagtacacctagtctgacgtacggtctaggtaggtaattttcggaacttaaccttacttcgtagtaacctaaacgtaagttaacgtttacctacgtttacccttaccgttaccgtttccgggtccgtaaccgggttaacctaacttacgggttagtaacttaacgtaccgtaaaacggtacgttacggttcggaccgttacgaccgtaccctagtttcctgtttaaccc

SEQ ID NO: 81575 - DNA, 480 bp, Homo sapiens
  misc_feature: GYAE6OF02GSZMM.52.1.A01.1.454.CMB.1.raw
  modified_base (397)..(397): a, c, t, g, unknown or other
  misc_feature (397)..(397): n is a, c, g, or t
  modified_base (399)..(399): a, c, t, g, unknown or other
  misc_feature (399)..(399): n is a, c, g, or t
tcagcgcagtacgacacgaccggtgctcgatttagacgtctcatcaggggggagtcagtctcagtcaggacacagcatggacatgagggtccccgctcagctcctggggctcctgctactctggctccgaggtgccagatgtgtcatccagatgacccagtctccatcctcctgtccgcatctgtaggagacagagtcatcatcacttgccggcaagtcagagcattagaacgtatttaaattggtatcaacagaaccagggaagccctagaactcctgatctatggtcatccactttgctgagtcggggtccatcaaggttcagtgcagtggatcgtggacagaattcactctcacatcacctagtctgcaggctggagtatttgctaacttcttntntacacagtagttactacgttccctctaccttcggcctggaccagtgtagatatactaacgactgtagctgacacatctgtc

SEQ ID NO: 81576 - DNA, 574 bp, Homo sapiens
  misc_feature: GYAE6OF02HASGL.52.1.A01.1.454.CMB.1.raw
  modified_base (265)..(265): a, c, t, g, unknown or other
  misc_feature (265)..(265): n is a, c, g, or t
tcagcgcagtacgacacgaccggtgctcgatttagacgtctcatcaggggggagtcagtctcagtcaggacacagcatggacatgagggtccccgctcagctcctggggctcctgctactctggctccgaggtgccagatgtgtcatccagatgacccagtctccatccctccctgtccgcatctgtaggagacagagtcatcatcacttgccggcaagtcagagcattagaacgtatttaatgtatcaacagaaacaggaaacnccctagaactcctgatctatgtcactctacttgctgagtcgggtccatcgaagtcagtgcagtgatcgtgggacagtaatcactctcacataccacctagtctgacgaggtctaggtagtatttggaccttaaacttacttcttacgtaccaacgtacgtaacgtttaccgtacgtttaccccttaccgttaccgttttcccgggcccgtttacggggacccttaaggttacgttaacgggtaacttaacgtaaccgtaaacgtaacgttggtacggtacgtcgacctaccgtacttcccgtagttccc

SEQ ID NO: 81577 - DNA, 549 bp, Homo sapiens
  misc_feature: GYAE6OF02JX7WR.52.1.A01.1.454.CMB.1.raw
  modified_base (413)..(413): a, c, t, g, unknown or other
  misc_feature (413)..(413): n is a, c, g, or t
tcagcgcagtacgacacgaccggtgctcgatttagacgtctcatcagggcacagcatggacatgagggtccccgctcagctcctggggctcctgctactctggctccgaggtgccagatgtgtcatccagatgacccagtctccatcctccctgtccgcatctgtaggagacagagtcatcatcacttgccgggcaagtcagagcattagaacgtatttaaattggtatcaacagaaaccaagggaaagcccctagaactcctgatctatggttcatcctacttgctgaggtcgggtccatcaaggttcagtggcagtgatctgggacagattcactctcacatacacagtctgcaggctagaggtatttcgactaactttacttcgtacgtacaactaaggtacgtttaacncgtttacccctactaccgttttccggcccgttacgggacctagtacgtgtaatactacgaaacgtaacttggtgctacggtctacctattccgtagtttccctactaccgttcccttacccgccttacgtcgtacg

SEQ ID NO: 81578 - DNA, 499 bp, Homo sapiens
  misc_feature: GYAE6OF02JDJBE.52.1.A01.1.454.CMB.1.raw
  modified_base (449)..(449): a, c, t, g, unknown or other
  misc_feature (449)..(449): n is a, c, g, or t
  modified_base (489)..(489): a, c, t, g, unknown or other
  misc_feature (489)..(489): n is a, c, g, or t
tcagcgcagtacgacacgaccggtgctcgatttagacgtctcatcagggcacagcatggacatgagggtccccgctcagctcctggggctcctgctactctggctccgaggtgccagatgtgtcatccagatgacccagtctccatcctccctgtccgcatctgtaggagacagagtcatcatcacttgccgggcaagtcagagcattagaacgtatttaaattggtatcaacagaaaccagggaaagcccctgaactcctgatctatggttcatccactttgctggaggtggggtcccatcaaggttcagtggcagtggatcgtgggacagaattcactctcaccatcaccagtctgcaggctgaggtattttgactaacttacttctgtcaacgtagtacttacacgttccctactaccgtttccgccctgggaccataggtgatanacaaacgactgtgctgcaccatctgtctctactcctaccncctatctacg

SEQ ID NO: 81579 - DNA, 516 bp, Homo sapiens
  misc_feature: GYAE6OF02I84OK.52.1.A01.1.454.CMB.1.raw
  modified_base (358)..(358): a, c, t, g, unknown or other
  misc_feature (358)..(358): n is a, c, g, or t
  modified_base (362)..(362): a, c, t, g, unknown or other
  misc_feature (362)..(362): n is a, c, g, or t
  modified_base (491)..(491): a, c, t, g, unknown or other
  misc_feature (491)..(491): n is a, c, g, or t
tcagcgcagtacgacacgaccggtgctcgatttagacgtctcatcagggcacagcatggacatgagggtccccgctcagctcctggggctcctgctactctggctccgaggtgccagatgtgtcatccagatgacccagtctccatcctccctgtccgcatctgtaggagacagagtcatcatcacttgccgggcaagtcagagcattagaacgtatttaaattggtatcaacagaaaccagggaaagcccctagaactcctgatctatggttcatcctactttgctgaggtcggggtcccatcgaaggttcaggtggcgagtggatcgtgggacagaattcactctcaccatcaccngtcngcagctgagtatttgactaactttacttctgtacaacgtatagtttaccacgtttccctactaccgtttccggcccttagggacctagtacgtggattactacaaacgacttggtgctgacaccatctnttcctcacttcctcccgctatctag

SEQ ID NO: 81580 - DNA, 538 bp, Homo sapiens
  misc_feature: GYAE6OF02IJ6F4.52.1.A01.1.454.CMB.1.raw
  modified_base (358)..(358): a, c, t, g, unknown or other
  misc_feature (358)..(358): n is a, c, g, or t
tcagcgcagtacgacacgaccggtgctcgatttagacgtctcatcagggcacagcatggacatgagggtccccgctcagctcctggggctcctgctactctggctccgaggtgccagatgtgtcatccagatgacccagtctccatcctccctgtccgcatctgtaggagacagagtcatcatcacttgccgggcaagtcagagcaattagaacgttatttaaattggtatcaaacagaaaaccagggaaagcccctagaactcctgatctagtggttacatcctactttgctgagtgggtccatcaagttcagtggcagtgatctgggacagaattcactctcaccatcaccagtcngcagctgagtatttgactaacttacttctagtcaactagtattacacgttccctactaccgttttcggacccgttgggaaccctataggtagtactaagtacaaaacgtaacgtgtaggctcgacaccctatcccttagttccttacgacctttccttaccccggacttacgtactacgg

SEQ ID NO: 81581 - DNA, 617 bp, Homo sapiens
  misc_feature: GYAE6OF02HQXQV.52.1.A01.1.454.CMB.1.raw
  modified_base (215)..(215): a, c, t, g, unknown or other
  misc_feature (215)..(215): n is a, c, g, or t
  modified_base (602)..(602): a, c, t, g, unknown or other
  misc_feature (602)..(602): n is a, c, g, or t
  modified_base (610)..(610): a, c, t, g, unknown or other
  misc_feature (610)..(610): n is a, c, g, or t
tcagcgcagtacgacacgaccggtgctcgatttagacgtctcatcaggggggagtcagtctcagtcaggacacagcatggacatgagggtccccgctcagctcctggggctcctgctactctggctccgaggtgccagatgtgtcatccagatgacccagtctccatcctccctgtccgcatctgtaggagacagagtcatcatcacttgccggnaagtcagagtctatagaacgttatttaagtgtatacaacaagaacgaaggaacctcctagacctctagtactacgtagtcgttcactcctacgtttgcgtaggtacggttccgggtacctagttacggtaacggttcgtaggtcggagtaggttaggtactcgggtagggaactaagtaacttccaactccgtaccaactactacccacgtacgtcgtagacgtaggtactaggtaagttgttacgacttaacgtttcttactacgtaacaagtacgtacgtttacctaccgtttaccctcgttaccgttcccggacgtacggtaacctagtacggtagtactaacgtaaccgtaagtacgtcggtacgtcgtacgacctaaccgtnttccgttnttacccg

SEQ ID NO: 81582 - DNA, 603 bp, Homo sapiens
  misc_feature: GYAE6OF02ISWL6.52.1.A01.1.454.CMB.1.raw
tcagcgcagtacgacacgaccggtgctcgatttagacgtctcatcagggggggagtcagtctcagtcaggacacagcatggacatgagggtccccgctcagctcctggggctcctgctactctggctccgaggtgccagatgtgtcatccagatgacccagtctccatcctccctgtccgcatctgtaggagacagagtcatcatcacttgccgggcaagtcagagcattaagaacgttatttaaattggtatacaaacaagaaaccgaagggaaacgcccctagaaaccttccctagtacttcgttaagtcgggttccacttccctaacttttcgcttggtagggttcggggtcccatacgtaaggttcaggtcggacaggtggtattcgtggggacaggtaattccactctacacctaataccacctagtactgacgaggctaggaggttatttcgactaactttacttctagtacaactagtacgttactacgttccccttacgtaccgttttccggcccgttacgggacccttagtaggtagtaacgttaactaaccgtaaacgtaacgtgtacggtctcgaccacctattcgtgttcc

SEQ ID NO: 81583 - DNA, 593 bp, Homo sapiens
  misc_feature: GYAE6OF02I3EPH.52.1.A01.1.454.CMB.1.raw
tcagcgcagtacgacacgaccggtgctcgatttagacgtctcatcagggcacagcatggacatgagggtccccgctcagctcctggggctcctgctactctggctccgaggtgccagatgtgtcatccagatgacccagtctccatcctccctgtccgcatctgtaggagacagagtcatcatcacttgccgggcaagtcagagcattagaacgtatttaaattggtatcaacagaaaccaggaaacgcccctgaactcctgatctatggttcatcctacttgctgaggtgggtcccatcaaggtcagtggcagtgatcgtagggacagaacttcactctcacctatacaccagtctgcaggctagaggtattttgacctaaactttacttctacgtacaaacgtagtacgtttaaccacggtttcccctctaaccgttttccggaccccgttacgggaaccctaagttacggtacggttaacttaacgttaaccgaaaccggtaacttggtacggtacctacggaccctaacctattccgttacgtttacctttactactttccccgttacccgtaccttacttccttaacg

SEQ ID NO: 81584 - DNA, 577 bp, Homo sapiens
  misc_feature: GYAE6OF02IGCNT.52.1.A01.1.454.CMB.1.raw
  modified_base (376)..(376): a, c, t, g, unknown or other
  misc_feature (376)..(376): n is a, c, g, or t
tcagcgcagtacgacacgaccggtgctcgatttagacgtctcatcagggggggagtcagtctcagtcaggacacagcatggacatgagggtccccgctcagctcctggggctcctgctactctggctccgaggtgccagatgtgtcatccagatgacccagtctccatcctccctgtccgcatctgtaggagacagagtcatcatcacttgccgggcaagtcagagcattagaacgtatttaaattggtatcaacagaaaccagggaaagcccctagaactcctgatctatgttcatcctactttgctgaggtcggggtcccatcgaaggttcagtggcagtggatcgtgggacagaattcactctcaccatcacngtctgcaggctggaggtattttagactaactttacttactgtaccaactagtaagtttacacgtttccctacgttaccgtttccggacccgttacgggaccctagttacggtaggtaacttaacgtaaccgtaaaaccggtaactttacgggtacggtaccgttacggtaccctaacccgtacgttcccgttagtttaccc

SEQ ID NO: 81585 - DNA, 531 bp, Homo sapiens
  misc_feature: GYAE6OF02H0JLT.52.1.A01.1.454.CMB.1.raw
  modified_base (271)..(271): a, c, t, g, unknown or other
  misc_feature (271)..(271): n is a, c, g, or t
  modified_base (346)..(346): a, c, t, g, unknown or other
  misc_feature (346)..(346): n is a, c, g, or t
  modified_base (374)..(374): a, c, t, g, unknown or other
  misc_feature (374)..(374): n is a, c, g, or t
tcagcgcagtacgacacgaccggtgctcgatttagacgtctcatcagggggggagtcagtctcagtcaggacacagcatggacatgagggtccccgctcagctcctggggctcctgctactctggctccgaggtgccagatgtgtcatccagatgacccagtctccatcctccctgtccgcatctgtaggagacagagtcatcatcacttgccgggcaagtcagagcattagaacgtatttaaattggtatcaacagaaaccagggaaacncccctagaacctcctgatctatggttcatcctactttgctgagtgggtccatcaaggttcagtggcagtgatcgnggacagaattcactctacaccatcaccngtctgcaggctaggagtatttgactaactttacttctcgtacaactagtacgttactaccgtttccctactaccgtttccggtccctacgggacctagtagtgtaatactaccgaaacgtacttggtaggtctacgaccaacctagttcctgttacc

SEQ ID NO: 81586 - DNA, 580 bp, Homo sapiens
  misc_feature: GYAE6OF02H50M4.52.1.A01.1.454.CMB.1.raw
  modified_base (408)..(408): a, c, t, g, unknown or other
  misc_feature (408)..(408): n is a, c, g, or t
  modified_base (427)..(427): a, c, t, g, unknown or other
  misc_feature (427)..(427): n is a, c, g, or t
tcagcgcagtacgacacgaccggtgctcgatttagacgtctcatcagggggggagtcagtctcagtcaggacacagcatggacatgagggtcccgctcagctcctggggctcctgctactctggctccgaggtgccagatgtgtcatccagatgaccagtctccatcctcctgtccgcatctgtaggagacagagtcatcatcacttgccggcaagtcagagcattagaacgttattaaattggtatacaacagaaacagggaaacgcccctagaactcctagactctattggttcatcctacttttgctgtacggtggggtccacgtcgtaaggttcagtggtcagtaggatcgtagggactagaattcactcctacaccatcacctagtctgtcgagtctgagttntttgacttacgttcttctntaccaactataacggttactaccgttcccttaccgttaccgttttaccgggccccgttagggacctagttaacgggtccggtaattaacgtaccgtaaaacggtaacgttcgtaacggtctaacggtcctaacctagtttacctggtttaccc

SEQ ID NO: 81587 - DNA, 510 bp, Homo sapiens
  misc_feature: GYAE6OF02GP4YB.52.1.A01.1.454.CMB.1.raw
tcagcgcagtacgacacgaccggtgctcgatttagacgtctcatcagggggggagtcagtctcagtcaggacacagcatggacatgagggtccccgctcagctcctggggctcctgctactctggctccgaggtgccagatgtgtcatccagatgacccagtctccatcctccctgtccgcatctgtaggagacagagtcatcatcacttgccgggcaagtcagagcattagaacgtatttaaattggtatcaacagaaaaccagggaaagccccctagaacctcctgatctatggttcatccactttgctgagtggggtcccatcaaggttcagtggcagtggatcgtgggacagaattcactctcaccatcaccagtctgcaggctgaggtattttgactaacttacttctgtccaacagtagttacacgttccctactacctttccggcccttgggacctagtagtggactatacaaacgtaactgtggctgccaccattctgttcc

SEQ ID NO: 81588 - DNA, 566 bp, Homo sapiens
  misc_feature: GYAE6OF02HXNWK.52.1.A01.1.454.CMB.1.raw
  modified_base (373)..(373): a, c, t, g, unknown or other
  misc_feature (373)..(373): n is a, c, g, or t
  modified_base (389)..(389): a, c, t, g, unknown or other
  misc_feature (389)..(389): n is a, c, g, or t
  modified_base (406)..(406): a, c, t, g, unknown or other
  misc_feature (406)..(406): n is a, c, g, or t
tcagcgcagtacgacacgaccggtgctcgatttagacgtctcatcagggggagtcagtctcagtcaggacacagcatggacatgagggtccccgctcagctcctggggctcctgctactctggctccgaggtgccagatgtgtcatccagatgacccagtctccatcctccctgtccgcatctgtaggagacagagtcatcatcacttgccgggcaagtcagagcaattagaacgtatttaaaattggtatacaacagaaaaccagggaaagcccctagaactcctagatctatggttcatccactttgctgagtcgggtccagtcaaaggtcagtgcagtgatcgtggacagattcactctacacatcaccngtctgcagctagagtntttgctaacttactctntcaacgagtaagttacctacgtttcccctacgttaccgttttacccggcccttacgggaaccctagtttaacggttcggaacttaacgttaaccaaaacgggtaactttcgggtacgggtccttcggaaccctaaccgtactttaccgttcgtttaaccc

SEQ ID NO: 81589 - DNA, 523 bp, Homo sapiens
  misc_feature: GYAE6OF02HBNVD.52.1.A01.1.454.CMB.1.raw
  modified_base (392)..(392): a, c, t, g, unknown or other
  misc_feature (392)..(392): n is a, c, g, or t
  modified_base (394)..(394): a, c, t, g, unknown or other
  misc_feature (394)..(394): n is a, c, g, or t
tcagcgcagtacgacacgaccggtgctcgatttagacgtctcatcaggggggagtcagtctcagtcaggacacagcatggacatgagggtccccgctcagctcctggggctcctgctactctggctccgaggtgccagatgtgtcatccagatgacccagtctccatcctccctgtccgcatctgtaggagacagagtcatcatcacttgccgggcaagtcagagcatagaacgtatttaaattggtatcaacagaaaccaggaaagccctgaactcctgatctatgttcatccactttgctgagtgggtccatcaagtcagtgcagtgatcgtggacagatcactctcacatcaccagtctgcagctagaggtatttgactaacttacttntntacaacagtacgttacacgttccctactactttccggcctacgggacctagttagtacggtattaacgtaccgaaacgtaacctaggtacggtaccgttaggacctaaccctagttccgtacgtttacc

SEQ ID NO: 81590 - DNA, 700 bp, Homo sapiens
  misc_feature: GYAE6OF02I0YZ2.52.1.A01.1.454.CMB.1.raw
  modified_base (282)..(282): a, c, t, g, unknown or other
  misc_feature (282)..(282): n is a, c, g, or t
tcagcgcagtacgacacgaccggtgctcgatttagacgtctcatcaggggggagtcagtctcagtcaggacacagcatggacatgagggtccccgctcagctcctggggctcctgctactctggctccgaggtgccagatgtgtcatccagatgacccagtctccatcctccctgtccgcatctgtaggagacagagtcatcatcacttcggccgggcaagtcagagctattaagaacgttaatttaaagttggtatacaacaagaaaaccgaagggaaacncccctagtaacctcctagtacttacttagtcggttcactccttaactttgtctggtaggttcgggggtacccaagtacgtaaacggtttccaaggtcgggacgtaggtaggtaattcggtaggggtaacaagtaacgttactaaccttacctaccaccctaattcccaaaccgcgttacctgaccgaacggtccgtaggtaacggtttaattttcgaaccgtttaaaccttttaccgtttacgttacgttaacctaaacgtaagttaaccgtttaaccgtaccgtttttcccctacgttacccgttttccgggaccccgttgggtaaccctagttacggtacggtaacgttaacgtaaccgaaaacggtaacgttcggttaggaccttacgaacccttacgtaacttcgtcgtttacc

SEQ ID NO: 81591 - DNA, 503 bp, Homo sapiens
  misc_feature: GYAE6OF02FVV8N.52.1.A01.1.454.CMB.1.raw
  modified_base (402)..(402): a, c, t, g, unknown or other
  misc_feature (402)..(402): n is a, c, g, or t
  modified_base (409)..(409): a, c, t, g, unknown or other
  misc_feature (409)..(409): n is a, c, g, or t
tcagcgcagtacgacacgaccggtgctcgatttagacgtctcatcaggggggagtcagtctcagtcaggacacagcatggacatgagggtccccgctcagctcctggggctcctgctactctggctccgaggtgccagatgtgtcatccagatgacccagtctccatcctccctgtccgcatctgtaggagacagagtcatcatcacttgccgggcaagtcagagcattagaacgtatttaaattggtatcaacagaaaccagggaaagcccctagaactctgatctatggttcatccactttgctgagtcggggtccatcaaggttcagtggcagtggatcgtggacagattcactctcacatcaccagtctgcaggctgagtatttgctaacttctcttntaccaanagtagttactacgttcctctacgttccgcccttgggaccctagtagtggatataccaaacgaacttgtacggtctcgaccactagtcctgtacc

SEQ ID NO: 81592 - DNA, 569 bp, Homo sapiens
  misc_feature: GYAE6OF02GSDNT.52.1.A01.1.454.CMB.1.raw
  modified_base (250)..(250): a, c, t, g, unknown or other
  misc_feature (250)..(250): n is a, c, g, or t
  modified_base (352)..(352): a, c, t, g, unknown or other
  misc_feature (352)..(352): n is a, c, g, or t
  modified_base (364)..(364): a, c, t, g, unknown or other
  misc_feature (364)..(364): n is a, c, g, or t
tcagcgcagtacgacacgaccggtgctcgatttagacgtctcatcagggcacagcatggacatgagggtccccgctcagctcctggggctcctgctactctggctccgaggtgccagatgtgtcatccagatgacccagtctccatcctccctgtccgcatctgtaggagacagagtcatcatcacttgccgggcaagtcagagcattagaacgttatttaaattggtatcaacagaaaccagggaaacncccctagaactcctgatctatggttcatcactttgctgagtgggtcccatcaaggttcagtggcagtggatcgtggacagactcactctcacatcacagtcngcgagctgagtntttcgacttaacttacttctacgtacaacgtagtacgttactaccgttaccctccgttaccgtttccgggcccgtacgggtacctaagttacggtacgtaatacgtaaccgaaaacgtaaccgtggtacggtcgtacgacctaaccctacttccgttcgttccttacgtacttaccccgtttacccggacctacgttcttaacgg

SEQ ID NO: 81593 - DNA, 556 bp, Homo sapiens
  misc_feature: GYAE6OF02JZ2K9.52.1.A01.1.454.CMB.1.raw
  modified_base (190)..(190): a, c, t, g, unknown or other
  misc_feature (190)..(190): n is a, c, g, or t
  modified_base (193)..(193): a, c, t, g, unknown or other
  misc_feature (193)..(193): n is a, c, g, or t
  modified_base (214)..(214): a, c, t, g, unknown or other
  misc_feature (214)..(214): n is a, c, g, or t
  modified_base (223)..(223): a, c, t, g, unknown or other
  misc_feature (223)..(223): n is a, c, g, or t
  modified_base (265)..(265): a, c, t, g, unknown or other
  misc_feature (265)..(265): n is a, c, g, or t
  modified_base (410)..(410): a, c, t, g, unknown or other
  misc_feature (410)..(410): n is a, c, g, or t
  modified_base (428)..(428): a, c, t, g, unknown or other
  misc_feature (428)..(428): n is a, c, g, or t
  modified_base (543)..(543): a, c, t, g, unknown or other
  misc_feature (543)..(543): n is a, c, g, or t
tcagcgcagtacgacacgaccggtgctcgatttagacgtctcatcagggggagtcagtctcagtcaggacacagcatggacatgagggtccccgctcagctcctgggctcctgctactctggctccgaggtgccagatgtgtcatccagatgacccagtctccatcctccctggtccacatctgtagganacngagtcatcatcacttgccggnaagtcagancaatagaacgtattaaattggtatcaacagaaaccaggaacnccctagaactcctgatctatggttacatcctactttgcttaggacggttaggggtcccagtaccgtaaggttcaggtggactagtggatcgtagggacagtaattcgacttctacactactcacagtctgacaggtcagtacgtntttcgacttacttacttnacgttaccaagtagttacgttactacgttccctagttacccgttcggtacccgtggacctaagttagtacggtaatacgtaacgaaactacgtacgtcgtactacgcctaacgtnttaccgtgttacc

SEQ ID NO: 81594 - DNA, 565 bp, Homo sapiens
  misc_feature: GYAE6OF02IMY4J.52.1.A01.1.454.CMB.1.raw
  modified_base (251)..(251): a, c, t, g, unknown or other
  misc_feature (251)..(251): n is a, c, g, or t
  modified_base (266)..(266): a, c, t, g, unknown or other
  misc_feature (266)..(266): n is a, c, g, or t
tcagcgcagtacgacacgaccggtgctcgatttagacgtctcatcaggggggagtcagtctcagtcaggacacagcatggacatgagggtccccgctcagctcctgggctcctgctactctggctccgaggtgccagatgtgtcatccagatgacccagtctccatccctccctgtccgcatctgtaggagacagagtcatcatcacttgcggcaagtcagagcattagaacgtatttaaatggtatcaanagaaaccagggaacnccctagaacctcctagactctaatgtcatcctatttgctgagtcgggtccagtacaaggttcaggtgacagtagatcgtagggactagaattcactctacacatcaccagtctgcgagtctaggagtatttcgacttaacttctcgtataccaactagtacgtactaccgttccctacgttacgtttccggacccttcgggaactacgtaggtacggtaattaacgaccttaaaacggtaaccgtttcggtacgggtacttacggtaaccctaaccgtaacgtttcgtacggtttaacc

SEQ ID NO: 81595 - DNA, 589 bp, Homo sapiens
  misc_feature: GYAE6OF02FVYDI.52.1.A01.1.454.CMB.1.raw
  modified_base (208)..(208): a, c, t, g, unknown or other
  misc_feature (208)..(208): n is a, c, g, or t
  modified_base (234)..(234): a, c, t, g, unknown or other
  misc_feature (234)..(234): n is a, c, g, or t
  modified_base (238)..(238): a, c, t, g, unknown or other
  misc_feature (238)..(238): n is a, c, g, or t
  modified_base (247)..(247): a, c, t, g, unknown or other
  misc_feature (247)..(247): n is a, c, g, or t
  modified_base (254)..(254): a, c, t, g, unknown or other
  misc_feature (254)..(254): n is a, c, g, or t
  modified_base (264)..(264): a, c, t, g, unknown or other
  misc_feature (264)..(264): n is a, c, g, or t
  modified_base (266)..(266): a, c, t, g, unknown or other
  misc_feature (266)..(266): n is a, c, g, or t
  modified_base (268)..(268): a, c, t, g, unknown or other
  misc_feature (268)..(268): n is a, c, g, or t
  modified_base (270)..(270): a, c, t, g, unknown or other
  misc_feature (270)..(270): n is a, c, g, or t
  modified_base (289)..(289): a, c, t, g, unknown or other
  misc_feature (289)..(289): n is a, c, g, or t
  modified_base (321)..(321): a, c, t, g, unknown or other
  misc_feature (321)..(321): n is a, c, g, or t
tcagcgcagtacgacacgaccggtgctcgatttagacgtctcatcagggtcgacagcatgcacactgagggtccccgctcagcctcctgggctcctgctactctggctccgaggtgccagatggtgtcagtccagtatgacccagtctccatccctcctgtcccgctattcgtgtacggagacagagtcgatcatcacgttgccgganagtcagagcattagactattaatgancaanacgaaacgnggtaacncctgaactcngntntntgtcatcctagttgcgtgnggtcggtccatcgaagttcagtgcagtgatgnggacagacttcactctacacgactccaccgtagtcgtcgacgagtgtaggacgtttactttcgaccttaactttcttcgtacgtacctaacgacgttacgttaccgtaccgttttacccgtccggtaaccgtttccgggacccgttcgggaaccctaggtacgttaggaacttacgtacgtaaacgtcgttcggagtaccgtcgactacctacttacgttcgtttacccgttacgtaccgtttcccgttaccggaccttaggttaccg

SEQ ID NO: 81596 - DNA, 538 bp, Homo sapiens
  misc_feature: GYAE6OF02GGH8Q.52.1.A01.1.454.CMB.1.raw
  modified_base (249)..(249): a, c, t, g, unknown or other
  misc_feature (249)..(249): n is a, c, g, or t
  modified_base (388)..(388): a, c, t, g, unknown or other
  misc_feature (388)..(388): n is a, c, g, or t
tcagcgcagtacgacacgaccggtgctcgatttagacgtctcatcagggcacagcatggacatgagggtccccgctcagctcctggggctcctgctactctggctccgaggtgccagatgtgtcatccagatgacccagtctccatcctccctgtccgcatctgtaggagacagagtcatcatcacttgccgggcaagtcagagcattagaacgttatttaaatggtatcaacagaaaccagggaaacncccctagaacctctgatctatggttcatcctacttgctgaggtcggggtccatcaaggttcagtggcagtgatcgtgggacagtaattcactctcaccatcacagtctgcaggctggagtatttgactaacttcttctntacaatagatttaactacgttaccctcgtaccgtttccggcccgtagggacctagttacggtagtacttaacgtacaaaacgtactggtcgctacggactacctagttccttacgttccttactacttcccttcccgacttacgtctacg

SEQ ID NO: 81597 - DNA, 540 bp, Homo sapiens
  misc_feature: GYAE6OF02G0DKT.52.1.A01.1.454.CMB.1.raw
  modified_base (372)..(372): a, c, t, g, unknown or other
  misc_feature (372)..(372): n is a, c, g, or t
tcagcgcagtacgacacgaccggtgctcgatttagacgtctcatcagggggggagtcagtctcagtcaggacacagcatggacatgagggtccccgctcagctcctggggctcctgctactctggctccgaggtgccagatgtgtcatccagatgacccagtctccatcctccctgtccgcatctgtaggagacagagtcatcatcacttgccgggcaagtcagagcattagaacgtatttaaattggtatcaacagaaaccagggaaagcccctgaactcctgatctatggttcactccactttgctgagtcggggtcccatcaaggttcagtggcagtgatcgtgggacagattcactctcaccatcacngtctagcaggctaggaggtattttcgactaactttacttcttgtactaacagtacgttaacgtacgttccctcgtaccgttttccggcccgttacgggacctagtagtggtattaactaaccgaaacgtaacgttggttcggactacgaccgtaccacttctcgttcc

SEQ ID NO: 81598 - DNA, 543 bp, Homo sapiens
  misc_feature: GYAE6OF02JNH8U.52.1.A01.1.454.CMB.1.raw
  modified_base (204)..(204): a, c, t, g, unknown or other
  misc_feature (204)..(204): n is a, c, g, or t
  modified_base (310)..(310): a, c, t, g, unknown or other
  misc_feature (310)..(310): n is a, c, g, or t
  modified_base (327)..(327): a, c, t, g, unknown or other
  misc_feature (327)..(327): n is a, c, g, or t
  modified_base (343)..(343): a, c, t, g, unknown or other
  misc_feature (343)..(343): n is a, c, g, or t
  modified_base (379)..(379): a, c, t, g, unknown or other
  misc_feature (379)..(379): n is a, c, g, or t
  modified_base (501)..(501): a, c, t, g, unknown or other
  misc_feature (501)..(501): n is a, c, g, or t
tcagcgcagtacgacacgaccggtgctcgatttagacgtctcatcagggcacagcatggacatgagggtccccgctcagctcctggggctcctgctactctggctccgaggtgccagatgtgtcatccagatgacccagtctccatcctccctgtccgcatctgtaggagacagagtcatcatcacttgccgggcaagtcagancattagaacgtatttaaatgtatcaacagaacaggaaagcccctagaactcctgatctatggtacatccattgctgagtcgggccatctaaggtcagtgcagtgancgtggacagaatcatcnctacactcacagtctncagctagagtcttgactaattacgttcagtaccaanagtacgtttacacttacccgtctacctttcgggacccgttagggaccctagtaacggttagtaactaacgtactaaaaccggtaacttgggacgtaccgtggtacaacccgttatacggttnttactttaccgtacgtcccttaccccggcttaacgtcgtaac

SEQ ID NO: 81599 - DNA, 561 bp, Homo sapiens
  misc_feature: GYAE6OF02GPQAK.52.1.A01.1.454.CMB.1.raw
tcagcgcagtacgacacgaccggtgctcgatttagacgtctcatcaggggggagtcagtctcagtcaggacacagcatggacatgagggtccccgctcagctcctggggctcctgctactctggctccgaggtgccagatgtgtcatccagatgacccagtcctccatcctccctgtccgcatctgtaggagacagagtcatcatcacttgccgggcaagtcagagcattagaacgtatttaaattggtatcaacagaaaccgaggaaacgcccctagacctctgatctatggttcactcctactttgcttgaggttcggggtcccagtacgaaggttcaggtggcgtaggtggatcgtagggacagtaacttcactctacaccatccacagtctgcgaggctaggtacgttattttcgacttaacttacttctagtacaaactaggtaacttacctacgtttccctacgttaccgttccggccgtacggtactagttacgtacgtaagtacgtaactaaacgtacgtggtacgtctacgacctacgtacttcgtcttacc

SEQ ID NO: 81600 - DNA, 478 bp, Homo sapiens
  misc_feature: GYAE6OF02HBXLJ.52.1.A01.1.454.CMB.1.raw
  modified_base (195)..(195): a, c, t, g, unknown or other
  misc_feature (195)..(195): n is a, c, g, or t
  modified_base (315)..(315): a, c, t, g, unknown or other
  misc_feature (315)..(315): n is a, c, g, or t
  modified_base (357)..(357): a, c, t, g, unknown or other
  misc_feature (357)..(357): n is a, c, g, or t
  modified_base (374)..(374): a, c, t, g, unknown or other
  misc_feature (374)..(374): n is a, c, g, or t
  modified_base (394)..(394): a, c, t, g, unknown or other
  misc_feature (394)..(394): n is a, c, g, or t
  modified_base (427)..(427): a, c, t, g, unknown or other
  misc_feature (427)..(427): n is a, c, g, or t
  modified_base (449)..(449): a, c, t, g, unknown or other
  misc_feature (449)..(449): n is a, c, g, or t
tcagcgcagtacgacacgaccggtgctcgatttagacgtctcatcagggcacagcatggacatgagggtccccgctcagctcctggggctcctgctactctggctccgaggtgccagatgtgtcatccagatgacccagtctccatcctccctgtccgcatctgtaggagacagagtcatcatcacttgccgggnaagtcagagcattagaacgtatttaaatggtatcaacagaaaccagggaaacgcccctagaactcctgatctatgtcatccacttgctgagtgggtccatcagttcagtgcagtgatcgnggacagacttcactctacacatcaccagtctgcagctgagtntttgactacttcttctnacacagtattacacgttccnctacgttccgcctacggactagtacgtgattanacgaaactagtgtgactgcacntctgtcttcacttcctccactacttctag

SEQ ID NO: 81601 - DNA, 604 bp, Homo sapiens
  misc_feature: GYAE6OF02GCLOP.52.1.A01.1.454.CMB.1.raw
  modified_base (191)..(191): a, c, t, g, unknown or other
  misc_feature (191)..(191): n is a, c, g, or t
  modified_base (348)..(348): a, c, t, g, unknown or other
  misc_feature (348)..(348): n is a, c, g, or t
tcagcgcagtacgacacgaccggtgctcgatttagacgtctcatcaggggggagtcagtctcagtcaggacacagcatggacatgagggtccccgctcagctcctggggctcctgctactctggctccgaggtgccagatgtgtcatccagatgacccagtctccatcctccctgtccgcatctgtagganacagagtcatcatcacttgccggcaagtcagagcattagaacgtatttaaattggtatacaacagaaaccagggaaacgcccctagaactcctgatctaatggttcatcctatttgctgagtggggtcccatacaaggttcagtggcagtggatcgnggacagtattcactctacaccatcacctgtctgcaggtctagaggtattttagaccgtaactttacttctcgttacaaacgtagtaacgtttaccacgtttccccttacgttaacccgttttccggacccgttacgggggtaaccctacggtttaagggtacgggtaacttaacgttaaccgtaaaaccggttaacgttccggttacggtaccgttacggtacccaaccttaacgtttaccgttcggttttaaccc

SEQ ID NO: 81602 - DNA, 579 bp, Homo sapiens
  misc_feature: GYAE6OF02INH69.52.1.A01.1.454.CMB.1.raw
  modified_base (218)..(218): a, c, t, g, unknown or other
  misc_feature (218)..(218): n is a, c, g, or t
  modified_base (275)..(275): a, c, t, g, unknown or other
  misc_feature (275)..(275): n is a, c, g, or t
  modified_base (345)..(345): a, c, t, g, unknown or other
  misc_feature (345)..(345): n is a, c, g, or t
  modified_base (350)..(350): a, c, t, g, unknown or other
  misc_feature (350)..(350): n is a, c, g, or t
  modified_base (381)..(381): a, c, t, g, unknown or other
  misc_feature (381)..(381): n is a, c, g, or t
tcagcgcagtacgacacgaccggtgctcgatttagacgtctcatcagggggagtcagtctcagtcaggacacagcatggacatgagggtccccgctcagctcctggggctcctgctactctggctccgaggtgccagatgtgtcatccagatgaccccagtcctccatcctccctgtccgcatctgtaggagacagagtcatcatcacttggccgganaagtcagagcaattagaacgttatttaaagtggtatacaacaagaaacagggaaacnccctagaacctctgatctatgtcatctacttgctgagtcgggtccatcgaagttcagtgcgagtgatcgnggaanagtaatcgactctcaaccataccaccagtcngtcgaggtctaggtagtatttcgactaacttacgttctatacctaacgagtaacgttacctacgtttcccctacgtaccgttttcccgggaccgtacgggtaacctaggtacgttacggaacttaacgtaaccgtaaaacgtaaccgttcggtacggtaccttacggacctaaccgtaactttcccgtagtttacccg

SEQ ID NO: 81603 - DNA, 605 bp, Homo sapiens
  misc_feature: GYAE6OF02I4C1O.52.1.A01.1.454.CMB.1.raw
  modified_base (183)..(183): a, c, t, g, unknown or other
  misc_feature (183)..(183): n is a, c, g, or t
  modified_base (222)..(222): a, c, t, g, unknown or other
  misc_feature (222)..(222): n is a, c, g, or t
  modified_base (285)..(285): a, c, t, g, unknown or other
  misc_feature (285)..(285): n is a, c, g, or t
  modified_base (501)..(501): a, c, t, g, unknown or other
  misc_feature (501)..(501): n is a, c, g, or t
  modified_base (553)..(553): a, c, t, g, unknown or other
  misc_feature (553)..(553): n is a, c, g, or t
tcagcgcagtacgacacgaccggtgctcgatttagacgtctcatcagggggggagtcagtctcagtcaggacacagcatggacatgagggtccccgctcagctccgtggggctcctgctactctggctccgaggtgccagatgtgtcatccagatgacccagtctccactccctccctgtccncatctgtaggagacagagtcatcaatcacttggccgganaagtcagagctaattagaacgttaatttaaagtggtaatacaaacaagaaaccgagggaaacncccctagaacctcctagaatctatagtacactcctacgtttgacttaggacggttcgggtaccctagtacgtaacggttacagggttaggaccgtaggtagggactttcgaggggtaactaagtaacttacgtacctacttaccaaacctacgtaccctaaccgtaagttcgacgtcgaacggtctaggtacgttatttacgactaacgttccttnacgtacaagtgtaacttactacgtccctattccgtttccgacttacggactntagtcgtataactaacgaatacggcttgctacggcctactactcgtattacg

SEQ ID NO: 81604 - DNA, 589 bp, Homo sapiens
  misc_feature: GYAE6OF02GC14L.52.1.A01.1.454.CMB.1.raw
tcagcgcagtacgacacgaccggtgctcgatttagacgtctcatcagggcacagcatggacatgagggtccccgctcagctcctggggctcctgctactctggctccgaggtgccagatgtgtcatccagatgacccagtctccatcctccctgtccgcatctgtaggagacagagtcatcatcacttgccgggcaagtcagagcattagaacgtatttaaattggtatcaacagaaaccagggaaagcccctgaactcctgatctatggttcatccactttgctgagtggggtccatcaaggttcagtggcagtggatctgggacagattcactctcaccatcacagtctgcagctggagtattttacgctaactttacttctgtactaacgtagtacgttaccacgtttccccttcgtaacccgtttttccgggaccccgttacgggggaaccctaacgttaaggttcgggtaacttaagttaacccgaaaaaccgtaaccgttaggttcggacgttacggaccaacccgtattccgttacgttcctttaccgaactttcccgttacccccgactacgttcgtaacg

SEQ ID NO: 81605 - DNA, 507 bp, Homo sapiens
  misc_feature: GYAE6OF02FWU8F.52.1.A01.1.454.CMB.1.raw
  modified_base (394)..(394): a, c, t, g, unknown or other
  misc_feature (394)..(394): n is a, c, g, or t
  modified_base (404)..(404): a, c, t, g, unknown or other
  misc_feature (404)..(404): n is a, c, g, or t
  modified_base (485)..(485): a, c, t, g, unknown or other
  misc_feature (485)..(485): n is a, c, g, or t
tcagcgcagtacgacacgaccggtgctcgatttagacgtctcatcagggcacagcatggacatgagggtccccgctcagctcctggggctcctgctactctggctccgaggtgccagatgtgtcatccagatgacccagtctccatcctccctgtccgcatctgtaggagacagagtcatcatcacttgccgggcaagtcagagcattagaacgtatttaaatggtatcaacagaaaccagggaaagcccctgaactcctgatctatggttcatccacttgctgaggtgggtccatcaaggttcagtggcagtgatcgtgggacagaattcactctcaccatccaccagtctgcaggctggtaggtattttgactaactttacttctgtacaanagtacttacncgttcctctacctttcggccctagggacctagtagtgatacacaaacgactgtgctacgactaccatcttcgttacttctnttcccttcccgactacttctag

SEQ ID NO: 81606 - DNA, 505 bp, Homo sapiens
  misc_feature: GYAE6OF02GSPQB.52.1.A01.1.454.CMB.1.raw
  modified_base (380)..(380): a, c, t, g, unknown or other
  misc_feature (380)..(380): n is a, c, g, or t
  modified_base (469)..(469): a, c, t, g, unknown or other
  misc_feature (469)..(469): n is a, c, g, or t
  modified_base (494)..(494): a, c, t, g, unknown or other
  misc_feature (494)..(494): n is a, c, g, or t
tcagcgcagtacgacacgaccggtgctcgatttagacgtctcatcagggcacagcatggacatgagggtccccgctcagctcctggggctcctgctactctggctccgaggtgccagatgtgtcatccagatgacccagtctccatcctccctgtccgcatctgtaggagacagagtcatcatcacttgccgggcaagtcagagcattagaacgtatttaaattggtatcaacagaaaccaggaaagcccctagaactcctgatctatggttcatccacttgctgaggtgggtccatcaaggtcagtggcagtgatcgtgggacagattcactctcacatcaccagtctgcagctgagtattttgactaacttacttctntacaacagtacttactcgttccctctactttccggcccgttagggacccagtagtaggatacgtacaaacgtatgtgtctggctacctntctcgttccttcacttcccttcccnctacttctacg

SEQ ID NO: 81607 - DNA, 691 bp, Homo sapiens
  misc_feature: GYAE6OF02IEGN8.52.1.A01.1.454.CMB.1.raw
tcagcgcagtacgacacgaccggtgctcgatttagacgtctcatcagggcacagcatggacatgagggtccccgctcagctcctgggctcctgctactctggctccgaggtgccagatgtgtcatccagatgacccagtctccatccctccctgtccgcatctggtaggagacagagtcatcatcacttgccgggcaagtcagagcattagaacgttattttaaatggtatacaaacgagaaaaccgagggaaacgcccctaggaactccgtagacttacttaagtggttctaactaccttacctttagccttaggaacggttcggggtaccccaattacgtaaggttacgaaggttcggcgtaggtacgggtagttacgtaggggaacaacggttaaagttccctaacgttctaacccaaccctaacgttaccaaccgtaacgttccgtcggtaccgtacgggtacgttagggtaagggttaacttttacggtacctaaacttttactttaccgtagttacaaacgtaacgttacgttactacgttcccttacctaccgtttcccggtccgtacgggacctaagtacggtagtacgtaactacgaaacgtacgtagtacggtctacggaccaacctacgtcctacgtttactccttaaccgttcccgttacccgtacctacgttctaacg

SEQ ID NO: 81608 - DNA, 507 bp, Homo sapiens
  misc_feature: GYAE6OF02GVA76.52.1.A01.1.454.CMB.1.raw
  modified_base (195)..(195): a, c, t, g, unknown or other
  misc_feature (195)..(195): n is a, c, g, or t
  modified_base (367)..(367): a, c, t, g, unknown or other
  misc_feature (367)..(367): n is a, c, g, or t
  modified_base (478)..(478): a, c, t, g, unknown or other
  misc_feature (478)..(478): n is a, c, g, or t
tcagcgcagtacgacacgaccggtgctcgatttagacgtctcatcagggcacagcatggacatgagggtccccgctcagctcctggggctcctgctactctggctccgaggtgccagatgtgtcatccagatgacccagtctccatcctccctgtccgcatctgtaggagacagagtcatcatcacttgccgggnaagtcagagcattagaacgtatttaaattggtatcaacagaaaccagggaaagcccctagaactcctgatctatggttcatcctactttgctgagtgggtcccatcaaggttcagtggcagtggatcgtgggacagattcactctcacatcaccagtctagcaggctgagtntttgactaacttcttctgtacaactagtacgttacacgttccctctaccgtttccggcccgtacggacctagtacggtgactgtcgaagtacgactgtcgtctgaccactnttctagtcttcaccttcctccgcctatcg

SEQ ID NO: 81609 - DNA, 506 bp, Homo sapiens
  misc_feature: GYAE6OF02H4IS3.52.1.A01.1.454.CMB.1.raw
  modified_base (316)..(316): a, c, t, g, unknown or other
  misc_feature (316)..(316): n is a, c, g, or t
tcagcgcagtacgacacgaccggtgctcgatttagacgtctcatcagggcacagcatggacatgagggtccccgctcagctcctggggctcctgctactctggctccgaggtgccagatgtgtcatccagatgacccagtctccatccctccctgtccgcatctgtaggagacagagtcatcatcacttgccggcaagtcagagcaattagaacgttatttaaatggtatacaacagaaaaccagggaaacgcccctagaactcctgatctatggttcatcctactttgctgagtgggtccatcaagttcagtgcngtgatctgggacagattcactctcacatcacagtctgcagctgagttatttgactaacttacttctgtactaacagtattactacttccctataccgtttcgcccttgggacctagttagtggtaattacacgaaacgacgtgtgctgccactatctcgttcttactactcccttacccgctactgtacg

SEQ ID NO: 81610 - DNA, 625 bp, Homo sapiens
  misc_feature: GYAE6OF02JYE31.52.1.A01.1.454.CMB.1.raw
  modified_base (297)..(297): a, c, t, g, unknown or other
  misc_feature (297)..(297): n is a, c, g, or t
  modified_base (420)..(420): a, c, t, g, unknown or other
  misc_feature (420)..(420): n is a, c, g, or t
tcagcgcagtacgacacgaccggtgctcgatttagacgtctcatcagggggaggtcgagtctcagtcaggacacagcatggacatgagggtccccgctccagcctcctggggctcctgctactctggctccgaggtgccagatgtgtcatccagatgacccagtctccatccctcctgtccgacatctgtaggagacagagtcagtcatcacttgccgggacaagtcgaagatcattagaacgtaattaaattggtatctaacacgaaacgaggaacgaccctacgaactaccgtanacgtactaactggttactacgtcctacttacgtctacgtacggtcggggtaccagtacgaaggttaccgtagtcggactaggtggatccgtagggaactagtaactacgtactactcaacctntaccgtacctacgtctacgacgtagccgttagtacggtcgtttacgacccttaatttaccgttacttggtaacctaacgtacgtacgttacgtaccgttcccttaacttacccgttccgtacccgtaacgggacctagttacggtctaagtcgtaactaaacggtcttaaggtcgtacttcggaccttaccagtccttacgttcg

SEQ ID NO: 81611 - DNA, 677 bp, Homo sapiens
  misc_feature: GYAE6OF02H9DNV.52.1.A01.1.454.CMB.1.raw
  modified_base (180)..(180): a, c, t, g, unknown or other
  misc_feature (180)..(180): n is a, c, g, or t
tcagcgcagtacgacacgaccggtgctcgatttagacgtctcatcaggggggagtcagtctcagtcaggacacagcatggacatgagggtccccgctcagctcctggggctcctgctactctggctccgaggtgccagatgtgtcatccagatgacccagtctccatcctccctgtccgnatctgtaggagacagagtcatcatcacgttggccggactaaggtcagagctaagttagaacgttatttaaagttggtatacaacaacgaaaaccgaagggaaacgccctagaactccttagatctatcggttacatcctactttgctggtaggtcggggtacccagttacgtaacggttcgtaaggtcggacgtagggtcggaacgttcggtaggggtaaccgtaagtaaacgtttccgaaactttcctacccaacctactacccaacccgttacggtccttcgaccggtaggtaccgtaggtaagggtttatttcggaaccttaacttttaacgttcctaggtaccaaagtacgtaaacgtttacctaccgtttcccctacgttacccgtttacccgggccgttaaccgggaccgttacgtagggttacggtataacgttaacctaacgggtaacctttggacggtctcggacctacccgtattccgtgtttaccc

SEQ ID NO: 81612 - DNA, 568 bp, Homo sapiens
  misc_feature: GYAE6OF02GICXT.52.1.A01.1.454.CMB.1.raw
  modified_base (180)..(180): a, c, t, g, unknown or other
  misc_feature (180)..(180): n is a, c, g, or t
  modified_base (217)..(217): a, c, t, g, unknown or other
  misc_feature (217)..(217): n is a, c, g, or t
  modified_base (225)..(225): a, c, t, g, unknown or other
  misc_feature (225)..(225): n is a, c, g, or t
  modified_base (310)..(310): a, c, t, g, unknown or other
  misc_feature (310)..(310): n is a, c, g, or t
tcagcgcagtacgacacgaccggtgctcgatttagacgtctcatcaggggggagtcagtctcagtcaggacacagcatggacatgagggtccccgctcagctcctggggctcctgctactctggctccgaggtgccagatgtgtcatccagatgacccagtctccatccctccctgtccncatctgtaggagacagagtcatcatcacttggccggnaagtcagncattagaacttatttaattggtatacaacaagaaaccgaggaaacgcccctagaacctcctgatctagtgttcatcctactttgntgaggtcgggtccatacgtaggttcagtggcagtgatcgagggacagtatcactcacacatcacctagtctgacgaggtctaggtagttatttcgacttaaccttttcttctacgtacctaacgtagtaacgtttactaccgtttaccctacttaccgtttccggcccgtacgggacctagttacggtcggtaattaacgtaacgaaaccgtacgtaggtacggtcctacggtaccaccgtacttccgttagttaccc

SEQ ID NO: 81613 - DNA, 535 bp, Homo sapiens
  misc_feature: GYAE6OF02IJ8NC.52.1.A01.1.454.CMB.1.raw
  modified_base (458)..(458): a, c, t, g, unknown or other
  misc_feature (458)..(458): n is a, c, g, or t
tcagcgcagtacgacacgaccggtgctcgatttagacgtctcatcaggggcacagcatggacatgagggtccccgctcagctcctggggctcctgctactctggctccgaggtgccagatgtgtcatccagatgacccagtctccatcctccctgtccgcatctgtaggagacagagtcatcatcacttgccgggcaagtcagagcattagaacgtatttaaattggtatcaacagaaaccagggaaacgcccctgaactcctgatctatggttcatcctactttgctgaggtcgggtccatcaaggttcagtggctagtgatcgtgggacagtattcactctcaccatccacctagtctgcaggctaggaggtattttgacttaacttcttcttgtacaatagtacttacacgttccctctaccgttcggaccctggacctagttagtggaacttanacgaaacgacgttgtgacctagacctacctacgttccttcgttaccttcgtacttcccgttacccgctactctaacg

SEQ ID NO: 81614 - DNA, 601 bp, Homo sapiens
  misc_feature: GYAE6OF02IKV21.52.1.A01.1.454.CMB.1.raw
tcagcgcagtacgacacgaccggtgctcgatttagacgtctcatcagggcgacagcgatggacattgagggtccccgctcaaggacggtcctggggcctcctgcttactctcggcctccgaggtgccagatgtgtcagtccaggataggacccagtctccatccctccctgtccgcatctgtaggagacagagtcatcatcacttgccggcaagtcagagcaattagaaacgttatttaaaattggtatcaaacagaaaccagggaaacgcccctagaactcctgatctatggtcactcctactttgctgagtcgggtcccagtctaaggttcagtggacgtagtggatcgtagggacaggtaacttcactctcaccatcaccagtctgcagctagaggtatttgacttaaacttcttactgtacaactagtacttactacgttccctcgtaccgtttcggcccgtacgggaccctaagttacggtaggtaacttaacgtaaccaaaaacgtacgttacggtgggtaccctcggtaaccctacctacgttccgttacgtcctttaccgacttttccctaccccggtacttacgtcttaacg

SEQ ID NO: 81615 - DNA, 553 bp, Homo sapiens
  misc_feature: GYAE6OF02HRYP0.52.1.A01.1.454.CMB.1.raw
tcagcgcagtacgacacgaccggtgctcgatttagacgtctcatcagggcacagcatggacatgagggtccccgctcagctcctggggctcctgctactctggctccgaggtgccagatgtgtcatccagatgacccagtctccatcctccctgtccgcatctgtaggagacagagtcatcatcacttgccgggcaagtcagagcattagaacgttatttaaattggtatacaacagaaaccagggaaacgcccctgaactcctgatctatggttacatcctactttgcgtgaggtcgggtccatcgtaaggttcagtggcagtggatcgtagggactagaatcactcactaccactcacacgtctgcaggctggtaggtatttgacttaactttacttcgtcgtacaactagtacgttactacggttccctactaccgtttcggcccgtagggacctagttagtgtaactatacaaagtaaccgtgtggactcgacctaccgtattccttcggttcttaccacgttcccgttccccgactacgttctaacgg

SEQ ID NO: 81616 - DNA, 522 bp, Homo sapiens
  misc_feature: GYAE6OF02ISGS6.52.1.A01.1.454.CMB.1.raw
  modified_base (216)..(216): a, c, t, g, unknown or other
  misc_feature (216)..(216): n is a, c, g, or t
tcagcgcagtacgacacgaccggtgctcgatttagacgtctcatcaggggggagtcagtctcagtcaggacacagcatggacatgagggtccccgctcagctcctggggctcctgctactctggctccgaggtgccagatgtgtcatccagatgacccagtctccatcctccctgtccgcatctgtaggagacagagtcatcatcacttgccgggnaagtcagagcattagaacgtatttaaattggtatcaacagaaaccaggaaacgcccctagaactcctgatctatggttcatccactttgctgagtcggggtccagtcaaggttcagtggcagtgatcgtggacagtatcactctcacctactcactagtctgcgaggctgaggttatttcgactaactttacttctcgtacaacgtagtacgttactacgtttccctcgtaccgtttccggcccgttagggacctagtagtaggtatactaaccaaacgtactgtgctgcctacacttcgtgttac

SEQ ID NO: 81617 - DNA, 621 bp, Homo sapiens
  misc_feature: GYAE6OF02IVHN8.52.1.A01.1.454.CMB.1.raw
  modified_base (488)..(488): a, c, t, g, unknown or other
  misc_feature (488)..(488): n is a, c, g, or t
tcagcgcagtacgacacgaccggtgctcgatttagacgtctcatcagggcacagcatggacatgagggtccccgctcagctcctggggctcctgctactctggctccgaggtgccagatgtgtcatccagatgacccagtctccatcctccctgtctgcatctagtaggagacagaatcacatcacttggccgggcgagtcgagacatagcatgtatctagtaattggtatcagaacgaaaaacgagggacacgtacccctaaactccgtagtactccgtacgatcgactactacctacgtttacggaaaccgcggggttacccaagtactaaagggttcgaaggtaggtaacggtcggcgtacggtaggaactagttacttttacgtcacttactcgagtacgacggctcgcagtctaggagtatagtcgaacaatacttaacttatcggaactaacgtagttaagtgtactacgttcctacccgtnttaccgtacggtttaccggggacggggtaccgaagggtaggtaacgtcgtaacgacggacggtaacgtcgggtacgtcggtacgacgtaccgtcgtttacggtccgtttacgtccttacgtcccgttaacccg

SEQ ID NO: 81618 - DNA, 537 bp, Homo sapiens
  misc_feature: GYAE6OF02HS56P.52.1.A01.1.454.CMB.1.raw
tcagcgcagtacgacacgaccggtgctcgatttagacgtctcatcaggggggagtcagtctcagtcaggacacagcatggacatgagggtccccgctcagctcctggggctcctgctactctggctccgaggtgccagatgtgtcatccagatgacccagtctccatcctccctgtccgcatctgtaggagacagagtcatcatcacttgccgggcaagtcagagcaattagaacgtatttaaattggtatacaacagaaaccgagggaaacgccctagaactcctgatctatggttcatcctatttgctgagtcggggtccatctaaggtcagtggcagtggatcgtggacagaatcactctacaccactacaccagtctgacaggctagaggtatttgactaactttctactgtacaacgtagtacgttactacgttccctacgtaccgtttccggcccgtagggtacccagtacgtaggtaatactaccgaaacgtacgtacggtggacctaggaccacctactccgtgttacc

SEQ ID NO: 81619 - DNA, 533 bp, Homo sapiens
  misc_feature: GYAE6OF02GK84B.52.1.A01.1.454.CMB.1.raw
  modified_base (370)..(370): a, c, t, g, unknown or other
  misc_feature (370)..(370): n is a, c, g, or t
tcagcgcagtacgacacgaccggtgctcgatttagacgtctcatcagggcacagcatggacatgagggtccccgctcagctcctggggctcctgctactctggctccgaggtgccagatgtgtcatccagatgacccagtctccatcctccctgtccgcatctgtaggagacagagtcatcatcacttgccgggcaagtcagagcattagaacgttatttaaatggtatcaacagaaaccagggaaacgcccctagaactcctgatctatggttcatccactttgctgagtgggtccatcaaggttcagtggcagtggatcgtgggacagacttcactctcacctatcactagtctgcaggctagaggtnttttgactaacttacttctcgtacaactagtacgttacctacgttccctactaccgtttccggcccgttagggaccctagttacggtacggtaatactacaaacgtactaggtgctagccaacctattccgttgtaccttcacttccttcccactactctacg

SEQ ID NO: 81620 - DNA, 540 bp, Homo sapiens
  misc_feature: GYAE6OF02I0P7X.52.1.A01.1.454.CMB.1.raw
  modified_base (362)..(362): a, c, t, g, unknown or other
  misc_feature (362)..(362): n is a, c, g, or t
tcagcgcagtacgacacgaccggtgctcgatttagacgtctcatcaggggggagtcagtctcagtcaggacacagcatggacatgagggtccccgctcagctcctggggctcctgctactctggctccgaggtgccagatgtgtcatccagatgacccagtctccatcctccctgtccgcatctgtaggagacagagtcatcatcacttgccgggcaagtcagagcattagaacgtatttaaatggtatcaacagaaaccagggaaacgccctagaactcctgatctatggttcatcctatttgcttgaggtcggggtccatcgaaggttcagtggcagtgatctgggacagaattcactcncaccatcaccagtctgcaggtctgagtatttgacttaacttcttctgtacaacagtacgttacacgtttccctctaccgtttccggcccgttagggaccgtagttcggtaggtactaacgttaaccgaaagtaccgttaggtacggtactacggacctaacctagttccgttgttacc

SEQ ID NO: 81621 - DNA, 549 bp, Homo sapiens
  misc_feature: GYAE6OF02FT5S9.52.1.A01.1.454.CMB.1.raw
tcagcgcagtacgacacgaccggtgctcgatttagacgtctcatcagggcacagcatggacatgagggtccccgctcagctcctggggctcctgctactctggctccgaggtgccagatgtgtcatccagatgacccagtctccatcctccctgtccgcatctgtaggagacagagtcatcatcacttgccgggcaagtcagagcattagaacgtatttaaattggtatcaacagaaaccagggaaacgcccctagaactcctgatctatggttcatccactttgctgagtcggggtccatcgaaggttcagtggcagtggatcgtgggacagtaattcactctcaccatccacagtctgcaggctgagtattttgactaactttacttctgtacaacgtaggtactacgttcctctaccttccggtcccgtcggtacgtacgtagttacggtagtaactacgaaacgtaacgtacgtgtcgtcgacgtacctactacttcgttcctttactaccgttaccgttccccgtacccgtaccttctagtacg

SEQ ID NO: 81622 - DNA, 560 bp, Homo sapiens
  misc_feature: GYAE6OF02HW1PY.52.1.A01.1.454.CMB.1.raw
  modified_base (171)..(171): a, c, t, g, unknown or other
  misc_feature (171)..(171): n is a, c, g, or t
  modified_base (195)..(195): a, c, t, g, unknown or other
  misc_feature (195)..(195): n is a, c, g, or t
  modified_base (522)..(522): a, c, t, g, unknown or other
  misc_feature (522)..(522): n is a, c, g, or t
tcagcgcagtacgacacgaccggtgctcgatttagacgtctcatcagggcacagcatggacatgagggtccccgctcagctcctggggctcctgctactctggctccgaggtgccagatgtgtcatccagatgacccagtctccactcctccctgtccgcatctgtagganacagagtcatcatcacttgccggnaagtcagagcattagaacgtatttaaagtggtatcaaacagaaaaccgagggaaacgcccctagaactcctgatactatgttcactcctacttgctgaggtcgggtccagtcgtaaggttcagtggcaggtggatcgtggacagtacttcactcacacactccactgtctgacgagctgtaggttatttcgacttaactttacttctacgtacaaagtacgtacgttacgtaccgttccctacgttaccgtttcggacccgttagggaccctaagttaggtacgtattaacgtaacgaaacgtaactggtacgtctcggactacctntccttcgttcctactcttccgttcccgactctcgtacg

SEQ ID NO: 81623 - DNA, 590 bp, Homo sapiens
  misc_feature: GYAE6OF02GQZ5I.52.1.A01.1.454.CMB.1.raw
  modified_base (198)..(198): a, c, t, g, unknown or other
  misc_feature (198)..(198): n is a, c, g, or t
  modified_base (218)..(218): a, c, t, g, unknown or other
  misc_feature (218)..(218): n is a, c, g, or t
  modified_base (396)..(396): a, c, t, g, unknown or other
  misc_feature (396)..(396): n is a, c, g, or t
tcagcgcagtacgacacgaccggtgctcgatttagacgtctcatcagggggggagtcagtctcagtcaggacacagcatggacatgagggtccccgctcagctcctggggctcctgctactctggctccgaggtgccagatgtgtcatccagatgacccagtctccatccctccctgtccgcatctgtaggagacagngtcatcatcacttgccgggnaagtcagagctattagaacgtatttaaattggtatcaacagaaaccaggggaaacgccccctagaacctcccgtagatactatcggttacatcctactttgcttggaggtcggggtccctatcgtaaggttcagtggacagtggatcgtagggacagaattcactctccactatcacngtctgctaggctaggagttatttcgactaacctttcttctcgtacaacgtagtacgtttacgacttaccccttacgtaccgtttaccggcccgttacgggaaccttacgtgggttaacggtacttaacgtaacctaaaccggtaagttggttacggtaccttcggacctacccctagttaccgtcgtttacccg

SEQ ID NO: 81624 - DNA, 591 bp, Homo sapiens
  misc_feature: GYAE6OF02II224.52.1.A01.1.454.CMB.1.raw
  modified_base (195)..(195): a, c, t, g, unknown or other
  misc_feature (195)..(195): n is a, c, g, or t
tcagcgcagtacgacacgaccggtgctcgatttagacgtctcatcagggcacagcatggacatgagggtccccgctcagctcctggggctcctgctactctggctccgaggtgccagatgtgtcatccagatgacccagtctccatcctccctgtccgcatctgtaggagacagagtcatcatcacttgccgggnaagtcagagcattagaacgttatttaaattggtatcaaacagaaaccaagggaaacgcccctagaactcctgatctatcggttcatcctactttgctgagtggggtccatcaagttcagtgcagtgatcgtgggacagacttcactctacaccatacacctagtctcgcaggctggagtatttgactaacttactcgttagtacaactaagtagttactacgtttccctctaccgtttccggcccttacgggtacctacgttaggttacgtaattaacgtacgtaaaaaccgtacgttacggtacggtacctggaccctaaccgtacgttcccgttacggtttaccctttaccgtacctttcccgttacccccggtcccttacgttccgttaacgg

SEQ ID NO: 81625 - DNA, 767 bp, Homo sapiens
  misc_feature: GYAE6OF02JU14M.52.1.A01.1.454.CMB.1.raw
tcagcgcagtacgacacgaccggtgctcgatttagacgtctcatcagggcacagcatggacatgagggtccccgctcagctcctgggctcctgctactctggctccgaggtgccagatgtgtcatccagatgacccagtctccatcctccctgtccgcagtctgtaggagacagagtcatcatcacttgccggcaagtcagagcattagaacgttatttaaagtggtatacaacgaagaaaccgagggaaacgtcccctagaaaccttccgtagtaacttcgtaattcggttacctaacgttcccgtaacttttcggtaccgtggtaacggttcggggttaccccagttaccgtaaagggttcctaaggtggaccgtaaggttggtaacgtcgtaacggggaactaagttaaacttccgtactacttaccaacccgtacgttaccgaaacccgtcgtcgttacgacctaagggtcttacgggtacgttattttaccggaccgttaaaccgttttacccgttcgttaaccgtaacgtaaccggtaaaggttaacggtttacctaacccgtttaccccgtaccgttaccggtttacccgggtaccccggtacggtaacccgtaaggtttaccggtaagggtaaccttaacttaaacccgggaagttaacccgttcggacgggttaacctccgtaaccgtaccgttagttaacccgttcgttacccgtttacaccgtttccccgttacccggactttcccgtacgttacg

SEQ ID NO: 81626 - DNA, 516 bp, Homo sapiens
  misc_feature: GYAE6OF02HDGAM.52.1.A01.1.454.CMB.1.raw
  modified_base (479)..(479): a, c, t, g, unknown or other
  misc_feature (479)..(479): n is a, c, g, or t
tcagcgcagtacgacacgaccggtgctcgatttagacgtctcatcagggcacagcatggacatgagggtccccgctcagctcctggggctcctgctactctggctccgaggtgccagatgtgtcatccagatgacccagtctccatcctccctgtccgcatctgtaggagacagagtcatcatcacttgccgggcaagtcagagcattagaacgtatttaaattggtatcaacagaaaccagggaaacgcccctagaacctcctagatctatggtcatccactttgctgaggtcgggtccatcgaaggttcagtggcgaggtggatcgtagggacagtaacttcaactctacaccatcacagtctgcgaggtctagaggtatttgactaacttactctagtacaatagtagttactagttccctataccttcggcctggacctagtagtgatatacaaacgactgtcgctacgcacctntctcgttcttactacttccgttcccacttactgtacg

SEQ ID NO: 81627 - DNA, 680 bp, Homo sapiens
  misc_feature: GYAE6OF02IE84O.52.1.A01.1.454.CMB.1.raw
  modified_base (180)..(180): a, c, t, g, unknown or other
  misc_feature (180)..(180): n is a, c, g, or t
  modified_base (221)..(221): a, c, t, g, unknown or other
  misc_feature (221)..(221): n is a, c, g, or t
  modified_base (424)..(424): a, c, t, g, unknown or other
  misc_feature (424)..(424): n is a, c, g, or t
  modified_base (517)..(517): a, c, t, g, unknown or other
  misc_feature (517)..(517): n is a, c, g, or t
tcagcgcagtacgacacgaccggtgctcgatttagacgtctcatcaggggggagtcagtctcagtcaggacacagcatggacatgagggtccccgctcagctcctggggctcctgctactctggctccgaggtgccagatgtgtcatccagatgacccagtctccatcctccctgtccanatcgtggtaggagacagagtcatcatcacgttggccggganaagtcagagctaagttagaacgttaatttaaattggtatacaacaagaaaaccgaagggaaacgccctacgaaactcccgtagactcgttaagtcggttacctaactcctaacgttttgcgttagtacgggttacggggtaccctaagtacgtaaacggtttcgtaggtaggtacgaaggttgggtatacgggtacggggaanaaacgtaactttcacttcctaccactacgtctaaccgtattaccgtgaccgtagggtctaggtagtttactttcgaacttaacgtttaccttntacgaactaacgtagttaacgttacctaccgtttaccctactttacccggttaccggtcccgtaacgggtaaccttagttagggttacgtacttaaaccgtaacgtaaacgtacgttcggttacggtcgtaacgtcccaaacctttcgtttaccgttattacc

SEQ ID NO: 81628 - DNA, 545 bp, Homo sapiens
  misc_feature: GYAE6OF02IGKVZ.52.1.A01.1.454.CMB.1.raw
  modified_base (231)..(231): a, c, t, g, unknown or other
  misc_feature (231)..(231): n is a, c, g, or t
  modified_base (318)..(318): a, c, t, g, unknown or other
  misc_feature (318)..(318): n is a, c, g, or t
  modified_base (326)..(326): a, c, t, g, unknown or other
  misc_feature (326)..(326): n is a, c, g, or t
  modified_base (347)..(347): a, c, t, g, unknown or other
  misc_feature (347)..(347): n is a, c, g, or t
tcagcgcagtacgacacgaccggtgctcgatttagacgtctcatcagggcacagcatggacatgagggtccccgctcagctcctggggctcctgctactctggctccgaggtgccagatgtgtcatccagatgacccagtctccatcctcctgtccgcatctgtaggagacagagtcatcatcacttgccggcaagtcagagcattagaacgtatttaaattggtatcaanagaaaccgaggaaacgccctgaactcctgatctattggttcatcctactttgctggtgtcgggtccatcaaggttcagtggcagtgntcgtgganagaatcactctacacatcacngtctgctaggctacgaggtatttacgactaaacttcttcgtcgtacaacagtattacacgttcctactacgtttcggacccttagggacctagtaggttacgacttacgtaacgtaaacgtatacggttacgctcgaactacccttattccgttacgttaccttctaacgttcccttcccggaacttcgttacttacg

SEQ ID NO: 81629 - DNA, 630 bp, Homo sapiens
  misc_feature: GYAE6OF02I2TZZ.52.1.A01.1.454.CMB.1.raw
  modified_base (180)..(180): a, c, t, g, unknown or other
  misc_feature (180)..(180): n is a, c, g, or t
  modified_base (191)..(191): a, c, t, g, unknown or other
  misc_feature (191)..(191): n is a, c, g, or t
  modified_base (225)..(225): a, c, t, g, unknown or other
  misc_feature (225)..(225): n is a, c, g, or t
  modified_base (274)..(274): a, c, t, g, unknown or other
  misc_feature (274)..(274): n is a, c, g, or t
tcagcgcagtacgacacgaccggtgctcgatttagacgtctcatcaggggggagtcagtctcagtcaggacacagcatggacatgagggtccccgctcagctcctggggctcctgctactctggctccgaggtgccagatgtgtcatccagatgacccagtctccatcctccctgtccgnatctgtagganacagagtcatcatcacttggccggcaagtcaganctattagaacgtatttaaattggtatacaaacaagaaaccgaggaaacncccctagaactcctgactcgtatggttcatcctactttgctggaggtcggggtccatcaaggttcagtggctagtgatcgtagggacagtaacttacaccttactacacctaactccacctagtctacgcacgggtcttacggaggtttacgttttcgaccgttaaccttttacttcccgttagtaacctaaaccgtaagttaacgtttacctacgtttaccccttaccgttaccgtttttacccgggcccgttacggggaccctaagttacggtaggttaacgtaactaaccgtaaaacggtaacgttacggtaggtacccttggaccctaacctacgtttaccgtggtttaccc

SEQ ID NO: 81630 - DNA, 504 bp, Homo sapiens
  misc_feature: GYAE6OF02JHZWA.52.1.A01.1.454.CMB.1.raw
  modified_base (494)..(494): a, c, t, g, unknown or other
  misc_feature (494)..(494): n is a, c, g, or t
tcagcgcagtacgacacgaccggtgctcgatttagacgtctcatcagggcacagcatggacatgagggtccccgctcagctcctggggctcctgctactctggctccgaggtgccagatgtgtcatccagatgacccagtctccatcctccctgtccgcatctgtaggagacagagtcatcatcacttgccgggcaagtcagagcattagaacgttattaaattggtatcaacagaaaccaggaaagcccctagaactcctgatctatggttcatccacttgctgagtcgggtccatcaaggttcagtggcagtggatcgtgggacagaattcactctacacatccacagtctgcagctgagtatttgactaactttacttctacgtacaactagtacgttactacgttccctactacgtttccgccgtcggacagtgtagatactacaaacgactggtcgctcgcactatctcgttcttcacttccgtacccnctactcgtac

SEQ ID NO: 81631 - DNA, 630 bp, Homo sapiens
  misc_feature: GYAE6OF02F9O56.52.1.A01.1.454.CMB.1.raw
tcagcgcagtacgacacgaccggtgctcgatttagacgtctcatcagggcacagcatggacatgagggtccccgctcagctcctggggctcctgctactctggctccgaggtgccagatgtgtcatccagatgacccagtctccatcctccctgtccgcatctgtaggagacagagtcatcatcacttgccgggcaagtcagagcattagaacgtatttaaattggtatcaacagaaaccagggaaagcccctgaactcctgatctatggttcatccactttgctgagtgggtccatcaaggttcagtggcagtggatcgtgggacagaattcactctcaccatcaccagtctgcgaggctgaggtattttgactaaactttacttctagttaccaaacgtaagtacgtttaaccgtacggtttccccttaccttaaccgttttcccgggaccccgttacggggtaaccctaagtttaaccggtagggtaacttaacgtaccgaaaaaccggtaaccttacgggttacgggtccttacgggtccctaacccgtaagttcccgttacggtttacctttaccgaacgtttccccgtttacccccggtacccgttaccgttcccgtttaacgg

SEQ ID NO: 81632 - DNA, 580 bp, Homo sapiens
  misc_feature: GYAE6OF02IA6A2.52.1.A01.1.454.CMB.1.raw
tcagcgcagtacgacacgaccggtgctcgatttagacgtctcatcaggggggagtcagtctcagtcaggacacagcatggacatgagggtccccgctcagctcctggggctcctgctactctggctccgaggtgccagatgtgtcatccagatgacccagtctccatcctccctgtccgcatctgtaggagacagagtcatcatcacttgccgggcaagtcagagcattagaacgttatttaaattggtatcaacaagaaaccagggaagcccctagaactcctgatctatgtcatcctactttgctgagtcggggtcccatcgaagttccagtgcagtggatcgtgggaacagtaacttcacttctacacctataccaccagttcctcgcgaggctcggtaggttacttttgaccttaactttacttctagtaaccaaagcgtaacggtttacctaacggtttccccttcgttaaccgttttcccggcccgttacgggtaaccctagttacgtacggtaattaacgttaaccgaaacgtacgttggtacggtctcgacctaccgtattccgtgttaccc

SEQ ID NO: 81633 - DNA, 491 bp, Homo sapiens
  misc_feature: GYAE6OF02FPDCZ.52.1.A01.1.454.CMB.1.raw
  modified_base (327)..(327): a, c, t, g, unknown or other
  misc_feature (327)..(327): n is a, c, g, or t
  modified_base (349)..(349): a, c, t, g, unknown or other
  misc_feature (349)..(349): n is a, c, g, or t
  modified_base (352)..(352): a, c, t, g, unknown or other
  misc_feature (352)..(352): n is a, c, g, or t
  modified_base (354)..(354): a, c, t, g, unknown or other
  misc_feature (354)..(354): n is a, c, g, or t
  modified_base (357)..(357): a, c, t, g, unknown or other
  misc_feature (357)..(357): n is a, c, g, or t
  modified_base (363)..(363): a, c, t, g, unknown or other
  misc_feature (363)..(363): n is a, c, g, or t
  modified_base (437)..(437): a, c, t, g, unknown or other
  misc_feature (437)..(437): n is a, c, g, or t
  modified_base (464)..(464): a, c, t, g, unknown or other
  misc_feature (464)..(464): n is a, c, g, or t
  modified_base (480)..(480): a, c, t, g, unknown or other
  misc_feature (480)..(480): n is a, c, g, or t
tcagcgcagtacgacacgaccggtgctcgatttagacgtctcatcagggcacagcatggacatgagggtccccgctcagctcctggggctcctgctactctggctccgaggtgccagatgtgtcatccagatgacccagtctccatcctccctgtccgcatctgtaggagacagagtcatcatcacttgccggcaagtcagagcattagaacgtatttaaatggtatcaacagaaacaggaacgcccctagaactcctgatctatgttcatcctactttgctgagtcggggtcctagtcgaggttcagtggcagtggatcgtggganagtaatcactctcactatcacntcngnagntgagtntttgactacttatctgtacatagtacgttactcgttccctctacgttcgccgtaggtacctagtacgtgattanacaaacgtactgtcgctgcacagtctntctctcttccgtcccncgtactctacg

SEQ ID NO: 81634 - DNA, 610 bp, Homo sapiens
  misc_feature: GYAE6OF02HXSKF.52.1.A01.1.454.CMB.1.raw
  modified_base (202)..(202): a, c, t, g, unknown or other
  misc_feature (202)..(202): n is a, c, g, or t
  modified_base (247)..(247): a, c, t, g, unknown or other
  misc_feature (247)..(247): n is a, c, g, or t
  modified_base (259)..(259): a, c, t, g, unknown or other
  misc_feature (259)..(259): n is a, c, g, or t
tcagcgcagtacgacacgaccggtgctcgatttagacgtctcatcagggcacagcatggacatgagggtccccgctcagctcctggggctcctgctactctggctccgaggtgccagatgtgtcatccagatgacccagtctccatcctcctgtccgcatctgtaggagacagagtcatcatcacttgccggcaagtcaganctattagaacgttatttaatggtatacaacagaaaccagggaacnccctagactccngatctatgtcatcctactttgctgagtcgggtcctagtcgaaggttcagtcgactagcgtatcgtaggacagtaattcgactctcacctatccaactgtctcgactacggtctggaggtttactttaggacttaacttacttcgtagttaccaaacgtacgttacgttacttaccgttcccttacgtacccgtttcggaccccgtacgggtaccctaagtacggtaacggtaactttacgaaaccgtaaaccgtaacgttcggtacggtccttacgaacccttaccgtaacttcctttacggtcctttacctacgtcccctttccccggacccttccgttaccgtaaccgg

SEQ ID NO: 81635 - DNA, 598 bp, Homo sapiens
  misc_feature: GYAE6OF02HNQKI.52.1.A01.1.454.CMB.1.raw
  modified_base (203)..(203): a, c, t, g, unknown or other
  misc_feature (203)..(203): n is a, c, g, or t
  modified_base (249)..(249): a, c, t, g, unknown or other
  misc_feature (249)..(249): n is a, c, g, or t
  modified_base (350)..(350): a, c, t, g, unknown or other
  misc_feature (350)..(350): n is a, c, g, or t
  modified_base (354)..(354): a, c, t, g, unknown or other
  misc_feature (354)..(354): n is a, c, g, or t
  modified_base (359)..(359): a, c, t, g, unknown or other
  misc_feature (359)..(359): n is a, c, g, or t
tcagcgcagtacgacacgaccggtgctcgatttagacgtctcatcagggcacagcatggacatgagggtccccgctcagctcctggggctcctgctactctggctccgaggtgccagatgtgtcatccagatgacccagtctccatcctccctgtccgcatctgtaggagacagagtcatcatcacttgccgggcaagtcagngcattagaacgttatttaaatggtatcaacagaaaccagggaaacncccctagaactcctgatctatggttcatcctacttgctgaggttcgggccatcgtaaggttcaggtggacaggtggactcgtgggacagaacttcacgtcncacntcacngtctgcagctagtagtatttcgacttaacttacgttctagtacaacgtagttacgttaaccgtacgttacccttctacccgttttccggacccgttacgggtaaccctagttaacggtacggtaacttacgtaacccgaaaacgttacgttcggtaggtccttacggcctaaccgagtttccttacggttacctttacctaccgtttccccttacccggacccttacgtaccgttaacg

SEQ ID NO: 81636 - DNA, 632 bp, Homo sapiens
  misc_feature: GYAE6OF02JYAWW.52.1.A01.1.454.CMB.1.raw
  modified_base (160)..(160): a, c, t, g, unknown or other
  misc_feature (160)..(160): n is a, c, g, or t
  modified_base (194)..(194): a, c, t, g, unknown or other
  misc_feature (194)..(194): n is a, c, g, or t
  modified_base (203)..(203): a, c, t, g, unknown or other
  misc_feature (203)..(203): n is a, c, g, or t
  modified_base (232)..(232): a, c, t, g, unknown or other
  misc_feature (232)..(232): n is a, c, g, or t
  modified_base (248)..(248): a, c, t, g, unknown or other
  misc_feature (248)..(248): n is a, c, g, or t
  modified_base (254)..(254): a, c, t, g, unknown or other
  misc_feature (254)..(254): n is a, c, g, or t
  modified_base (375)..(375): a, c, t, g, unknown or other
  misc_feature (375)..(375): n is a, c, g, or t
tcagcgcagtacgacacgaccggtgctcgatttagacgtctcatcagggcacagcatggacatgagggtccccgctcagctcctggggctcctgctactctggctccgaggtgccagatgtgtcatccagatgacccagtctccatccctccctgtccgnatctgtaggagacagagtcatcatcactgccggnaagtcaganctatagaacgtatttaaagtgtatacaanaagaaaccagggaacnccctanaactctgatctagtgtcatctacttgctggagtcgggtccatcgaaggtcagtcggacaggtggtactcgtaggaactaagtacttacgacttcgtacacctacgtacctaccaggttccncgtacgtacggtgtacggtagtttaacgtttacgttaactttaccttcgttagtaccgaaacgtagttaaccgtttacgtaacgttccccgttacgttaccgtttcccggaccggttacgtacccgtaagttacgtaggtaacttacgtaaccgaaacgttacgtacgtcggtacctagtacccgtctaacttaccgttcgttaaaccttccgttaaccgttcccgttaacccgtctaccgttacggtacttaacgg

SEQ ID NO: 81637 - DNA, 714 bp, Homo sapiens
  misc_feature: GYAE6OF02HKSQ4.52.1.A01.1.454.CMB.1.raw
  modified_base (216)..(216): a, c, t, g, unknown or other
  misc_feature (216)..(216): n is a, c, g, or t
tcagcgcagtacgacacgaccggtgctcgatttagacgtctcatcaggggggagtcagtctcagtcaggacacagcatggacatgagggtccccgctcagctcctggggctcctgctactctggctccgaggtgccagatgtgtcatccagatgacccagtctccatcctccctgtccgcatctgtaggagacagagtcatcatcacttgccgggnaagtcagagcattaagaacgttaatttaaagttggtatacaaacaacgaaaaccgaagggaaacgcccctagaacctcctagactctatggttcactcctactttgcgtggtaggtcgggtaccagtacgtaaggttcgaggtcggacgtaggtggtactcggtgggaactaagtaactttacgacttcctaccaactactaccgaacctagtcctcgacgtacggcgtagggtaggttacttttacgaccttaaccttttacgttacgttacgtaacctaaacgtaacggttaacgtttaccgtacccgttttaccccgttaaccgtttaccccggttttacccgggtaccccgttaccggggtaacccttacgggttacggttacggttaacgttaaaccgtaaacccggttaaaaccgttaacggttccgggttaacgggtacccttacgggtaaccccttaacccgttacgtttaccgttacccgttttaaccc

SEQ ID NO: 81638 - DNA, 581 bp, Homo sapiens
  misc_feature: GYAE6OF02GJQ6F.52.1.A01.1.454.CMB.1.raw
tcagcgcagtacgacacgaccggtgctcgatttagacgtctcatcagggcacagcatggacatgagggtccccgctcagctcctggggctcctgctactctggctccgaggtgccagatgtgtcatccagatgacccagtctccatcctccctgtccgcatctgtaggagacagagtcatcatcacttgccgggcaagtcagagcattagaacgttattttaaattggtatacaacaagaaaccgaagggaaacgcccctagaacctcctagatctatggttcatcctactttgctggaggtcggggtcccagtacgtaaggttcaggtcggacaggtcggtatcgtgggactaggtaattcactctacaccatccacagtctgcgagctagaggttatttgacttaactttcttctagtacaacgtagtacgttactacgttccctactaccgtttccggccgttcggacctagttacggtagtatactaacgaaacgtactggtacgtcgtacgaccgtactacgttcgttccgtttacttacttaccgtttcccgttccccgtcgttacctcgttaag

SEQ ID NO: 81639 - DNA, 522 bp, Homo sapiens
  misc_feature: GYAE6OF02G5DC5.52.1.A01.1.454.CMB.1.raw
  modified_base (254)..(254): a, c, t, g, unknown or other
  misc_feature (254)..(254): n is a, c, g, or t
  modified_base (363)..(363): a, c, t, g, unknown or other
  misc_feature (363)..(363): n is a, c, g, or t
  modified_base (425)..(425): a, c, t, g, unknown or other
  misc_feature (425)..(425): n is a, c, g, or t
  modified_base (488)..(488): a, c, t, g, unknown or other
  misc_feature (488)..(488): n is a, c, g, or t
  modified_base (495)..(495): a, c, t, g, unknown or other
  misc_feature (495)..(495): n is a, c, g, or t
tcagcgcagtacgacacgaccggtgctcgatttagacgtctcatcagggcacagcatgcacatgagggtccccgctcagctcctggggctcctgctactctggctccgaggtgccagatgtgtcatccagatgacccagtctccatccctccctgtccgcatctgtaggagacagagtcatcatcacttgccgggcaagtcagagcattagaacgttatttaaagttggtatacaacaagaaaccagggaaacnccctagaactcctgatctatgttcatcctattgctggaggtcgggtccagtacgtaaggttcaggtggcgaggtggatcgtaggacagtaattcactctcaccatcacngtctgacagctgtagtatttcgactacttactctgtacaagtagtacttactcgttaccctntaccgttccgaccgtcggactagtgtagactataacaaagtcgtaggcgtctacgaccacgtnttacgtnttacttactcttcccgtccactatacg

SEQ ID NO: 81640 - DNA, 579 bp, Homo sapiens
  misc_feature: GYAE6OF02GN43L.52.1.A01.1.454.CMB.1.raw
  modified_base (567)..(567): a, c, t, g, unknown or other
  misc_feature (567)..(567): n is a, c, g, or t
tcagcgcagtacgacacgaccggtgctcgatttagacgtctcatcagggcacagcatggacatgagggtccccgctcagctcctggggctcctgctactctggctccgaggtgccagatgtgtcatccagatgacccagtctccatcctccctgtccgcatctgtaggagacagagtcatcatcacttgccgggcaagtcagagcattagaacgttatttaaagttggtatcaacaagaaaccgaaggaaacgcccctagaactcctgatctatggttcactccacgtttgctggaggtcggggtccatcgaaggttcgagtggacgtagtggtagtcgtagggacaagtacttcactctacaccatccactacgtctgctagctggagttatttgaccttaactttaccttctcgtactaacgtagtacgttaactccgtttaccctaccgtaccgtttcccgggcccgttacgggaccctagttacgtacggtattactaacaaaacgtacgtgtacgctaggtaccaccgtattccgtattaccttctacgttcccgttacccncttactctaacg

SEQ ID NO: 81641 - DNA, 522 bp, Homo sapiens
  misc_feature: GYAE6OF02FJQ6U.52.1.A01.1.454.CMB.1.raw
  modified_base (480)..(480): a, c, t, g, unknown or other
  misc_feature (480)..(480): n is a, c, g, or t
tcagcgcagtacgacacgaccggtgctcgatttagacgtctcatcagggcacagcatggacatgagggtccccgctcagctcctggggctcctgctactctggctccgaggtgccagatgtgtcatccagatgacccagtctccatcctccctgtccgcatctgtaggagacagagtcatcatcacttgccgggcaagtcagagcattagaacgtatttaaatggtatcaacagaaaccagggaaacgcccctagaactcctgatctatggttacactccactttgctgacggtcggggtccatcgaaggttcaggtggcagtggatcgtgggacagaattcactctacacatccaccagtctgcaggctggagtactttgactaactttactctgtacaactgacttacgacttccctctaccgtttccggcctagggacctagtagtaggataactacgaaacgtacgtggtcgctanccactatcttcgtctacgtcttccgtcccgtctacttcgtag

SEQ ID NO: 81642 - DNA, 587 bp, Homo sapiens
  misc_feature: GYAE6OF02HBH48.52.1.A01.1.454.CMB.1.raw
  modified_base (284)..(284): a, c, t, g, unknown or other
  misc_feature (284)..(284): n is a, c, g, or t
  modified_base (473)..(473): a, c, t, g, unknown or other
  misc_feature (473)..(473): n is a, c, g, or t
tcagcgcagtacgacacgaccggtgctcgatttagacgtctcatcagggggggagtcagtctcagtcaggacacagcatggacatgagggtccccgctcagctcctggggctcctgctactctggctccgaggtgccagatgtgtcatccagatgacccagtctccatccctccctgtccgcatctgtaggagacagagtcatcatcacttcggccgggacaagtcagagctaattagaacgttaatttaaattggtaatacaacaagaaaaccgagggaaacncccctagaacctcctagatctatggttcatcctactttgcgtggaggtcgggtcccatcgtaaggttcgaggtggctaggtaggacttcggtagggaacaagtaacttccacttcctacaactactaccaccgtagtcctagacgtaggctaggaggttatttcgacttaactttatctagtacctaanagtacgttactacgttccctcgtacctttccggacccgttaggacctagtcgtagtaactaacgtaacaaaccgtagttcgtagggtactacggaccctacgacttctagttcc

SEQ ID NO: 81643 - DNA, 642 bp, Homo sapiens
  misc_feature: GYAE6OF02JQNLA.52.1.A01.1.454.CMB.1.raw
  modified_base (201)..(201): a, c, t, g, unknown or other
  misc_feature (201)..(201): n is a, c, g, or t
tcagcgcagtacgacacgaccggtgctcgatttagacgtctcatcagggcacagcatggacatgaggtccccgctcagctcctgggctcctgctactctggctccgaggtgccagatgtgtcatccagatgacccagtctccatcctccctgtccgcatctgtaggagacagagtcatcatcacgttgccggcaagtcagnagactagtaagtaacgttaatttaagttagtagtacaacgaacgaaacgaacggaacgaccgtacgtactacgtagtacgtacgtacgttacgttactactaccgtacgttcgtacgtacggtacggtacggtacgtacgtacgtacgtacgtaggtagtacgtagtagtacgtacgtacggtacgtacgtaactactactactacactactacgtacgtacgtacgtacgtacgacgtacgtagtagttacgttacgtacgttacgttacttacgtacgtacgtaacgtacgtacgttacgttacgttacctacgttaccgttaccgtaccgtacgtacgtacgtacgtagtacgtacgtaacgtaacgtacgtacgtacgtacgtctactacgtactacgtacgttacttactacttaccgtaccgtaccgtacgtacg

SEQ ID NO: 81644 - DNA, 685 bp, Homo sapiens
  misc_feature: GYAE6OF02JK3DJ.52.1.A01.1.454.CMB.1.raw
tcagcgcagtacgacacgaccggtgctcgatttagacgtctcatcagggcacagcatggacatgagggtccccgctcagctcctggggctcctgctactctggctccgaggtgccagatgtgtcatccagatgacccagtctccatcctccctgtccgcatctgtaggagacagagtcatcatcacttgccggcaagtcagagctaattagaacgttatttaattggtatacaaacagaaaccgaaggaacgcccctagaacctcctagtacttactagtggttactacttcctactttgcgtggtaggtcgggtccagtacgtaacggttcaggtggacaggtcgtatcgtaggaacgtataacgttaccacgttcctaccaaccgtataccctaacgtacgttccgtcgacgacggtactagggtaacgttacgttttacgaaccttaaacctttacgtttacttaccgtaaccgtaacgtacgttaaacgtttaccgttaccgttacccctttacgttaccggttttccggacccgtttagggaccttagtacggtacgtaacttaacgaaccgtaaacgtacgttggttacgtaccgtacgtaccctaactacgtttccgttaccggtttaccttaccgttaccgttccccgtttacccgaccgtttattacccggttaag

SEQ ID NO: 81645 - DNA, 635 bp, Homo sapiens
  misc_feature: GYAE6OF02IPE8Q.52.1.A01.1.454.CMB.1.raw
  modified_base (204)..(204): a, c, t, g, unknown or other
  misc_feature (204)..(204): n is a, c, g, or t
  modified_base (246)..(246): a, c, t, g, unknown or other
  misc_feature (246)..(246): n is a, c, g, or t
tcagcgcagtacgacacgaccggtgctcgatttagacgtctcatcagggcacagcatggacatgagggtccccgctcagctcctggggctcctgctactctggctccgaggtgccagatgtgtcatccagatgacccagtctccatcctccctgtccgcatctgtaggagacagagtcatcatcacttggccggcaagtcagancattagaacgttattaaatggtatcaacagaaaccaggaacncccgtagaactctagatctatggttcactcacttgctgaggtcgggtccagtcgaaggttcagtggctagtggatcgtggacagtattcgacttcgtacaccgtactaccaccgacgtctacgcgaggtctaggtaggttagtttacgaccttaaacttaccgttctacggtacctaaacgttaacgtaacggtttacgtaccggtttaccccttacgtaaccggttttcccgggtacccgttacggggtaacctaagggttaacggttacggtaagttaacgtaaacccgaaacggtacctgggtacgtacctcggaacctaccgtacgttaccgtcggtttaccttacgtaaccttcccgtttacccgaccttcgttaccgttacgg

SEQ ID NO: 81646 - DNA, 543 bp, Homo sapiens
  misc_feature: GYAE6OF02HFOG4.52.1.A01.1.454.CMB.1.raw
  modified_base (523)..(523): a, c, t, g, unknown or other
  misc_feature (523)..(523): n is a, c, g, or t
tcagcgcagtacgacacgaccggtgctcgatttagacgtctcatcagggggggagtcagtctcagtcaggacacagcatggacatgagggtccccgctcagctcctggggctcctgctactctggctccgaggtgccagatgtgtcatccagatgacccagtctccatcctccctgtccgcatctgtaggagacagagtcatcatcacttgccggcaagtcagagcattagaacgttatttaaattggtatacaacaagaaaccgagggaaacgcccctagaacctcctagattctatggttcatcctactttgctggaggtcggggtacccatcgaaggttcaggtggcaggtgatcgtagggacagaattcactctacaccactcaccagtctagcaggtctaggtagttatttcgacttaactttactcttgtacaactagtagttactacgttcctacttaccgtttcgcccgttagggacctagtagtgtactacgtacgaaactacgtgtcggctanccgacctagttctcgttacc

SEQ ID NO: 81647 - DNA, 503 bp, Homo sapiens
  misc_feature: GYAE6OF02F4KKC.52.1.A01.1.454.CMB.1.raw
  modified_base (217)..(217): a, c, t, g, unknown or other
  misc_feature (217)..(217): n is a, c, g, or t
  modified_base (344)..(344): a, c, t, g, unknown or other
  misc_feature (344)..(344): n is a, c, g, or t
  modified_base (348)..(348): a, c, t, g, unknown or other
  misc_feature (348)..(348): n is a, c, g, or t
  modified_base (401)..(401): a, c, t, g, unknown or other
  misc_feature (401)..(401): n is a, c, g, or t
tcagcgcagtacgacacgaccggtgctcgatttagacgtctcatcaggggggagtcagtctcagtcaggacacagcatggacatgagggtccccgctcagctcctggggctcctgctactctggctccgaggtgccagatgtgtcatccagatgacccagtctccatccctccctgtcccgcatctgtaggagacagagtcatcatcacttgccggnaagtcagagcattagaacgtatttaaattggtatcaacagaaaccagggaaacgcccctagaactcctgatctatggtcatccactttgctgagtcggggtccatcaaggttcagtggcagtgatcngganagatcactctcaccatcacagtctgcaggctgagtatttgctaacttcttctntacaacagtattactacttccctctactttcggaccctggtacctagtagtcggataatacgaaacgtacttgtacgtactcgacctacgtcttctgttacc

SEQ ID NO: 81648 - DNA, 573 bp, Homo sapiens
  misc_feature: GYAE6OF02G8EAI.52.1.A01.1.454.CMB.1.raw
  modified_base (372)..(372): a, c, t, g, unknown or other
  misc_feature (372)..(372): n is a, c, g, or t
  modified_base (383)..(383): a, c, t, g, unknown or other
  misc_feature (383)..(383): n is a, c, g, or t
tcagcgcagtacgacacgaccggtgctcgatttagacgtctcatcagggcacagcatggacatgagggtccccgctcagctcctggggctcctgctactctggctccgaggtgccagatgtgtcatccagatgacccagtctccatcctccctgtccgcatctgtaggagacagagtcatcatcacttgccgggcaagtcagagcattaagaacgttatttaaatggtatcaacaagaaaccgagggaaacgcccctagaactcctagatctagtggttcactcctactttgctggtaggtcgggtcccagtcgaaggttcaggtaggcgaggtgatcgtgggacagtaattcactctcacatacacagtcngcagctgagtntttcgactaacttactctatacaatagtacttacgacgtttccctactaccgttttccggacccgttcgggacctaagttacggtagtaacttaacgtaccgaaaacgtaccgttggcgtactacgtccaaccgttattcccgttgtttacccgttactaccgtttcccttccccgtactaccttgtacg

SEQ ID NO: 81649 - DNA, 513 bp, Homo sapiens
  misc_feature: GYAE6OF02FT6AZ.52.1.A01.1.454.CMB.1.raw
  modified_base (217)..(217): a, c, t, g, unknown or other
  misc_feature (217)..(217): n is a, c, g, or t
  modified_base (272)..(272): a, c, t, g, unknown or other
  misc_feature (272)..(272): n is a, c, g, or t
  modified_base (399)..(399): a, c, t, g, unknown or other
  misc_feature (399)..(399): n is a, c, g, or t
  modified_base (509)..(509): a, c, t, g, unknown or other
  misc_feature (509)..(509): n is a, c, g, or t
tcagcgcagtacgacacgaccggtgctcgatttagacgtctcatcagggggggagtcagtctcagtcaggacacagcatggacatgagggtccccgctcagctcctggggctcctgctactctggctccgaggtgccagatgtgtcatccagatgacccagtctccatcctccctgtccgcatctgtaggagacagagtcatcatcacttgccgggnaagtcagagcattagaacgtatttaaattggtatacaacagaaaccagggaaacncccctagaacctcctgatctatggttcatccactttgctgagtcggggtccagtcaaggttcagtggcaggtggatcgtagggacagtaattcactctcacctatcaccagtctgcaggctgaggtntttgacttaacttacttctagtacaactagtacttactacgttccctctactttccggccctgggacctatagtagataactacaaacgtattgtgctcgacactatctnttcc

SEQ ID NO: 81650 - DNA, 516 bp, Homo sapiens
  misc_feature: GYAE6OF02H9TFV.52.1.A01.1.454.CMB.1.raw
  modified_base (96)..(96): a, c, t, g, unknown or other
  misc_feature (96)..(96): n is a, c, g, or t
  modified_base (191)..(191): a, c, t, g, unknown or other
  misc_feature (191)..(191): n is a, c, g, or t
  modified_base (200)..(200): a, c, t, g, unknown or other
  misc_feature (200)..(200): n is a, c, g, or t
  modified_base (216)..(216): a, c, t, g, unknown or other
  misc_feature (216)..(216): n is a, c, g, or t
  modified_base (273)..(273): a, c, t, g, unknown or other
  misc_feature (273)..(273): n is a, c, g, or t
  modified_base (388)..(388): a, c, t, g, unknown or other
  misc_feature (388)..(388): n is a, c, g, or t
  modified_base (411)..(411): a, c, t, g, unknown or other
  misc_feature (411)..(411): n is a, c, g, or t
tcagcgcagtacgacacgaccggtgctcgatttagacgtctcatcaggggggagtcagtctcagtcaggacacagcatggacatgagggtccccgntcagctcctggggctcctgctactctggctccgaggtgccagatgtgtcatccagatgacccagtcctccatcctccctgtccgcatctgtaggngacagagtnatcatcacttgccggnaagtcagagctattagaacgttatttaaattggtatacaactagaaaccgaggaacnccctagaactctgatctatgttcatctattgctgagtcggtccatcaagttcagtgctagtgatcgtggactagtaatcactcacactatccactgtctgctaggctaggtagtntttgaccttattcttgtcaacanagttactactacgttccctcttacttccgggacctagggacctatggtacgtactaactaccaaacgtacgtgtaccgtctacgacctacctatccgttagttcc

SEQ ID NO: 81651 - DNA, 590 bp, Homo sapiens
  misc_feature: GYAE6OF02GS6NS.52.1.A01.1.454.CMB.1.raw
tcagcgcagtacgacacgaccggtgctcgatttagacgtctcatcagggggggagtcagtctcagtcaggacacagcatggacatgagggtccccgctcagctcctggggctcctgctactctggctccgaggtgccagatgtgtcatccagatgacccagtctccatcctccctgtccgcatctgtaggagacagagtcatcatcacttgccgggcaagtcagagcattagaacgtaatttaaattggtaatcaacagaaaaccagggaaacgcccctagaactcctgatctatggttcatcctatttcgctgaggtcggggtccctagtacgtaaggttcaggttggcgaggtaggatcgtagggaacagtaattccactctccacctactccaacctagtctcgaccgacggctaggaggttatttgacttaactttacttctgtacaactagtacgttacacctttccctacttacccgtttccggtacccgtacgggtacccgtagttacggtaggtacttaacgtaaccgtaaaacggtaacttaggttcggtactcggtacccacctacgttacctggtttcc

SEQ ID NO: 81652 - DNA, 560 bp, Homo sapiens
  misc_feature: GYAE6OF02FFP4B.52.1.A01.1.454.CMB.1.raw
  modified_base (380)..(380): a, c, t, g, unknown or other
  misc_feature (380)..(380): n is a, c, g, or t
tcagcgcagtacgacacgaccggtgctcgatttagacgtctcatcagggcacagcatggacatgagggtccccgctcagctcctggggctcctgctactctggctccgaggtgccagatgtgtcatccagatgacccagtctccatcctccctgtccgcatctggtaggagacagagtcatcatcacttgccgggcaagtcagagcattagaacgttatttaaatggtatcaacagaaaccagggaaacgcccctgaactcctgatctatggttcactccactttgctgaggtcggggtccctatccaaggttcaggtcggcagtggatcgtgggacagtaattccactctcacctatccacctacgtctgacgaggtcnggtaggtacttttgacttaactttacttctcgtacaactagtactttactcttccctcttacccgtttccggtccctagggtacctagttaggtacggtaatactaccgaaacgtacgttgtacgactcgacctacctacttctacgttccttactcgttcccttcccacctactcgtac

SEQ ID NO: 81653 - DNA, 710 bp, Homo sapiens
  misc_feature: GYAE6OF02ISRZU.52.1.A01.1.454.CMB.1.raw
  modified_base (171)..(171): a, c, t, g, unknown or other
  misc_feature (171)..(171): n is a, c, g, or t
  modified_base (694)..(694): a, c, t, g, unknown or other
  misc_feature (694)..(694): n is a, c, g, or t
tcagcgcagtacgacacgaccggtgctcgatttagacgtctcatcagggcacagcatggacatgagggtccccgctcagctcctggggctcctgctactctggctccgaggtgccagatgtgtcatccagatgacccagtctccatccctccctgtccgcatctgtagganacagagtcatcatcacgttggccgggactaagtcaggagctaagttaagaacgttaatttaaagttggtatacaacaagaaaccgaaggaacgccctagaactcctagtatcttagtcggttactactcctactttcgtacgtaggtacggtcggggtccctaagttaccgtaacggttcaaggtggacgtaggtaggtacgtacggtagggaacctaagtaacttaccgtaccttactccaacgtactacctaaccgtacgttctaggaccgaacggtctaagggtaggtttacgttttacaccgttaaacctttcgttactaaccggtaactaaaccgttaggttaactttaccgtaccgtttaccccttacttacccgtttcccgggtacccgttacgggtaaccctagttacgggtagttaacgttaacgttaaacccggaaaccgttagtttaccggcgtaccgttaccggaccaaccttgttcctcgtttacccgtactccttaccccggttacccncccgttattcgtaacg

SEQ ID NO: 81654 - DNA, 837 bp, Homo sapiens
  misc_feature: GYAE6OF02GKWWV.52.1.A01.1.454.CMB.1.raw
tcagcgcagtacgacacgaccggtgctcgatttagacgtctcatcagggcacagcatggacatgagggtccccgctcagctcctggggctcctgctactctggctccgaggtgccagatgtgtcatccagatgacccagtctccatccctccctgtccgcatctgtaggagacagagtcatcatcacttgccggcaagtcagagcattaagaacgttatttaaagttggtactacaaacaagaaaaccgaagggaaacgcccctagtaaccttccgtagtactactaagtggtttaccaacttcccttaacgttttcggccgttagggtacggggttcgggggttacccctaagttaccgtaaacgggttttccgaggttcgggacgtaaggtggtacgttcggtaggggaacctaaggtaactttaccgaccttccgtacccaacctacgttaccctaacccgtacgtccgtacggaccgtacgggtcgttacgggtaacggtttaacgttttttacggaacccgtttaaaaccttttaccgttttaccgttaaccggtttacccgaaaacgttaacgggtttaacgttttaacccttaacccggttttacccccgttacccgtttaacccggttttccccggggtaccccggttaccggggtaacccttaaggttaacggttacgggttaactttaacgtaaaccgttaaaaccggtaaccgttcgggttaccggtacgttacggacccgtaacccttacgttccggtttaccgtttacccgtttacctacccgttttccccgtttacccccggaccttaccgttaccttaccgg

SEQ ID NO: 81655 - DNA, 704 bp, Homo sapiens
  misc_feature: GYAE6OF02I0EZM.52.1.A01.1.454.CMB.1.raw
  modified_base (194)..(194): a, c, t, g, unknown or other
  misc_feature (194)..(194): n is a, c, g, or t
tcagcgcagtacgacacgaccggtgctcgatttagacgtctcatcagggcacagcatggacatgagggtccccgctcagctcctggggctcctgctactctggctccgaggtgccagatgtgtcatccagatgacccagtctccatcctccctgtccgcatctgtaggagacagagtcatcatcacttgccggnaagtcagagcattagaacgttatttaaagtggtatcaacagaaaccgagggaaacgcccctagaacctcctagatctagtcgttcactcctacgtttcgcgtaggtacggtcggggtccctaagtcgtaaacgggtttcaagggttcggactagggtaggtaacgtcgtacggggaactaaggtaactttccgtaaccgttctaccaaccgtacttacccaacctacggtaccgtcggacgtacggtaccgtaggtacggtttacgtttacggtaccttaaacgtttccttacgttacgtaccgtaaacgtaacgtacgtttaaccgtaccgtttccccgtacgttacccggtttcccggtcccgttagggtaaccctaggttacggttacgtaattaaccgtaacaaaaccggttacgttcgggtacgcgttacgacccgtaacctagttccttaccgttccgtttaacctaccgtttaccccgttacccgaccttacgttacctaagg

SEQ ID NO: 81656 - DNA, 621 bp, Homo sapiens
  misc_feature: GYAE6OF02JM8QN.52.1.A01.1.454.CMB.1.raw
  modified_base (174)..(174): a, c, t, g, unknown or other
  misc_feature (174)..(174): n is a, c, g, or t
tcagcgcagtacgacacgaccggtgctcgatttagacgtctcatcagggcacagcatggacatgagggtcccccgctcagctcctggggctcctgctactctggctccgaggtgccagatgtgtcatccagatgacccagtcctccatccctccctgtccgcatcgtgtagganacagagtcatcatcacgttggccggcaagtcagagctaatagtaacgttattttaaattggtatacaaactaagaaaccgaggaaacgcccctagaactcctgatctagtcggtactacttacctcgttagcgtaggtacggtcgggtccattacgtaaggttctaaggtggacgtaaggtcggatcggtaggaactagtacttacactctaccactatccaacctgttccagcgaggtacgtaggtagtactttgaccttaactttactacttacgaactaacgtagtacgttactccgttacccttcgtaccggttccggtcccgtacgtaccggggtatacgtacggtaactaaccgtaactaaacggtacttcggtacgtcgtacaccgtacctattcctacgttacctacgtcctacccgttacccgtacctagttactacg

SEQ ID NO: 81657 - DNA, 593 bp, Homo sapiens
  misc_feature: GYAE6OF02IGOW7.52.1.A01.1.454.CMB.1.raw
  modified_base (194)..(194): a, c, t, g, unknown or other
  misc_feature (194)..(194): n is a, c, g, or t
  modified_base (371)..(371): a, c, t, g, unknown or other
  misc_feature (371)..(371): n is a, c, g, or t
tcagcgcagtacgacacgaccggtgctcgatttagacgtctcatcagggcacagcatggacatgagggtccccgctcagctcctggggctcctgctactctggctccgaggtgccagatgtgtcatccagatgacccagtctccatcctccctgtccgcatctgtaggagacagagtcatcatcacttgccggnaagtcagagcattagaacgttatttaaattggtatcaacagaaacgaagggaaacgccctagaacctcctgatactatggttacatcctattcgcgttggaggttcgggcctagtacgtaaggttcaggtggactaggtggatcgtggacaagatccactctaccacactcaccgtntctgctaggctagggagtttactttagactttaaaccttcttcgtagttaaccaaacggtagttaacttaccgttaccgttcccctagttacccgtttccggacccgtaggaccctagttaggtacggtaactactacgaaacgtacgtggtacgtccgagtaccaacttgtcccgttacgttaccttctaacgttttccccgtcccctacttcgtactacg

SEQ ID NO: 81658 - DNA, 588 bp, Homo sapiens
  misc_feature: GYAE6OF02FX3II.52.1.A01.1.454.CMB.1.raw
  modified_base (255)..(255): a, c, t, g, unknown or other
  misc_feature (255)..(255): n is a, c, g, or t
  modified_base (272)..(272): a, c, t, g, unknown or other
  misc_feature (272)..(272): n is a, c, g, or t
  modified_base (358)..(358): a, c, t, g, unknown or other
  misc_feature (358)..(358): n is a, c, g, or t
tcagcgcagtacgacacgaccggtgctcgatttagacgtctcatcagggggggagtcagtctcagtcaggacacagcatggacatgagggtccccgctcagctcctggggctcctgctactctggctccgaggtgccagatgtgtcatccagatgacccagtctccatcctccctgtccgcatctgtaggagacagagtcatcatcacttgccgggcaagtcagagcattagaacgtatttaaagttgtatcaanacgaaaccagggaaacncccctagaactcctgatctatggttcattcctactttgctgaggtcggggtcccagtacgtaaggttcaggtggctagtggatcgngggacagtaacttcgactctacgaccactcaacctagtctgaccgaggtcctggtaggttacttttcggacttaaacgtttaccttcgttagtacctaacgtaacgtacgtttaaccgtacgtttaccctaccgttaccgtttaccggccccgttagggaaccctagtacggtgtattaacgtaacaaacggacttcgtacgacgtcgacctacgacttccgttgttacc

SEQ ID NO: 81659 - DNA, 606 bp, Homo sapiens
  misc_feature: GYAE6OF02G0A40.52.1.A01.1.454.CMB.1.raw
  modified_base (336)..(336): a, c, t, g, unknown or other
  misc_feature (336)..(336): n is a, c, g, or t
  modified_base (361)..(361): a, c, t, g, unknown or other
  misc_feature (361)..(361): n is a, c, g, or t
tcagcgcagtacgacacgaccggtgctcgatttagacgtctcatcagggcacagcatggacatgagggtccccgctcagctcctggggctcctgctactctggctccgaggtgccagatgtgtcatccagatgacccagtctccatcctccctgtccgcatctgtaggagacaggagtcatcatcacttgccgggcaagtcagagcaattacgaacgttatttaaattggtatacaacaagaaaccagggaaacgccctagaactcctgatctatggttcatcctactttgctgaggtcgggtcccatcaaggttcaggtggcaggtgatgtgganagattcactcacacatcacctatcngcgagctggaggttatttcgacttaactttcttctacgtacaacgtaagtacgtttaacctacgttcccctacttaccgttttccgggccccgttacggggaacccttagttacgggttaggtaacttaacgttaaccaaaacggtaactttcgggtacggtacgtacggaaccctaccttacgttccgtttacgttacccgttccttaaccgtttccccttccccgtaccttacttccgtaacg

SEQ ID NO: 81660 - DNA, 933 bp, Homo sapiens
  misc_feature: GYAE6OF02I38OR.52.1.A01.1.454.CMB.1.raw
  modified_base (303)..(303): a, c, t, g, unknown or other
  misc_feature (303)..(303): n is a, c, g, or t
  modified_base (923)..(923): a, c, t, g, unknown or other
  misc_feature (923)..(923): n is a, c, g, or t
tcagcgcagtacgacacgaccggtgctcgatttagacgtctcatcagggggggagtcagtctcagtcaggacacagcatggacatgagggtccccgctcagctccgtggggctcctgctactctggctccgaggtgccagatgtgtcatccagatcgacccagtctccatccctccctgtccgcactctgtaggagacagagtcatcatcacgttcggccgggcaacgtcagagactagttaagtaacgttaatttaaagttggttaactacaaacgtaacgaaaacccgaaggggaaaaccnccccctaggtaaacccttcccgtagtaacgttaccttaggttaccgggttacctaaccgttaccccttacgttttcggaccgttacgggttaacgggttcccgggggggttaaccccctaagtttaacccgggttaaaacgggttttcccgaaacgggggtttacgggtaccgttaaggggttaccgggtaacgtttaccggggttacgggggggtaaaacccttaaaggttaaaaccgttttacccgtaaccctttaaccctttaaccccgtaacccttaaacccgttaccccgtaaaccccggttaaacggtccgttaaccgggaccgtacggggtacccgttaaggggtaacgggttttacgtttttaacggaacctttaaacccgttttttacgttacccgttacggttaaaccgtaaaccggttaaggtttaaacccgtttaccggttacccgtttacccccgtttacggttaccccggttttcccgggtaccccggttaacgggtaacccgttacggtaggttaacgggtaactttaacggtaaacccgttaaaacggtaaccgtttagggtaccggttaacttccgggtaaccctacgttacgtttacccgtntttaacccgg

SEQ ID NO: 81661 - DNA, 664 bp, Homo sapiens
  misc_feature: GYAE6OF02G4CRP.52.1.A01.1.454.CMB.1.raw
  modified_base (253)..(253): a, c, t, g, unknown or other
  misc_feature (253)..(253): n is a, c, g, or t
tcagcgcagtacgacacgaccggtgctcgatttagacgtctcatcagggcacagcatggacatgagggtccccgctcagctcctggggctcctgctactctggctccgaggtgccagatgtgtcatccagatgacccagtctccatcctccctgtccgcatctgtaggagacagagtcatcatcacttggccgggcaagtcagagcattagaacgttatttaagttggtatcaacaagaaaccgagggaaacncccctagaacctcctagatctagtggttcactcctactttgctggaggtcgggtccctatacgtaaggttcgaggtcggactagtggagttcgtagggacaagtacttaccactcctacacctactaccacgtagtcgtgtacggcgttaggtaaggttatttttacgacttaaccgtttactttcgtacgttacctaaacgtagggttaaccgtttaaccgtaccgtttacccttacgttacccgtttcccgggtacccgttacggggtaaccttaagtagggttagtactaaccgtaaccgtaaaccggtaacgttggttcggtacgtaccgtaccgtaacctacttccgttacgtttccttaccgttaccgttccctttaccccgtaccttaaccgttcttagtaacg

SEQ ID NO: 81662 - DNA, 503 bp, Homo sapiens
  misc_feature: GYAE6OF02G5H44.52.1.A01.1.454.CMB.1.raw
tcagcgcagtacgacacgaccggtgctcgatttagacgtctcatcagggcacagcatggacatgagggtccccgctcagctcctggggctcctgctactctggctccgaggtgccagatgtgtcatccagatgacccagtctccatcctccctgtccgcatctgtaggagacagagtcatcatcacttgccgggcaagtcagagcattagaacgtatttaaattggtatcaacagaaaccagggaaagcccctgaactcctgatctatggttcatccactttgctgagtgggtccatcaaggttcagtggcagtggatcgtgggacagtacttcactctcacatcaccagtctgcaggctagaggtattttcgactaactttacttctcgtacaactagtacgttacacgttccctctaccgttccggcctagggacctagtagtagtattactacaaacgtactgtgctgccactatctgtctctacttcctccgctatcta

SEQ ID NO: 81663 - DNA, 564 bp, Homo sapiens
  misc_feature: GYAE6OF02FXIC1.52.1.A01.1.454.CMB.1.raw
  modified_base (215)..(215): a, c, t, g, unknown or other
  misc_feature (215)..(215): n is a, c, g, or t
  modified_base (269)..(269): a, c, t, g, unknown or other
  misc_feature (269)..(269): n is a, c, g, or t
tcagcgcagtacgacacgaccggtgctcgatttagacgtctcatcaggggggagtcagtctcagtcaggacacagcatggacatgagggtccccgctcagctcctggggctcctgctactctggctccgaggtgccagatgtgtcatccagatgacccagtctccatcctccctgtccgcatctgtaggagacagagtcatcatcacttgccggnaagtcagagcattagaacgtatttaaattggtatcaacagaaaccagggaaacnccccgtagaactcctgatctagtcgttcatcctactttgctgagtcgggtccagtcaaggttcagtgcaggtgatcgtagggacagtattcgactctcaccatcaccagtctgcagcgtgagtattttgacctaacgtttacttactcgtacacgtaagtacgttaacgtacgttaccctccttacgtttacccgcccggtaccgggtactaacgttacggtaggtacgttaacgtaacgtaaaccggtaacgtacggtacgggactcggtacccactactaccgttgttacccg

SEQ ID NO: 81664 - DNA, 587 bp, Homo sapiens
  misc_feature: GYAE6OF02G14JI.52.1.A01.1.454.CMB.1.raw
  modified_base (273)..(273): a, c, t, g, unknown or other
  misc_feature (273)..(273): n is a, c, g, or t
tcagcgcagtacgacacgaccggtgctcgatttagacgtctcatcaggggggagtcagtctcagtcaggacacagcatggacatgagggtccccgctcagctcctggggctcctgctactctggctccgaggtgccagatgtgtcatccagatgacccagtctccatcctccctgtccgcatctgtaggagacagagtcatcatcacttcgccgggacaagtcagagcattagaacgttatttaaattggtatcaacagaaaccagggaaacncccctagaactcctgatctatggtcatccactttgctgtacgtcggggtaccagtacgaaggttcgaggtggacgtaggtaggacttcggtagggaactaaggtaacttcaactctaccgacctatcctaactcggtctcgacgacggtctacggtaggttacttttggaccttaactttactctacggtacaacgtagtaacgttacacgttttccacgttccgtttccggccttagggaaccttagtaggtcgtacgtaacgtaccaaacggttacgtcggtacgtactcgaccacgtacttcgtacgttcc

SEQ ID NO: 81665 - DNA, 557 bp, Homo sapiens
  misc_feature: GYAE6OF02HMUSA.52.1.A01.1.454.CMB.1.raw
  modified_base (171)..(171): a, c, t, g, unknown or other
  misc_feature (171)..(171): n is a, c, g, or t
  modified_base (328)..(328): a, c, t, g, unknown or other
  misc_feature (328)..(328): n is a, c, g, or t
  modified_base (352)..(352): a, c, t, g, unknown or other
  misc_feature (352)..(352): n is a, c, g, or t
  modified_base (402)..(402): a, c, t, g, unknown or other
  misc_feature (402)..(402): n is a, c, g, or t
tcagcgcagtacgacacgaccggtgctcgatttagacgtctcatcagggcacagcatggacatgagggtccccgctcagctcctaggggctcctgctactctggctccgaggtgccagatgtgtcatccagatgacccagtctccatcctccctgtccgcatctgtagganacagagtcatcatcacttggccggcaagtcagagcattagaacgttatttaaattggtaatcaacagaaaccagggaaagcccctgaacctcctgatctatggttcatccactttgctgagtgggtcccatcaaggttcagtgcagtgatctggganagaacttcactcgtcacatcaccngtctgcagctggagtatttgactaattactctgtacaacgtagtattacncgttaccctacgtaccttccggaccctacgggtaccagttacggtcgtaactaactaccgaaaaccgttacgtcggtacggtcttacggcctaaaccctgttaccctgttaccgttctaaccttcccgttaccccggacttacgtccgttaacgg

SEQ ID NO: 81666 - DNA, 584 bp, Homo sapiens
  misc_feature: GYAE6OF02F2CBA.52.1.A01.1.454.CMB.1.raw
  modified_base (252)..(252): a, c, t, g, unknown or other
  misc_feature (252)..(252): n is a, c, g, or t
  modified_base (267)..(267): a, c, t, g, unknown or other
  misc_feature (267)..(267): n is a, c, g, or t
tcagcgcagtacgacacgaccggtgctcgatttagacgtctcatcaggggggagtcagtctcagtcaggacacagcatggacatgagggtccccgctcagctcctggggctcctgctactctggctccgaggtgccagatgtgtcatccagatgacccagtctccatcctcctgtccgcatctgtaggagacagagtcatcatcacttgccggcaagtcagagcattagaacgtatttaaattggtatcaanagaaaccagggaaancccctagaactctgatctatggttcatcctacttgctgagtcggggtccatcaaggttcagtggcagtggatcgtagggacagaattcgactctacaccataccaccagtctcgctacggactgacggttatttacgacttaacttacttctgtacaacgtagtaacgttacgtacgtttcccctacgtaccgttttccggcccgttacgggaccctaaggttacgtagggtaacttaactaaccgtaaaaccggtacgttacggtacgggtccgttacggaacccgtaaccctacgtttacctacggtttaacccc

SEQ ID NO: 81667 - DNA, 617 bp, Homo sapiens
  misc_feature: GYAE6OF02H71IS.52.1.A01.1.454.CMB.1.raw
  modified_base (271)..(271): a, c, t, g, unknown or other
  misc_feature (271)..(271): n is a, c, g, or t
tcagcgcagtacgacacgaccggtgctcgatttagacgtctcatcagggggggagtcagtctcagtcaggacacagcatggacatgagggtccccgctcagctcctggggctcctgctactctggctccgaggtgccagatgtgtcatccagatgacccagtctccatcctccctgtccgcatctgtaggagacagagtcatcatcacttgccgggcaagtcagagcattagaacgttatttaaagttggtatcaacagaaccagggaaancccctagaacctcctagactctatcggttacatcctatttgccttgacggttcgggggtaccctaagtccgtaaaggtttcaaggttgggacctagggtagggagttccgtaggggaacccaaggtaactttcgaaccttactaccaacgtactaccaccaacgttctcgcgtaggctacggaggttatttcgacgtaactttacttacgttgacctaagacgttattaccgtacttcccgtacacccgttttcggcccttagggtaccctagttacggtcgtaagttacaaccgttaaacgaaccgttggtcggcttaccgacctacccgtaattccgtattccg

SEQ ID NO: 81668 - DNA, 600 bp, Homo sapiens
  misc_feature: GYAE6OF02HO99U.52.1.A01.1.454.CMB.1.raw
  modified_base (195)..(195): a, c, t, g, unknown or other
  misc_feature (195)..(195): n is a, c, g, or t
tcagcgcagtacgacacgaccggtgctcgatttagacgtctcatcagggcacagcatggacatgagggtccccgctcagctcctggggctcctgctactctggctccgaggtgccagatgtgtcatccagatgacccagtctccatcctccctgtccgcatctgtaggagacagagtcatcatcacttggccggnaagtcagagcattagaacgttaattttaaattggtactacaaacaagaaaaccgaagggaaaacgcccctagaacctcctagattctatggttcatcctactttgctggacggtcggggtcccagtcgtaaggttcaggtggactaggtgagttcgtgggacagtattcactcacacatccacagtctgcgaggcgtaggagttattttcgacttaactttacttcgttagtaccaactacggtaattaacctcgttaccccttactaccgtttccggccccgttagggaccctaagttacgtggtaattaacgacaaacgtacgttggtacggtcgtacgtccaccttatcccgttagttccttacctacgtttaccccgttacccgaccttagtaccgttaag

SEQ ID NO: 81669 - DNA, 639 bp, Homo sapiens
  misc_feature: GYAE6OF02F9HJM.52.1.A01.1.454.CMB.1.raw
  modified_base (219)..(219): a, c, t, g, unknown or other
  misc_feature (219)..(219): n is a, c, g, or t
  modified_base (271)..(271): a, c, t, g, unknown or other
  misc_feature (271)..(271): n is a, c, g, or t
tcagcgcagtacgacacgaccggtgctcgatttagacgtctcatcaggggggagtcagtctcagtcaggacacagcatggacatgagggtccccgctcagctcctggggctcctgctactctggctccggaggtgccagatgtgtcatccagatgacccagtctccatccctccctgtccgcatctgtaggagacagagtcatcatcacttggccgganaagtcagagcattagaactatttaattggtatacaacagaaacgaggaaacncccctagaacctctgatctagtggttacactcctactttgctggaggtcggggtccagtactaaggttcgagtcggctaggtggtagtcgtagggacagtacttacactctacacctactccaaccgtgtccgtgtcgaggttccgtaggtacggttagtttacgtacccgttaacgttttaccttcgttacgtacctaaacgtaaggttaacgttaccgttacccgtttccccttacgttaccgtttcccggtacccgttaccgggtacctagttaggttacgtaacttaacggttaaccgaaacggttaccgttacgggttacgtaccgtaccggtcctaaacccgtcgttaccgttcgttacccg

SEQ ID NO: 81670 - DNA, 602 bp, Homo sapiens
  misc_feature: GYAE6OF02JWZFL.52.1.A01.1.454.CMB.1.raw
  modified_base (265)..(265): a, c, t, g, unknown or other
  misc_feature (265)..(265): n is a, c, g, or t
  modified_base (418)..(418): a, c, t, g, unknown or other
  misc_feature (418)..(418): n is a, c, g, or t
tcagcgcagtacgacacgaccggtgctcgatttagacgtctcatcagggcacagcatggacatgagggtccccgctcagctcctggggctcctgctactctggctccgaggtgccagatgtgtcatccagatgacccagtctccatcctccctgtccgcatctgtaggagacagagtcatcatcacttggaccgggacaagtcagagctaattagtaacgttaatttaaagtcggtaataccaaagacgaaaccgagggtaaacncccctagaacctcctagactctatggttcatccctagttgctacggaggttcggtacctatacgtagttcaggtcggcaggtgactcgtgggaactagaacttcactactacacgtactaccacgtagtctagctaggctagtagtcgtttanaccgttacttacgttcgacgtaactaacgtagtacgttaccgtacgttcccgtacgtaccgtttcggacccgttgggaaccctagtaggttactaattaacgaccaaacggttactgtacggcttacggcctaacgtctcgagtttccttaactccttacccgtcccgtaactcgtcgttaacg

SEQ ID NO: 81671 - DNA, 653 bp, Homo sapiens
  misc_feature: GYAE6OF02I530C.52.1.A01.1.454.CMB.1.raw
  modified_base (181)..(181): a, c, t, g, unknown or other
  misc_feature (181)..(181): n is a, c, g, or t
  modified_base (263)..(263): a, c, t, g, unknown or other
  misc_feature (263)..(263): n is a, c, g, or t
  modified_base (271)..(271): a, c, t, g, unknown or other
  misc_feature (271)..(271): n is a, c, g, or t
  modified_base (601)..(601): a, c, t, g, unknown or other
  misc_feature (601)..(601): n is a, c, g, or t
tcagcgcagtacgacacgaccggtgctcgatttagacgtctcatcaggggggagtcagtctcagtcaggacacagcatggacatgagggtccccgctcagctccgtggggctcctgctactctggctccgaggtcgccagatgtgtcatccagatgaccagtctccatccctcctgtccgntatctgaggagacagacgtcatcactcacgttggccggactaagtcagagtcaattaagaacgttaattaagtggtactaanccaagaanaaccgagggaacctccctagaacctcgatacgtactaagttcgtactacgtaccctagttacgcgttacggtaagggtccggtaactagtaccgtaaggttactagggtacggatagggtacggtactagggtaacggaacgtaagtacgtacctacgtacctacgtaccgtaacgtacctaacgtactacgacgtacggacgtacgtacggtacgttagtttacgtaacttaacgttactacgtacgtaacgtaacgtacgttacgttaacgttacgttacctacgttacccggtacgtaccggtaacgtaccgtacgtacggtaacgntaacgtaacgtaacgtaacgtacgtacgtacgtacgtacgtacgtacgtacg

SEQ ID NO: 81672 - DNA, 745 bp, Homo sapiens
  misc_feature: GYAE6OF02HOKRT.52.1.A01.1.454.CMB.1.raw
  modified_base (194)..(194): a, c, t, g, unknown or other
  misc_feature (194)..(194): n is a, c, g, or t
  modified_base (255)..(255): a, c, t, g, unknown or other
  misc_feature (255)..(255): n is a, c, g, or t
tcagcgcagtacgacacgaccggtgctcgatttagacgtctcatcagggcacagcatggacatgagggtccccgctcagctcctggggctcctgctactctggctccgaggtgccagatgtgtcatccagatgacccagtctccatcctccctgtccgcatctgtaggagacagagtcatcatcacttgccggnaagtcagagactattaagaacgttatttaaagttggtatcaaacacgaaaccagggaaacncccctaggaactcctagatctatggttcactcctactttcgacgtggtacggtcgggtacccatacgtaaggttacaggtacggtactaggtggtacgtcggtacgggacgtaagtaactttccaaccttccgtacctaccctaagtaccctaaccgtacgttctacggtacgtaagggtcgtacggtagggtttacttttacggaacccttaaacttttacccgtttcgtacgttaccgtaaagtacgttaacgttaaccgttaccgtttaccccgttacctttaacccgggttttccccggaacccggttacgggttaacccgttaaccggttaacgggttaccggttaaaccgttaaacgtttaacccggaaaaacggttaccgttacgggtacggttaccgtacggtaaccctaaccgttacttccgttaaccgttccgtttaaccgacctttcccgttacccccgtcgtacgttaccgttaacgg

SEQ ID NO: 81673 - DNA, 525 bp, Homo sapiens
  misc_feature: GYAE6OF02FNQ90.52.1.A01.1.454.CMB.1.raw
  modified_base (191)..(191): a, c, t, g, unknown or other
  misc_feature (191)..(191): n is a, c, g, or t
  modified_base (269)..(269): a, c, t, g, unknown or other
  misc_feature (269)..(269): n is a, c, g, or t
  modified_base (487)..(487): a, c, t, g, unknown or other
  misc_feature (487)..(487): n is a, c, g, or t
tcagcgcagtacgacacgaccggtgctcgatttagacgtctcatcaggggggagtcagtctcagtcaggacacagcatggacatgagggtccccgctcagctcctggggctcctgctactctggctccgaggtgccagatgtgtcatccagatgacccagtctccatcctccctgtccgcatctgtagganacagagtcatcatcacttgccgggcaagtcagagcattagaacgtatttaaattggtatcaacagaaaccagggaaancccctgaactcctgatctatggttcatccactttgctgagtggggtcccatcaaggttcagtggcagtggatcgtgggacagaattcactctcaccatccaccagtctgcaggctgagtattttgactaacgtttacttcgtgtaccaactagtagttaactacgtttccctactacctttccggacccgttgggaaccctagttacgtggtattaanacaaacgtaactggtagctcgcctaaccattctgttcc

SEQ ID NO: 81674 - DNA, 634 bp, Homo sapiens
  misc_feature: GYAE6OF02HKUDX.52.1.A01.1.454.CMB.1.raw
  modified_base (619)..(619): a, c, t, g, unknown or other
  misc_feature (619)..(619): n is a, c, g, or t
tcagcgcagtacgacacgaccggtgctcgatttagacgtctcatcagggggggagtcagtctcagtcaggacacagcatggacatgagggtccccgctcagctccgtggggctcctgctactctggctccggaggtgccagatgtgtcatccagatcgacccagtcctccatccctccctgtccgcatcgtaggtaggagacgagagtcatcatcacgttggccggacaagtcagagctaagttaagaacttaatttaaattggtatacaacaagaaaccgaaggaaactccctagaactcctagtatcgtagtggtcactcctacgtttgctaggacggtccggggtacctagtacgtaacggtcgacgttggactaggtcggtatcggtaggaacaaggtactccaactcgtacaccctataccacgtacgtcgtcacgtagcgtaggtagtacgtttacgaattaccgttattctacgtaacaacgtacgggttaacttacgtccgtttacccgtacgttccgttacccgggtaccgttacggtaacccgtgttacggtaggtaacgttacaaccggtaaacgtaacgtcggtacggtcgtacgacctaacccgtntccggttacttaccc

SEQ ID NO: 81675 - DNA, 606 bp, Homo sapiens
  misc_feature: GYAE6OF02FJ8FW.52.1.A01.1.454.CMB.1.raw
  modified_base (202)..(202): a, c, t, g, unknown or other
  misc_feature (202)..(202): n is a, c, g, or t
  modified_base (344)..(344): a, c, t, g, unknown or other
  misc_feature (344)..(344): n is a, c, g, or t
  modified_base (350)..(350): a, c, t, g, unknown or other
  misc_feature (350)..(350): n is a, c, g, or t
  modified_base (355)..(355): a, c, t, g, unknown or other
  misc_feature (355)..(355): n is a, c, g, or t
tcagcgcagtacgacacgaccggtgctcgatttagacgtctcatcagggcacagcatggacatgagggtccccgctcagctcctggggctcctgctactctggctccgaggtgccagatgtgtcatccagatgacccagtctccatcctccctgtccgcatctgtaggagacagagtcatcatcacttgccggcaagtcagngcattagaacgttatttaaattggtatcaacagaaaccagggaaagcccctagaacttcctgatctatgattcatcctactttgctgagtcggggtcccagtcaaggttcaggtggcaggtgatcgtggacagattcactcncaccanccacngtctagcagctgagtatttgactaactttacttcgtagttacaacgtagtacttaccgtacgtttccctaccgttactttcccgggacccgttacgggaccctaagttacggttagggaacttaacgttaccgaaaaccggttaacgttcggtacgggtaccgttaaccggcctaacccgttacgttccgtttcgttaccgttttaccgtaacccgtttccctttaccccccggtactaccgtttaacccg

SEQ ID NO: 81676 - DNA, 579 bp, Homo sapiens
  misc_feature: GYAE6OF02HT61N.52.1.A01.1.454.CMB.1.raw
  modified_base (195)..(195): a, c, t, g, unknown or other
  misc_feature (195)..(195): n is a, c, g, or t
  modified_base (251)..(251): a, c, t, g, unknown or other
  misc_feature (251)..(251): n is a, c, g, or t
  modified_base (331)..(331): a, c, t, g, unknown or other
  misc_feature (331)..(331): n is a, c, g, or t
  modified_base (350)..(350): a, c, t, g, unknown or other
  misc_feature (350)..(350): n is a, c, g, or t
  modified_base (380)..(380): a, c, t, g, unknown or other
  misc_feature (380)..(380): n is a, c, g, or t
tcagcgcagtacgacacgaccggtgctcgatttagacgtctcatcagggcacagcatggacatgagggtccccgctcagctcctggggctcctgctactctggctccgaggtgccagatgtgtcatccagatgacccagtctccatcctccctgtccgcatctgtaggagacagagtcatcatcacttgccgggnaagtcagagcattaagaacgttatttaaatggtatacaacagaaaccagggaaacncccctagaacctcctgatctatggttcatcctactttgctagacggtcgggtcctagacgaaggtcgacgtagtacgagngatgtggacagtattcacnctacgtacactctacgagtactgacgaggngtacgtagtacgttacgtactacttacttcgtacgtactaacgtacgtacgttacttaccgttaccgtacgttaccgttacgtaccgtacggtacgtacgtagtacgtacgtaacgtaacgtaacgtacgtacgtacgtacgtacgtactacctacgtcgttacgtccttacttactaccgtaccgtacctactcgtcg

SEQ ID NO: 81677 - DNA, 658 bp, Homo sapiens
  misc_feature: GYAE6OF02JGC1W.52.1.A01.1.454.CMB.1.raw
tcagcgcagtacgacacgaccggtgctcgatttagacgtctcatcagggcacagcatggacatgagggtccccgctcagctcctggggctcctgctactctggctccgaggtgccagatgtgtcatccagatcgacccagtctccatccctccctgtccgcatctgtaggagacagagtcatcatcacgttgccgggcaagtcagagcattagaacgttatttaattggtatacaacaagaaccgagggaacgccctagtaacctcctgactcgtagtcggttacacgtaccctagtttgcgtaggacggtcgggtaccagtacgtaacggttcaaggtggacgtagtggtactcgtagggacaagtactcgtactactacaccataccactacgttctaggacaggtctacgggtagttactttacgacttaaccttacttctacggtaacctaacgagtttacgttacctaccgtttacccgtaccgttacccgttttccgggaccccggttaaggggtaaccctaggtttaacggtacggtaaccttaataaacccggtaaacgtacgttacggtacgtcgaccggtcctaacctcttacgtccggtttaccttaaccgtccctttcccgtaccccgtcttaccgtacgttacgg

SEQ ID NO: 81678 - DNA, 530 bp, Homo sapiens
  misc_feature: GYAE6OF02GJUEJ.52.1.A01.1.454.CMB.1.raw
  modified_base (231)..(231): a, c, t, g, unknown or other
  misc_feature (231)..(231): n is a, c, g, or t
  modified_base (303)..(303): a, c, t, g, unknown or other
  misc_feature (303)..(303): n is a, c, g, or t
  modified_base (319)..(319): a, c, t, g, unknown or other
  misc_feature (319)..(319): n is a, c, g, or t
  modified_base (324)..(324): a, c, t, g, unknown or other
  misc_feature (324)..(324): n is a, c, g, or t
  modified_base (334)..(334): a, c, t, g, unknown or other
  misc_feature (334)..(334): n is a, c, g, or t
  modified_base (340)..(340): a, c, t, g, unknown or other
  misc_feature (340)..(340): n is a, c, g, or t
  modified_base (343)..(343): a, c, t, g, unknown or other
  misc_feature (343)..(343): n is a, c, g, or t
  modified_base (345)..(345): a, c, t, g, unknown or other
  misc_feature (345)..(345): n is a, c, g, or t
  modified_base (354)..(354): a, c, t, g, unknown or other
  misc_feature (354)..(354): n is a, c, g, or t
  modified_base (368)..(368): a, c, t, g, unknown or other
  misc_feature (368)..(368): n is a, c, g, or t
tcagcgcagtacgacacgaccggtgctcgatttagacgtctcatcagggcacagcatggacatgagggtccccgctcagctcctggggctcctgctactctggctccgaggtgccagatgtgtcatccagatgacccagtctccatcctccctgtccgcatctgtaggagacagagtcatcatcacgttgccgggcaagtcagagcattagaacgtatttaatgtatcaanaagaaaccgaggaaacgccctagaactctgatctatgttcatccacttgcgtgagtcgggtccatcagttcngtgcagtgatgagganagatnactctacacntacacntcngnagctgagtntttgctaacttctntcgtacagtagtacgttacacgttcctactccggttacgtccgtagggacctagtacgtcgtaatacgtacgaaacgtacgtgtacgtctacggtctaaccgttactccgttgttacccttacctacgtttccccgtacccgtacccttagttcccgttaag

SEQ ID NO: 81679 - DNA, 609 bp, Homo sapiens
  misc_feature: GYAE6OF02FIAOM.52.1.A01.1.454.CMB.1.raw
  modified_base (227)..(227): a, c, t, g, unknown or other
  misc_feature (227)..(227): n is a, c, g, or t
  modified_base (272)..(272): a, c, t, g, unknown or other
  misc_feature (272)..(272): n is a, c, g, or t
tcagcgcagtacgacacgaccggtgctcgatttagacgtctcatcagggggggagtcagtctcagtcaggacacagcatggacatgagggtccccgctcagctcctggggctcctgctactctggctccgaggtgccagatgtgtcatccagatgacccagtctccatccctccctgtcccgcatctgtaggagacagagtcatcatcacttgccgggcaagtcagncattagaacgtatttaaattggtatcaacagaaaccagggaaacncccctgaacctcctgtatctatggttcattccactttgactgaggtcggggtcccagtacgtaaggttcagtggacaggtggtactcgtacggggacaaggtaacttccacttcctaccaaccgactccaaccctagttccttagccgtacgggtactggtaaggttacttttggaacccttaaacttttaccgttcttacgtaccaaacgtaacgtaacgtttacctacgtttccccttacgttaccgtttcccgtacccgtacgggaccctagttacgtgaactaactacctaaacgtactggtacggtctcggacctactacttcttacgttcc

SEQ ID NO: 81680 - DNA, 609 bp, Homo sapiens
  misc_feature: GYAE6OF02JNV6Z.52.1.A01.1.454.CMB.1.raw
  modified_base (184)..(184): a, c, t, g, unknown or other
  misc_feature (184)..(184): n is a, c, g, or t
  modified_base (195)..(195): a, c, t, g, unknown or other
  misc_feature (195)..(195): n is a, c, g, or t
  modified_base (200)..(200): a, c, t, g, unknown or other
  misc_feature (200)..(200): n is a, c, g, or t
  modified_base (230)..(230): a, c, t, g, unknown or other
  misc_feature (230)..(230): n is a, c, g, or t
  modified_base (308)..(308): a, c, t, g, unknown or other
  misc_feature (308)..(308): n is a, c, g, or t
  modified_base (562)..(562): a, c, t, g, unknown or other
  misc_feature (562)..(562): n is a, c, g, or t
  modified_base (603)..(603): a, c, t, g, unknown or other
  misc_feature (603)..(603): n is a, c, g, or t
tcagcgcagtacgacacgaccggtgctcgatttagacgtctcatcaggggggaggtcagtctcagtcaggacacagcatggacatgagggtccccgctcagctcctggggcctcctgctactctggctccgaggtgccagatgtgtcactccagatcgacccagtcctccatccctcctgtccncatctgtaggnacagntcatcatcacgtggccggcaagtcaagganctaattagtaaacgttatttaaattgtatacaacaagaaaccgaagggaaccaccccgtagacctactacgactactntcggttacctacttcctactttgcgtagtacggtcggggtacccatacgtaacggttcgaggtcggctaggtggacgtcggtagggaacctaggtaacttccgtactcctacacctataccaccgtagtctggctacggtgtacgaggttatttcgtacttaacttacttcgtacgtcaagtactaacgttactaccggttccctaccgttccgttccgtaccgtgggacctaagttcgtacggtataacctanaaccggtaacgttggttacgacttcgacctacctatccttnttaccg

SEQ ID NO: 81681 - DNA, 560 bp, Homo sapiens
  misc_feature: GYAE6OF02HPX2S.52.1.A01.1.454.CMB.1.raw
  modified_base (308)..(308): a, c, t, g, unknown or other
  misc_feature (308)..(308): n is a, c, g, or t
tcagcgcagtacgacacgaccggtgctcgatttagacgtctcatcaggggggagtcagtctcagtcaggacacagcatggacatgagggtccccgctcagctcctggggctcctgctactctggctccgaggtgccagatgtgtcatccagatgacccagtctccatcctccctgtccgcatctgtaggagacagagtcatcatcacttgccgggcaagtcagagcattagaacgtatttaaattggtatcaacagaaaccagggaaacgcccctagaactcctgactctatggttcatcctactttncgtgaggtcggggtccatctaaggtcagtggcaggtggatcgtggacagtaattcactcctacactataccaacctgtctgcaggctaggtaggttatttacgactaactttacttcgtatacaacaagtaacttacctacgttcccttactaccgtttccggacccgttgggaacctagttaggtcggtaatacgtaaccaaacggtaacttaggtcggtacttcgacctaaccgactttccgtgtttacc

SEQ ID NO: 81682 - DNA, 593 bp, Homo sapiens
  misc_feature: GYAE6OF02F18AF.52.1.A01.1.454.CMB.1.raw
  modified_base (98)..(98): a, c, t, g, unknown or other
  misc_feature (98)..(98): n is a, c, g, or t
  modified_base (393)..(393): a, c, t, g, unknown or other
  misc_feature (393)..(393): n is a, c, g, or t
tcagcgcagtacgacacgaccggtgctcgatttagacgtctcatcgaggggggagtcagtctcagtcaggacacagccatggacatgagggtccccgntcagctcctggggctcctgctactctggctccgaggtgccagatgtgtcagtccagatgacccagtctccatcctccctgtccgcatctgtaggagacagagtcatcatcacttgccggcaagtcagagctattagaacgtatttaaagttggtatacaacagaaaaccaggggaaagccccctgaactcctgactactataggttcactccactttgctgaggtgggggtcccatcaaggttcagtggcagtggatctgggacagaacttcactctcacctataccaccagtcngcagctagaggtatttgctaactttacgttctgtaccaactaggattaacgtacgtttaccctcgttaaccgtttccggtacccgttacgggtaccctaaggttacgtacgggaacttaacgttacgaaacccggtaacgtttcgggtacggtaccttacgggtacccgtaaccgtacgttacccgttacgtttacccgg

SEQ ID NO: 81683 - DNA, 751 bp, Homo sapiens
  misc_feature: GYAE6OF02HPT77.52.1.A01.1.454.CMB.1.raw
  modified_base (745)..(745): a, c, t, g, unknown or other
  misc_feature (745)..(745): n is a, c, g, or t
tcagcgcagtacgacacgaccggtgctcgatttagacgtctcatcaggggggagtcagtctcagtcaggacacagcatggacatgagggtccccgctcagctcctggggctcctgctactctggctccgaggtgccagatgtgtactcacgatgtaccacgtctccactcctccctcgtcgcatctgtaggagacagagtactactacactactaccgttcggtaccggggaccgaagtacgacgagactagttaagtaacgttaatttaagtttaggttagtacaactaacgaaacgaacggaacggtaacccgtacgtaacctacctacgtagtaccttagttcggttcgtactacctactttacgttcgtggtacgggtcggggttacccgtacgtacgtaacggttacgtacgtgggtcgtacggtaggtacgttacgtacgggtaacgaacttaaacgttaccgttacctaccgtccctaaccctactaccgtaaccctaacgttcgtcggtaccgtaacgggtacggttacggtaaggtttacgtttaccgttaaccgttaacctttacccttttacgttacgtaaccgaaaccgtaggttaaccgtttacgttacccgttaccctccgtttaaccgtttcccggtacccggtaacggtaacgattaacggtggtaacttaacgtaccggaaacttaaccggttgtcggtacctacgaactaccttactcgttccgttnttaccc

SEQ ID NO: 81684 - DNA, 514 bp, Homo sapiens
  misc_feature: GYAE6OF02FHZ6Y.52.1.A01.1.454.CMB.1.raw
  modified_base (216)..(216): a, c, t, g, unknown or other
  misc_feature (216)..(216): n is a, c, g, or t
  modified_base (268)..(268): a, c, t, g, unknown or other
  misc_feature (268)..(268): n is a, c, g, or t
  modified_base (368)..(368): a, c, t, g, unknown or other
  misc_feature (368)..(368): n is a, c, g, or t
  modified_base (420)..(420): a, c, t, g, unknown or other
  misc_feature (420)..(420): n is a, c, g, or t
  modified_base (506)..(506): a, c, t, g, unknown or other
  misc_feature (506)..(506): n is a, c, g, or t
tcagcgcagtacgacacgaccggtgctcgatttagacgtctcatcaggggggagtcagtctcagtcaggacacagcatggacatgagggtccccgctcagctcctggggctcctgctactctggctccgaggtgccagatgtgtcatccagatgacccagtctccatcctccctgtccgcatctgtaggagacagagtcatcatcacttgccgggnaagtcagagcattagaacgtatttaaattggtatcaacagaaaccagggaancccctagactctgatctatgttcatcctactttgctggaggtcggggtacccagtccgaaggttcaggtggcagtggatcgtagggacagaattcactcncaccatccactagtctgcaggctggaggttatttgaccttaacttcttcgtntaccaacagtacgttactacgttccctactacgttccgcctcgggactatggtagatacacgaaacgtactgtgtctgaccacgtntctgttcc

SEQ ID NO: 81685 - DNA, 669 bp, Homo sapiens
  misc_feature: GYAE6OF02H7DQT.52.1.A01.1.454.CMB.1.raw
  modified_base (96)..(96): a, c, t, g, unknown or other
  misc_feature (96)..(96): n is a, c, g, or t
  modified_base (181)..(181): a, c, t, g, unknown or other
  misc_feature (181)..(181): n is a, c, g, or t
  modified_base (191)..(191): a, c, t, g, unknown or other
  misc_feature (191)..(191): n is a, c, g, or t
  modified_base (217)..(217): a, c, t, g, unknown or other
  misc_feature (217)..(217): n is a, c, g, or t
  modified_base (228)..(228): a, c, t, g, unknown or other
  misc_feature (228)..(228): n is a, c, g, or t
  modified_base (280)..(280): a, c, t, g, unknown or other
  misc_feature (280)..(280): n is a, c, g, or t
  modified_base (304)..(304): a, c, t, g, unknown or other
  misc_feature (304)..(304): n is a, c, g, or t
  modified_base (662)..(662): a, c, t, g, unknown or other
  misc_feature (662)..(662): n is a, c, g, or t
tcagcgcagtacgacacgaccggtgctcgatttagacgtctcatcaggggggagtcagtctcagtcaggacacagcatggacatgagggtccccgntcagctcctgggctcctgctactctggctccgaggtgccagatgtgtcatccagatcgacccagtctccatcctcccgtgccganatcgtgaggngacagatcatcatcacttggccgganaagtcagacgntaattagaacgttaatttaaagttggtatacaaacaagaaaccagggaaacnccctagaactcctagtatactagngttacacgtcctactttgctaggtacgtcggggtacccaagttacgaaacggttcgtaaggttgggacctaaggtttggtaacttcggtacggggaactaaaggtaccttacaaacctttccgttaccaaaccctagttacccaaaccgttacgtcgtacgaccgtaaggaccgtaggtacgttacgtttcgaaaccttaacgttttactttcgagttaacctaagtagtaacgtttacgtaccgtttacccgtacgttaaccgtttcccggacgttaccgggaactacgttaggtacggtaactacgtaaaccaaacgtacgttggtacgttacacggacctaactagtttaccgtntttaccc

SEQ ID NO: 81686 - DNA, 715 bp, Homo sapiens
  misc_feature: GYAE6OF02I0R9K.52.1.A01.1.454.CMB.1.raw
tcagcgcagtacgacacgaccggtgctcgatttagacgtctcatcagggcacagcatggacatgagggtccccgctcagctcctggggctcctgctactctggctccgaggtgccagatgtgtcatccagatgacccagtctccatccctccctgtccgcatctgtaggagacagagtcatcatcacttcggccgggacaagtcagagctaattaagaacgttaattttaaagttggtatacaaacaagaaaaccgaagggaaacgcccctagaacctcctagatcttagtggttcatcctactttgcgtgaggtcgggtaccctgtactaaggtcaggtggcgtagtggatcgtagggactaagtacttaccactcgtaccactactccaaccgtagtccgtcgacgtaggtccgttaaggtaacggtttattttaccggaacctttaaacctttaccgtttaccgtacggttaacccaaacgtaagtttaccggtttaaccttacccggtttacccctacgttacccggttttcccgggaccccgtttaacgggtaacccttaagggttaggttacggtaaacttaacgtaacccggtaaaaacgcggtttacgtcggtacgtaccggtacctaccggttaacttccgtttacggttacccttttcgaacccgtttacccccgttacccgtaccccttagttcggttaaaccg

SEQ ID NO: 81687 - DNA, 595 bp, Homo sapiens
  misc_feature: GYAE6OF02FVVR6.52.1.A01.1.454.CMB.1.raw
  modified_base (218)..(218): a, c, t, g, unknown or other
  misc_feature (218)..(218): n is a, c, g, or t
  modified_base (584)..(584): a, c, t, g, unknown or other
  misc_feature (584)..(584): n is a, c, g, or t
tcagcgcagtacgacacgaccggtgctcgatttagacgtctcatcaggggggagtcagtctcagtcaggacacagcatggacatgagggtccccgctcagctcctggggctcctgctactctggctccgaggtgccagatgtgtcatccagatgacccagtcctccatccctccctgtccgcatctgtaggagacagagtcatcatcacttgccgggnaagtcagagcattagaacgttaatttaaattggtatacaacaagaaaccgagggaaacgcccctagaacctctgatctatggttcactcctactttgctggtaggtcgggggtcccagttaccgtaaggttctaggtcggctagggtggatcgtaggggtacaagtaacttacacttctacacctactaccaaccgtacgtctcgcgaggtcgtaggtaggttagtttcgacttaacgtttacttctagtacctaagtacgttaagttacctacgtttccctacttaccgtttccgcccgttacggacctagtaggtcgtaacgtactaaccgaaacgtacttaggtcgtactcgtacctaccgtnttctcgttacc

SEQ ID NO: 81688 - DNA, 770 bp, Homo sapiens
  misc_feature: GYAE6OF02JE8W9.52.1.A01.1.454.CMB.1.raw
  modified_base (172)..(172): a, c, t, g, unknown or other
  misc_feature (172)..(172): n is a, c, g, or t
  modified_base (198)..(198): a, c, t, g, unknown or other
  misc_feature (198)..(198): n is a, c, g, or t
tcagcgcagtacgacacgaccggtgctcgatttagacgtctcatcagggcacagcatggacatgagggtccccgctcagctcctggggctcctgctactctggctccgaggtgccagatgtgtcatccagatcgacccagtctccatccctccctgtccgcatctgtagganacagagtcatcatcacttggccgganaagtcaggagtctaagttaagaaacgttatttaaagtttcggaatacgaaacgaacgaaaaccgaagggtaaaccgaccctaggtaacctcctagatactagttgtacacttcctacgtttcgcgttaggacggttccgggtaccctagtacgtaaacggttcgtacggtggacgtaggtggtaacgtcgcgggtaacaaggttaactcgtaactctacgaacctagaccctaacgtactacgtcgacgtacggtacgtaggtacggtttaacgtttcgacctttaaacgtttaccgttacgttagtacccgtaaagttaacgttaacgtttacttaccggttaccctttacgttaacccggtttccgtaccgttacgggaacccgttaggttacgggtttaccgtaaacgttacgttaaacccgtaaaacggttaccgtaaacgggttccgtaacggttaccggttaacccttaaccgttaccgtttaaccgttacccggtttacccctttaaggttaccccttttaacccggttccccgttacccggttaacgttaccgtttaaaccggg

SEQ ID NO: 81689 - DNA, 642 bp, Homo sapiens
  misc_feature: GYAE6OF02H23XQ.52.1.A01.1.454.CMB.1.raw
  modified_base (260)..(260): a, c, t, g, unknown or other
  misc_feature (260)..(260): n is a, c, g, or t
  modified_base (285)..(285): a, c, t, g, unknown or other
  misc_feature (285)..(285): n is a, c, g, or t
tcagcgcagtacgacacgaccggtgctcgatttagacgtctcatcagggcacagcatggacatgagggtccccgctcagctcctggggctcctgctactctggctccgaggtgccagatgtgtcatccagatgacccagtctcatcctccctgtccgcatctgtaggagacagagtcatcatcacttgccgggcaagtcagagcattagaacgtatttaaattggatcaacagaaaccagggaaagcccctgaacttccngatctatggttcatccactttgctnagtcggggtccatcaaggttcagttggcaggtgactcgtgggactaagaattcgaactcctctaaccagttacccaaccgtagtccttaggacgacggtcttaggacgggtttaagtttttggaacttaaaccttttaccgtttaactcggttactaaacccgtaagtaacggtttaactacgggttttaccccctctaaccgttttccgggaccccgttagggaaccctagtacgtaggaacttaataccgaaaacgaaccttggtacggacttaccggacttaaccgaccgtttacctaggttacccttttacaacgttcccgtttaccccccgtaacttaccgtacgtttacgg

SEQ ID NO: 81690 - DNA, 644 bp, Homo sapiens
  misc_feature: GYAE6OF02HNBBT.52.1.A01.1.454.CMB.1.raw
  modified_base (251)..(251): a, c, t, g, unknown or other
  misc_feature (251)..(251): n is a, c, g, or t
tcagcgcagtacgacacgaccggtgctcgatttagacgtctcatcagggcacagcatggacatgagggtccccgctcagctcctggggctcctgctactctggctccgaggtgccagatgtgtcatccagatgacccagtctccatcctccctgtccgcatctgtaggagacagagtcatcatcacttgccgggcaagtcagagcattagaacgttatttaaattggtatcaaacagaaaccagggaaacncccctagaactcctgatctatgtcatccattgctgacgtcgggtccatcgtaaggtcaggtggctaggtgatcgtgggacagtaacttcacttctaccacctatacccaccgtacgtacgtcgaccgaacggtcgtagggtaacggttacgtttttacggaccttaaacgtttaccgtttcgtacggttaacctaaaccgtaaggttaccgtttaacctacggtttcccctacgttacccgtttccggtaccccgttagggaccctaagttacggttaggtaacttaacgtaccgaaaaccggtacgttggtacgtactcggtaaccaccttagtccgttacgtacctttacgaacctttccccgttccccggtaccttacttaccgttaacg

SEQ ID NO: 81691 - DNA, 709 bp, Homo sapiens
  misc_feature: GYAE6OF02IPJJE.52.1.A01.1.454.CMB.1.raw
  modified_base (202)..(202): a, c, t, g, unknown or other
  misc_feature (202)..(202): n is a, c, g, or t
  modified_base (277)..(277): a, c, t, g, unknown or other
  misc_feature (277)..(277): n is a, c, g, or t
tcagcgcagtacgacacgaccggtgctcgatttagacgtctcatcagggcacagcatggacatgagggtccccgctcagctcctggggcctcctgctactctggctccgaggtgccagatgtgtcatccagatcgacccagtctccatccctccctgtccgcatctggtaggagacagagtcatcatcacgttggccggganaagtcagacgctaagttagaaacgttaattttaaagttggtaactacgaaacacggaaaaccgaaggggaaaccncccctagaacctccgtagtacttacgtagttcggttaccacttccctaacttttcggcgttggtacgggttccgggtacccagttacgtaacggttcgaggtggcaaggtcggactcggtagggaacagtaacttccgacttccgtacaacctactacctaaccgtacgttcgtcgacgtacggtcgtaggtaacggttacttttacggaacctttaaacttttccgttacgtacgtaaacctaagttacgttacgttaccgttaccgtttccctagttaccgtttccgggcccgttacggaacctaggtaacgttacggtaacttaaccgtaacgaaaccgttagtacggtacggaccttacggaccctaccgttattccgttcttacgttcctaaccgtttccccgtacccgtacttaccgtattaacgg

SEQ ID NO: 81692 - DNA, 625 bp, Homo sapiens
  misc_feature: GYAE6OF02HSP6N.52.1.A01.1.454.CMB.1.raw
  modified_base (134)..(134): a, c, t, g, unknown or other
  misc_feature (134)..(134): n is a, c, g, or t
  modified_base (291)..(291): a, c, t, g, unknown or other
  misc_feature (291)..(291): n is a, c, g, or t
  modified_base (436)..(436): a, c, t, g, unknown or other
  misc_feature (436)..(436): n is a, c, g, or t
tcagcgcagtacgacacgaccggtgctcgatttagacgtctcatcaggggggagtcagtctcagtcaggacacagcatggacatgagggtccccgctcagctcctggggctcctgctactctggctccgaggtnccagatgtgtcatccagatgacccagtctccatccctccctgtccgctatctgtaggacgacagagtcatcatcacttcggcccggacaagtcagacgctaattaagaaacgttaatttaaaagttggtatacaaacaagaaaccgaagggaaaccncccctagaacctccgtagacttactagttcgttacactcctattttcgctggtaggtcggggtacccatacgtaaggttcaggtgctaggtggatcggtaggaactagtaacttcactcctacaccactaccacgtagtctacgngtacgcgtaggtaggttactttcgtaccttaactttaccttcgtacgttaaccaagtacgttaacgtttaacctccgttacccttaccgttaccgtttccggacccgttacggaacctagttacgtagtaactactaaccgaaaacgtcgtacggtgtccgtacgacctacgtaacttccgtagttacc

SEQ ID NO: 81693 - DNA, 725 bp, Homo sapiens
  misc_feature: GYAE6OF02HKZ2R.52.1.A01.1.454.CMB.1.raw
  modified_base (299)..(299): a, c, t, g, unknown or other
  misc_feature (299)..(299): n is a, c, g, or t
tcagcgcagtacgacacgaccggtgctcgatttagacgtctcatcaggggggggagtcagtctcagtcaggacacagcatggacatgagggtccccgctcagctcctggggctcctgctactctggctccggaggtgccagatgtgtcatccagatgacccagtctccatccctccctgtccgcatctaggtaggagacagagtcatcatcctacgttcggccgggctaagtcagagactaattaagaacgttaatttaaagttggtaatacaaacgaacgaaaccgaacgggtaaacnccccgtagaacctccgtagtactcttagttggttacctacttcctactttcgcttggtacggtcgggtaccctagtccgtaaggttcagggtggacgtaggtggtacgtcggtagggaactagtaacttaccacttcctaccaacctacctcctaaccgtagtccgtcgacgacgggttacttggtaacggttacttttacgtaaccttaaaaccgttttctttaccgttacggttaaccaaacgttaacggtttaaccgtttaaccgtaccccgttttaccccgttacgttacccgggttttacccccgggccggttaacccgggaaccttagggtacggttaacggtacttaactaaccgtaaacgggtaccttgggtaccgttaccgtaccgacttacccgttacgttccggttaccttaccg

SEQ ID NO: 81694 - DNA, 827 bp, Homo sapiens
  misc_feature: GYAE6OF02GD0K4.52.1.A01.1.454.CMB.1.raw
tcagcgcagtacgacacgaccggtgctcgatttagacgtctcatcagggcacagcatggacatgagggtccccgctcagctcctggggctcctgctactctggctccgaggtgccagatgtgtcatccagatgacccagtctccatcctccctgtccgcatctgtaggagacagatcatcatcacttgccggcaagtcagagctaattagaacgttatttaaagttggtatacaacaagaaaccgaagggaaacgcccctagaaccgttcctagtatctaacttcggttacacttacctaacgtttgcgttaggacgggtcggggtacccctaagtaccgtaacgggtttctaagggttcgggtaccgtaagggttacgggtaacgtttccggtaacgggggtaaacctaacgggttaaaacctttaccgtaaacccgttaccctaaccctaaccccgtaacttaccccaaacccggttagttacccgtaggtacccggtaagggttaccgtaggttaacgggtttactttttacgtaacctttaaaccttttaaccgtttaccgttaggttaacccaaacgttaacggtacgtttaacccttacgtttccccttaccgttaaccggttttcccggtacccggttacgggaaccttagttaacggttacggtaactttaaccgtaaacccgtaaaaggttaccgttacggttcggtacccgttacggtaaccctaaccggttaactttcccggtttaacttttcccgtttaaccggttaacccttttccccggttaaccccgaccgtttaaccgtttccgttaaacg

SEQ ID NO: 81695 - DNA, 671 bp, Homo sapiens
  misc_feature: GYAE6OF02HWZSU.52.1.A01.1.454.CMB.1.raw
  modified_base (176)..(176): a, c, t, g, unknown or other
  misc_feature (176)..(176): n is a, c, g, or t
  modified_base (201)..(201): a, c, t, g, unknown or other
  misc_feature (201)..(201): n is a, c, g, or t
  modified_base (660)..(660): a, c, t, g, unknown or other
  misc_feature (660)..(660): n is a, c, g, or t
tcagcgcagtacgacacgaccggtgctcgatttagacgtctcatcagggcacagcatggacatgagggtccccgctcagctcctggggctcctgctactctggctccgaggtgccagatgtgtcatccagatcgacccagtcctccatccctccgtcgtccgcatctggtaagganacagatcatcatcacttggccgganaagtcagagctaagtttaagaaacgtttattttaaaacgttggtaatacaaacaacggaaaaccgaggggaaaaccgtcccctaggaaacctccgtagtacttcgtagttcggttactactccctagttttgacgtaggtacggtccgggtacccagtacgtaagggttacaggtggactaggtgtactcggtagggaactaggtaactcactctacactagtcccacgtgtcctagcgtaggtacgtcggtaaagtttacgtttcgaaccgtttaacctttacgttcgtacgtaacaaacgttaggttaccttaacgttaccgtttcccgtacgtcccgtttacccggacccggtacgtaccgtaagttacggtactacttaccgtaaacgaaacgtttcgtcgtacggtctacgtaccgacttcgtacgttcgtaccttacgtactcccgttacccntacgttatacg

SEQ ID NO: 81696 - DNA, 620 bp, Homo sapiens
  misc_feature: GYAE6OF02H7HJO.52.1.A01.1.454.CMB.1.raw
tcagcgcagtacgacacgaccggtgctcgatttagacgtctcatcagggcacagcatggacatgagggtccccgctcagctcctggggctcctgctactctggctccgaggtgccagatgtgtcatccagatgacccagtctccatccctccctgtccgcatctgtaggagacagagtcatcatcacttgccggcaagtcagagcattaagaacgttattttaaattggtaactcaaacgaagaaaccgaagggaaacgccccgtagaacctcctagatctagtcggttacatcctctttgtctggacggtcgggtcccagtacgtaaggttcgaggtggcaggtgacgtcggtagggactagtaactctactctacacctatacacctacgtctcggcgtacggcgttagggtaggtttacttttacggaaccctttaactttccgttcgtaacgtacctaaacggtacgtttaaccgttaccgtaccgtttcccgttcccttaaccgtttcccggcccgttacgggaccttaagtaggtacgtaatacgtacgtaaacgttagtgtacgtctacgctacctcttccttcgtcttactaccttccgtcccactctgtac

SEQ ID NO: 81697 - DNA, 552 bp, Homo sapiens
  misc_feature: GYAE6OF02HYSK7.52.1.A01.1.454.CMB.1.raw
  modified_base (199)..(199): a, c, t, g, unknown or other
  misc_feature (199)..(199): n is a, c, g, or t
  modified_base (234)..(234): a, c, t, g, unknown or other
  misc_feature (234)..(234): n is a, c, g, or t
  modified_base (254)..(254): a, c, t, g, unknown or other
  misc_feature (254)..(254): n is a, c, g, or t
  modified_base (324)..(324): a, c, t, g, unknown or other
  misc_feature (324)..(324): n is a, c, g, or t
  modified_base (359)..(359): a, c, t, g, unknown or other
  misc_feature (359)..(359): n is a, c, g, or t
  modified_base (517)..(517): a, c, t, g, unknown or other
  misc_feature (517)..(517): n is a, c, g, or t
  modified_base (522)..(522): a, c, t, g, unknown or other
  misc_feature (522)..(522): n is a, c, g, or t
  modified_base (528)..(528): a, c, t, g, unknown or other
  misc_feature (528)..(528): n is a, c, g, or t
tcagcgcagtacgacacgaccggtgctcgatttagacgtctcatcagggcacagcatggacatgagggtccccgctcagctcctgggggctcctgctactctggctccgaggtgccagatgtgtcatcccagatgaccccagtctccatcctccctgtccgcatctggtaggagacagagtcatcatcacttgccgggnaagtcagagcattagaacgttattttaaatggtancaacagaaaccagggaaacncccctagaactcctgatctatgtcatccattgctgaggtcgggtccatcaaggttcagtgcagtgatcgngggactagtactcgactctaccacatcaccagtcngcaggctagaggttatttcgacgtaactttactactcgtaacaacgtagtacgttacgttaccgtttaccctaccgttaccggtttccggcccgttacgggacctagttaggtacgtattactaaccgaaacgtcgttggtacgcctacgctaacctntcgtntctacncgttcctacccgcttactctaacg

SEQ ID NO: 81698 - DNA, 642 bp, Homo sapiens
  misc_feature: GYAE6OF02H8JUS.52.1.A01.1.454.CMB.1.raw
tcagcgcagtacgacacgaccggtgctcgatttagacgtctcatcgagggggggagtcagtctcagtcaggacacagcatggacatgagggtccccgctcagctccgtggggctcctgctactctggctcgaggtgccagatgtgcatccagatcgaccagtcctccatccctccctgtccgcatctgtaggagacagacgtcaatcaatctacgttcggccgggactaagtcagagactaattaagtaaacgtttaaatttaaagttaggtataacaaacgtaacgaaaaccgaagggaaacctcccctaagtaacctcctagtataccgtagttgtactactaccttactttgacgttggtacgggtacggttaccctaagtaccgtaaaggtctaaggtcgacgtagtggaactggtaggacagttactccgaatccgtacacgactacaccgtagcctagcgtaaggtctaaggtacggtttatttaccgaagttaacttacttcgtagtaaccaagtacgtaacttaccgtactttcccctgttaaccgtccgaacgtaggacttagagttacgagtacttaaacgaacgtaacggttgacgtacctacgaccgttaaccacgtttaccgtcttacc

SEQ ID NO: 81699 - DNA, 688 bp, Homo sapiens
  misc_feature: GYAE6OF02ISVLR.52.1.A01.1.454.CMB.1.raw
tcagcgcagtacgacacgaccggtgctcgatttagacgtctcatcaggggggagtcagtctcagtcaggacacagcatggacatgagggtccccgctcagctcctggggctcctgctactctggctccgaggtgccagatgtgtcatccagatgacccagtcctccatccctccctgtccgcatctgtaggagacagagtcatcatcctacgttcggccgggacaagtcaggacgactattaagaacgttaatttaaagttggtatacaaacgaacgaaaccgaagggaaacgtccccgtagaaccttccgtagtactcgtagttcggttactacttcctactttgctggtacggttcggggtaccctagtacgtaacggttcgaggtcggactaggtacggtatcggtagggaactagtaacttaccgactcctacgacctactaccaaccgtagtcgtcgacgtacggtcgtaggtagttactttacgaccttaacctttacgttacgttacgtaccgtaaagttacggttaacgtttacccgttaccgttccccgttacgttacccggtttacccggtacccggttaacggaccttagtacggttaacgtacgttaaccggtaaccgtaaaccgtacggtttcgtacggtcctacgtacctaaccgtacgtttccgttacgttcc

SEQ ID NO: 81700 - DNA, 635 bp, Homo sapiens
  misc_feature: GYAE6OF02JLC16.52.1.A01.1.454.CMB.1.raw
  modified_base (207)..(207): a, c, t, g, unknown or other
  misc_feature (207)..(207): n is a, c, g, or t
  modified_base (233)..(233): a, c, t, g, unknown or other
  misc_feature (233)..(233): n is a, c, g, or t
  modified_base (260)..(260): a, c, t, g, unknown or other
  misc_feature (260)..(260): n is a, c, g, or t
  modified_base (274)..(274): a, c, t, g, unknown or other
  misc_feature (274)..(274): n is a, c, g, or t
  modified_base (289)..(289): a, c, t, g, unknown or other
  misc_feature (289)..(289): n is a, c, g, or t
tcagcgcagtacgacacgaccggtgctcgatttagacgtctcatcagggggggaggtcagtctcagtcaggacacagcatggacatgagggtccccgctcagctcctggggctcctgctactctggctccggaggtgccagatgtgtcatccagatgacccagtctccatcccgtccctgtccgcatctggtaggagacagtacgtnagtcatcacttggccggcagtcaganctatagaactattaaatggtatacaanagaaacaggaaacnccctagaactcgtanatctatggtcactacctatttcgctaggacggtcggtaccatacgtaagtcgtagtgcaggtagatgtacgggaatacggtaattaccgtaccttcgtaccctaaccgtactaccgtaaccctaaggttccctaggtaccgtaaggtccggttaggtaacggtttaccgtttaagtacccgttaaaccttttcctacgttacgtacaaacgtaaagttaccgttaaccgtaccgttacccttaccgtaccgtttacccggaccgttcggaacttacggttaggacgtaactaactaaccgtaaagaccgttggacgtacctacggacctactacttactaccttcg

SEQ ID NO: 81701 - DNA, 786 bp, Homo sapiens
  misc_feature: GYAE6OF02HVHOZ.52.1.A01.1.454.CMB.1.raw
tcagcgcagtacgacacgaccggtgctcgatttagacgtctcatcaggggggagtcagtctcagtcaggacacagcatggacatgagggtccccgctcagctcctggggctcctgctactctggctccgaggtgccagatgtgtcatccagatcgacccagtcctccactccctccctgtccgcactctggtaggagacgagagtacatcatctacgttcgggacccggggactaaggtccgaaggacgtaccgtaaagtttaacggtaaacggtttaaatttttaaaaagtttcgggtaaacttaaccgaaaaccgaaaacggtaaaaaccccggaagggggtaaaacccgtcccccgttaacgtaaacccttcccgttagtactttacgtacggtttcggttacctaaccttccctaacgtttttcggcgttagggtacgggttaccggggttacccacgttacggtaacggtttccgagggttcgacgtaggttaggtacgtcggtagggactaaggtacttccacgtcacccgtactactccaccgtagtcgtacacggtacgcggttaaggtagttaagtttccgtagttaaccgtttacgttccgtaagtaccgaattaacgtaacgtaccttacccggttcccttacgttaccgggtttaccgtcccggtaacggtaccgagtttacgggtacttaacgtaacgtaaacgtaaaccggtggtacccggtttacgggtcctaaccgggtccaacccgtttacgttccttacgttaccccc

SEQ ID NO: 81702 - DNA, 683 bp, Homo sapiens
  misc_feature: GYAE6OF02FG80N.52.1.A01.1.454.CMB.1.raw
  modified_base (668)..(668): a, c, t, g, unknown or other
  misc_feature (668)..(668): n is a, c, g, or t
tcagcgcagtacgacacgaccggtgctcgatttagacgtctcatcaggggggagtcagtctcagtcaggacacagcatggacatgagggtccccgctcagctcctggggctcctgctactctgctccgagtgccagatgtgtcatccagactgacccagtcctccatcccgtccctgtccgcatctgtacggacgacagtacgtccatcattccacgttcggccgggtcaaagtcaagcgactagttaagaacgttaatttaaacgttcggtataccaaacgacgtaaaccgaagggaaacctcccctagaacctcgtacgatacctatcggtctaacgtcctacgttgctacggtacggtaccgggtaccctaggtacgtacggtcgtaggtacgcgtaggtacgtagtcgtacggtaacaacgttaactccgtaacctacaccgtaacctacgtaaccaccgtacgtccgtacgacgtaccggtacgttaccggtagttacttttacggacctttaacgttaccgttagttacctaaccgtaaacgttcggtaacttaacccgttacgtttacccgtacgtttacccgtaaccgtcggttaccggaacctacgtacgtaacggtacctacgtaacctaaacggtccttggaccgttcgcaccttancgttactacggttac

SEQ ID NO: 81703 - DNA, 586 bp, Homo sapiens
  misc_feature: GYAE6OF02FGCH8.52.1.A01.1.454.CMB.1.raw
  modified_base (225)..(225): a, c, t, g, unknown or other
  misc_feature (225)..(225): n is a, c, g, or t
  modified_base (383)..(383): a, c, t, g, unknown or other
  misc_feature (383)..(383): n is a, c, g, or t
  modified_base (406)..(406): a, c, t, g, unknown or other
  misc_feature (406)..(406): n is a, c, g, or t
tcagcgcagtacgacacgaccggtgctcgatttagacgtctcatcaggggggagtcagtctcagtcaggacacagcatggacatgagggtccccgctcagctcctggggctcctgctactctggctccgaggtgccagatgtgtcatccagatgacccagtctccatcctccctgtccgcatctgtaggagacagagtcatcatcacttcgccgggcaagtcagngcattagaacgtatttaaattggtatacaacaagaaaccgagggaaacgcccctagaacctcctagatactatggttacacttcctactttgctagaggttcggggtcccagtactaaggttcagtgcagtgatcgtgggacagtatcactcacacancacatctgcaggtctggtagttntttagacttaacttacttctagtacctaacagtaacgtttaactacgtttacccctacttacccgtttccgacccggtgggaaccctaagttaggtacgtaacttaactaacccgtaaaacgtaacccgtttggtacggtaccgttcggaaccctaacccggtatttccgtgtttaaccc

SEQ ID NO: 81704 - DNA, 704 bp, Homo sapiens
  misc_feature: GYAE6OF02IHSSI.52.1.A01.1.454.CMB.1.raw
  modified_base (241)..(241): a, c, t, g, unknown or other
  misc_feature (241)..(241): n is a, c, g, or t
tcagcgcagtacgacacgaccggtgctcgatttagacgtctcatcagggcacagcatggacatgagggtccccgctcagctcctggggctcctgctactctggctccgaggtgccagatgtgtcatccagatcgacccagtcctccatccctccctgtccgcatctggtaggagacagagtcatcatcacgttgccgggacaagtcagagctattagaacgttatttaagtggtatacaanaagaaaccgaagggaacgcccctagaacctccgtagtactatagttggtaccacttcctacttgccgtaggtacggtcgggtaccctagtacgtaacggttcgaggttggaccgtaggtacggtacgtaccggtagggtaactaacggttaacttccgtaacttctaaccgtaactacttacccaaaccgtcgtacgtacgacccggtagtcgtaggtaacgttacttttacgaccttaaacgtttcgttcgacgttaacgaaacgttaggtacgtttaacctcccgttaaccgtcttacccggtttaccgcccgggtaagtacccgtaagtttaacgtaggtaacttaacgtaaacgtaaaccgtacggttggtacctacggtacgaacctaacccgtgttacccgttagttacccgttacttccggttaacccttaccccggtacttaccgtagtttaacg

SEQ ID NO: 81705 - DNA, 775 bp, Homo sapiens
  misc_feature: GYAE6OF02HEPOH.52.1.A01.1.454.CMB.1.raw
tcagcgcagtacgacacgaccggtgctcgatttagacgtctcatcagggcacagcatggacatgagggtccccgctcagctcctggggctcctgctactctggctccgaggtgccagatgtgtcatccagatgacccagtctccatcctccctgtccgcatctgtagagacagagtcatcatcacttgccggcaagtcagagcaattacgaacgtatttaaagtggtatcaacgtaagaaaccagggaaacgcccctagaaccttcctagattctaatcggttacattcccacgtttagtccgtaggacggttcggggtacccctaagttccgtaaagggtttccaagggttacgggaccgtaaggttcgggtaacgtcggttaggggaacctaaggtaaccgttcaaccgttctaccaacctatcccgaaccacgttctacggacgtacggtcctaggtaacgggttactttttacggaacccttaaacgttttaccgtttactaccgttaacgtaaaccgtaacggttaaccgtttaaccgtaccggttttaccccgttacctttaaccccgggttttacccggtccccgtaacggggttaccctaacgtaagggtttaaccgggtaacgtttaaacgtaaacccgtaaaaccggttaacgttaccgggtacggtactaaccggtacccctacgttaacccgttcggtttacgttacccgttaccgttacccgtttaccccgttccccggaaccttacggttcccgttaaacg

SEQ ID NO: 81706 - DNA, 700 bp, Homo sapiens
  misc_feature: GYAE6OF02GQF7T.52.1.A01.1.454.CMB.1.raw
  modified_base (97)..(97): a, c, t, g, unknown or other
  misc_feature (97)..(97): n is a, c, g, or t
  modified_base (226)..(226): a, c, t, g, unknown or other
  misc_feature (226)..(226): n is a, c, g, or t
tcagcgcagtacgacacgaccggtgctcgatttagacgtctcatcaggggggagtcgagtctcagtcaggacacagcatggacatgagggtccccgntcagctcctggggctcctgctactctggctccgaggtgccagatgtgtcatccagatgacccagtcctccactccctaccctgtaccgcactctaggtacggagacagagtcatcatcacttgccgganaagtcagagactattaagaacgttaatttaaagttggtaactacaacgaacgtaaaccgagggtaacgcccctagtaaccgtcctagtacttactagttcggttacgaccttacctacctttggacgttggtaacgggttcgggggtacctacgtacgttacggtcgaggtacggctaaggtggtacgtacggtgggtaacattactaccaccttacaccgtacaactcccactacgtcgtcgacggtggtacgtcggtagttcgttacgaacgttacctttacgtcgtttagaccgtaagtacgtaagttacccttaccgttacccttacggttcccgttaaccggtcccggtaacgggtcctaaggttacggtaacgttacggtaaaccgttaaacccgtaacggttaaccggttcgttaccgggtacccgttaccggaacccttacgttaccttaccggtttgttaccccc

SEQ ID NO: 81707 - DNA, 756 bp, Homo sapiens
  misc_feature: GYAE6OF02JBZSA.52.1.A01.1.454.CMB.1.raw
  modified_base (211)..(211): a, c, t, g, unknown or other
  misc_feature (211)..(211): n is a, c, g, or t
tcagcgcagtacgacacgaccggtgctcgatttagacgtctcatcagggcacagcatggacatgagggtccccgctcagctcctggggctcctgctactctggctccgaggtgccagatgtgtcatccagatgacccagtctccactccctccctgtccgactacttctaggtacggagacagtagtcatcgatccacgttcggccggganaacgtcgacgagctaagttaacgaacgttaattttaaagttggtaataccaaacgaacgaaaccgtaagggaaccgtcccgtaagtaacctccgttagaacttactacgttcggttacctactccgttaaccgtttggtcgttacgtacgggttacgggttaccccaacgttacggtaaacggtttcgtaagggtacggttacctaagggttacggtaacgtcgggttaacgggaaccttacggtaaacttccgtaacctacgtacctaaccaacgttacccaaccgttattaccgacggtacctacggtacgtaggttacgttacgtttaccgtaaccttaactttacggttacttaaccggtactaaacggttacgttaacgtaaccgttccgttacccgtacctaccggtttccgaccgtaccggtactaacgtacggtagttactaacgtacgaaacgtcgtagtcgtacgtacgtccgtacctacgttaccttcgtaccgttacttacccttaccgttccgtacctacgttaccgttaag

SEQ ID NO: 81708 - DNA, 711 bp, Homo sapiens
  misc_feature: GYAE6OF02HV0FT.52.1.A01.1.454.CMB.1.raw
  modified_base (188)..(188): a, c, t, g, unknown or other
  misc_feature (188)..(188): n is a, c, g, or t
  modified_base (212)..(212): a, c, t, g, unknown or other
  misc_feature (212)..(212): n is a, c, g, or t
  modified_base (447)..(447): a, c, t, g, unknown or other
  misc_feature (447)..(447): n is a, c, g, or t
  modified_base (684)..(684): a, c, t, g, unknown or other
  misc_feature (684)..(684): n is a, c, g, or t
tcagcgcagtacgacacgaccggtgctcgatttagacgtctcatcaggggggagtcagtctcagtcaggacacagcatggacatgacgggtccccgctcagctctggggctcctgctactctggctccggaggtcgccagatgtgtcatccagatcgacccagtcctccattccctccctgtcccganactctggtaggagacgagtagtcntacattcacgttcggaccgggacaagtcagacgctaattaggaaacgttagttttaaaacgttgtaacttaccaagaacgaaaccgaacgggaacgccccgtacgaacgtcctaggtactttcgtagttacggttacctaacttcccgttactttcgacgttcgggtacggttcggggtacccagttaccggtaaggttctagggtcgggtaacgtagtacgggtacttacgggngggtaaactaaggtaaccttcgaccttctaccaacccgtactaccgaacgttcgtaccgagtcgacggtactagggtacgttaacgtttacgtactaacctttacgttactacgtacgtaacgtacgttaactccgttaaccgtttaccctcgtttaaccgttccggtacccgtaggaaccgtaccgttagtacggtaacaacgttaaccgaagtaaccgtttcggaggttccgtanacccgtactactttaccgtcgttaccg

SEQ ID NO: 81709 - DNA, 699 bp, Homo sapiens
  misc_feature: GYAE6OF02IQB86.52.1.A01.1.454.CMB.1.raw
  modified_base (168)..(168): a, c, t, g, unknown or other
  misc_feature (168)..(168): n is a, c, g, or t
  modified_base (209)..(209): a, c, t, g, unknown or other
  misc_feature (209)..(209): n is a, c, g, or t
  modified_base (283)..(283): a, c, t, g, unknown or other
  misc_feature (283)..(283): n is a, c, g, or t
  modified_base (637)..(637): a, c, t, g, unknown or other
  misc_feature (637)..(637): n is a, c, g, or t
tcagcgcagtacgacacgaccggtgctcgatttagacgtctcatcagggcacagcatggacatgacgggtcccccgctcagctccgtggggcctcctgctactctggcctccgaggtgccagatgtgtcatccagatcgacccagtcctccactccctccctgtccgntatctggtaggagacagagtcatcatcacgttcggccgganaagtcaagcgactaattaacgaaacgttatttaaagttggtactacgaaacgaacgaaaaccgaagggaaaccnccccgtaagaacctccgtagtattacgtagtcggttacctacgtacccgtagtttcgacgtaggaacggtccgggtaccctaataccggtaacggttcgaaggtcggacgtagtacggtattccggtaggaaactacgtacttacctaccttcgtaacccaactaactccgaaccgtacgtcacggacgtagtcgtaacgggtaattacgtttaccgactttaaacgtttacgtcgtacgtaaacgaaacgttacggttaaaccgttacgtaacccttttacccgacgtttaacccgttcccgggaaccgttacggtaacctagttaggacgtaatactaacgaaacgttacgngtacgctaccgacctacgtagttctacgtcttcgaccttccccgtaccacttacgtgtaaag

SEQ ID NO: 81710 - DNA, 794 bp, Homo sapiens
  misc_feature: GYAE6OF02GHWLQ.52.1.A01.1.454.CMB.1.raw
  modified_base (181)..(181): a, c, t, g, unknown or other
  misc_feature (181)..(181): n is a, c, g, or t
  modified_base (221)..(221): a, c, t, g, unknown or other
  misc_feature (221)..(221): n is a, c, g, or t
  modified_base (230)..(230): a, c, t, g, unknown or other
  misc_feature (230)..(230): n is a, c, g, or t
  modified_base (287)..(287): a, c, t, g, unknown or other
  misc_feature (287)..(287): n is a, c, g, or t
tcagcgcagtacgacacgaccggtgctcgatttagacgtctcatcaggggggagtcagtctcagtcaggacacagcatggacatgagggtccccgctcagctcctggggctcctgctactctggctcgaggtgccagatgtgtcatccagatgacccagtcctccactccctcctgtccgntactctgtaggagacagatcatcatctacttcggccgganaagtcaganactaattaagtaacttaatttaaagttggtactaacaacaagaaaccgagggaaccncccgtaagaacctcgtagacttcgtagtcggttaccattccgttattcgcgtacgggtaggttccggggtacctagttacgtacggttcgtaggtacgcgtacggtggtactacgggtacggtaacgtacgttaaccgttctaacccgtttacgtaccgaacccgttaacgtacccgtaaccgttacggttaccggtaacgtacgggtaaaccgggttcgtaacgggtttaacgggtttacttttaacggaacccttttaaacccgttttccgtttaccgtttaacgtaaccggtaaaacgttacggttaaccgttttaccgttaaacccgttttcccgttaacccgggttttaacccggttcccgggtaccccggttaaggggttacccgtaacggtttaccggggtagttaaccgtttaacggtaaaccgttaaacggtaccggtttacgggttaccggtaccgttacggtaaccttaccgtacgtttcccggttatttacccgg

SEQ ID NO: 81711 - DNA, 585 bp, Homo sapiens
  misc_feature: GYAE6OF02GO1SW.52.1.A01.1.454.CMB.1.raw
  modified_base (216)..(216): a, c, t, g, unknown or other
  misc_feature (216)..(216): n is a, c, g, or t
  modified_base (258)..(258): a, c, t, g, unknown or other
  misc_feature (258)..(258): n is a, c, g, or t
  modified_base (273)..(273): a, c, t, g, unknown or other
  misc_feature (273)..(273): n is a, c, g, or t
  modified_base (578)..(578): a, c, t, g, unknown or other
  misc_feature (578)..(578): n is a, c, g, or t
tcagcgcagtacgacacgaccggtgctcgatttagacgtctcatcaggggggagtcagtctcagtcaggacacagcatggacatgagggtccccgctcagctcctggggctcctgctactctggctccgaggtgccagatgtgtcatccagatgacccagtctccatcctccctgtccgcatctgtaggagacagagtcatcatcacttgccgggnaagtcaagagcattaagaacgttatttaaattggtatcaaanagaaacagggaaacnccctagaacctcctgatctatggttcatccactttgctgacgtcgggtacccagtcgtaaaggtcagtggactagtggatctagggacagtaactcgactctacgacctataccaaccgtagtcgttacggcaggacgtgacgggttatttcgaccttaacttactttcgacgttacaaacctaggtaacgttaaccgtacgtttaccctacgtacgttttacccggccgttacggacctacgtacgttggtacctattaccgaaacggtacttaggacggtcgtacgccgtacctattaccgtnttaaccg

SEQ ID NO: 81712 - DNA, 609 bp, Homo sapiens
  misc_feature: GYAE6OF02GX7SP.52.1.A01.1.454.CMB.1.raw
  modified_base (215)..(215): a, c, t, g, unknown or other
  misc_feature (215)..(215): n is a, c, g, or t
  modified_base (224)..(224): a, c, t, g, unknown or other
  misc_feature (224)..(224): n is a, c, g, or t
  modified_base (271)..(271): a, c, t, g, unknown or other
  misc_feature (271)..(271): n is a, c, g, or t
tcagcgcagtacgacacgaccggtgctcgatttagacgtctcatcaggggggagtcagtctcagtcaggacacagcatggacatgagggtccccgctcagctcctggggctcctgctactctggctccgaggtgccagatgtgtcatccagatgacccagtctccatccctcctgtccgcatctgtaggagacagagtcatcatcacttgccggnaagtcagancattagaacgttatttaaattggtatacaacacgaaaccagggaacncccctagaacctcctgacttctagttggtcactcctactttgctgtaggtcggggtacccagtacgaaggttcaggtcggcagtggatcgtagggaacagtaatcactctacaccatccaacctagtctcgacgtagtcgtagaaggtttactttcgaccgttaactttacgttcgtagtaccaaagtacgtactttaccgtcgtttaccctacttacccgttttccggacccgtacgggaccttacgtaggtaggtaacttaacgttaaccaaaaccggttaacgttgggtacggttacgtacggtacccctaaacgtcgtttaccttaggttaccc

SEQ ID NO: 81713 - DNA, 735 bp, Homo sapiens
  misc_feature: GYAE6OF02IQO6D.52.1.A01.1.454.CMB.1.raw
tcagcgcagtacgacacgaccggtgctcgatttagacgtctcatcagggcacagcatggacatgagggtcccccgctcagctcctggggctcctgctactctggctccgaggtgccagatgtgtcatccagatgacccagttctccatccctccctgtccgctatcgtgtaggagacagagtcatcatcctacgttcggccgggacaacgtcgaaggacgacgtaagttaacggtaacgttaagttttaaagttggtaactaccgaaacgaaacggtaaacccgaaaggggaaacctaccccccgtaaggtaacccttccgtaggtacttacttaagttcgttacgttactacccttaacgtttcgtaccgtagggtaacggggttccgggtacccctaagttaccggtaaacgggtttccgaagggttgaccggtaggtcgtagttacggtagggaactacgtaagtttcctaccctctacctaactacgtacccaaccgtcgtacgtcgcgtaacgtcgtaaggtaggttactttacggactaaacctttcttactacgtactaacgtacgtttactaccttaccgtccttaccgtaccgttccggccgtacggtacctaagttagtaagtacttaacgtaaacaaacggttctacggtcgtcgtaccgacctaccttacgtccgttaccgttcttacctccggttacctacccccgtatccgttattaaccg

SEQ ID NO: 81714 - DNA, 692 bp, Homo sapiens
  misc_feature: GYAE6OF02H5ART.52.1.A01.1.454.CMB.1.raw
tcagcgcagtacgacacgaccggtgctcgatttagacgtctcatcagggcacagcatggacatgagggtccccgctcagctcctggggctcctgctactctggctccgaggtgccagatgtgtcatccagatgacccagtctccatcctccctgtccgcatctgtaggagacagagtcatcatcacttgccgggcaagtcagagcattaagaacgttatttaaattggtatacaacagaaaaccgagggaaaacgcccctagtaacctcctagactacttattggttacatccctactttgtcgtagacggttcggggtaccctagtacgtaaggttcaggttggacgaggtggacgtcgtaggggactaggtaacttcgtaccttacctaccacctaacgtaccaccgtaacgttccgtacgccgagggtacttacgggtaagggtttaacttttcggaacctttaaacttttaaccctttacgttcgttaactaaacgttaacgttacgtttaacctaccgttttaccctacgttacccgtttcccgggtacccggttacgggacccgttaagttaggtacgttaattaacgtaaacgtaaaccgtagttagtacgggtctacggtaccaccctagttcctttcggtaccctttactaccttcccgttaccccgtacttacgttctaacg

SEQ ID NO: 81715 - DNA, 642 bp, Homo sapiens
  misc_feature: GYAE6OF02FZ2V0.52.1.A01.1.454.CMB.1.raw
  modified_base (272)..(272): a, c, t, g, unknown or other
  misc_feature (272)..(272): n is a, c, g, or t
  modified_base (406)..(406): a, c, t, g, unknown or other
  misc_feature (406)..(406): n is a, c, g, or t
  modified_base (428)..(428): a, c, t, g, unknown or other
  misc_feature (428)..(428): n is a, c, g, or t
  modified_base (594)..(594): a, c, t, g, unknown or other
  misc_feature (594)..(594): n is a, c, g, or t
  modified_base (637)..(637): a, c, t, g, unknown or other
  misc_feature (637)..(637): n is a, c, g, or t
tcagcgcagtacgacacgaccggtgctcgatttagacgtctcatcagggcacagcatggacatgagggtccccgctcagctcctggggctcctgctactctggctccgaggtgccagatgtgtcatccagatcgacccagtctccatccctccctgtcccgctatctggtaggagacagagtcatcatcacgttcggccgggctaaagtcagagctagttaaggaaacgttatttaaatggtatacaaacgaacgaaaccgaagggaaaccnccccgtagaaccttccgtagacttactagttcggttacctactcctacgtttcgcgtggtacggtcgggtacccagtacgtaaggttcgaggtcggacgtaggtggtactcggtaggtacaagtacttcactcncaacgactaccacgtacgtcgngacgtgacgtacggtagttactttcgacttaacctttacgtctacgtaccaacgtacgtacttaacgtccgttaccctcgttaccggttcccggtacccgtagggtaccagttacggtagtaactacgtaaaccgaacggtatcggtgtacctcggaactaccctnttaaccttcgttacctacttacctacccgttcccgacttactntaacg

SEQ ID NO: 81716 - DNA, 650 bp, Homo sapiens
  misc_feature: GYAE6OF02HHR4S.52.1.A01.1.454.CMB.1.raw
  modified_base (288)..(288): a, c, t, g, unknown or other
  misc_feature (288)..(288): n is a, c, g, or t
tcagcgcagtacgacacgaccggtgctcgatttagacgtctcatcagggggggagtcagtctcagtcaggacacagcatggacatgagggtccccgctcagctcctggggctcctgctactctggctccgaggtgccagatgtgtcatccagatgacccagtcctccatcctccctgtccgcatctggtaggagacagagtcatcatcacttggccgggcaagtcagagctaagttaagaacgttaatttaaagttggtatacaaacaacgtaaaccgaagggaaacncccctagaacctcctgatctagtggttcactcctactttgctggtagggttcggggtaccctagtacgtaacggttgaggtggctaggtaggtactcggtagggaactagtaacttcgactctaccaacctactaccaacctacgtcgtgccaggtctaggtagttacgtttcgaccttaactttacgttcgtagtaccaacgtaaggttaacgttacctacgtttcccgttacgttacccgttttcccggcccggttaacggtaaccctaggtacggttacggtaactaacgttaaccgaaaaccggtaacgttggtaccggttcctacggaccctaccgtacgtttccttacgtttaccg

SEQ ID NO: 81717 - DNA, 714 bp, Homo sapiens
  misc_feature: GYAE6OF02GF8HF.52.1.A01.1.454.CMB.1.raw
  modified_base (159)..(159): a, c, t, g, unknown or other
  misc_feature (159)..(159): n is a, c, g, or t
  modified_base (180)..(180): a, c, t, g, unknown or other
  misc_feature (180)..(180): n is a, c, g, or t
tcagcgcagtacgacacgaccggtgctcgatttagacgtctcatcagggcacagcatggaccatgagggtcccgctcagctcctggggctcctgctactctggctccgaggtgccagatgtgtcatccagatgacccagtctccatcctccctgtccgnatctggtacggagacagagtnatcatcacgttcgccgggacaagtcagagacattaacgaacgttaattttaaacgttggttaataccaaacgaagaaaaccgaacgggaaaacgccccctaggaaaccttacctgaacttccttaagttcggtttacacttaccctacgtttgcgtgtaggtccggggtcctatcgtaaaggttcagtcggcgtagttcgggacttcggtacggaacgtaaggtaacttacgtacctcgttaccaacctactacctaaccgtaacgttcctcggacgtacggtacgttacggtaaggtttagtttaccgtacgttaaaaccttttcgttactcggttaacaacgttaacgtaacgtttacctaaccggtttccctactttccggttaccgtcccggtagtaccgtagttacggttcgtaaattactaaaccgtaaacggtaccttacgggtgtaacctacgggaacctaacccgtagttcccgttacgttccttaccgttacttacccttcccggtaacctcgtacgttaaccg

SEQ ID NO: 81718 - DNA, 653 bp, Homo sapiens
  misc_feature: GYAE6OF02F9ZIX.52.1.A01.1.454.CMB.1.raw
  modified_base (196)..(196): a, c, t, g, unknown or other
  misc_feature (196)..(196): n is a, c, g, or t
  modified_base (254)..(254): a, c, t, g, unknown or other
  misc_feature (254)..(254): n is a, c, g, or t
tcagcgcagtacgacacgaccggtgctcgatttagacgtctcatcagggcacagcatggacatgagggtccccgctcagctcctggggctcctgctactctggctccgaggtgccagatgtgtcatccagatgacccagtcctccatcctccctgtccgcatctgtaggagacagagtcatcatcacttgccgggnaagtcagagcattagaacgttattttaaagtggtatcgaaacagaaaccagggaaacncccctgaactccgtgactctatcggttcactccacttgctgagtcgggtcccagtcaaggttcagtggacaggtggatcgtagggacaggtaattcgacgtctaccaacctataccaccagttactgcgtaggctaggtacgggttaattttcggacttaaacgtttaccgtttacgtagttaccaaccgttagtaacgttaacttacgtttaccccgtaccttaccgtttacccggcccgtaggggtaccctaagttaacggtagtaacttaaccgtaccgtaaaaccgtacgttacgggtacgaccgtcggtaacccgtaacccgtagtcccgttagttaccccgtttactaacgtttcccccgttaccccggtaccttacccggttctttaaccgg

SEQ ID NO: 81719 - DNA, 596 bp, Homo sapiens
  misc_feature: GYAE6OF02GRIII.52.1.A01.1.454.CMB.1.raw
  modified_base (191)..(191): a, c, t, g, unknown or other
  misc_feature (191)..(191): n is a, c, g, or t
tcagcgcagtacgacacgaccggtgctcgatttagacgtctcatcagggggggagtcagtctcagtcaggacacagcatggacatgagggtccccgctcagctcctggggctcctgctactctggctccgaggtgccagatgtgtcatccagatgacccagtctccatcctcctgtccgcatctgtagganacagagtcatcatcacgttggccgggacaagtcagagactagttaagaacgttaatttaaagttggtatacaaacaagaaaaccgaagggaaactcccctagaacctcctagactctagtaggttacatcctatttgctagtacggtcgggtccagtacgaacggttcgagtggacgtaggttaggagttcggtagggaactagtaacttcactctacacctactccactgtctgacgtaggctagtagttattacgacttaacttctacttcgtaacaagtacgttattacgtaccgttccttacgttccgtttacccggaccgtaggtacctagttacgagttaactaagttaaccaaagttacgtggttacgactacgacctacgtactttccgtcgttacc

SEQ ID NO: 81720 - DNA, 825 bp, Homo sapiens
  misc_feature: GYAE6OF02FUKNC.52.1.A01.1.454.CMB.1.raw
tcagcgcagtacgacacgaccggtgctcgatttagacgtctcatcagggggggagtcagtctcagtcaggacacagcatggacatgagggtccccgctcagctcctggggctcctgctactctggctccgaggtgccagatgtgtcatccagatgaccccagtcctccatccctccctcgtccgcactcgtggtaggagacagagtcatcactcctacgttcggccgggacaacgtcgaaggacgtactaattaaggtaaacgttaaattttaaagttaggttaacttaacaaacgtaaacggaaaaacccggaaaggggtaaaaccgtacccccgtaaggtaacccttacccgttagtaactttacgttagttacgggtttacctaacttacccttacgttttacgtccttagggtacggggttaccgggggtacccctaaggttaaccgttaacgggttaccgtaacggggtcgggacggttagggtacggtacgttccggtaggggaaccgtaagttaaacctttacgaccctttcgtacctaaccctatacccctaacccggtacgttccgtacgaccgggtacgggtccgtaagggtaacgggttttacttttacggtaaaccctttaaccttttaccgttacgttacgttaacctaacggttaacggttaacgtttaaccctaccgttttccccgttacgtttacccggtttccggcccggttacggtacctacggttagtacggttaacttaagaacccgtaaacgtaccgttggtaccgtcgtacggacccttaacttcgttcccgttacgttaccc

SEQ ID NO: 81721 - DNA, 731 bp, Homo sapiens
  misc_feature: GYAE6OF02IDWJE.52.1.A01.1.454.CMB.1.raw
  modified_base (313)..(313): a, c, t, g, unknown or other
  misc_feature (313)..(313): n is a, c, g, or t
tcagcgcagtacgacacgaccggtgctcgatttagacgtctcatcagggggggagtcagtctcagtcaggacacagcatggacatgagggtccccgctcagctccgtggggctcctgctactctggctccgaggtgccagatgtgtcatccagatcgacccagtctccatccctccctgtccgctattctggtaaggagacacgagtcatacatcacgttggaccgggactaacgtcaggacgactaattagtaaacgttaattttaaacgttggtaacttacaaacgtaaacgaaaccgaaggggtaaaccnccccgtagtaaccttccctaggtacttacttagttacggttcacgtacctacgtttcgcgttaggtggtcggggtaccagtacgtaacgttcgagtcggctagggtgtacgtcggtaagggactagtaacttccacttcctacgacctactcctaaccgtacgtctcggtaacgcgtacgtacggtagggttacttttagacctttaacgtttaccttccgtataacgaacgtacgtttaacggttacccttaccggttttacccacccgtttaccgggttttcccgggtacccggtacggtaacccgttagtacggggttaactaaccggttaaactaaccgtaaaaccggttaggttaccggggtaccttcggttaaccggtacctaaccggtactttcccggtaacttttccccg

SEQ ID NO: 81722 - DNA, 700 bp, Homo sapiens
  misc_feature: GYAE6OF02F09JC.52.1.A01.1.454.CMB.1.raw
  modified_base (554)..(554): a, c, t, g, unknown or other
  misc_feature (554)..(554): n is a, c, g, or t
tcagcgcagtacgacacgaccggtgctcgatttagacgtctcatcaggggggagtcagtctcagtcaggacacagcatggacatgagggtccccgctcagctccgtggggctcctgctactctggctccgaggtgccagatgtgtcatccagatcgacccagtcctccactccctccctgtccgctatcgtagtaggagacagacgtacactcactcctacgttcggccgggactaaggtcaaggacgactaagttaacggtaaacgttaattttaaagtttggtaactaacaaacaacgaaaacgaagggaaacgcccccgtaagaaccttcctagtaacttacgttagttcggtttacacttccttacctttgtcgttaggaggttccggggtacccagttacggtaagtttaccgtaggtcggacgaggttagggacgttacggtgggaacgtaggtaaattccgtacctttcgaccctaaccacgtacctaacccgtatcttacggacgtaggtcgtaggtagttactttacgtaccttactttacgttntccgtaccaagtactaacgttaccgtaccttccttacttccgttaccggccgttacggtacctagttaggtcgtaacttaacggtaaccaacggtacgttacgtacggtctaaccggttactacccgacgtttacctcgttaaccg

SEQ ID NO: 81723 - DNA, 572 bp, Homo sapiens
  misc_feature: GYAE6OF02G5KKV.52.1.A01.1.454.CMB.1.raw
  modified_base (192)..(192): a, c, t, g, unknown or other
  misc_feature (192)..(192): n is a, c, g, or t
  modified_base (216)..(216): a, c, t, g, unknown or other
  misc_feature (216)..(216): n is a, c, g, or t
tcagcgcagtacgacacgaccggtgctcgatttagacgtctcatcaggggggagtcagtctcagtcaggacacagcatggacatgagggtccccgctcagctcctggggctcctgctactctggctccgaggtgccagatgtgtcatccagatgacccagtctccatccctccctgtccgcatctgtagganacagagtcatcatcacttgccggnaagtcagagcaattagaacgttatttaaattggtatacaacagaaaccgagggaaacgcccctagaactcctagattctattcggttacacgtcctacgtttgctggaggtcggggtacccagtcgtaaggttcaggtggcgagtggatcgtgggacagtactcactctcaccatacaccagtctcgcgaggtctagaggttatttcgacttaacttacttctagtacaacgtagtacttacgtacgttccctattaccgtttccggcccgtacggacctagtacgttacggacttaacgtaccgaaacgtacgttaggtacggtcctcggtaccctaacctcgttcctcgttacc

SEQ ID NO: 81724 - DNA, 768 bp, Homo sapiens
  misc_feature: GYAE6OF02JA2DU.52.1.A01.1.454.CMB.1.raw
  modified_base (172)..(172): a, c, t, g, unknown or other
  misc_feature (172)..(172): n is a, c, g, or t
tcagcgcagtacgacacgaccggtgctcgatttagacgtctcatcagggcacagcatggacatgagggtccccgctcagctcctggggctcctgctactctggctccgaggtgccagatgtgtcatccagatgacccagtctccatccctccctgtccgcatctagtagganacagagtcatcatcacttcggccgggcaagtcagagctagttaagaacttaattttaaagtggtaatacaaacagaaaccgagggaaacgcccctagaacctccgtagattcttagtgttacactcctactttgcgtaggtacggtccgggtacctagtcgtaacggttcaggtcggacgtagtaggactcggtagggaactaaggtaacttcgtaccttaccgtaccaaccgtactacccgaaccgttaacgttccgtaggaccgtaagggtacccgttagggtaacggtttacgttttacgaaccgtttaaacctttacgtttacgtaccgtaaaccgtaacgttaaacgttaacgtttaaccgtaacccgtttcccccgttaaccgttacccgggttttaccccgaccgggttaccgggaaacccgtttaagttaaccggttacggttaaaccttaacttaaacccgggaaaaccgttaacgttagggttaccgtaccgtaccgtaacccttaccgtaacgtttaccggttccgttttaacgtacctttacccggtttcccctaaccccggtactaacccgtttcgtaaacgg

SEQ ID NO: 81725 - DNA, 573 bp, Homo sapiens
  misc_feature: GYAE6OF02FR8DQ.52.1.A01.1.454.CMB.1.raw
  modified_base (153)..(153): a, c, t, g, unknown or other
  misc_feature (153)..(153): n is a, c, g, or t
  modified_base (274)..(274): a, c, t, g, unknown or other
  misc_feature (274)..(274): n is a, c, g, or t
  modified_base (392)..(392): a, c, t, g, unknown or other
  misc_feature (392)..(392): n is a, c, g, or t
  modified_base (395)..(395): a, c, t, g, unknown or other
  misc_feature (395)..(395): n is a, c, g, or t
tcagcgcagtacgacacgaccggtgctcgatttagacgtctcatcagggggggagtcagtctcagtcaggacacagcatggacatgagggtccccgctcagctcctggggctcctgctactctggctccgaggtgccagatgtgtcatccagntgacccagtctccatccctccctgtccgcatctgtaggagacagagtcatcatcacttggccgggcaagtcagagcattagaacgttatttaaattggtatcaacagaaaccagggaaacncccctagacctcctgatctatggttcatcctactttgctgagtcgggtcccagtctaaggttcaggtgctaggtggatcgtagggaactagtaacttcacctctacaccatccacctntcngcgaggtctggtagttatttgaccttaacttcttctcgtacaacgtagtacgttactaccgtttccctaccgttaccgtttcccggtacccgtgggtaacctaggttacgtaggtaacttaacaaccgtaaacgtacgttggtacggtctacgtaccgtacctattccgtacgttacc

SEQ ID NO: 81726 - DNA, 625 bp, Homo sapiens
  misc_feature: GYAE6OF02H4N7K.52.1.A01.1.454.CMB.1.raw
  modified_base (293)..(293): a, c, t, g, unknown or other
  misc_feature (293)..(293): n is a, c, g, or t
  modified_base (384)..(384): a, c, t, g, unknown or other
  misc_feature (384)..(384): n is a, c, g, or t
tcagcgcagtacgacacgaccggtgctcgatttagacgtctcatcagggggggagtcagtctcagtcaggacacagcatggacatgagggtccccgctcagctcctggggctcctgctactctggctccggaggtgccagatgtgtcatccagatcgaacccagtcctccatccctcctgtccgcatctgtaggagacagagtcatcatcacgttcgccgggacaagtcgagacgactaattagtaaacgttattttaaaatggtactacaaacaagaaaaccgaagggaacncccgtagacctcctagattactattcggttcactctactttcgctggaggtccgggtaccagtactagttcgagtgcgagtgatgaggaanagtactcactccacacactacactacgtctagacgtacggctaggtagttatttcgtaactaacgttacttactacgtaactaaatacgtaacttaaccgttaccgttacccttacgttaacccgtttccggacccgttaaggtacccgtaagttacgtaacggtactaaacgtaacctaaacggtaacggtcggtacgtacttacggacctaacccggttacttaccttacgttaacccg

SEQ ID NO: 81727 - DNA, 558 bp, Homo sapiens
  misc_feature: GYAE6OF02FM4DT.52.1.A01.1.454.CMB.1.raw
  modified_base (183)..(183): a, c, t, g, unknown or other
  misc_feature (183)..(183): n is a, c, g, or t
  modified_base (216)..(216): a, c, t, g, unknown or other
  misc_feature (216)..(216): n is a, c, g, or t
  modified_base (225)..(225): a, c, t, g, unknown or other
  misc_feature (225)..(225): n is a, c, g, or t
  modified_base (231)..(231): a, c, t, g, unknown or other
  misc_feature (231)..(231): n is a, c, g, or t
  modified_base (261)..(261): a, c, t, g, unknown or other
  misc_feature (261)..(261): n is a, c, g, or t
  modified_base (403)..(403): a, c, t, g, unknown or other
  misc_feature (403)..(403): n is a, c, g, or t
tcagcgcagtacgacacgaccggtgctcgatttagacgtctcatcagggggggagtcagtctcagtcaggacacagcatggacatgagggtccccgctcagctcctggggctcctgctactctggctccggaggtgccagatgtgtcatccagatgacccagtctccatcctccctgtcccgnatctgtaggagacagatcatcatcactgccggnaagtcagancattanaacgtattaatgtatcaacagaacaggaanccctagaactcctagatctatggtcatcctacttgcttgaggtggggtccctagtactaaggttcagtggcagtggactcgtgggacaggaattacacgtactcacctatacctaacgatctagcgaggtactgtaaggttntttgaccttaaacttacttactagtacaaactaggtaactttaacgactttcccctattaccgttccgacccgttggacctagtacggtagactaactaaccgtaaaacggtactaggtcggtactccgacctaacctagttccttaggttaccc

SEQ ID NO: 81728 - DNA, 635 bp, Homo sapiens
  misc_feature: GYAE6OF02IUU1B.52.1.A01.1.454.CMB.1.raw
tcagcgcagtacgacacgaccggtgctcgatttagacgtctcatcaggggggagtcagtctcagtcaggacacagcatggacatgagggtccccgctcagctcctggggctcctgctactctggctccgaggtgccagatgtgtcatccagatgacccagtctccatcctccctgtccgcatctgtaggagacagagtcatcatctacttcggccgggacaagtcaggacgctaattaagaacgttaatttaaagttaggtacttacaaacgaacggaaaccgaagggaaacgtcccctagtaacctcctagactactagttcggttactacttcctacgtttgtccgttaggtacggttcggggtaccctagtaccgtaaggttcgacggtcggacgtagtcggatcggtagggaacaggtaacttactactctaccacctactaccaacctcgtctagcaggtctaggacggttatttacgacttaaccttctttacgtcgtacaactacggtaacttaccgtaccgtttcccgtacttacccgtttccggacccgttagggtacctagtagtacgtatactaacgaaacgtacgtcggtacggtctacgaccgactacgttaccgtgttacc

SEQ ID NO: 81729 - DNA, 582 bp, Homo sapiens
  misc_feature: GYAE6OF02HK9PC.52.1.A01.1.454.CMB.1.raw
  modified_base (216)..(216): a, c, t, g, unknown or other
  misc_feature (216)..(216): n is a, c, g, or t
tcagcgcagtacgacacgaccggtgctcgatttagacgtctcatcaggggggagtcagtctcagtcaggacacagcatggacatgagggtccccgctcagctcctggggctcctgctactctggctccgaggtgccagatgtgtcatccagatgacccagtctccatcctccctgtccgcatctgtaggagacagagtcatcatcacttgccgggnaagtcagagcattagaacgtatttaaattggtaatcaacagaaacagggaacgcccctagaactcctgatctatggttcatcctactttgctgacgtcgggtcccatcgaaggttcagtggcaggtggactcgtgggaacagaattcactctcaccactcacctagtctacgcgaggtcctaggtaggttaacttttcggaccttaaacgtttaccttcttagtaaccaacggtagtaactttaccgacgtttcccctacgtaccgttttccggaccgtacgggtaccctagtacggtagtaattaacgtaaccgtaaacgtacgttacggtggacttcggacctacctaacgtccgtattacccg

SEQ ID NO: 81730 - DNA, 723 bp, Homo sapiens
  misc_feature: GYAE6OF02G7JG1.52.1.A01.1.454.CMB.1.raw
tcagcgcagtacgacacgaccggtgctcgatttagacgtctcatcagggggggagtcagtctcagtcaggacacagcatggacatgagggtccccgctcagctcctggggctcctgctactctggcctccgaggtgccagatgtgtcatccagatgaccctagtctccatccctccctgtccgcatctgtagagacagagtcatcatctactcggccggacaaggtcaagagctaagttaagtaaacgttaatttaaagttgtaatacgaaacagaaaaccgaaggaaaccgcccctaggaacctcgtagtactctagttcgttacaccttcctactttcgacgtaggtacggtccgggtaccagtaacgtaacggttaccgtagggtacgtacgtacgggtagtaacgttcggtaacgggtaacgtaacgttaacgttacctaccgttactaccaacctaaccgtaccgaacccgtacggttcctacggtaccggaggttccgtaaggtacgtttaacgtttccgactttaaacgtttacttaccgtagtaaccgtaacgttaggttaaccgtttaccttaccggttcccttacgttacccgtttacccgggtaccttacgggtacctaaggtacggtttagtaacgttaacgtaaccgtaaccgggtaacgttcggttacggtcctacggacccgtaacgttcttaccgttagtttacccg

SEQ ID NO: 81731 - DNA, 710 bp, Homo sapiens
  misc_feature: GYAE6OF02GN49H.52.1.A01.1.454.CMB.1.raw
tcagcgcagtacgacacgaccggtgctcgatttagacgtctcatcagggcacagcatggacatgagggtccccgctcagctcctggggctcctgctactctggctccgaggtgccagatgtgtcatccagatgacccagtctccatccctccctgtcccgcatctggtaggagacagagtcatcatcacttggccgggcaagtcagacgcaattaagaacgttaattttaaagttgggtaatccgaaacaacggaaaaccgaggggaaaactccccctagaaccttcccgtagacttacttacgttggttacacttccctacttttggactacggtacgggttcggggtacccctagtaccgtaaacgggttcgaagggttcgggactaggttcggtaacgttcggtacggggactaaggtaactttaccacccttcgtactaaccctactacccaacccgtagtccgttacggccgacgggtcgttaggtaacgggtttattttcccggaacttaaacccgttttcttacgttacgtacctaaacggttaggtaacgtttaccacgttttccccagtttacccgttccggaccccgttaggtaccctaagtggttacgacttaacacaaaccgtacttcggtagactaccggactaccttctacgttcgttcttacgtacccttccgttccccgacgtacttacgtacg

SEQ ID NO: 81732 - DNA, 584 bp, Homo sapiens
  misc_feature: GYAE6OF02GC1WQ.52.1.A01.1.454.CMB.1.raw
  modified_base (247)..(247): a, c, t, g, unknown or other
  misc_feature (247)..(247): n is a, c, g, or t
  modified_base (350)..(350): a, c, t, g, unknown or other
  misc_feature (350)..(350): n is a, c, g, or t
  modified_base (357)..(357): a, c, t, g, unknown or other
  misc_feature (357)..(357): n is a, c, g, or t
tcagcgcagtacgacacgaccggtgctcgatttagacgtctcatcagggcacagcatggacatgagggtccccgctcagctcctggggctcctgctactctggctccgaggtgccagatgtgtcatccagatgacccagtctccatcctccctgtccgcatctgtaggagacagagtcatcatcacttgccgggcaagtcagagcattagaacgtatttaaatggtatcaacagaaaccagggaaancccctagaactcctgatctatggtcatccactttgctgaggtgggtcccatcaaggttcagtggcagtggatcgtggacagaattcactctcaccatcaaccngtctgcnggctagaggtattttgactaactttactctacgtacaacgtagtacgttacacgtttccctactaccgtttccggacccgttacgggacctacgttaggtacggtaataacgttaacgaaaaccgtaacgttcggtacggtctacggacctaacctacgttaccttcgttacctttacccgtaacttttcccccgttaccccggaccccttacgttccgtttaacgg

SEQ ID NO: 81733 - DNA, 826 bp, Homo sapiens
  misc_feature: GYAE6OF02JZIS4.52.1.A01.1.454.CMB.1.raw
  modified_base (158)..(158): a, c, t, g, unknown or other
  misc_feature (158)..(158): n is a, c, g, or t
  modified_base (202)..(202): a, c, t, g, unknown or other
  misc_feature (202)..(202): n is a, c, g, or t
  modified_base (257)..(257): a, c, t, g, unknown or other
  misc_feature (257)..(257): n is a, c, g, or t
tcagcgcagtacgacacgaccggtgctcgatttagacgtctcatcagggcacagcatggacatgaggtccccgctcagctcctggggctcctgctactctggctccgaggtgccagatgtgtcatccagatgacccagtctccatcctccctgtccgnatctgtaggagacagagtcatcatcacgttgccggcaagtcagnacattagaacgttatttaatggtatcaacagaaaccaggaacgccctagactccngatctagtcggttacacgtacctacgtttacgccgtaggtacggttacggggtaccccagttaccgtaaagggtttccgaaggttcgggtaccgtaaggttacgggtaaacttccggttacgggggaactaaacgggtaactttacccgaacccgttacccgttaccgtaaaccccgtaacgttaccctaaacccgttaacgggttaccgtttacgggaccgtaaccggggtccgttaacgggtaacgggtttaaacgttttttaccggacccgtttaaaaccgtttttacccgtttacggttaacgttaaccgtaaacgtacggttaacgttttaaacccgtaccggttttaccccttaccggtttacccgttttacccggggtccccttaacgggggtaacccttaacgtttaacgggttaacggttaacgttaaccgttaaacgtaaaccggttaccgttacggtttacggaccgttacggtaaccctaccgtacgtttaccgttacggtttacccttaccgtacgtttaccccgttccccgaacccgttacgttaccgttaacgg

SEQ ID NO: 81734 - DNA, 879 bp, Homo sapiens
  misc_feature: GYAE6OF02I7YRF.52.1.A01.1.454.CMB.1.raw
  modified_base (135)..(135): a, c, t, g, unknown or other
  misc_feature (135)..(135): n is a, c, g, or t
tcagcgcagtacgacacgaccggtgctcgatttagacgtctcatcgaggggggagtcagtctcagtcaggacacagcatggacatgagggtccccgctcagctccgtgggctcctgctactctggcctcgaggtnccagatgtgtcatccaaggatcgacccagtctccacgttcctccctgtccgactatcgttaggaagggacgacgaggactcagttccatccgacgttcggacccgggataacggttcaaggacgtacctagttaacggtaaaccgtttaaagttttaaagtttaggtaacttacgaaacgaaggaaaaccgaagggaaaccgtccctaacggtaacctcgtacgattaccgttaagttacggttaccaacttcccgtacgtttacggtcgttagggtaacgggttccggtaccaacgttacgtaacggttccgtaggtaggccgtagtacggtcgttacggaggtaacggtataacgttaccgtacctactaccgaaccccgttagtacccgacgtaaccgggtttctaccgggacgtaacgggttccgtaagggttaccgggttttaaattccgggttaaaccctttaaccggttttcccgacgttttaaccggaaacccgttaaacggttaccgggtttaaacggttacccttttaccccggggtttaaccccttccgggtttaacccggtttaccccgggttaaaccggtaacggggttaccccggttaactttaaggggttaccctaaaaacggttccggtaaaacccggtttaaaaccggtaggtttacccggtaccggtttaacccggttaaccaaccggtttaaccccttcgggtttacccgttttaccggtacccg

SEQ ID NO: 81735 - DNA, 763 bp, Homo sapiens
  misc_feature: GYAE6OF02GFBSL.52.1.A01.1.454.CMB.1.raw
  modified_base (172)..(172): a, c, t, g, unknown or other
  misc_feature (172)..(172): n is a, c, g, or t
  modified_base (261)..(261): a, c, t, g, unknown or other
  misc_feature (261)..(261): n is a, c, g, or t
  modified_base (756)..(756): a, c, t, g, unknown or other
  misc_feature (756)..(756): n is a, c, g, or t
tcagcgcagtacgacacgaccggtgctcgatttagacgtctcatcagggcacagcatggacatgagggtccccgctcagctcctgtggctcctgctactctggctccgaggtgccagatgtgtcatccagatgacccagtctccatccctccctgtccgcatctggtagganacagagtcatcatcacttgccgggcaagtcagagctaagttaagaacgttaatttaagttggtactcaacaggaaaccaaggggaaacncccctagaacctccgtagtatctagtcgttacacttcctactttgcgtggacggttaccggggtaccctagtacgtaacggtttacagggttcggacgtagggtcggtacttaccgggtggggaactaaggtaactttaccacccgttcctaccgaaccctatacccgtaacgtagtttccgtacgacggtacggtacgttagggtaaggtttacttttcggaaccctttaaaccgtttacctttcgtacggttaaccttaaacggtaacggtttacgtttaacccgttacccgttttacccccgtttaccgttaacccggtttttccccgggaccccggtttacggggtaaacccttgggttaaccgggttaggttacgtaaaccgttaaaccggaaaaccgttacggttacgggttacggtcgttaccgaccgttaacctacgttccgtttgttacccgtttactacccgtttaccccggttcccgtaccctnttaccgg

SEQ ID NO: 81736 - DNA, 673 bp, Homo sapiens
  misc_feature: GYAE6OF02GDN1A.52.1.A01.1.454.CMB.1.raw
  modified_base (259)..(259): a, c, t, g, unknown or other
  misc_feature (259)..(259): n is a, c, g, or t
tcagcgcagtacgacacgaccggtgctcgatttagacgtctcatcagggcacagcatggacatgagggtccccgctcagctcctggggctcctgctactctggctccgaggtgccagatgtgtcatccagatgacccagtcctccatccctccctgtccgcatctgtaggagacagagtcatcatcagttcggccgggacaagtcagagtcagttagaacgttatttaaagtggtactcaacagaaaccaggggaaacncccctagaacctctagactctagttggttacactcctacgtttgctggtacggttcgggtcctagtaccgtaaggttccgaaggttggctaggtcgatcgtagggacaagtactgacctctaccacgataccgacctagtcgtagccgtaggtacgttggtaacggttacttttaccgagttaaaccttttacgttcgttacggaaacctacgtaaaggttacctttaacccgtccgttttacccctccgttaaccggttttcccggacccgtacgggtaacctagtttacggtagttaacttaccgaaacttaaaccggtcgtagggtaccgtcgtaccgcccgtaacttccgtaccttcgttcgtttacctacccgtttaccgttaccccggtaccttacgttaccgttacg

SEQ ID NO: 81737 - DNA, 697 bp, Homo sapiens
  misc_feature: GYAE6OF02IGICR.52.1.A01.1.454.CMB.1.raw
  modified_base (209)..(209): a, c, t, g, unknown or other
  misc_feature (209)..(209): n is a, c, g, or t
  modified_base (435)..(435): a, c, t, g, unknown or other
  misc_feature (435)..(435): n is a, c, g, or t
tcagcgcagtacgacacgaccggtgctcgatttagacgtctcatcagggcacagcatggacatgagggtccccgctcagctcctggggctcctgctactctggctccgaggtgccagatgtgtcatccagatcgacccagtctccatccctccctgtccgctatctgtaggagacagagtcatcatcacttggccggacaagtcagganactaattaacgaacttattttaaagtggtactacgaaaacacggaaaaccgtagggaaaacgtcccctagaacctcctagaatctaagttggttactaacgtccctaacgttttgccgttaggacggtcgggtaccctagtacgtaagttcgaggtcggactaggtcgatcggtacggggactagaactttccacttacgtaccacctctacacccgtgtccgtancgtacgggtctaggtcgttaatttacgaccttaaactttcgtccttaggtaccaaacgtacgttacttacggttacccttccgtaccttaccgttcccggtaccccggtagggtaaaccctaggtaagtcgggttaacctaaacggtactaaaacgtacgtggtaccgggtactaccgggccaaccgttctaccggtttccttaccgttttaccgacccgtttcccggttacccccgttaacgtttaccggtaaccttaagg

SEQ ID NO: 81738 - DNA, 892 bp, Homo sapiens
  misc_feature: GYAE6OF02FP804.52.1.A01.1.454.CMB.1.raw
  modified_base (160)..(160): a, c, t, g, unknown or other
  misc_feature (160)..(160): n is a, c, g, or t
tcagcgcagtacgacacgaccggtgctcgatttagacgtctcatcagggcacagcatggacatgagggtccccgctcagctcctggggctcctgctactctggctccgaggtgccagatgtgtcatccagatcgacccagtctccatcctccctgtccgnatctgtaggagacagtagtcatcatcacgttcggccggacaagtcagacgctaattacgaacgttattttaaagtggtaactaccaaacgaacgtaaaccgaagggtaaaccgacccccgtagaaccttcctaggtaacttccgttaagttcgggtttacacgttacccgtaacgtttcggacgttaggtacgggttcgggggtacccctaagttaccggtaaacggtttcgtaagggttacgggtacgtaacgggttacggtaacgttcggtacggggaaaccgtaaggttaaaccgtttccgtaacctttacctaacccgtaacccgtactaacccgtaaccgtaacggttccgtaacggtccgtaacgggtacgttacgggtaacggttagtttttacccggaacctttaaaccgtttaccgtttacgtaccgttaaccgtaaccggttaacggttaacgtttaacccgtttaccgggttacccctttaaccggttttacccgggtttaccccgggtaccccggtttaacgggtaaccccgttaaggttaaccgggttaacggttaacgtttaaacccgtaaaccggtaaaaaccggttaccgttagggtttacccggtacgttaccggtaacccgttaaacccggtcctttaaccggtttaccgtttacccgtttacgttacccgtttaccccggtttaaccccggcctttaacggttccgttaacgg

SEQ ID NO: 81739 - DNA, 733 bp, Homo sapiens
  misc_feature: GYAE6OF02HNXT2.52.1.A01.1.454.CMB.1.raw
  modified_base (360)..(360): a, c, t, g, unknown or other
  misc_feature (360)..(360): n is a, c, g, or t
tcagcgcagtacgacacgaccggtgctcgatttagacgtctcatcagggcacagcatggacatgagggtccccgctcagctcctggggctcctgctactctggctccgaggtgccagatgtgtcatccagatcgacccacgtctccactcctccctgtccgcactctcggtaggagacagagtcatcactctaacttcgccgggacaagtcgagagtacattagaaacggttatttaaattggtactacaaacaagtaaaccgacgggaaacgcccctgaactccagtatactagtcggtacactccattgctgaggtcgggtacccatacgtaggttcagtcggtcaaggttgattcgngggacataactcgtacctctacgacctatacccaaccgtgttccgtacggtccggtacggtccggtcggtttaaggttaacgtttaccgtaacctttaaaccgtttccgttacttaacggaaacctaacggttaacggtttaaccgttacccttacgttaacccgttcccgttaacggttccccggtaaccgggtaccggtaacttaaccgggtaaggtacgtttaaccctaaaggtaaacccgtaaacgggttacgtttccgggacgttaaccggtcccgttaaaccacttcccggtttaacctcgggtttaacccttacccggtttacccggtcccgtttaccccgtaacggttttcacccgtttaaaggg

SEQ ID NO: 81740 - DNA, 561 bp, Homo sapiens
  misc_feature: GYAE6OF02I9W73.52.1.A01.1.454.CMB.1.raw
  modified_base (196)..(196): a, c, t, g, unknown or other
  misc_feature (196)..(196): n is a, c, g, or t
tcagcgcagtacgacacgaccggtgctcgatttagacgtctcatcagggcacagcatggacatgagggtccccgctcagctcctggggctcctgctactctggctccgaggtgccagatgtgtcatccagatgacccagtctccatccctccctgtccgcatctgtaggagacagagtcatcatcacttgccgggnaagtcagagcattagaacgttatttaaattggtatacaaacagaaaaccaagggaaacgcccctagaactcctgatctatggttcatcctactttgctgaggtcggggtccatcaaggttcagtggcagtggatcgtgggacagaattcactctcaccatcaccagtctgcaggctgagtatttgactaacttacttctgtacaatacgtacgttactacgttccctctaccgtttccggcccgttagggacctagttacggttaggtaacttaactaacgaaacgtaacgttcgttacggctacggccctaactacgttcctcgttaccttctacttacccgttccccgacttactccttaacg

SEQ ID NO: 81741 - DNA, 729 bp, Homo sapiens
  misc_feature: GYAE6OF02HQJGF.52.1.A01.1.454.CMB.1.raw
  modified_base (182)..(182): a, c, t, g, unknown or other
  misc_feature (182)..(182): n is a, c, g, or t
  modified_base (205)..(205): a, c, t, g, unknown or other
  misc_feature (205)..(205): n is a, c, g, or t
tcagcgcagtacgacacgaccggtgctcgatttagacgtctcatcagggcacagcatggacatgagggtccccgctcagctcctggggctcctgctactctggctccgaggtgccagatgtgtcatccagatcgacccagtctccactccctccctgtccgctaatctggtaggacgacagngtcatcatcacgttcggccgganaagtcaggacactaagttacgaacgttattttaaacgttggtaactacgaaactaacggaaaacccgtaaggggaaaaccgtcccctaaggtaaaccttcccgtagtacttacgttaacgttcgggttacctaacgttacccctaacgttttcgaccggttgggtaacggggttccggggtacccctaagttaccggttaaagggttccgaagggttcgggacgtagggtacggtacgttcggtacggggaactaaggtaacttaccgtacttccgtacgaacctactccctacgtacgtcgtacgcgtaggtctaggtacgttctttacgaaccttaatttactcgtacgtaacaagtacgttacttacgtacctcccgttacttcccggttcgaccgttacggacctagttcggtacgtacttaacgaaccaaagttccgtggtcgtctacggacctccgttaacttcgttaccgttacttcctaaccgttccccgttacccgtacgttaccttacgtaacg

SEQ ID NO: 81742 - DNA, 778 bp, Homo sapiens
  misc_feature: GYAE6OF02F1G51.52.1.A01.1.454.CMB.1.raw
  modified_base (132)..(132): a, c, t, g, unknown or other
  misc_feature (132)..(132): n is a, c, g, or t
tcagcgcagtacgacacgaccggtgctcgatttagacgtctcatcagggcacagcatggacatgagggtccccgctcagctcctggggctcctgctactctggctccgaggtgccagatggtgtcatccagntcgacccagtcctccattccctccctgtcccgcacttcctggtaggacgacagacgtcatcatcacgttcgccgggtacaagtcagtacgctagttaagaacgttaatttttaaagttggtaactaccaaacgaaacgtaaaccgaacgggaaacgtacccctagtaaacctccgttagtactacgttagttacggttacctacttaccttacgttttaccggcgttacgggtacggttaccgggggtaccctacgttaccggtaaacggtttccgtaaggttccggtacggtagggttacggtaacgttccggtaaggggtaaccgaaggttaaccgttaaccgtacccgttactaccgtaacccctaacgtaccctaacccgttaaggtcccgttacggaccggtacggtaccggtcggttaagggttacgttttacggtaacctttaacgttacctttacgtaccgtactaacgtaacgtacggtttacctacgttccctacgtttaccgttccggtcgtacggttacgtacgttaggtacggttaactacgttaaaccgaacgtaacgttcgtacgcgttacgcctaactcgttactcggttaccttacgttccttaccgttcccgaccttactagttaacg

SEQ ID NO: 81743 - DNA, 605 bp, Homo sapiens
  misc_feature: GYAE6OF02JJUS9.52.1.A01.1.454.CMB.1.raw
  modified_base (170)..(170): a, c, t, g, unknown or other
  misc_feature (170)..(170): n is a, c, g, or t
  modified_base (175)..(175): a, c, t, g, unknown or other
  misc_feature (175)..(175): n is a, c, g, or t
  modified_base (204)..(204): a, c, t, g, unknown or other
  misc_feature (204)..(204): n is a, c, g, or t
  modified_base (247)..(247): a, c, t, g, unknown or other
  misc_feature (247)..(247): n is a, c, g, or t
  modified_base (326)..(326): a, c, t, g, unknown or other
  misc_feature (326)..(326): n is a, c, g, or t
  modified_base (511)..(511): a, c, t, g, unknown or other
  misc_feature (511)..(511): n is a, c, g, or t
tcagcgcagtacgacacgaccggtgctcgatttagacgtctcatcagggcacagcatggacatgagggtccccgctcagctcctggggctcctgctactctggctccgaggtgccagatgtgtcatccagatgacccagtctccatcctccctgtccgcatctgtagganacagngtcatcatcacttggccggcaagtcagancattagaacgttattaatggtatacaagagaaccgaggaaacncccctgaacctccgtagactctacttggtacactacctactttcgcgtagacggttcgggtaccctagtacaacggttnagtggacaggtaggctacgtagggacagtacttcgaactccgtacacgactaccacgtgtactcgacgtaggtcctaggtagttacgtttcgaccttaactttacttacgtagttaccaacgttaggtaacgtttacctacgttcccttacgtaccggtttccgaccgtaggacctagtaggtanataactacaaacgtacgtggtacgtcacgtaccgtacctactcgtacgtttaccttcaaccgtttcccgtaccccgaccgttattacccgtaag

SEQ ID NO: 81744 - DNA, 672 bp, Homo sapiens
  misc_feature: GYAE6OF02IQSQU.52.1.A01.1.454.CMB.1.raw
  modified_base (448)..(448): a, c, t, g, unknown or other
  misc_feature (448)..(448): n is a, c, g, or t
tcagcgcagtacgacacgaccggtgctcgatttagacgtctcatcagggcacagcatgcacatgagggtcccccgctcagctcctggggctcctgctactctggctccgaggtgccagatgtgtcatccagatgacccagtctccatccctccctgtccgcatctgtaggagacagagtcatcatcacttgccggacaagtcgagagctaattaagaacgttaatttaaagttggtatacaacaagaaaccgaaggaacgtccccgtagaactccgtagtactacttagtcggttactacttacctacgtttcgtcgtacggtacgggtcggggtacccctagttaccgtaaggttacgaggtcggacgtaggtgtacgtacgtagggacagtaactctactaccgtacacctataccacctagtctcgcgacggtctaggtacgttntttacgacttaacctttacttacgttacgtactaaccgtagtaaccgttaccgttaccgttcccttaccgttacccgtttccggtaccccggttacggtacctaggttacgggtagttaacgtaaactaaccgtaaccgtacgttacgggtaccgtacgtcgtaaccaccgtacttccttacgttaccgttacctaccgttcccgttaccctaccgtacttccg

SEQ ID NO: 81745 - DNA, 696 bp, Homo sapiens
  misc_feature: GYAE6OF02GW8SQ.52.1.A01.1.454.CMB.1.raw
tcagcgcagtacgacacgaccggtgctcgatttagacgtctcatcagggcacagcatggacatgagggtccccgctcagctcctggggctcctgctactctggctccgaggtgccagatgtgtcatccagatgacccagtctccatcctccctgtccgcatctgtaggagacagagtcatcatcacttgccggcaagtcagagcattagaacgttatttaaattggtatacaaacagaaaaccagggaaacgccccctagaacctccgtagactctagtggttcactcctactttgctggtacggttcggggtacccctagtccgaaggtttcaggttcggcgtaggtcggactcggtgggaactagtaacttcactctaccgacctactaccacctacggtcctgaccgtagggtctgggtaacggttatttttacggaccttaaacgtttaccgttctacgtaacctaacgacgttaaccgtttacctaccgtttccccttacgtacccgtttcccgggtcccgttacggggtaaccctaagttacgggtacggttaacttaaccggtaaccgaaaaacggttaacgttcggttaccgggtaccgtacgaccgtaacccttacgttaaccgttcgttttaccctttcctaccgttttaccccccgttaccccggtcctttacgttcttaaccgg

SEQ ID NO: 81746 - DNA, 664 bp, Homo sapiens
  misc_feature: GYAE6OF02HESGT.52.1.A01.1.454.CMB.1.raw
tcagcgcagtacgacacgaccggtgctcgatttagacgtctcatcagggcacagcatggacatgagggtccccgctcagctcctggggctcctgctactctggctccgaggtgccagatgtgtcatccagatgacccagtctccatcctccctgtccgcatctggtaggagacagagtcatcatcacttgccgggcaagtcagagcattagaacgttatttaaagttggtatacaaacagaaaccgagggaaacgcccctagaacctcctgtactactagtggttctaactcctactttgctggaggtcgggccagtcaggtcaggtggcaggtgatcgtggacagtacttcactctcacatccacagtcgtacgcgaggtctaggtaggttacttttacgaccttaaactttaccgttacgtacgtaacgtaaaccgtacggttacgtttaacctacgtttccccgttaactttaccggtttacccgggaccccgttacggggtaacctaacgttaacgggttagggtaaacttaacgtaaacccggtaaaacgtacggttaccgggtcggtacgttccggtaacgtaccctattaccgtttacggtttccctttaccgttaacccgttcccgtttaccccgtaccttacttaccgttaacgg

SEQ ID NO: 81747 - DNA, 702 bp, Homo sapiens
  misc_feature: GYAE6OF02IV3UJ.52.1.A01.1.454.CMB.1.raw
  modified_base (97)..(97): a, c, t, g, unknown or other
  misc_feature (97)..(97): n is a, c, g, or t
  modified_base (142)..(142): a, c, t, g, unknown or other
  misc_feature (142)..(142): n is a, c, g, or t
  modified_base (242)..(242): a, c, t, g, unknown or other
  misc_feature (242)..(242): n is a, c, g, or t
tcagcgcagtacgacacgaccggtgctcgatttagacgtctcatcagggggggagtcagtctcagtcaggacacagcatggacatgagggtccccgntcagctcgtggggctcctgctactctggctccggaggtcgccagntgtgtcatccagatcgaccctagtcctaccactccctcctgtccactattcgtgtaggacacagactcaatcagtctacgttcggccggataaggcaggnactaattacggtaaattatttaagtgtaactacaaacgaacgaaaccgaggaaaccgccctaacgtaaacccgtcgtagaacttacgtacgttacggttaccacttcccgtagttttcgcgttacgggtacggtccggggttaccctaagttaccggtaaacgtttacgaacgggtggaacgtcgggtagtaacgttcggtaacggactaaaggttacttaccgaccttactacctacaactacccgacgttaccgtacgtacgtacggaacggtcgtaacgggttactttacgggttaccttaacttaaaccgttcgttacgtacacgtaacgtagttaccgtaactccgtcccttacgtacgttcccggtacgacggtacttaacgtggtaaccttagaaccgtaaacgtactaacggttgacggtactcgaacctacgtactttcgtacctttccgg

SEQ ID NO: 81748 - DNA, 689 bp, Homo sapiens
  misc_feature: GYAE6OF02IZHAF.52.1.A01.1.454.CMB.1.raw
  modified_base (165)..(165): a, c, t, g, unknown or other
  misc_feature (165)..(165): n is a, c, g, or t
  modified_base (213)..(213): a, c, t, g, unknown or other
  misc_feature (213)..(213): n is a, c, g, or t
  modified_base (389)..(389): a, c, t, g, unknown or other
  misc_feature (389)..(389): n is a, c, g, or t
tcagcgcagtacgacacgaccggtgctcgatttagacgtctcatcagggcacagcatggacatgagggtccccgctcagctcctgggctcctgctactctggctccgaggtcgccagatgtgtcatccgagatcgacccagtcctccactccctccctgtcccgnacttctaggtaggagacaggactacactcactcacttcggccggtaanagtcagacgctaagttaacgaacgttttaatttaaagtggtaactacaacgaacggaaaccgtaagggaacctcccgtagaacctcgtagtattcgtagttcgtactccgttaccttacgttcgcgttaggacgggtccgggtcccagttacgtaggttacgaggtcgaagtaggngtagtacgtgtaactagtaactccgaagtcctacacgtaccaccgtactcgtactacgcggagtcgtacgttacgttacgtttaacgcccttaagtttccggttcgttacaacgttagtaacgttaacctttaccgtacgttacccctacggttaccttacccggtcgtacggtaacctcgttaagtacgtacgttacgtaaaccgtaacgtacgttcggaccgttcaccggtaccctcggttaactccgttaacccgttccttctccccgtttacaccccgttagtcctaacgtaccgg

SEQ ID NO: 81749 - DNA, 785 bp, Homo sapiens
  misc_feature: GYAE6OF02FRDEO.52.1.A01.1.454.CMB.1.raw
  modified_base (231)..(231): a, c, t, g, unknown or other
  misc_feature (231)..(231): n is a, c, g, or t
tcagcgcagtacgacacgaccggtgctcgatttagacgtctcatcagggcacagcatggacatgagggtccccgctcagctcctggggctcctgctactctggctccgaggtgccagatgtgtcatccagatgacccagtctccatcctccctgtccgcatctagtaggagacagagtcatcatcattcggccgggcaagtcagagctattagaacttatttaagtggtanacaacgagaaaccgaggaaacgcccctagaacttcctgatctattggttacacttcctacgttttgacgttggtaggttcggggtcccctagtacgtaagggttccaaggttcggacgtaggtagggtattaccggtagggaacctaaggtaaacgttcctaacgttccgttaccaaccgttaactacccgtaaacctacggttaccgtcggtaccggtacgggtacgtagggttaacgggtttaactttttacggaaccgtttaaaccttttaaccgtttaccgttaacggtaacctaaaccgggttaacgtaaccggttttaaccgttacccggtttaccccgttaccgttaacccggttttacccgggtaccccggttaacggggaaccttaacggttaacgggttacgttaaaccgtaacgttaaaccgtaaaaccgttaccgttacgggttcggtaccgtacggtaacccgtaccgttaacgttccgtttaccgtccgttttaccacccgtttacccgttaccccggtacccttacttaccggttaacg

SEQ ID NO: 81750 - DNA, 709 bp, Homo sapiens
  misc_feature: GYAE6OF02FR0B7.52.1.A01.1.454.CMB.1.raw
tcagcgcagtacgacacgaccggtgctcgatttagacgtctcatcagggtcacagcatggacatgagggtcccgctcagctcctggggctcctgcgtactctggctccgaggtggccagatgtgtcatccagatcgacccagtctccatccgtccctgtccgcattcgtagtaggagacaggacgtccaagtcatccagttggccgggacaaagtcagagactattagaaacgtttaattttaaagtggtaataccaaagtaacgtaaaaccgaacggggaaaacgcccccgttagaaaccttaccgtagtaacgtactaacgttcggtaacctaaccgttaccctactttcggtaccgtaggttacggtccgggttacccgaacgttacgaagggtttaccagggtaggtaccgtaggtaggtacgtcgtaggggaactaaggtaacttccgtaactctaacgactatacctacctacgttaccgagtaccgacggtctaggtaagtagtttacgacgtaacttacgttcgtacgtacgaacgtacgtacgttacctaccgttacctaccgttacgttccgcccttacgggtacctagttcggaagtactaacgtacgaaacgttacgtcgttacggacgtcgtaccgaaccttacgtacgttaccgttacttacgtaccttacccgtcccgacctacgtgttaaccg

SEQ ID NO: 81751 - DNA, 794 bp, Homo sapiens
  misc_feature: GYAE6OF02HFR70.52.1.A01.1.454.CMB.1.raw
  modified_base (227)..(227): a, c, t, g, unknown or other
  misc_feature (227)..(227): n is a, c, g, or t
tcagcgcagtacgacacgaccggtgctcgatttagacgtctcatcagggcacagcatggacatgagggtccccgctcagctcctggggctcctgctactctggctcgaggtgccagatgtgtcatccagatcgacccagtcctccactccctcccgtcgtccgactattctaggtagggagacaggtagtcctatcagtctaacgttcggccgggacaaggtcaagngactaagttaagtaacgttaattttaaagtggtaactacgaaaacaacgaaaccggaagggtaaaccgcccctaaggtaacctaccttaggattacttagtcggtttacaacgttcctaacttttcgcgtaggtaagggttccgggtccctaagtacggtaacgtacggtacggtcggaagtacgggtggtaatcggtagggaactaacggtattacctacgtacctacgaaccctacggttaccaacccggttagttaccgtccggagaaccgggttcgtaagggtaacggtttacgttttcgaacccgtttaaaccttacgttccgttaaccgtacgaaacgttaacggttacggttaaaccttacccggttttccctacccgtttaacccggtttccgggacccccggggtttagaaccgttaaacggttagttaaccggtaagttaacctaaacccggtaaaaggttacccttggggtaccgttctaccggaaccctacctttaacgttccttacgtaccgtttcaccgtttccccgttaccctatacggttacttaaccggg

SEQ ID NO: 81752 - DNA, 922 bp, Homo sapiens
  misc_feature: GYAE6OF02FW5QV.52.1.A01.1.454.CMB.1.raw
tcagcgcagtacgacacgaccggtgctcgatttagacgtctcatcaggggggagtcagtctcagtcaggacacagcatggacatgagggtccccgctcagctcctggggctcctgctactctggctccgaggtgccagatgtgtcatccagatcgacccagtcctccatcccgtccctgtcccgcactctggtaggagacagagtcatcatccacgttcggccgggactaaggtcaggagtacctaagttacgaaacgttaatttaaaacgttggttaataccgaaacaacggaaaacccgtaacggggtaaaacgccccccgtagaacccttacccgtggtaacttaccgttaaggttcggtttacctacttaccctacgttttacggacctttagggtaacgggtttaccgggggtacccctaagttaaccgttaaacgggtttaccgtaacgggttcggtaccggtaaagggttcgggtaaacggtttcggtaacggggtaactaaacgttaaacgtttcctaaacccgtttcgtaaccccgtaaccgtaaccgtttacccgtaaaccccgtacggtttaccctagggaacccgttaaggggtacccgttaacggggtaaacggttttcgtttttaccggaacctttaaaacccgtttttccgttacgtttaacgttaacccgtaaacggttacgttaaaccggttttaacgttaacccggttttcccctttaacccgtttaaccccgggttttccccggtaaccccgggttaccggtaaccccgtttaaggttaccggggttaacgttaaaccggtttaacccgttaaacggttaaaacccggttacggtttaccgggttacggttaacccgttcggaacccttaaccgtaccgtttccggttaacgttttacccccg

SEQ ID NO: 81753 - DNA, 704 bp, Homo sapiens
  misc_feature: GYAE6OF02JP6R9.52.1.A01.1.454.CMB.1.raw
  modified_base (170)..(170): a, c, t, g, unknown or other
  misc_feature (170)..(170): n is a, c, g, or t
tcagcgcagtacgacacgaccggtgctcgatttagacgtctcatcagggcacagcatggacatgagggtccccgctcagctcctggggctcctgctactctggctccgaggtgccagatgtgtcatccagatgacccagtctccatcctccctgtccgcatctgtagganacagagtcatcatcacttcggccgggacaagtcagacgcaagttagaacgttaattttaaattggtatacgaacaacggaaaaccgtaaggggaaaccgccccttacggaaccttacctaggtattcgttacgtggtttacctaaccttaccgttacgtttcgtacggttacggtacgggttccggggtttacccaacgttacggttaaacgggttccgtaggtaccgggcgtaagggtggtaacgttcggttagggaaactaacggttacttaccgtactcctaccgaaccttacgaccctaacgtcgtcgtacgcgtacgtcgtaggtacggttactttacgtaactaacgtttactcgttagaccctataacggttctaaccgttccgttacctaccgttacgttccggacccgtacggtactagttacggtagttactaacgtaacaacggtcgtacggtgaccgtcgtacctacttacgtcttcggttaacctttcgacctttccgtacccggtactacgttactacgg

SEQ ID NO: 81754 - DNA, 820 bp, Homo sapiens
  misc_feature: GYAE6OF02HLFUI.52.1.A01.1.454.CMB.1.raw
tcagcgcagtacgacacgaccggtgctcgatttagacgtctcatcagggcacagcatggacatgagggtccccgctcagctcctggggctcctgctactcgtggctccgaggtgccagatgtgtcatccagatcgaccagtctccactcctcctcgtccgctactctgtaggagtacagtacgtcatctactactacgttcggaccgggactaacgtcgaagacgactaacgttaacgtaacgtttaagttttaaagttggtaactaccaaacgaaacgaaaccggtaaggaacccgacccgtaacgaaccttcggtagtacttacgtaagttcggttaactcttaccctacgtttggtacggtacgggtacgggttacccgggtacctaacggttacggtaaacggttacgtacgggtacggacgttagggtacggtattacggaacggggtaactaacggtactaccgtacttacccgacctaaccgtactaccgtaccgtaacggttcacggtacggtacggttacggttaggttaacgttttaacgtttaacgtaaccgtttaaacgtttacgttccgttaaccgtaagaaccgttaacgtttaacgtacctttacccgttacccgttaccgtttaccggtaccggttacccggttaacgtaaccggttaattacggtaacgttaccgttaaacgtaaaccggtaacggttacggttcggtaccgggttacgtaccgaaccccgttaattccgttaaccgttcgtttaccttaccggtttaccctcccgtttcccgtaacgttcctaccgttaacg

SEQ ID NO: 81755 - DNA, 842 bp, Homo sapiens
  misc_feature: GYAE6OF02JAVHS.52.1.A01.1.454.CMB.1.raw
tcagcgcagtacgacacgaccggtgctcgatttagacgtctcatcaggggggagtcagtctcagtcaggacacagcatggacatgagggtccccgctcagctcctgggctcctgctactctggctccgaggtgccagatgtgtcatccagatgacccagtctccatcctccctgtccgcatctgtaggagacagagtcatcatctacgttcggccggacaacgtcagagctaagtaaggtaacgttaatttaaagttggtactaacaaacgtaacgaaaacccgtaagggaaaccgtacccccgtaggtaacccttccgtaacgttaacgttactttaacggttaccgggttaactaactttaccccggttaacttttcggtaccgttacgggtacgggttacccggggggttacccctaacggtaaccggttaaacggttaccgtacgggttacgggtaccggtaaggggtttacgggtaacgtttccgggaaggggtaaacctaaaggttaaacctttacctaaccgtttacccgttaccgaaaaccccttaagttaacccccgtaaccgttaaccgttccggtcgggtaaccgtggggttaccggtaggttaacggtttaacgttttacgggtaacctttaaaccgttttccgtttacgtaccggtaacctaaacggtaacgttaaccggttaacccgtttaccttaccccgttacctttaacccgtttccggggtaccctagggttaaccctggttaggtacgttacgtaagtaacccgaaaacgttggttacggtaccggttctaaccgtacgtaccttacgttcctttaggtaccc

SEQ ID NO: 81756 - DNA, 853 bp, Homo sapiens
  misc_feature: GYAE6OF02JRJGO.52.1.A01.1.454.CMB.1.raw
tcagcgcagtacgacacgaccggtgctcgatttagacgtctcatcaggggggagtcagtctcagtcaggacacagcatggacatggacgggtccccgctcagctccgtgggcctcctgctactctggctccggaggtcgccagatgtgtaccataccgagaactcggaacccctgttccctccctacttccccttcccgtcgtcccgtactacgttcgttggtaacgggaacgtaacgaagtacgttaccagttacctaacgtcccgtaaccgttccggggaccccgggaacgtaaacgtacggaaacggtagaaccgtttaaagttaaccggttaaacgttttaaagtttaaaacgtttaggtaaccttaacgaaaaccgtaaaacggaaacccggtaacgggaaacccgtacccctaacgtaaccctacccgtagttaacttacgttacgttaccgttaccgtaccttaaccgttccgtttagtcgtaggtaccgggtccggtaacctagtacgttacggtagtacggtggacgtaggtacgtacgttcggtaagtactaacgttacgttaccgtacttaccgaccgtacctaccgtacctaactaccgtacgtcgtacggtgtaccgtaggttaacgtttcggttaacttaaccgtttaacccgtttacttaccgttacgtaaccgttaagttaacggttacccgttacccgtttacccttacccgttaccgtttacccggtttcgacccgttacgtaccggtacgttagttaccggtaactaacgtaaccgttaaacggcgttaacgtacggtacctacggtacctaccgttcgttaccgttctacccg

SEQ ID NO: 81757 - DNA, 702 bp, Homo sapiens
  misc_feature: GYAE6OF02H4L2C.52.1.A01.1.454.CMB.1.raw
  modified_base (122)..(122): a, c, t, g, unknown or other
  misc_feature (122)..(122): n is a, c, g, or t
  modified_base (161)..(161): a, c, t, g, unknown or other
  misc_feature (161)..(161): n is a, c, g, or t
  modified_base (203)..(203): a, c, t, g, unknown or other
  misc_feature (203)..(203): n is a, c, g, or t
  modified_base (290)..(290): a, c, t, g, unknown or other
  misc_feature (290)..(290): n is a, c, g, or t
tcagcgcagtacgacacgaccggtgctcgatttagacgtctcatcagggcacagcatggacatgagggtccccgctcagctcctggggctcctgctactctggctccgaggtgccagatgtntcatccagatgacccagtcctccactcctccctgtccgnactcgtgtaggagacagagtcatcatctacttggcccggganaagtcagacgctaagttaagaacgttattttaaattggtactaccaaacgaagaaaccgaagggaaaccgtcccctagtaacctccngtactactatcggttacacttcctacgttttgcgttaggtacggtcgggtaccctagtacgtaaggttcgaggtgacgaggtggtaacgttcggagggtaacgtaagtaacttcctacttcctacctaacctactaccgacccgtacgtccgtacgtacgacgggtccgttaggtaacggttactttcgtaccttaacttaccttacgttacgtactaaacgtacgtaacgttaaccttccgttccccttccgttacccggtttccgtcccggtttacggggaacctacgggtttaacggttacgtaacttacggaaacccgtaaaggtacgttcggtcggtacgtaccgaccgtaccttaccgttccttcgttaccgttcttaccgtcccgttacccacgttactcgtacg

SEQ ID NO: 81758 - DNA, 595 bp, Homo sapiens
  misc_feature: GYAE6OF02JLQ2F.52.1.A01.1.454.CMB.1.raw
  modified_base (122)..(122): a, c, t, g, unknown or other
  misc_feature (122)..(122): n is a, c, g, or t
  modified_base (199)..(199): a, c, t, g, unknown or other
  misc_feature (199)..(199): n is a, c, g, or t
  modified_base (255)..(255): a, c, t, g, unknown or other
  misc_feature (255)..(255): n is a, c, g, or t
  modified_base (273)..(273): a, c, t, g, unknown or other
  misc_feature (273)..(273): n is a, c, g, or t
  modified_base (376)..(376): a, c, t, g, unknown or other
  misc_feature (376)..(376): n is a, c, g, or t
  modified_base (379)..(379): a, c, t, g, unknown or other
  misc_feature (379)..(379): n is a, c, g, or t
  modified_base (402)..(402): a, c, t, g, unknown or other
  misc_feature (402)..(402): n is a, c, g, or t
  modified_base (419)..(419): a, c, t, g, unknown or other
  misc_feature (419)..(419): n is a, c, g, or t
tcagcgcagtacgacacgaccggtgctcgatttagacgtctcatcagggcacagcatggacatgagggtccccgctcagctcctggggctcctgctactctggctccgaggtgccagatgtntcatccagatgacccagtctccatccctcctgtccgcatctggtaggagacagagtcatcagtcacgttcgccgganaagtcagagactaattagaacttatttaaagtgtatacaacagaaaccgaggaacnccctagactacagtactntatgtacatcctacttgctaggtaggtcggtacccattcgaaggttcaggtgacgtagtcgtatcgtaggaactagacttgactcacaactagtaccaacgtntcngtacgtacggtacgtgaacgttntttccgaacttaacttntcgtacgtacaataggtacttacgtaccgttacctacgttaccgttccggaccgtacggtacctaagttacgtacggtaacttacgtaaccgtaagtacgttcggtcgtacgtaccgaaccttaacgtacgtaccttcgtacctcgtaccttccctacccgacgttataccgtacg

SEQ ID NO: 81759 - DNA, 857 bp, Homo sapiens
  misc_feature: GYAE6OF02GF9N2.52.1.A01.1.454.CMB.1.raw
tcagcgcagtacgacacgaccggtgctcgatttagacgtctcatcagggggggagtcagtctcagtcaggacacagcatggacatgagggtccccgctcagctcctggggctcctgctactctggctccgaggtgccagatgtgtcatccagatgacccagtctccactccctccctgtcccgcatctggtaggacgacagagtcatcactcctacgttcggcccgggacaaggtcaaggacactaagtttaacgaaacgttaattttaaagttggtaactacaaacgaacggaaaaccgaagggaaaccgtcccctaagtaacccttacgtacgtacttacgtacgttacggttactacttaccgttacgtttgaccggttagggttacggggttaccggggttaccctaagtttaaccgttaaacgggttctacggggtaggacggttagggtacggtacgttaccggtaaggggaacttaacggttaactttaccgtaacctttccgtaccgtaaccgtactacccgtaacgttacgtcgttacggaccgtagggtcgttaagggtacgtttaacgttttccgaaccgtttaaaccttttaccgttacgttacgtaaaccgtaaacgttaacgttaacggttttaacccgtcccggtttttacccctaacgggttttaccccgttacccgggtaccccgttaacgggggtaacctttagggtttaacggtacgggttttaaaacgaaaccggtttaaccgttaaaaccggggtttaaacgtccgggtttaaccggtacccgttaacggtaaccccccgttaactccggggtttttacctcccgtttttaacccg

SEQ ID NO: 81760 - DNA, 869 bp, Homo sapiens
  misc_feature: GYAE6OF02FMHWU.52.1.A01.1.454.CMB.1.raw
tcagcgcagtacgacacgaccggtgctcgatttagacgtctcatcagggcacagcatggacatgagggtccccgctcagctcctggggctcctgctactctggctccgaggtgccagatgtgtcatccagatcgacccagtcctccactccctccctgtccgcatctaggtaggacgacgagagtcatcacttccacgttcggcccggggtactaaaggtccaaggtacgacctaagttaacggaaacgtttaacttttaaagttaggtactaaccgaaacgtaacgtaaaaaccgaacgggggtaaacctcccccgtaaggtaacccgttaccgttacggtaacttacgtttaacgttacgggtttaacctaccgtttacccgttaacggtttttcggaccgttacgggtacgggttaccggggtacccctacgttaccggtaaaccgggtttacgtacgggttcggtaccggtaacggttacgggtaacgtttccggtaaggggtaaccgtaagtaaccgttactaacccttccgttaaccgtaacccctacgttacccaaccgtcgtaccgtacgaccggtacggtcgttacgggttaagggttacgttttccgaacccttaacgttttaccgttaggtaccggttaaccgtaaacggttaccggtttaaccttacccggtacccgtttacccgtacccgttttaccggttcccgggtacccggttacggttaccctagggtttaaccggtacgttaacggtaacctaaacggtaaaccgttacggttacgttcggacgttcgaccgtaccttacgttccgttacttcgttacctcgtttacccggtcctacttacgtcttaaccg

SEQ ID NO: 81761 - DNA, 872 bp, Homo sapiens
  misc_feature: GYAE6OF02ICJRA.52.1.A01.1.454.CMB.1.raw
tcagcgcagtacgacacgaccggtgctcgatttagacgtctcatcagggcacagcatggacatgagggtccccgctcagctcctggggctcctgctactctggctccgaggtgccagatgtgtcatccagatcgacccagtcctccatcctcctgtccgctatctgtaggagacagagtcatcatcacgttcggccgggactaaggtcacgagtctaagttaacgaaacgttaattttaaagttggtaactacgaaactaacgaaaaaccggtagggaaaacgtccccgtaggaaaccttccgtaggtacttaccgtacgttagggtttcctaacttacccgtaacgttttacggccgttagggtaacggggttccgggggttcccccaaagtttacccggtaaagggttttacgaacgggttacggaccggtaggttaccggaagttaccggtaggggtaaaccgaggttaaacttcctacctttacgaccctaccctaagtacctaaccgacgttccgtacgaccgtaggtcccgttaggtaacgggtttactttacggaactttaaaccgttaccgttcgttacgtaacctaaacggtaaacgttaccgtttacgtaacccgttttaccaccgttaccccggttttacgggtaccccggttaacgggtaacccgtacggttttaacggtaaggggttaaccttacggttaaaacccgaaaccgtttaaccgggttccggttacgggtttcccgaacccgggttcccgtaaaacccgtttgttacccggttttaccgttaccctttaccgtaaccccgtttccccgttttaacccccggacttttaccccggggtaattttaaccccggg

SEQ ID NO: 81762 - DNA, 873 bp, Homo sapiens
  misc_feature: GYAE6OF02GU17V.52.1.A01.1.454.CMB.1.raw
  modified_base (176)..(176): a, c, t, g, unknown or other
  misc_feature (176)..(176): n is a, c, g, or t
  modified_base (186)..(186): a, c, t, g, unknown or other
  misc_feature (186)..(186): n is a, c, g, or t
tcagcgcagtacgacacgaccggtgctcgatttagacgtctcatcagggcacagcatggacatgagggtccccgctcagctcctggggctcctgctactctggctccgaggtgccagatgtgtcatcagatcgaacccagtcctccactccctccctgtccgctatctgtaggganacagatcatntactcgtacgttcgggccggtacaaagtccaggactacgtaagttaacgtaaacgtttaagttttaaagttaggttataacctaaaacgaaacggaaaaccggaaacggggaaaccgtacccccgtaaggtaaacccttccgtagttaacctaccgttaacggttcggtttaccttaaccttacccgtttaacgtttacggtccggttacggtacgggggttacccgggtaccccttaaagtaaccggtttaacgggtttacgagggtacgggtaacgtaagggtagggttactacgggttacgggtaacccgaagttaaacccgttaccttaacccgttaccgttaccaacccggtaagttaaccccaacgggttaactccgtcggtaccgtacgggttaaaccgtgggttaacggttacgttttaccgtaaccggtttaaccgttttaacggtttaccgtacggttaaaccaaccggttaacggttaaacccgtttaccgggttaaccttaacccgttaccgtaacccgggttttccgtacccggggtacgttaacccggtaattaacggtaaggttaactaacctaaacggtaaaccggtactggggttactcgtaaccgtacttaccgacgttaccttcgtacgttaccttaccgttcccgtttccccggacttcgttactcg

SEQ ID NO: 81763 - DNA, 677 bp, Homo sapiens
  misc_feature: GYAE6OF02IGZKM.52.1.A01.1.454.CMB.1.raw
  modified_base (113)..(113): a, c, t, g, unknown or other
  misc_feature (113)..(113): n is a, c, g, or t
  modified_base (170)..(170): a, c, t, g, unknown or other
  misc_feature (170)..(170): n is a, c, g, or t
  modified_base (195)..(195): a, c, t, g, unknown or other
  misc_feature (195)..(195): n is a, c, g, or t
  modified_base (238)..(238): a, c, t, g, unknown or other
  misc_feature (238)..(238): n is a, c, g, or t
  modified_base (632)..(632): a, c, t, g, unknown or other
  misc_feature (632)..(632): n is a, c, g, or t
tcagcgcagtacgacacgaccggtgctcgatttagacgtctcatcagggcacagcatggacatgagggtccccgctcagctcctggggctcctgctactctggctccgaggtnccagatgtgtcatccagatgacccagtctccatcctccctgtccgcatctgtagganacagagtcatcatcacttgccgggnaaagtcgagagactatagtaactatttaaagtgtaatacaaanacgaaaccgaagggaaaccgtcccctagtaacctcctagtaactctaacgtcggttactacgtacctaagtttcgacgtggaacggttccggggtacccctaagttaccgaaacggtttacgacggttacggaacgtaggttagtacgtaccggtaaggggaactaagtacgtttaccgaacttaccactaaaccactttaaccgaaccgtagttaccgtcggactaaggcctagtacggacttttaggacctttaaacgttctacggttaactactaaacggtaattaccgttaaacgacgtttaccccttccgtaacgtttcccgggaccttacggactagtacgtaaggtactacgtaacgaaacgttagtcgagtaccgtagcctaaccncgttactcgtttacttcctaattcccgtaccgactactcgtaacg

SEQ ID NO: 81764 - DNA, 813 bp, Homo sapiens
  misc_feature: GYAE6OF02FNM1L.52.1.A01.1.454.CMB.1.raw
tcagcgcagtacgacacgaccggtgctcgatttagacgtctcatcagggcacagcatggacatgagggtccccgctcagctcctggggctcctgctactctggctccgaggtgccagatgtgtcatccagatgacccagtctccatcctccctgtccgcatctgtaggagacagagtcatcatcacttgccgggcaagtcagagcattaagaacgttaattttaaagttggtaataccaaacaagaaaaccgaagggaaaccgcccctagaaaccttccgtagtactcttagttcggtttaccacgttaccctaacgttttgccgttggtaacggttccgggggttacccctaacgttaccggtaaaggttttccgtaagggttcgggtacgtaggtacgggtacgtccggtaggggaacctaagttaacgtttcctaccttaccgtacctaaacccgtaactacccaacccgtacgttccgtaggtaccgtaacgggcgtttagggtaacggtttacgtttttacgaaccgtttaaaccttttaccgttacgttaccggttaaccaaacggttaacgtttaacgtttaacccgttaaccgtttacccccgttaccgtttacccggttttacccggtaccccgttacggggtaacccttaacggttacggttaacggtaaaccttaaaccgtaaccgttaaaaaccgtaccgttagggttaccggtcgttacggaccctaaccgtacgtttccgttacgtttacccttacttaccgtttaccccgttcccggtaccttaccgttcgttaaccg

SEQ ID NO: 81765 - DNA, 1118 bp, Homo sapiens
  misc_feature: GYAE6OF02F6D78.52.1.A01.1.454.CMB.1.raw
tcagcgcagtacgacacgaccggtgctcgatttagacgtctcatcagggggggagtcagtctcagtcaggacacagcatggacatgagggtccccgctcagctccgtggggctcctgctactctgggctccgaggtcgccagactgtgtcatccagatcgacccagtcctccactccctccctcgtccgactattccgtaggtaaggaacggactaaggtacgttccaatcctaacgtccgtaccgttccgggcccggggtactaaacggttccaaagggtagtaccctaaaggtttaaacggtaaaccgttaaagtttttaaaaacgtttggggtaacttaaaccaaaaccggtaaacgggaaaaaaccccgggtaaacgggggtaaaaacccgtccccccgttaaacggtaaaaccccgtttaccggtacggtaaccttaccgtttaaacgggttaccggtttaccctaaaacctttcccggtttaacccgttttacggcccgttttaaggggtaccggggggtttaccccgggggttaacccttaacgttaaacccggggtttaaacgggtttaccggttaacgggttacggggaaaccgttaccgggggtttaagggtaacccggtttcggggtaaagggggttaaaacccgaaaccgggttttaaactttaccccgttaaacccgttttccccgttacggtaaaccccgtaaacgtttacccctaaccgtaacccgggttttcctacgggttaccgaacggggttaccttaggggtaaacggttttaccgttttaaccggtacccgttttaaaacggttttacctttaccggttaaacgtttaacccaaaacggggttaaaccgtttaacggttttaaaccccgttaccccgttttaaccccgtttaccgtttaaaccccgggttttccccgggaaacccgtttaacccggggaaacttaaccggggttaccggttaaagggtttaaccccggttaaagttaaaacccccgggtaaaaccgttttaacccgggtcgggggtttaaaccctcccggtttaaccgggaacccgttttaacccggtaaccccggttttaggtaccctttttacccg

SEQ ID NO: 81766 - DNA, 760 bp, Homo sapiens
  misc_feature: GYAE6OF02FQR4C.52.1.A01.1.454.CMB.1.raw
  modified_base (138)..(138): a, c, t, g, unknown or other
  misc_feature (138)..(138): n is a, c, g, or t
  modified_base (598)..(598): a, c, t, g, unknown or other
  misc_feature (598)..(598): n is a, c, g, or t
tcagcgcagtacgacacgaccggtgctcgatttagacgtctcatcagggggggagtcagtctcagtcaggacacagcatggacatgagggtccccgctcagctccgtggggtctcctgctactctggctccggaggtnccagatggtgtcatccagatcgacccagtcctcctactccctccgtcgtccgactactccgtaggtagaacgactaggtactactactcgtactacctacggttacggccgggactaacggtaccgaggactacgttaaacggttaaaggtaaaccgttttaaagtttttaaaaggttggttaactaaaccgaaaacggtaaacgtaaaaccgggaaacgggggtaaacccgaccccgttaagaaacccgttccgtaggtaaccttcgttaaccggttgttacctaccttaccgttccgttcggtcggttacgggttacgggtacccggggtaccctaggttaccggttaagggttacggtacggtacgggtgtaagggttcgtacggtacgtacggtactaacgtacttacgtaccctacgttacccgtaactacgtacctacgtacgtcgcggtacgngtacggtagtgttacgttacacgtttacttactactctaacgtataacggttactaccgtccgttaccttacgttcgttaccggtacgtcgtaactaggttgacgtacaacggtacaacgtacgtacggttacgcgtacgtccgtaatcgttacttcgtacg

SEQ ID NO: 81767 - DNA, 700 bp, Homo sapiens
  misc_feature: GYAE6OF02JPCZ1.52.1.A01.1.454.CMB.1.raw
  modified_base (137)..(137): a, c, t, g, unknown or other
  misc_feature (137)..(137): n is a, c, g, or t
  modified_base (222)..(222): a, c, t, g, unknown or other
  misc_feature (222)..(222): n is a, c, g, or t
  modified_base (257)..(257): a, c, t, g, unknown or other
  misc_feature (257)..(257): n is a, c, g, or t
  modified_base (494)..(494): a, c, t, g, unknown or other
  misc_feature (494)..(494): n is a, c, g, or t
tcagcgcagtacgacacgaccggtgctcgatttagacgtctcatcaggggggagtcagtctcagtcaggacacagcagtggacatgagggtccccgctcagctccgtgggctcctgctactctggcctccggaggtnaccagatcgtgtcactccgagagtcgacccgatcctccactccctcccgtgtccgctattcgtaggtacggatacgagactcatntactacgtacgttcggccggaactaggtacagganaccgtaagttaagtaactttaagtttaagtagtaataacgaaaccgaagtaaaccggaacggaccgtaccccgtacgtaacctccgatagttccttagttcgttactacgttacctacgtttcgcgttgggtacggttcccgggtacctacgtaacggtacgttagaacgtcgggatacgggtagtcgtacgtacggataactcgtcacgtactaccgacttcgactacacgtacgngtcgtacgtgtacggtattacgttctaaccgtaacttccgtaattcgtaactacgtaacgtttaccgttacttacccgtttccgttaccgttaccgttaccgggtaccggttaaccggtaaccgttccggttaagtacgttaacttaaccgtaacgtacgttacgtaagttccgataaccgtccgtacttctacgggttctaaccg

SEQ ID NO: 81768 - DNA, 719 bp, Homo sapiens
  misc_feature: GYAE6OF02I9LZR.52.1.A01.1.454.CMB.1.raw
  modified_base (699)..(699): a, c, t, g, unknown or other
  misc_feature (699)..(699): n is a, c, g, or t
tcagcgcagtacgacacgaccggtgctcgatttagacgtctcatcagggggagtcagtctcagtcaggacacagcatggacatgagggtccccgctcagctccgtggggctcctgctactctggctcgaggtgccagatgtgtcatccagatcgacccagtcctccacttccctccgttgtccgactatccgtggtaaggagacaggatcatcatcctacgtcggccgggacactcagacacattaagaactttaagtttaaattcggtactaccgaaacaacgaaacccggtaaggggaaacctcccgtacgtaactccgtagtactcgttagtggtacactcctatttcgcgttaggtacggtccggtaccacgtcgtaaggttctaggtacggctaagggtcgtacgttcgacgggaactaagtaacttcgtaccttagtacccaactaccgtacccgtaaactcggttaacctcgggtacgtaacgggttactcggggttaaacggtttcttttaacgggaaccctttaaccgttttcgttacttaccgtaaccgtaaactaggttaaccgtttaacccgtaccgtttaccccgttacgttacccgtttaccgggacccgttacgtaaccttacggtagtacgttacacggtttaaacgacgtaacgtgtaaccggtcgttaccggaacccgttnttaccgttcgtacgtttacc

SEQ ID NO: 81769 - DNA, 841 bp, Homo sapiens
  misc_feature: GYAE6OF02FONAO.52.1.A01.1.454.CMB.1.raw
  modified_base (301)..(301): a, c, t, g, unknown or other
  misc_feature (301)..(301): n is a, c, g, or t
tcagcgcagtacgacacgaccggtgctcgatttagacgtctcatcaggggggagtcagtctcagtcaggacacagcatggacatgagggtccccgctcagctcctgggctcctgctactctggctccgaggtgccagatgtgtcatccagatgacccagtcctccatccctccctgtccgctatctggtaggacgacagagtcatcatcacttcggccgggacaagtcagagactaagttaagtaacgttaattttaaagttggttaactacaaaacgaacgaaaaccgtaagggaaaccnccccgtacgtaaccgtacccgtagaacttcgttaagttcggtacctacttccttaacgtttgtccgttggtaacggttcggggttacccagttacgtaacggtttcgtaggtggtaccgtaggttacggtacgttacggtaggggaaccgtaaggttaacttccgtaacccgttcctaccgtaaccctacgtacccgaaacccgtacgtttccgtacggaccgtagggtaccttagggtaacggtttacgttttacgaaccgtttaaaccctttcgtttaccgttacggttaacccgtaaacggttaacggttaacggttttaaaccccgtaccggttttaccccctttaaccgtttaccccgggttttaaccccgggtaccccggtttaccgggtaaacccgttaagggtttaaccgggttaagggtttaacgttaaaaccggttaacccgtaaaaaaccggttaaccgtttaaggggttacccgtccgttaacccgggaacccttaccggtaaccgttttaccgttagttttaccccg

SEQ ID NO: 81770 - DNA, 670 bp, Homo sapiens
  misc_feature: GYAE6OF02GTPKV.52.1.A01.1.454.CMB.1.raw
tcagcgcagtacgacacgaccggtgctcgatttagacgtctcatcaggggggagtcagtctcagtcaggacacagcatggacatgagggtccccgctcagctcctgggctcctgctactctggctcgaggtgccagatgtgtcatccagatcgacccagtcctccatccctcctgtccgcatcgtagtaggacgacagagtcatcatctacttcggaccggactaacgtacgagagactaagttaacggtaacgtttaattttaaagttggtaactacgaaacgaacggaaaacccgtaagggaaaccgtcccctacgtaaccttaccgtacggtactcgtagttcggttactaccgttccttacgtttcgacgtacggtacgggttcgggtaccctagtaccgtaacggtttgacggtcggtacgtaggttcgacgttcggtaggtaactacgttacttacctacgtactaccacgtacctacaccgtagtacgacgtacgtagtcgttacggtagtttaccgtttataccgttaactttcgtactacgtaacgacttacgtacgttaccgtaccgttcctaccgttaccgttcccgccgtacgtacgtagtacgtagtacgtaactaacgtacgtacgtacgacgtctcacctacgtcttactcgtac

SEQ ID NO: 81771 - DNA, 792 bp, Homo sapiens
  misc_feature: GYAE6OF02H35N6.52.1.A01.1.454.CMB.1.raw
tcagcgcagtacgacacgaccggtgctcgatttagacgtctcatcaggggggagtcagtctcagtcaggacacagcatggacatgagggtccccgctcagctcctggggcctctgctactctggctcgagtgccagatgtgtcatccagactcgacccagtcctaccacttccctcctcgtccgactactctggtaaggacgaacgtagacgtacattaccacttccgaacttcgggaccccggggactaagggtcaaggtacgacgttaaagtttaacggtaaaccgttttaaagttttaaaacgttagggttaacttaaaccaaacggtaaacgaaaacccggaacggggtaaaaccggtaccccccgttaagtaaaacccgttcccgttaacgttaactttaccggttactttacgggtttacacgtttacccttaacgttttcgaccgttagggtaccggttacggggtaccctagtaccggttaaggtcggaaggtgacgtgggtcgtagttccggaggtaactaacggtacttcgtaactctaaacgcctaacacctacccgtagttccgagtaccggtacgtccgtaggttaacggtttactttcgaaccgtttaaccttacctttacgtactaacgtaacgttaacgttaacgttaccgtacctttacccggttaccttacccggtttccggtacccggtacgggtactaacggttacgtagtaccgtaaacgtacgtaaacgtacgttagtacgacgtcaccgttaccctgttacctcgtacg

SEQ ID NO: 81772 - DNA, 732 bp, Homo sapiens
  misc_feature: GYAE6OF02J2HEX.52.1.A01.1.454.CMB.1.raw
  modified_base (702)..(702): a, c, t, g, unknown or other
  misc_feature (702)..(702): n is a, c, g, or t
  modified_base (724)..(724): a, c, t, g, unknown or other
  misc_feature (724)..(724): n is a, c, g, or t
tcagcgcagtacgacacgaccggtgctcgatttagacgtctcatcagggggagtcagtctcagtcaggacacagcatggacatgagggtccccgctcagctcctgggctcctgctactctggctccggaggtgaccagatgtgtctatccagactcgaccctagtcctccactcccttccgtcgtccgcacgtctaggtaggacgacgagtacgtctacttcgacttccgacgttccgggaccggtactaagtcgagagtccttaaagttacgttaaacgttaattaagttcggaactaaccgaaacgacgaaaccgaacggaaccgtcctaacgtacctccgtatacgtaactttcggtacggttacctagttaccgttacgttcggaccgtcgggttacggttaccggtacctaagttaccgtaacgtcgtaacggtgaacgttggtacgtacgtcggtacgaacgtagtacctcgacttcaccgtactacgactacgtcgtcgtacgtcgtacgtgtacgtacggtttacttacgtaaccgttactttactacgtacgtactaaaccggtagttacccttaacggtaccttttacccgaccggtttaccgttacccgggttaccgaacggttactaaccggtacgttaagttacccgtaacgtaaccggttactaccgggtacgttcgtaccgttaacncccgtttacgactttccggttntttacccg

SEQ ID NO: 81773 - DNA, 733 bp, Homo sapiens
  misc_feature: GYAE6OF02HWB7A.52.1.A01.1.454.CMB.1.raw
  modified_base (94)..(94): a, c, t, g, unknown or other
  misc_feature (94)..(94): n is a, c, g, or t
  modified_base (165)..(165): a, c, t, g, unknown or other
  misc_feature (165)..(165): n is a, c, g, or t
  modified_base (290)..(290): a, c, t, g, unknown or other
  misc_feature (290)..(290): n is a, c, g, or t
  modified_base (463)..(463): a, c, t, g, unknown or other
  misc_feature (463)..(463): n is a, c, g, or t
  modified_base (486)..(486): a, c, t, g, unknown or other
  misc_feature (486)..(486): n is a, c, g, or t
tcagcgcagtacgacacgaccggtgctcgatttagacgtctcatcagggcacagcatggacatgagggtccccgctcagctcctggggctcctnctactctggctccgaggtgccagatgtgtcatccagatacgacccagtcctccactccctccctcgtccgnactcgtggtaaggagacgagagtcatacacttcacgttcggccgggactaagtcgagagctagttaagaacgttttaatttaagttggtaactacgaaacgaacgaaaaccggaaggggaaaccnccccgtagtaacctccgtagtactaccgttaggtcgtttaccacttacccgttagttcgtacgtagggtacgggttccgggtaccctaacgtacggtaaggttccgtaaggtggacgtagggtagtacgtcggtacgggactaagtacgttccactctaccgaactctaaccncgtacgttctacgggacgtcggngtaaggttacggttagtttaccgtaaccgtttaactttaccttcggttacctaaacgaacgttaacggttaacttaccgttaacccgtttccctacccggtttacgttcccgggttaccggtacggtaaccgtaggttaacggtacgttaacgttaacctaaacgaaacgttcgtacggttcgactaccggtactaccgtcgttacttcgttacgttcctcttcccgtcccgtacgttctacgtacg

SEQ ID NO: 81774 - DNA, 649 bp, Homo sapiens
  misc_feature: GYAE6OF02FZ1Y1.52.1.A01.1.454.CMB.1.raw
  modified_base (196)..(196): a, c, t, g, unknown or other
  misc_feature (196)..(196): n is a, c, g, or t
  modified_base (252)..(252): a, c, t, g, unknown or other
  misc_feature (252)..(252): n is a, c, g, or t
  modified_base (390)..(390): a, c, t, g, unknown or other
  misc_feature (390)..(390): n is a, c, g, or t
tcagcgcagtacgacacgaccggtgctcgatttagacgtctcatcagggcacagcatggacatgagggtccccgctcagctcctggggctcctgctactctggctccgaggtgccagatgtgtcatccagatgacccagtctccatcctccctgtcccgcatctggtaggagacagagtcatcatcacttgccggnaagtcagagcattagaacgttatttaaatggtaatcaacagaaaccgagggaaacncccctagaacctcctgatctatcggttcatcctactttgctgaggtcgggtcctagtcgaaggttcaggtggcaggtggactcgtggacagtacttcactctacactatccacagtctgccgaggctaggtaacgttntttacgacttaacgtttcttacgtcgtaaccaacgtagtacgtttaaccgttacgtttcccctactttaccggtttcccggacccgttacggggtaaccttaacggtttaacgggttacgtaagtaaaccgttaaccgtaaaaccggttaacgttcgggtacggtaccgtacgtaaccgtaaccttacgttacgttaccgtttaccgttaccttaacccggtttacccctttccccggacttttaccgtcgttaaaccg

SEQ ID NO: 81775 - DNA, 802 bp, Homo sapiens
  misc_feature: GYAE6OF02G48JQ.52.1.A01.1.454.CMB.1.raw
  modified_base (198)..(198): a, c, t, g, unknown or other
  misc_feature (198)..(198): n is a, c, g, or t
tcagcgcagtacgacacgaccggtgctcgatttagacgtctcatcaggggggagtcagtctcagtcaggacacagcatggacatgagggtccccgctcagctcctggggctcctgctactctggctccggaggtgccagatgtgtcatccagatgacccagtcctccatcctccctggtccgctatctggtaacgganacaggagtcatcatcacttggcccggatagtcagagactaattaagtaacgttatttaaacttggtatacaacgaacgaaacccgagggaactccccgtagtaaccttccgtagtacttaccgtaagttcggttacctattcctaacgttttcggaccgttgggtacgggttacggggttcccctaagttaccgttaaagggttccgaggttcgggaccgtaaggttgggtacttacggtaggggaacctaaggtaacctttacgacctacccgttaaccaaccgttactacccaaaccgtacggttccgtacggtaacgtacgggtaccgttacggggtaacggttttaacgttttacggtaaaccgttttaaacctttacgtttacccgttagtttaaaccgtaaaccgttaaaggtttaaccgtttaaccgttaccccgttttaccccggttacctttacccgggttttcccgggtacccgtagggggttaacccctaagggttaccgtaacggtaacgttaaccgtaaaccgtaaaccggtaccggttacggtacggtaccgttcggtaccttaccgtaacgttccgttcggttaacccc

SEQ ID NO: 81776 - DNA, 741 bp, Homo sapiens
  misc_feature: GYAE6OF02FSGQO.52.1.A01.1.454.CMB.1.raw
  modified_base (195)..(195): a, c, t, g, unknown or other
  misc_feature (195)..(195): n is a, c, g, or t
  modified_base (481)..(481): a, c, t, g, unknown or other
  misc_feature (481)..(481): n is a, c, g, or t
tcagcgcagtacgacacgaccggtgctcgatttagacgtctcatcaggggggagtcagtctcagtcaggacacagcatggacatgagggtccccgctcagctcctggggctcctgctactctggctccgaggtgccagatgtgtcatccagatcgacccagtctccatccctccctgtccgctatctagtagganacagtagtcatcactctacgtcggccggacaagtcagagctaattagaacgttaattttaagttaggttataccgtaaacaacgaaaccgaagggaaaccgcccctaggtaacctcgtcgtaactcgtagttcgttacacttcctacgttcgtcgttagggacggttccggggtaccctagtaccggtaacggtttagaacgtcggacgtaggtcggtacgtcggtacgggaagtaaacgtaacgttacctaccgttcctccgtaacactaccgaccgtagttccnggaccgacggttactacggtagtttaccgtttcgacttttaaccgttccgtttaacgtccgttaaacgaaacgttggtaaaccgtttaacccggtttaccttttaccccgttacggtttaccccgtttacccgggtacccggtacgggtaaacccgttaggttaggtcgggttaacccttaaagtaacccggtaaaccgtagtttaccgggtagtccccgtacggtaacccttacccggtcgtttacccttcgtttaccc

SEQ ID NO: 81777 - DNA, 752 bp, Homo sapiens
  misc_feature: GYAE6OF02IA8ZV.52.1.A01.1.454.CMB.1.raw
  modified_base (748)..(748): a, c, t, g, unknown or other
  misc_feature (748)..(748): n is a, c, g, or t
tcagcgcagtacgacacgaccggtgctcgatttagacgtctcatcagggcacagcatggacatgagggtccccgctcagctccctggggctcctgctactctggctccgaggtgccagatgtgtcatccagatcgacccagtctccactcctccctgtccgcatctggtaggagacagagtctatcatcacgttcggccgggacaagtcgaggacgactaatttaaagaaacgtttaatttttaaagttaggtaactacgaaacaacgaaaaccggtaacgggaaaccgtcccgtacgtaacctccgtagtattactagttcggttacctacgtacccttaacgttttcgcgtagggtacggttccgggtacctaacgtacgtaacggttcgagggtaggtacgtagggtaggtacgttacggacgggtaactaagtaactttaccgaaccttaccgtacctaccgtactacccgtaccggtacttaccgtcggacgtacggggtcgtacgggttagtttacgtttaccgtaacctttaaacgtttaccctttacgttcgttaaacctaaacgttacgtttaaccgtttaacggttaccttttacccgttaccgttaccggtttccccggtacccggttaacgggtaccctaagggttcgtaagtaacgttacgaacgtaagtaccgttggtacgacttacgcctacgtacgttccttgtaccttctaccgttccctccctcttactntacg

SEQ ID NO: 81778 - DNA, 567 bp, Homo sapiens
  misc_feature: GYAE6OF02HM1UV.52.1.A01.1.454.CMB.1.raw
  modified_base (251)..(251): a, c, t, g, unknown or other
  misc_feature (251)..(251): n is a, c, g, or t
  modified_base (362)..(362): a, c, t, g, unknown or other
  misc_feature (362)..(362): n is a, c, g, or t
  modified_base (379)..(379): a, c, t, g, unknown or other
  misc_feature (379)..(379): n is a, c, g, or t
  modified_base (391)..(391): a, c, t, g, unknown or other
  misc_feature (391)..(391): n is a, c, g, or t
tcagcgcagtacgacacgaccggtgctcgatttagacgtctcatcagggcacagcatggacatgagggtcccgctcagctcctggggctcctgctactctggctccgaggtgccagatgtgtcatccagatgacccagtctccatcctccctgtccgcatctgtaggagacagatcatcaatcacgttgccgggacaagtcagagcaattagaacgttattttaaatggtatcaacagaaaccagggaacncccctagaacctcctgatctatgttcatcctacttcgctgacggtggtccatcgtaagtcgagtcgactaggtcgtatcgtagggacagtattcactctacacctatcacngtctgacagctgagttntttgactacttnttcgagtacaacgtagtacttacactttccctacttaccggtttccggcccgtaggaccagttacgaggtaactaacttaccgaaagtaccgttggtagtcctacgcctaaccttacgtcgtttaccgttacttaccctaacgttcccttaccccgaacgttacgtaccgttaacg

SEQ ID NO: 81779 - DNA, 905 bp, Homo sapiens
  misc_feature: GYAE6OF02IGKNZ.52.1.A01.1.454.CMB.1.raw
tcagcgcagtacgacacgaccggtgctcgatttagacgtctcatcaggggggagtcagtctcagtcaggacacagcatggacatgagggtccccgctcagctccgtgggctcctgctactctggctccgaggtgccagatggtgtcatccagatcgaccctagtcctccatccctcccgtgtccgactatccgtaggtaaggacacgagacgttacatccaactcgtaacgttcgggcccgggtaacaaggtccgagacgccttaagtaacgttaacgttaattttaaacgtaggtactaaccaaacgaacggaaaccgtaaacgggaaacctcccctaagtaaccttccgttatacgttcgttaaacggttcgttactccgtacctttagttccgacttagggttaccggtaccgggttaccaagttacgtaaacggttcgtaaacggttcggacgtaagggttcggtacgttaaccggtaggggtaaacctaaagggtaccgtttaccgttaaacctccgttaaacccgaaccgtacgtttaccccgaaccgttttaaccgggtccgttacggtaaaacgggtcgggtaacgtttaccgggtaaaggggttttttaaccctttacgaaacgtttttaaaaccccttccggtttaaccgtacggtaacccgttaaaggttcggttaaccgtttaaacccgtccccgttttaaacccgaccggtttttaaccccggggtccggttaccggtaaccccggttagttaaccgggttacggtttaacgaaaccctttaaccgggttaaaacccctaaaggggtttcccgttaaccggggttccgaacccggttttaacggaaccccccgtttaagggtttaccgttcccggtttttaaccgtttcccg

SEQ ID NO: 81780 - DNA, 904 bp, Homo sapiens
  misc_feature: GYAE6OF02JB3XS.52.1.A01.1.454.CMB.1.raw
tcagcgcagtacgacacgaccggtgctcgatttagacgtctcatcagggcacagcatggacatgagggtccccgctcagctcctggggctcctgctactctggctccgaggtgccagatgtgtcatccagatgacccagtctccatccctccctgtccgcatctgtaggagacgagagtcatctactcacgttcggcccgggactaaacgtcgaaggtagctaagttaacgaacgtttaattttaaaagttggtaactacgaaaacaacgtaaaaccgaagggaaaccgtccccgtaagtaaaccctcctagaacttacgttagttacggttcctaacttccctaacgtttcgccgttaggtacgggtttccggggtacccctagttaccggtaaaggttcgtagggtgggtacgtagggtacggtacgtcggtacgggaacgtaaggtacttaaccaccgttaccctaccaaacccttacgtacccttaaacccggtgtttaccgtcggaaccgtagggtaaccgttgggtttaacgggttttaccttttttaacgggaaccctttaaacccttttttaccgtttaccggttaacgttaaacccgtaagtaaacccggttttaaccgggtttaacccttacccgggtttttaccccccctttaaccgggtttaccccgggttttaccccgggtttaccccggtaacccggggttaaaccgtttacgtttaaacccggggttaaggaaccgtttttaaacccgaaaccccggttaaaacgttaccggggttaacgttccggggtaaccttaaccggtaccccttaacgtcgttttaccccggttacttttcccggtctttaacccgttccccgtttacccggacccttttagtacccgtaacgg

SEQ ID NO: 81781 - DNA, 671 bp, Homo sapiens
  misc_feature: GYAE6OF02GVKCQ.52.1.A01.1.454.CMB.1.raw
  modified_base (250)..(250): a, c, t, g, unknown or other
  misc_feature (250)..(250): n is a, c, g, or t
  modified_base (434)..(434): a, c, t, g, unknown or other
  misc_feature (434)..(434): n is a, c, g, or t
  modified_base (636)..(636): a, c, t, g, unknown or other
  misc_feature (636)..(636): n is a, c, g, or t
tcagcgcagtacgacacgaccggtgctcgatttagacgtctcatcagggcacagcatggacatgagggtccccgctcagctcctggggctcctgctactctggctccgaggtgccagatgtgtcatccagatgacccagtctccatcctccctgtccgcatctgtaggagacagagtcatcatcacttggcggacaagtcagacgcattagaacgttatttaaatggtatcaacaagaaaccgaggaacncccctgaacctcctagattctagttcgtacctatacctactttgcttacggtacggtacggggtccctagtacggtaacgttccgaggttcggacgttaggtaggactacggttagggaaccaagtacgtttacaccgtttcgtaacccgtaacctaacttacccgaaacgtccgtttacccgngtaccgtacggtacgttacggaaggtttactttacggtaaccttaacgttaccttagttacgtacgaactacggtaacttaaccgtcccgtttacctcgtaccgttccggacctacgggtactgtaacggtactagtaaccgtaacctaaacggaccgttaggtacggtccgtacgacccgtactacgttaccttccggttntactaccgtttccctccccgacttacgtctaacgg

SEQ ID NO: 81782 - DNA, 715 bp, Homo sapiens
  misc_feature: GYAE6OF02GY2PR.52.1.A01.1.454.CMB.1.raw
  modified_base (250)..(250): a, c, t, g, unknown or other
  misc_feature (250)..(250): n is a, c, g, or t
tcagcgcagtacgacacgaccggtgctcgatttagacgtctcatcagggcacagcatggacatgagggtccccgctcagctcctggggctcctgctactctggctccgaggtgccagatgtgtcatccagatgacccagtctccatcctccctgtccgcatctggtaggagacagagtcatcatcacttggccggcaagtcagagcattagaacgttatttaaagtggtatacaacagaaacagggaacnccctagaacctctgatctagtgttacattcctactttgcgtaggcggttccgggtccctagtaccgtaaggttcgaggtcggtacgtaggtggacgttcggtagggaacgtaagttaactttccacttccgtaccaaccgtactaccctaacgacgtccgtcggacgtacggtacgtaggtaaccggtttattttcggaaccctttaaatttcccggtcttacggtaaaccgtaactaagggttaccgtttaacccgttacgtttcccccgtacgtttacccggtttacccgggtcccgttaggggaaccctttacggtaggttaacgggtaacttaaccgtaaaccgtaaaccggtacttcgggtacgtccggtacgtaccctaccgttaagttccgtttccgtttaaccggtttacttccccggtttacccctttacccgggaccctttacgttcgttaaacg

SEQ ID NO: 81783 - DNA, 931 bp, Homo sapiens
  misc_feature: GYAE6OF02G7QW7.52.1.A01.1.454.CMB.1.raw
  modified_base (918)..(918): a, c, t, g, unknown or other
  misc_feature (918)..(918): n is a, c, g, or t
tcagcgcagtacgacacgaccggtgctcgatttagacgtctcatcagggcacagcatggacatgagggtccccgctcagctcctggggctcctgctactctggctccgaggtgccagatgtgtcatccagatcgacccagtctccatccctccctgtccgcatctggtaggagacagagtcagtcatccacgttcggaccgggactaaagcgaaggagacgtaaagtttaaggaaaaccgttttaaagttttaaaacggtttaggttaaactaaccgtaaaaaccgaaacggtaaaaaaaccccgggaaacgggggtaaaacccgtaccccccgttaaaggtaaaaccccttacccgttaagtaactttaccggttaacgttacgggtttaacctaaccgttaccccttacgtttttcgggaaccgttaggggtacccggggtttaccgggggtaccccctaagttaaccgggttaaaacgggtttccgtaacggggttcgggaaccggttaaggggttaggaacgtttaccgtaacgggggaaactaagtaaacctttaccgactttaccgaccaaccgttaacaccgtaccgtagtcctacgggacgtagggtacgttagggtaacgggtttgttttaaccggtaacccgttaaaccgtttttaccgtttaacggttaccgtaaaccggtaaacgtttaacgtttaccggtttaacccgtttaccgttaaccccccgttttaccgtaaccccggttttccggaacccggtttaacccgggaaacctaagggttaacccggttggtaaacttaaacgtaaccgaaaaacggtttaccgtaggttaccggtacccgtagtaaccctaaccttagtacccttacggttaccttacccgtactcccccgtttaacccgtnttaccgtacgtac

SEQ ID NO: 81784 - DNA, 785 bp, Homo sapiens
  misc_feature: GYAE6OF02HN2CN.52.1.A01.1.454.CMB.1.raw
  modified_base (120)..(120): a, c, t, g, unknown or other
  misc_feature (120)..(120): n is a, c, g, or t
  modified_base (514)..(514): a, c, t, g, unknown or other
  misc_feature (514)..(514): n is a, c, g, or t
tcagcgcagtacgacacgaccggtgctcgatttagacgtctcatcagggcacagcatggacatgagggtccccgctcagctccgtggggctcctgctactcgtggctccgaggtgccagntgtgtcactccagtactcgaccctagtcctccacttccctcctgtccactatcgtaggtaggactacgagagtcctataccgatccgtacgttcggaccgggtacaacgtcgagtacgtacgtaacgttaacggtaaacgtttaattttaacggttacggtactaaccgtaaacgtaaaaccgggaaaaccggtaacggggaaaacccgtccccgttaacgtaaccttaccgtacgtaacgtttactacggttacggttacctacgttacccgttaccgttcggtacggtacgggtcgggttaccggtaccctaagttaccgtacggttgtacggtcgacggtaggtacgtacgtacggtacggaactacgtaacttccgactaccgacctacncgtaccgtactacgtcgtacgacgttacggtcgttaacggtaacgttacgtttactaaccttaccgttacttacggttactaacgtaacgtaacgtttccgttaccgttacccgttcccttaccgtttcccggtaccggtaccgtacgtacgtaacggttacgtaacgtactaacgtaaccgtaacgtacggtcgtacgtacgtaccgtacgtaccttattccgtttacgtaccttaccgttcccgtacgttactacggttcctaagtacc

SEQ ID NO: 81785 - DNA, 953 bp, Homo sapiens
  misc_feature: GYAE6OF02GJNNQ.52.1.A01.1.454.CMB.1.raw
tcagcgcagtacgacacgaccggtgctcgatttagacgtctcatcagggggggagtcagtctcagtcaggacacagcatggacatgacgggtccccgctcagcctccgtggggcctccgtgcctactcgtagggcctcggaggtcgaccagtatggtcgtacacttccgaagtactccgacccgtagttcctaccacttccctcccgtcgtacccgctattcgttagggtaacggacgtaccgaggtacgtaccacttaccaacgttccttacggttaccgggaccccggggtaataaccgttacggaacggacgtaacgttaaacgtttaaacggtaaaccggttttaaatttttaaaacggttagggtaaacctaaccgaaaaccggtaacggaaaacccgggtaaacggtaaaacccggtacccccgttaaagttaacccgtacgttaaggttaaccttttcgttaacggtttccggttaacctaccgttttaacccgttacgttttccgtacggtttaggggttaccgggttaccccggttaccgttaaggttaaacccggttacggtttacgttaacgggggacccggtagttaaccggggtttgaaaccgttcgggttaacggaaaccgttaaagttcccgttaacgttacccaccgttaccaacccgtacttaacccaacgggttccttcgtaacggtaccgggtacgttgggtaacggtttacggtttaacgtttccgtaaaccgtttacttttaccgagttacccgtaacgttaaagtagttaacccgtttccgttaacccgtttcccttaacggtttcccggtttacccgacccggtttaggaacttaccggttaggtaccgtaagttccgtaaaccgacgggttacttgggtaacccgtcgtaaccgtaaccttcggtacccgtttacgttaccgttaaccc

SEQ ID NO: 81786 - DNA, 825 bp, Homo sapiens
  misc_feature: GYAE6OF02G2T24.52.1.A01.1.454.CMB.1.raw
tcagcgcagtacgacacgaccggtgctcgatttagacgtctcatcagggcacaggcatggacatgagggtccccgctcagcctcctggggcctcctgctactcgtggctcgaggtgccagatcgtgtcatccgagtatacgacctgtcctcccattccctcccgtcgtccgctattccgtggtacggacgtacgtagtacgtcatcctatccgtacgttcggaccggtactaacgtcgaggtacgtactaacgttaacggtaaaccgtttaagtttaaacgtttggaaacgttaccaaacgttaaacgggtaaaaccggtaaaggggaacctaccccgttagtaaacccgttcctaggacctttacgtacgttacggtaacctacgtaccccttacgtttcgcgtaacggtacgggttaccggtaccctaggttccgtaaaggtcgtaggtccgggtacgtaggttacgacgttcgggtacggtaacgaagttaccttaccgtacctctacctaacgaccgttaccccaacgtttcggtcccgtagtaaccgtccgggttaagtcgggttaaccggttacgttttaaccggtacttaacggtttaccttacggtacgtaccgtaagtacggtttaaccgttaccgttctttaccggtacccttaccgggttccgtaccgttaccggacgtacgttaaggtcgtaacgtttaacctacggtaaacgtttcgggtcggttacgtaccggtcgtaacccgtcgtaacgttccgttaacgttccctacgttacccgtttccccgtaccgtcccggtaaccttgtaccgg

SEQ ID NO: 81787 - DNA, 831 bp, Homo sapiens
  misc_feature: GYAE6OF02F6C8R.52.1.A01.1.454.CMB.1.raw
tcagcgcagtacgacacgaccggtgctcgatttagacgtctcatcagggggggagtcagtctcagtcaggacacagcatggacatgagggtccccgcgtcagctccgtggggctcctgctactctggctccggaggtgccgagagtgtcgtcactccagatcgaccagtctccactccgtcctgtccgctatctgtaggagacgagagtcactcgatactcgttcggccggacaagtacagagtactaagttaacgtaacggtttaattttaaacggtttacggttaataaccaaaccggtaaacggaaaacccgaaggggtaaaaccgtaccccgtaacgtaaccgttaccctaggtacgttactagttcggtttacctaacgttacccgttacttttacggtaccgttaggggtacgggttccggggttaaccctaggttacgtaaacgggtttcgacgggtttcggacgttagggttacggtacgtaccggtagggaactagttacctacgtacttacccgactacctactacctacgacgttcgtagaccgtaggtccgtagggtacggtttactttacggtaaccttaacgtttacgtttacgtacgtaaactaacggttaacggttacggtttaccgttaaccccgttttaccgttaccgttttaacccggttttcccggtacccggttaaccgggtaacctttacggttaacgggttacggttaacgttaaccgttaaaccgggtaaacgttaacggttccgggttaacggttaccgttacccgtaaaccggttaccctacgtttaccgtttacggtttacccg

SEQ ID NO: 81788 - DNA, 919 bp, Homo sapiens
  misc_feature: GYAE6OF02F1RU1.52.1.A01.1.454.CMB.1.raw
tcagcgcagtacgacacgaccggtgctcgatttagacgtctcatcagggcacagcatggacatgaggggtccccgctcagctcctggggctcctgctactctggctccgaggtgccagatcgtgtcactaccaggatcggaccagtcctccacttccctcctcgtccgcaacttcgtagggtacggagacgtagacgtcagtctacgtactacgtcgggaccggtacgaacgtcaaggacgtcctaagttaacggtaacgttttaaagtttaaacgttgggtaactaacgaaacgtaaaacggaaaaccggtaaagggggtaaacccgtcccccgtaaggtaaaccccttccgtacggtaaccttaccgttaagtttccgggtttactaccgtttacccgtttacggtttacggaccggttggggtaaccggggttccccggggttaacctacggttaccggttaacgggttaccgtagggttcgggaccggtagggttcggtaacttccggggtaacggtaacgtaaacgttaccgtttactaccgttaaccacctaaacccggtactaaccctaaccggtcggttacccggtacgtaccggtaaggtaccgtaagggtacgttttaccgtttaactaacccggtttaacgtttacccttcgtaaccgtaacctaagggttaccggttaatttaacccggttacccgttacccctttaccggttaccgggtttaccccggtaccggttaacggttaccgaaggtttaaccggtaggttaaaccttaaacctaaaccgggtaacgttaccggtgggttaccggtacctaccgtaacccggttgtaccgttttacccgggtttaccttaccgtaccgtttaccccggttacccgtacccaacgttttactacccgttaag

SEQ ID NO: 81789 - DNA, 661 bp, Homo sapiens
  misc_feature: GYAE6OF02HCK2V.52.1.A01.1.454.CMB.1.raw
  modified_base (199)..(199): a, c, t, g, unknown or other
  misc_feature (199)..(199): n is a, c, g, or t
tcagcgcagtacgacacgaccggtgctcgatttagacgtctcatcagggcacagcatggacatgagggtccccgctcagctcctggggctcctgctactctggctccggaggtgccagatgtgtcatccagatgacccagtctccatccctcctgtccgctatctgtaggagacagagtcatcatcacgttgccggganaagtcagagctaagttagaacgttaattttaaagttcggtaatacaaacaaggaaaacccgaaggggaaaccgccccgtagaactcctagacttctagttggttcacttcccactttgcgtaggtcgggttcgggtacccagttcgtaacgggttcaggttcgggctaggtgaagttcgtagggaactagaactttcacttcgacctactaacctccgaacctgtcctgtacgacggtcgtaggtaggtattttcgacttaacttcttcttaggactaagtcgttacgttactccgttacccttccttaccgttacggcccggttacgaacgtacgtaggtcgttaactacgtaaacgtaaacgtagtcggtacggtacgtccgtacctaccgttaaccgttgttacccgttccgtttaccttccgtttcccccgttacccgtacgttacctacgttaacgg

SEQ ID NO: 81790 - DNA, 701 bp, Homo sapiens
  misc_feature: GYAE6OF02H778K.52.1.A01.1.454.CMB.1.raw
  modified_base (534)..(534): a, c, t, g, unknown or other
  misc_feature (534)..(534): n is a, c, g, or t
  modified_base (539)..(539): a, c, t, g, unknown or other
  misc_feature (539)..(539): n is a, c, g, or t
tcagcgcagtacgacacgaccggtgctcgatttagacgtctcatcagggcacagcatggacatgagggtccccgctcagctcctggggctcctgctactctggctccgaggtgccagatgtcgtcatccagatcgacccagtctccactcctccctgtccgcatctgtaggagacagagtcatcatcacttcggccgggtacaaggtcaagagactaagttaagtaaacggttaattttaaaagtttgggtaacttaccaaacgaacggaaaacccggtaaacggggaaaaccggacccccgtttagggaaacccttcccttaggtacttacctttaaggttgggttaccttaactacccgttaactttcgtcgttaggaaccggttcggggttacccaagttacgtaacggtttcacgttgggactaggtgtaagtcgtagggaactacgtataccacttacacgtacctaacgtaccacgtcgtacgtacgcgaacggtctaggacggttatttcacgttaacttacgttancttanaacgtagtagtttacacgttccttacgtaccgtttcgtacccggtgaacctagtaccggtagtactagtaactaaacgtacgtagcggtacgtacgtaccgtacctcgttactacgttctttactacccggttccgttacccggtacttcggtaccttacgg

SEQ ID NO: 81791 - DNA, 725 bp, Homo sapiens
  misc_feature: GYAE6OF02IGB5S.52.1.A01.1.454.CMB.1.raw
  modified_base (358)..(358): a, c, t, g, unknown or other
  misc_feature (358)..(358): n is a, c, g, or t
tcagcgcagtacgacacgaccggtgctcgatttagacgtctcatcaggggggagtcagtctcagtcaggacacagcatggacatgagggtccccgctcagctccgtggggctcctgctactctggcctcgaggtgccagtatgtgtacatccagatcgaccctagtcctccacttccctcccgtgtcccgctattccgttaggtaaggacgaaccgaggtaaccgtcaacttacctaacgttacctaacgtttcgggacccgggtacaaggttaccaggacgtacttaagttaaggtaaaacgtttaattttaaaacgttaggtaactacgaaacgaacgtaaaaccgagggaaaccnccctacgtaacctccgtagtaacttcgttacgtcgttactacgttcctacgttttgacgttgtacgggtccgggtacctagtacgtaacggtcctaaggtcgagtacgaggtactaggtacggaacagtacgtcctacttccctacgactactaccaccgtagaccgtgaaccgtgtacgtgtaacgtttcgttactacgttaactttacttcgacgtaaccgaacgttacggtaacctttacgtaccctttcccgtacgttacccgtttaccgccgttaacggtaaccgtagttacggagttacctaagtaaaccgtaacggtcgttacggtgtccgtaagaccccttagtacgtcttcggttacc

SEQ ID NO: 81792 - DNA, 714 bp, Homo sapiens
  misc_feature: GYAE6OF02I7OKH.52.1.A01.1.454.CMB.1.raw
  modified_base (96)..(96): a, c, t, g, unknown or other
  misc_feature (96)..(96): n is a, c, g, or t
  modified_base (227)..(227): a, c, t, g, unknown or other
  misc_feature (227)..(227): n is a, c, g, or t
  modified_base (332)..(332): a, c, t, g, unknown or other
  misc_feature (332)..(332): n is a, c, g, or t
  modified_base (474)..(474): a, c, t, g, unknown or other
  misc_feature (474)..(474): n is a, c, g, or t
  modified_base (706)..(706): a, c, t, g, unknown or other
  misc_feature (706)..(706): n is a, c, g, or t
tcagcgcagtacgacacgaccggtgctcgatttagacgtctcatcaggggggagtcagtctcagtcaggacacagcatggacatgagggtccccgntcagctcctgggctcctgctactctggcctccgaggtgccagatgtgtacatccagatcgacccagtcctccatccctcctgtccgacacgttctgtaggagacagtctcagtcattcacttcggccgganaacgtcgagagctaataagtaacgttaatttaaagttggtaactacaacgaacggtaaaaccgaaggggtaaaacaccccgtagaaaccgttccgtagtaacttnttaagttcggtactaaccgtccttacgtttgtaccgtggttacgggtccggggtacctaacgtacgtaacggttcaaggtcggtactaggttggaacttcggtacgggtaactacggtacttacctacctacctacgaaccnctaccggaacctagtccgtacgacgtagtcggtaggtaacgtttacgtttacgaacttacgtttaccttcgtaacgtaagtaaccgtaacgtaccgtttaacgtcccgttttacccgtaacgtttaccggtttcccgtaccgttaccggtaactacggttacggttaacgtactaaacgtaaccgttaaaacgtcgtacggtacgttcggtacaccgttacgtcttaccgtntttacccg

SEQ ID NO: 81793 - DNA, 838 bp, Homo sapiens
  misc_feature: GYAE6OF02H3ZEW.52.1.A01.1.454.CMB.1.raw
tcagcgcagtacgacacgaccggtgctcgatttagacgtctcatcagggcacagcatggacatgagggtccccgctcagctcctggggctcctgctactctggctccgaggtcgccagatgtgtacatccagatcgaccctagtcctccactccctccctgtccgctatcgtagtaggagacagacgtcactcagtctacgttcgggaccggtacaagttacgagacgtacaagtttaacgaaacgtttatttaaagttcgtatacgaacgtaacgaaaccgaggaaccacccgtagtacctcgtagacttacgtagttggttacctatacccttacttgtacggtagtaccgggttcggtaccccgagttacgtacggttacgaggttgacgtagggtacggtcgttacggtacgggactaaacgttaccttacctaacccgtaccgttaccgaaccctacgtaccctaccgttacggtccgaacggacggtacggtacgtacgggtaacggttttcttttaaccgtactttaaccgtttcgttacgttacccgttaaacccgtaacgggtacttttaccccggtttaaaccttcccgtttaccccggtaccgttttaaccccgggtttccccgggtttaccccggacgggtaaccgtttaaggtacgggttaaccgtaaccttaaaccggtaaaccgtaaaaccgggttcggtttaccggtcgtaccgggttacaaacccgtttcccgggttacttaccggttacccggttaacccttttaccgttacccccggtttccccgttaccctttaacggtacccgtttaccttaacggg

SEQ ID NO: 81794 - DNA, 708 bp, Homo sapiens
  misc_feature: GYAE6OF02GBG0L.52.1.A01.1.454.CMB.1.raw
tcagcgcagtacgacacgaccggtgctcgatttagacgtctcatcagggcacagcatggacatgagggtccccgctcagctcctgggctcctgctactctggctccgaggtcgccagatgtgtcatccagatgacccagtctccatcctcctgtccgcatctgtaggagacagagtcatcatcacgttggccggactaagtcagacgctaagttacgaacgtttattttaaagttcgggtaactaccgaaaacgtaacgaaaaccggaagggtaaaacgcccccttaaggaaaccctccgtagacttcgtagttcggttacacttacccgtacgtttgccgttaggacggttccggggtaccctagtacgtaacggttcgacggttacggtacgtacggtggacttcgtacgggactagtaacttcgtactccgtacaacccgtatcccgaaccgtacgttcctacgacgtaccgggtcttacgggtaagttaactttttacggaccttaaaccgtttacttcgtacgtacctaaacgtacgttaacgtttaccgtacgtttaccctacgtttaccgttccggcccgttaagggtacctaaggttagtacggtaacttaacgaaccgtaaacgtgtacggttcgcgtaccgactaacgtcgttccgtacttccgttacgtccttcccgtacccgcgttatcgttaacg

SEQ ID NO: 81795 - DNA, 733 bp, Homo sapiens
  misc_feature: GYAE6OF02J0CS6.52.1.A01.1.454.CMB.1.raw
  modified_base (428)..(428): a, c, t, g, unknown or other
  misc_feature (428)..(428): n is a, c, g, or t
  modified_base (432)..(432): a, c, t, g, unknown or other
  misc_feature (432)..(432): n is a, c, g, or t
tcagcgcagtacgacacgaccggtgctcgatttagacgtctcatcagggcaccagcatggacatgaggtccccgctcagctcctgggctcctgctactctggctccgaggtgccagatgtgtcatccagatcgaccctagttctccagtccctcctagtccgctatcgtaggtaggacgacgtagagtacctatactagtcctaaccgttcgggccgggacgtaaagtccaggtagtacctaagtttaagaaaccgttaagttttaaaacgttggtaactaccgaaaaccgtaagggtaaaacccgaaagggggtaaaaccctcccctaaggtaaacccttcctaaggtacttagtacgttcggttaaccacttacccgtgtttacgcgtggaacggttccggaccagttacgaggttccaggtcggntagnggattaccggaggaactagtaaccgttcacgttacaactaccgtactaaccttaccggaatcgttacgcgtacgtgtacggtaacgttcgttacgacttacgtacgttctaggtaaccacggttaagtcttaaccgtcgttaccctacgtaccctttcggccgttaccgcggtaacgtacgtacgtaacttccgaacgtaaccgtagttaccggccgttaggtaccctacggtaacctttcgtaacgttccgttaaccgttactcccggttaaccctccgtacccttagtcccgtttaacg

SEQ ID NO: 81796 - DNA, 617 bp, Homo sapiens
  misc_feature: GYAE6OF02GWMFN.52.1.A01.1.454.CMB.1.raw
  modified_base (160)..(160): a, c, t, g, unknown or other
  misc_feature (160)..(160): n is a, c, g, or t
  modified_base (253)..(253): a, c, t, g, unknown or other
  misc_feature (253)..(253): n is a, c, g, or t
  modified_base (387)..(387): a, c, t, g, unknown or other
  misc_feature (387)..(387): n is a, c, g, or t
  modified_base (405)..(405): a, c, t, g, unknown or other
  misc_feature (405)..(405): n is a, c, g, or t
tcagcgcagtacgacacgaccggtgctcgatttagacgtctcatcagggcacagcatggacatgagggtccccgctcagctcctggggctcctgctactctggctccgaggtgccagatgtgtcatccagatgacccagtctccatccctccctgtccgntatctgtaggagacagagtcatcatcacttcggccggcaagtcagagcattaagaacgttatttaaatggtatcaacagaaaccagggaaacnccctagaacctctagatcgtatgttcactccctactttgctggaggtcgggtaccctagtacgtaaggttcgagtcgggcaggtagactgtagggactaagtaacttaccacttcacactactaccacacgtcngcgaggtctagacggttntttacgacttacttactctacgtacaacgtagtacgttacctcgtttaccctacgttacccgttccgggtaccgttacgggtaaccaggtttaacggtagtaacgttaactaaaccgtaaaacggcgttaggtgtacctacggaacccgaaccttacttacgtttaccttcgttaacctccgttacccgttccccgaatttacctggttaac

SEQ ID NO: 81797 - DNA, 714 bp, Homo sapiens
  misc_feature: GYAE6OF02F0OS8.52.1.A01.1.454.CMB.1.raw
  modified_base (119)..(119): a, c, t, g, unknown or other
  misc_feature (119)..(119): n is a, c, g, or t
  modified_base (132)..(132): a, c, t, g, unknown or other
  misc_feature (132)..(132): n is a, c, g, or t
  modified_base (577)..(577): a, c, t, g, unknown or other
  misc_feature (577)..(577): n is a, c, g, or t
  modified_base (699)..(699): a, c, t, g, unknown or other
  misc_feature (699)..(699): n is a, c, g, or t
tcagcgcagtacgacacgaccggtgctcgatttagacgtctcatcagggcacagcatggacatgagggtccccgctcagctccgtggggctcctgctactctggctccgaggtgccagntgtgtcatccagntgacccagtctaccaatcccgtccctgtcccgctacttctagtaggagaacagagtcaattcattcacgttggcccggataacggtcagacgactaagttaacgtaacgttaactttaaagtcggtaataccgaaagaaacggaaaccgtaaggaaacgtccccgtagtaaacctcgtacgaattcgtaacgttgggttccaagttaccctacgtttaggtacgtacgggttaacggttaccggggtaacctagtacggttaaacggtcgttacggtggtacgtagtacggtagttaccgtagaacccgtaagtaccgtttactctaccgtactaaccgtacttaaccacgtacttgtacgacgacggtacgtaggtacgttaacttttcgaacgttaaacctttagtcttacgaactaacgtaagtcgttaacgcgtttacccnttaccggtcgtaccgtaggtaccctaagtgtacgtaacgtacaaacgttaagcgttacgtacgtacacggtctaacctaacgtcgttacgttaactttcgaccgtttaccttaccccggttntaccggttctaaacg

SEQ ID NO: 81798 - DNA, 695 bp, Homo sapiens
  misc_feature: GYAE6OF02HW0XV.52.1.A01.1.454.CMB.1.raw
  modified_base (367)..(367): a, c, t, g, unknown or other
  misc_feature (367)..(367): n is a, c, g, or t
  modified_base (434)..(434): a, c, t, g, unknown or other
  misc_feature (434)..(434): n is a, c, g, or t
tcagcgcagtacgacacgaccggtgctcgatttagacgtctcatcagggggggagtcagtctcagtcaggacacagcatggacatggagggtccccgctcagctccgtggggcctcctgctactctggctccgaggtgccagatgtgtcataccagatcgaccctagtcctacctacttccctcctcgtccgactatcgtaggtaaggagaacgagagtacatactactcctacgttcggacccggtacgtaagtacgagacgacgttaattaggtaaacgtttatttaaagttggtactaacaacgaacgaaaaccgagggaaacctaccccgtagtaacctcgtagtactcgttagttcggtacncgttaccgtattgacgtggtaggtccggtacctacgtacgtaacggttcaggtcgcgtagtacggtntacggaggtacaagttacgtacctacgtactaaccgtactacgacctaacgtctcgagcggtagcgtaggtatttacgttataccgttaacttcgttacgtcaaaccgtaagtacggttaaccgttacgtacccgtttctccgtttaacccggttcccggtacggtaaccgttacgacgttacgttaagaccttaacggtaacggaaccttagggtcgtaccggttcgacctcgtaaccgttcgttacggtctttaccccg

SEQ ID NO: 81799 - DNA, 764 bp, Homo sapiens
  misc_feature: GYAE6OF02GYBZL.52.1.A01.1.454.CMB.1.raw
  modified_base (160)..(160): a, c, t, g, unknown or other
  misc_feature (160)..(160): n is a, c, g, or t
  modified_base (184)..(184): a, c, t, g, unknown or other
  misc_feature (184)..(184): n is a, c, g, or t
  modified_base (188)..(188): a, c, t, g, unknown or other
  misc_feature (188)..(188): n is a, c, g, or t
tcagcgcagtacgacacgaccggtgctcgatttagacgtctcatcagggcacagcatggacatgagggtcccgctcagctcctggggctcctgctactctggctccgaggtgccagatgtgtcactccaggatcgacccagtctccatcctcctgtccgnatcgtagtaggacacgtagacgtntacncagtccacgttcggccgggataacgtcgacggtaagccgtaaagttaaggtaaaaccgttaagtttttaaaaacggtggttaaactaaccgaaacgtaaacggtaaaaccggaaacgggtaaaccgtacccctaggtaaccgtcctagtacgtacttacggtggtaacctacgtacctaacgtttgacgtaggtacgttcggggtacctagtacgtaaggttacgtagtcggacgaggtacggtcgtggtaacggacgtaacgttactaccgtactacctacccgaactaactacctaacgtacgttcgacgtacgacggtacggtacgtaggttacttagtaccttaaacgtcttacgtaacgtaccgtaactagtaaccgttacgtaccttacccgttaaccgtccggttccggtacccgtaacgggtaacctaaggtacgttacgaaattaccggtaaaccgtaaacgttacccgtagggtacgtacctccggtacctaacttccgttcccgttaagtttccccgttaacttacccgtttaccgtaccccgttacggtacttacgtttaacgg

SEQ ID NO: 81800 - DNA, 840 bp, Homo sapiens
  misc_feature: GYAE6OF02JLON6.52.1.A01.1.454.CMB.1.raw
  modified_base (818)..(818): a, c, t, g, unknown or other
  misc_feature (818)..(818): n is a, c, g, or t
tcagcgcagtacgacacgaccggtgctcgatttagacgtctcatcaggggggagtcagtctcagtcaggacacagcatggacatgagggtcccccgctcagctcctggggctcctgctactctggctccgaggtgccagatgtgtcatccagatcgaccctagtctccactcccgtccctgtcccgactacttcgtggtacggacgaactaggagttcaatccgtatacctacgttccgggcccggggtactaacggtaccgaaggacgtaccttaagtttaacggtaaaccggtttaaattttaaaggtttacgggttaactaacctaaaaccgaaacggtaaaacccggtaaaacgggggtaaaaccccgtccccccgttaaggtaaacccccttacccggttacgtaaccgtttacgttaacgttccggttaaccctactttacccccgttaagttttcggaacgttcgggtacgggtcccggggttaccctaagttaaccggtaacggttaccggtaggtaccggacggtacgtacggttaagtccgggtagtaaccgtagtaaacgttccgtaacctaccgacgtaaccctagtaccctaccgtaacgtcgtctaacggcgtactggtacgttatttacctacttaaccttcttacgactaaccgtaacgtcgggttaaccttaccggttacccttacccgttaccgtacgtttaccccgggaacgttaccgggaaccctttaggtaacgtagttaaccttaacggtaacgtaaccgttacggtaggttaccggccttacgacccggtttaanccgtttaccggtttctaacccg

SEQ ID NO: 81801 - DNA, 754 bp, Homo sapiens
  misc_feature: GYAE6OF02GHQR2.52.1.A01.1.454.CMB.1.raw
  modified_base (174)..(174): a, c, t, g, unknown or other
  misc_feature (174)..(174): n is a, c, g, or t
tcagcgcagtacgacacgaccggtgctcgatttagacgtctcatcagggcacagcatggacatgagggtccccgctcagctcctggggctcctgctactctggctccgaggtgccagatgtgtcatccagatcgacccagtctccactccctccctgtccgcatctagtagganacagtagtcatcactactacgttcggccggactaagtacaggagactaagttaagtaacgtttaattttaaagtggtaactaaccgaaacgtaacgaaaaccggacgggaaaccgtacccctagaacccttccgtagtacttacgttagttcggttacctaccgttcccgttacgtttacggtcgtagggtacgggttccgggtaccctagttaccggtaaggttaccgaggttccggagtaggtggtacgttcggaggacctaagtaccttacctacctcacactactaccacgtcgttcacggtacgacggtctagggttaagtttacgtttacaaccgtttaaactttacccgttcgtaaaccgtacttaaacgtacgttaacccgtttacctcccgtttacccgttaccgtttaacccgggttcccccggagtacccggttaacgtacgttagggtactaaccgttaactaacccgaaacgttcgttcggacgtaccgtacgacccgttaaccttcgttacctaccgttaccttttacggtacctttaccccgccctttaacttacgtagtaaccg

SEQ ID NO: 81802 - DNA, 821 bp, Homo sapiens
  misc_feature: GYAE6OF02FGJAI.52.1.A01.1.454.CMB.1.raw
  modified_base (183)..(183): a, c, t, g, unknown or other
  misc_feature (183)..(183): n is a, c, g, or t
tcagcgcagtacgacacgaccggtgctcgatttagacgtctcatcagggcacagcatggacatgagggtccccgctcagctcctggggctcctgctactctggctccgaggtgccagatgtgtcatcctagatcgaccctagtctccagtccctcccgtgttcccgcatctaggtaacggganaccaggtacgtcctaatccgaagtcctacgtttcgggccccggggtactaaaggtccaaggacgacctaagttacggaaaccgtttaatttttaaacgttcgggtactaccgaaacgtaacggaaacccggaaggggtaaaccgtcccccgtagaaacccttccgtacggtacttaccgttaacgtcgggttacctaacgtttaccctaaccgtttcgacgttagggtaacggtttaccgggggtacccctagtaaccggttaaacgggttctaaccgggtcggtaaccgtaggtagggtacctaccgggtaaggaccgtaggtaacctttccacgttcctaccgtaacaccttaccgaacccgtcgtaaccgtcgccgtaacgggttcgaaggttacgggttacttttacggtaacctaaccgttttacccgtttcgtaccgtaacgtaaaccggttacggtaaacgttttaccgaacccggttttccctaaccgtttccggtttacccgccggttacggaacccttaaggtacggtacgtaacttaacgaccgtaacgacgttcgtcgacgttacgccaacctacgttcttccgaacttccggtccttaacccgtccgtacccttagtactaacgg

SEQ ID NO: 81803 - DNA, 211 bp, Homo sapiens
  misc_feature: GYAE6OF01EWGP4.29.86.H09.1.454.CMB.1.raw
  modified_base (211)..(211): a, c, t, g, unknown or other
  misc_feature (211)..(211): n is a, c, g, or t
tcagatagagtactcacgaccggtgctcgatttagtgctatagacttgggtttggtgcccaagctgctggagggcacggtcaccacgctgctgagggagtagagtcctgaggactgtaggacagccgggaaggtgggcacagcggccctgggctgcctggtcaaggactacttccagtactctatctgagcgggctggcaaggcgcatagn

SEQ ID NO: 81804 - DNA, 249 bp, Homo sapiens
  misc_feature: GYAE6OF01B4VQU.29.86.H09.1.454.CMB.1.raw
  modified_base (244)..(249): a, c, t, g, unknown or other
  misc_feature (244)..(249): n is a, c, g, or t
tcagatagagtactcacgaccggtgctcgatttagtgctatagacttgggtttgggtgcccaagctgctggagggcacggtcaccacgctgctggaggagtagacgtcctggaggactggtaggacacgggaccggggtaagggtcgggacaacgaggcccggtcccgtgggctcgccgtggtacgaaggacttacttccagtactctatctgacggcgggctggacgaaggcgactaagtagnnnnnn

SEQ ID NO: 81805 - DNA, 214 bp, Homo sapiens
  misc_feature: GYAE6OF01A0YPA.29.86.H09.1.454.CMB.1.raw
  modified_base (212)..(214): a, c, t, g, unknown or other
  misc_feature (212)..(214): n is a, c, g, or t
tcagatagagtactcacgaccggtgctcgatttagtgctatagacttgggtttgggtgcccaagctgctggagggcacggtcaccacgctgctgagggagtagagtcctgaggactgtaggacagccgggaaggtgggcacagcggccctgggctgcctggtcaaggactacttccagtactctatctgagcgggctggcaaggcgcatagnnn

SEQ ID NO: 81806 - DNA, 213 bp, Homo sapiens
  misc_feature: GYAE6OF01CEWY1.29.86.H09.1.454.CMB.1.raw
  modified_base (212)..(213): a, c, t, g, unknown or other
  misc_feature (212)..(213): n is a, c, g, or t
tcagatagagtactcacgaccggtgctcgatttagtgctatagacttgggtttgggtgcccaagctgctggagggcacggtcaccacgctgctgagggagtagagtcctgaggactgtaggacagccgggaaggtgggcacagcggccctgggctgcctggtcaaggactacttccagtactctatctgagcgggctggcaaggcgcatagnn

SEQ ID NO: 81807 - DNA, 225 bp, Homo sapiens
  misc_feature: GYAE6OF01AXI2Y.29.86.H09.1.454.CMB.1.raw
  modified_base (214)..(225): a, c, t, g, unknown or other
  misc_feature (214)..(225): n is a, c, g, or t
tcagatagagtactcacgaccggtgctcgatttagtgctatagacttgggtttgggtgcccaagctgctggagggcacggtcaccacgctgctgagggagtagagtcctgaggactgtaggacaggccgggaaggtgggcacagcggccctgggctgcctggtcaaggactacttccagtactctatctgagcgggctgggcaaggcgcatagnnnnnnnnnnnn

SEQ ID NO: 81808 - DNA, 221 bp, Homo sapiens
  misc_feature: GYAE6OF01BJUAN.29.86.H09.1.454.CMB.1.raw
  modified_base (212)..(221): a, c, t, g, unknown or other
  misc_feature (212)..(221): n is a, c, g, or t
tcagatagagtactcacgaccggtgctcgatttagtgctatagacttgggtttgggtgcccaagctgctggagggcacggtcaccacgctgctgagggagtagagtcctgaggactgtaggacagccgggaaggtgggcacagcggccctgggctgcctggtcaaggactacttgcagtactctatctgagcgggctggcaaggcgcatagnnnnnnnnnn

SEQ ID NO: 81809 - DNA, 215 bp, Homo sapiens
  misc_feature: GYAE6OF01ELO7X.29.86.H09.1.454.CMB.1.raw
  modified_base (212)..(215): a, c, t, g, unknown or other
  misc_feature (212)..(215): n is a, c, g, or t
tcagatagagtactcacgaccggtgctcgatttagtgctatagacttgggtttgggtgcccaagctgctggagggcacggtcaccacgctgctgagggagtagagtcctgaggactgtaggacagccgggaaggtgggcacagcggccctgggctgcctggtcaaggactacttccagtactctatctgagcgggctggcaaggcgcatagnnnn

SEQ ID NO: 81810 - DNA, 540 bp, Homo sapiens
  misc_feature: GYAE6OF01BH2U5.29.86.H09.1.454.CMB.1.raw
  modified_base (236)..(236): a, c, t, g, unknown or other
  misc_feature (236)..(236): n is a, c, g, or t
  modified_base (238)..(239): a, c, t, g, unknown or other
  misc_feature (238)..(239): n is a, c, g, or t
  modified_base (241)..(243): a, c, t, g, unknown or other
  misc_feature (241)..(243): n is a, c, g, or t
  modified_base (245)..(245): a, c, t, g, unknown or other
  misc_feature (245)..(245): n is a, c, g, or t
  modified_base (247)..(248): a, c, t, g, unknown or other
  misc_feature (247)..(248): n is a, c, g, or t
  modified_base (250)..(251): a, c, t, g, unknown or other
  misc_feature (250)..(251): n is a, c, g, or t
  modified_base (253)..(253): a, c, t, g, unknown or other
  misc_feature (253)..(253): n is a, c, g, or t
  modified_base (258)..(258): a, c, t, g, unknown or other
  misc_feature (258)..(258): n is a, c, g, or t
  modified_base (261)..(261): a, c, t, g, unknown or other
  misc_feature (261)..(261): n is a, c, g, or t
  modified_base (268)..(268): a, c, t, g, unknown or other
  misc_feature (268)..(268): n is a, c, g, or t
  modified_base (273)..(274): a, c, t, g, unknown or other
  misc_feature (273)..(274): n is a, c, g, or t
  modified_base (278)..(278): a, c, t, g, unknown or other
  misc_feature (278)..(278): n is a, c, g, or t
  modified_base (283)..(283): a, c, t, g, unknown or other
  misc_feature (283)..(283): n is a, c, g, or t
  modified_base (287)..(287): a, c, t, g, unknown or other
  misc_feature (287)..(287): n is a, c, g, or t
  modified_base (289)..(289): a, c, t, g, unknown or other
  misc_feature (289)..(289): n is a, c, g, or t
  modified_base (291)..(293): a, c, t, g, unknown or other
  misc_feature (291)..(293): n is a, c, g, or t
  modified_base (295)..(296): a, c, t, g, unknown or other
  misc_feature (295)..(296): n is a, c, g, or t
  modified_base (299)..(299): a, c, t, g, unknown or other
  misc_feature (299)..(299): n is a, c, g, or t
  modified_base (301)..(301): a, c, t, g, unknown or other
  misc_feature (301)..(301): n is a, c, g, or t
  modified_base (303)..(304): a, c, t, g, unknown or other
  misc_feature (303)..(304): n is a, c, g, or t
  modified_base (306)..(306): a, c, t, g, unknown or other
  misc_feature (306)..(306): n is a, c, g, or t
  modified_base (326)..(326): a, c, t, g, unknown or other
  misc_feature (326)..(326): n is a, c, g, or t
  modified_base (328)..(328): a, c, t, g, unknown or other
  misc_feature (328)..(328): n is a, c, g, or t
  modified_base (330)..(330): a, c, t, g, unknown or other
  misc_feature (330)..(330): n is a, c, g, or t
  modified_base (333)..(334): a, c, t, g, unknown or other
  misc_feature (333)..(334): n is a, c, g, or t
  modified_base (336)..(336): a, c, t, g, unknown or other
  misc_feature (336)..(336): n is a, c, g, or t
  modified_base (338)..(338): a, c, t, g, unknown or other
  misc_feature (338)..(338): n is a, c, g, or t
tcagatagagtactcacgaccggtgctcgatttagtgctatagactttggggttttggggtgcccaacggctgctggtagggcacggtcaccacgtcgttgggctggagggagtagacgtcctggaggactggtaggacaggaccgggaaggtgggcgaccagcagccctgggctggcctggtcaaggctacttccagtactctatcgtggacgcgggctgggcaaggcgcatagncnncnnncncnncnncngtcangcntttatancacannctgngcgancganantnnntnntcntntnnanacaacacgacgacacacacncncntcnncncnctctcgtacgtacgtacgacgtactacgtacgtacgtagtagagtgtcgtcgtacgtacgtagttacgttacttactactactacacgacgtacgcgtacgtacgacgcgtacgacgacgtacgtacgtacgtacctaactacttacttacgtacgtaacgtaacgtacgttacgttagtactaccgttccgtccgtaccgg

SEQ ID NO: 81811 - DNA, 211 bp, Homo sapiens
  misc_feature: GYAE6OF02IHICU.29.86.H09.1.454.CMB.1.raw
  modified_base (211)..(211): a, c, t, g, unknown or other
  misc_feature (211)..(211): n is a, c, g, or t
tcagatagagtactcacgaccggtgctcgatttagtgctatagacttgggttgggtgcccaagctgctggagggcacggtcaccacgctgctgagggagtagagtcctgaggactgtaggacagccgggaaggtgggcacagcggccctgggctgcctggtcaaggactacttccagtactctatctgagcgggctggcaaggcgcatagn

SEQ ID NO: 81812 - DNA, 238 bp, Homo sapiens
  misc_feature: GYAE6OF02G7P05.29.86.H09.1.454.CMB.1.raw
  modified_base (213)..(238): a, c, t, g, unknown or other
  misc_feature (213)..(238): n is a, c, g, or t
tcagatagagtactcacgaccggtgctcgatttagtgctatagacttgggttgggtggcccaagctgctggagggcacggtcaccgacgctgctgagggagtagagtcctgaggactgtaggacagccgggaaggtgggcacagcggccctgggctgcctggtcaaggactacttccagtactctatctgagcgggctggcaaggcgcatagnnnnnnnnnnnnnnnnnnnnnnnnnn

SEQ ID NO: 81813 - DNA, 215 bp, Homo sapiens; identical to SEQ ID NO: 81809
  misc_feature: GYAE6OF02HXHGQ.29.86.H09.1.454.CMB.1.raw
  modified_base (212)..(215): a, c, t, g, unknown or other
  misc_feature (212)..(215): n is a, c, g, or t

SEQ ID NO: 81814 - DNA, 212 bp, Homo sapiens
  misc_feature: GYAE6OF02F86BG.29.86.H09.1.454.CMB.1.raw
  modified_base (212)..(212): a, c, t, g, unknown or other
  misc_feature (212)..(212): n is a, c, g, or t
tcagatagagtactcacgaccggtgctcgatttagtgctatagacttgggtttgggtgcccaagctgctggagggcacggtcaccacgctgctgagggagtagagtcctgaggactgtaggacagccgggaaggtgggcacagcggccctgggctgcctggtcaaggactacttccagtactctatctgagcgggctggcaaggcgcatagn

SEQ ID NO: 81815 - DNA, 231 bp, Homo sapiens
  misc_feature: GYAE6OF02GPHJ8.29.86.H09.1.454.CMB.1.raw
  modified_base (212)..(231): a, c, t, g, unknown or other
  misc_feature (212)..(231): n is a, c, g, or t
tcagatagagtactcacgaccggtgctcgatttagtgctatagacttgggtttgggtggcccaagctgctggagggcacggtcaccacgctgctgagggagtagagtcctgaggactgtaggacagccggaaggtgggcacagcggccctgggctgcctggtcaaggactacttccagtactctatctgagcgggctggcaaggcgcatagnnnnnnnnnnnnnnnnnnnn

SEQ ID NO: 81816 - DNA, 229 bp, Homo sapiens
  misc_feature: GYAE6OF02IPJ6M.29.86.H09.1.454.CMB.1.raw
  modified_base (212)..(229): a, c, t, g, unknown or other
  misc_feature (212)..(229): n is a, c, g, or t
tcagatagagtactcacgaccggtgctcgatttagtgctatagacttgggtttgggtgcccaagctgctggagggcacggtcaccacgctgctgagggagtagagtcctgaggactgtaggacagccgggaaggtgggcacagcggccctgggctgcctggtcaaggactacttccagtactctatctgagcgggctggcaaggcgcatagnnnnnnnnnnnnnnnnnn

SEQ ID NO: 81817 - DNA, 168 bp, Homo sapiens
  misc_feature: GYAE6OF01B0HIH.14.53.E09.1.454.CMB.1.raw
  modified_base (168)..(168): a, c, t, g, unknown or other
  misc_feature (168)..(168): n is a, c, g, or t
tcagcgtctagtaccacgaccggtgctcgatttagagagagtgtgttgggttgggaagaggaagactgacggtcccaggagttcaggtgctgggcacagcggccctgggctgcctggtcaaggactacttccgtactagacgctgagcgggctggcaaggcgcatagn

SEQ ID NO: 81818 - DNA, 170 bp, Homo sapiens
  misc_feature: GYAE6OF01BC6CL.14.53.E09.1.454.CMB.1.raw
  modified_base (170)..(170): a, c, t, g, unknown or other
  misc_feature (170)..(170): n is a, c, g, or t
tcagcgtctagtaccacgaccggtgctcgatttagagagagtgtgttgggtttgggaagaggaagactgacggtccccaggagttcaggtgctgggcacagcggccctgggctgcctggtcaaggactacttccgtactagacgctgagcgggctggcaaggcgcatagn

SEQ ID NO: 81819 - DNA, 496 bp, Homo sapiens
  misc_feature: GYAE6OF01BWWXF.14.53.E09.1.454.CMB.1.raw
  modified_base (482)..(482): a, c, t, g, unknown or other
  misc_feature (482)..(482): n is a, c, g, or t
tcagcgtctagtaccacgaccggtgctcgatttagagagagtgtgttgggtttgggggggtccaggaggcagaactctgggtgtctcaccatggcctggatccctctacttctcctcctcctcactctctgcacaggctctcaggcctcctatgagctgacacagccaccctcggtgtcagtgtccccaggacagacggccaggatcacctgctctggagatttgttgacaaagcagtatgctttttggaccagcagaagccaggccaggcccctctcttgattatatataaggacactgagaggccctcagggatccctgagcgattctctggctcagctcagggacaacactcaccttgaccatcagtgcagtccaggcagaagacgaggctgactattatgtcaatcagcagtcagcactaattcttatcgggtgttcggcggaggaccagctgaccgtctaggtcacgcccgaaggcncgcccccgtggtcc

SEQ ID NO: 81820 - DNA, 489 bp, Homo sapiens
  misc_feature: GYAE6OF01CLO4P.14.53.E09.1.454.CMB.1.raw
  modified_base (300)..(300): a, c, t, g, unknown or other
  misc_feature (300)..(300): n is a, c, g, or t
  modified_base (342)..(342): a, c, t, g, unknown or other
  misc_feature (342)..(342): n is a, c, g, or t
  modified_base (482)..(482): a, c, t, g, unknown or other
  misc_feature (482)..(482): n is a, c, g, or t
tcagcgtctagtaccacgaccggtgctcgatttagagagagtgtgtgggtccaggaggcagaactctgggtgtctcaccatggcccggatccctctacttctcctcctcctcactctctgcacaggctctcaggcctcctatgagctgacacagccaccctcggtgtcagtgtccccaggacagacggccaggatcacctgctctggagtatttgttgaacaaagcagtatgtcttttggaccagcagaagccaggccaggccctctcttgattatatataaggacactgagaggccctnagggatccctgagcgattctctggctcagctcagggacaacnctcacttgaccatcagtgcagtccaggcagagacgagctgactattatgtcaatcagcagtcagacacttaatcttatcggtgttcggcggaggaccagctcgacgtcaggtcagcccgaaggtcctcgccccgtcgtcncgttccg

SEQ ID NO: 81821 - DNA, 173 bp, Homo sapiens
  misc_feature: GYAE6OF01DOE0N.14.53.E09.1.454.CMB.1.raw
  modified_base (173)..(173): a, c, t, g, unknown or other
  misc_feature (173)..(173): n is a, c, g, or t
tcagcgtctagtaccacgaccggtgctcgatttagagagagtgtgttgggtttgggggaagaggaagactgacggtcccccaggagttcaggtgctgggcacagcggccctgggctgcctggtcaaggactacttccgtactagacgctgagcgggctggcaaggcgcatagn

SEQ ID NO: 81822 - DNA, 564 bp, Homo sapiens
  misc_feature: GYAE6OF01D8IC5.14.53.E09.1.454.CMB.1.raw
tcagcgtctagtaccacgaccggtgctcgatttagagagagtgtgttggctttgggggagtctccctcactgccctgctgggatctcagggcttcattttctgtcctccaccatcatggggtcaaccgccatcctcgccctcctcctggctgttctccaaggagtctgtgccgaggtgcaactggtgcagtctggtccagaggtagaaaaagcccggggagtctctgaagatctcctgtcagggttctggatataattttagtaactgttggacggcgtggtgcgccagaggccgggaaaggcccctggagtggatggggatcgtctttcctggtgactcagaaaccagatacagcccgtcttcgaacgcagtcgatcatatcggcgacaagtcgtacaactaccgcctacctgctagtggagcagccgtcgacggccgtcggaccgaccgaccagtacgtactaagttcgcgcgactcgactacaaccacgtacttattttagtacgtttcgtgggtcccaccgggacaacgttcggtcctaccgtcttcttcacgtaccccg

SEQ ID NO: 81823 - DNA, 590 bp, Homo sapiens
  misc_feature: GYAE6OF01D5BQM.14.53.E09.1.454.CMB.1.raw
  modified_base (336)..(336): a, c, t, g, unknown or other
  misc_feature (336)..(336): n is a, c, g, or t
  modified_base (576)..(576): a, c, t, g, unknown or other
  misc_feature (576)..(576): n is a, c, g, or t
tcagcgtctagtaccacgaccggtgctcgatttagagagagtgtgttgggtttgggggagtctccctcactgccctgctgggatctcagggcttcattttctgtcctccaccatcatggggtcaaccgccatcctcgccctcctcctggctgttctccaaggagtctgtgccgaggtgcaactggtgcagtctggtccagaggtagaaaaagcccggggagtctctgaagatctcctgtcagggttctggatattaattttagtaactgttggaccggctgggtgcgccaggacggccgggaaaggcctggagtggagtggggatcgtctttccgnggtgactcgaagaaaccagactacacgcccgtccttcgaacgccgaggtcatcatacgtccggaccgacaacgtccgtacaactacccgcctacctgcaggtggacgcgacgccgtacgacggccgtcggaccaccgcctagtcgtactattcgcgactactcactcacaccgtatttagttttagtactttcggcgggtaccgacgggtacaacgttcggtccgtccgttcttcttccncgtccccgtacccg

SEQ ID NO: 81824 - DNA, 600 bp, Homo sapiens
  misc_feature: GYAE6OF01AVW33.14.53.E09.1.454.CMB.1.raw
  modified_base (473)..(473): a, c, t, g, unknown or other
  misc_feature (473)..(473): n is a, c, g, or t
tcagcgtctagtaccacgaccggtgctcgatttagagagagtgtgttgggtttgggggagtctccctcactgccctgctgggatctcagggcttcattttctgtcctccaccatcatggggtcaaccgccatcctcgccctcctcctggctgttctccaaggagtctgtgccgaggtgcaactggtgcagtctggtccagaggtgaaaaagcccggggagtctctgaagatctcctgtcagggttctggatattaattttagtaactgttggaccggctgggtgcgccaggaggcccgggaaagccgtggagtggagtggggatcgtcgtttccgtggtgactcgagaaaccagatacacgtcccgtcttcgaacggccaggtcatcatacgtcggaccgtacaagtcccgtacaacgtcccgcctaacctgcgtaggtcggacgcacgtccctcggacggtcctccggaccncccgacatcgtactacgttgccgcgtatccaactccacgaccgtattacgtttttcgtacgttcgggtccggaccggacgtacgtacggttcgttccgtcttcgttacctcgccgtcccgaacccgg

SEQ ID NO: 81825 - DNA, 550 bp, Homo sapiens
  misc_feature: GYAE6OF01EZCLS.14.53.E09.1.454.CMB.1.raw
  modified_base (332)..(332): a, c, t, g, unknown or other
  misc_feature (332)..(332): n is a, c, g, or t
  modified_base (459)..(459): a, c, t, g, unknown or other
  misc_feature (459)..(459): n is a, c, g, or t
tcagcgtctagtaccacgaccggtgctcgatttagagagagtgtgttgggtttgggggagtctccctcactgcccctgctgggatctcagggcttcattttctgtcctccaccatcatggggtcaaccgccatcctcgccctcctcctggctgttctccaaggagtctgtgccgaggtgcaactggtgcagtctggtccagaggtgaaaaagcccggggagtctctgaagatctcctgtcagggttctggatataattttagtaactgttggaccggctgggtgcgccagaggcccgggaaaggcctggagtggatggggatcgtctttccnggtgactcagaaaccagatacagcccgtcttcgaagccaggtcatcatatcggccgacaagtccgtacaactaccgcctacctgcagtggagcagcctcgaggccctcggacacccgccatgtactntgcgcgatcactcacaccgattattttgacgttttcgtcggggccacggggactaacgttcggtcctccgttctccttcacgccctacccg

SEQ ID NO: 81826 - DNA, 673 bp, Homo sapiens
  misc_feature: GYAE6OF01CRKI4.14.53.E09.1.454.CMB.1.raw
  modified_base (214)..(214): a, c, t, g, unknown or other
  misc_feature (214)..(214): n is a, c, g, or t
tcagcgtctagtaccacgaccggtgctcgatttagagagagtgtgttgggtttgggggggtccaggaggcagaactctgggtgtctcaccatggcctggatccctctacttctcctcctcctcactctctgcacaggctctcaggcctcctatgagctgacacagccaccctggtgtcagtcgtcccaggacagacggccaggatcacctgctntggagtattttgtagaacaaaggcagttatgtctttttggaccagcaagaagccaaggccacggccctctcttgtattataataagtaaggacactgagacggcctgagggacttcccgagacgcgtacttcgtcgtcggcctaccgagccacgaagggaaccaaactacctaccgaaccttacgaaccctaatcgaagtcgactacgtaccgaggaccgaaggaacgaacgtacggcgtacgtaacttaatttagttacgttaacaattccgaagaccgtaagttaccgaacgtaaccctaacgtttaaactttcgtttaacgggtccggggtttacgggttaccggggaccgggaaacgggtaaccgaacggtaccgtacgggtaccccgttaccggtaacgggttaccaaccggtacccgaaaggcccttacccggtcccccggtcggttaacccg

SEQ ID NO: 81827 - DNA, 769 bp, Homo sapiens
  misc_feature: GYAE6OF01BFTIP.14.53.E09.1.454.CMB.1.raw
tcagcgtctagtaccacgaccggtgctcgatttagagagagtgtgttgggtttgggggagtctccctcactgccctgctgggatctcagggcttcattttctgtcctccaccatcatggggtcaaccgccatcctcgcccctcctcctggctgttctccaaggagtctgtgccgaggtgcaacgtggtgcagtctggtccaggaggtagaaaacggccggggagtctctagaagatctcctgtcgtaggttctaggattattaattttagtaacgttggtcggaccggtgtgggtgcgaccgaggacgggaccgggaaggccgtagggagtggaggtggggtacttcgttcgtttaccgtggtagacctacgaacgtaaaccgagtaactaccgaccgtccccgttaccgttacggaacggccgaggtacactctaatacgtaccggaccgtacgaacgttcccgtactaacgtaccccgtacctaccgtacgtaccgtagggtacggacgaccgaccgtcccggtaccgggtacggaccccggtaccgggaacccgtaccccggaccgtaagttaccgttaacgttaacgtccgggtaccggtaccgtacctaccgtaaccctacccgaaccgttaccgttaagtttttacttttacggttaccgtttaccgggtacggggtaacccgaacgggttaaccgtacgtttaccgggttcccctttcccggttacgtttacccgttccgtaacccgtcccctaaaccccgg

SEQ ID NO: 81828 - DNA, 884 bp, Homo sapiens
  misc_feature: GYAE6OF01EF5CX.14.53.E09.1.454.CMB.1.raw
  modified_base (163)..(163): a, c, t, g, unknown or other
  misc_feature (163)..(163): n is a, c, g, or t
tcagcgtctagtaccacgaccggtgctcgatttagagagagtgtgttgggtttgggggagtctccctcactgccctgctgggatctcagggcttcattttctgtcctccaccatcatggggtcaaccgccatcctcgccctcctcctggctgttctccaaggngtctgtgccgaggtgcaacgtggtgcagtctggtccgagaggtagaaaaacggccggaggtacgtctagtagatctcctgtgtaggtcgttgagtaattagtttaagttacgtagtcggtacggcggtcggttggcgacgacgaacgggaccgggtaaccgggacgtcgggtaggtaggaggtagggtacggtacgttccggtttaccgtttacggtacggtaccgttacgaacggtaaaaccgtaacggtaacgtaaccgaccgtaccccgtacccggttacccggtaacgggaccggtacggtacgtaacgtacgtacgttaacgtaccggtacccggtaaccgaaccgtttaaccgggaccttaaaccgtacccgtaccccgttaacccgtacgtaccgtacggttcgggaaacgggtacgtaacccgtacccggtacccggttccggggaacccgttaaccccgggaccgaaccccggtaacccgtacgtacgttaacgttacgtttaggacccggtaccggtaacctaccgttccctaacccgaaccgttaccgtttaaagtttacgttttttaacgtttacgttaccggggtttaccggggaaccccgggtttaacgggtaaacccggttaaggttaccggtttacccccggtttttacccgggtaacctttaccccgttttcccgggaaacccttcccccccgggtaaaccccg

SEQ ID NO: 81829 - DNA, 562 bp, Homo sapiens
  misc_feature: GYAE6OF01EVGQM.14.53.E09.1.454.CMB.1.raw
  modified_base (378)..(378): a, c, t, g, unknown or other
  misc_feature (378)..(378): n is a, c, g, or t
tcagcgtctagtaccacgaccggtgctcgatttagagagagtgtgtgggtccaggaggcagaactctgggtgtctcaccatggcctggatccctctacttctcctcctcctcactctctgcacaggctctcaggcctcctatgagctgaaacagcccaccctcggtgtcagtcgtccccaggacagacggccaggatcacctgctcgtggagtatttgttagacaaagcagtatgtctttttggaccagcagaagccaggccacggcccctctcttgatttatatagtaaggacacgtgaggacggccctcgagggactccctgagcgtattcctcgtcggcctccagctcgaaggacaacacctcaccttgacctancagtgctagtccaggcagaagacgaggctgacttattattgtacatcagcagtcgagactaacttattcgttacgtcgggttgttccgggacgggaacgggaccgaaggtccgtacggtacccgttacgtacggtccacggacccgaacgggtccctaccgcccccgtcggtcctccgttcccg

SEQ ID NO: 81830 - DNA, 606 bp, Homo sapiens
  misc_feature: GYAE6OF01CF00W.14.53.E09.1.454.CMB.1.raw
  modified_base (594)..(594): a, c, t, g, unknown or other
  misc_feature (594)..(594): n is a, c, g, or t
tcagcgtctagtaccacgaccggtgctcgatttagagagagtgtgttgggtttgggggagtctccctcactgccctgctgggatctcagggcttcattttctgtcctccaccatcatggggtcaaccgccatcctcgccctcctcctggctgttctccaaggagtctgtgccgaggtgcaactggtgcagtctggtccagaggtgaaaaagcccggggatctctgaagatctcctgtcagggttctggatatattttagtaactgttggaccggcgtgggtgcgccagaggcccgggaaaggccgtggagtggagtggggtatccggttctttccgtggtcgtactcgaacgaaaccagaataccagtccccgttccgttacggaaacggcccgaaggtcagtcagtacgtccggacgaacacgtccgtacaactaccgcctacctgcagtcgagacacgcctcggacgccgtacggaccaccgactactcgtactacgttcgcgacgtactacactccacgtaccgtatttatttttcgtaactttcggtcgggtaccgacgggtactacgtcggtccttccgtcttacctcncgtccctacccg

SEQ ID NO: 81831 - DNA, 546 bp, Homo sapiens
  misc_feature: GYAE6OF01BNXMM.14.53.E09.1.454.CMB.1.raw
tcagcgtctagtaccacgaccggtgctcgatttagagagagtgtgttgggtttgggggggtccaggaggcagaactctgggtgtctcaccatggcctggatccctctacttctcctcctcctcactctctgcacaggctctcaggcctcctatgagctgacacagccaccctcggtgtcagtgtccccaggacagacggccaggatcacctgctctggagtatttgttgacaaagcagtatgtcttttggtaccagcagaagccaggccaggccctctcttgattatatataaggacactgagaggccctcgagggatccctgagcgattctctggctccagctcgagggacaacactacaccttgaccatcagtgcagtccaggacagaagacgagctagactattattgtctaatcagcagtcacgctaacgttaacttctttagtcgggttgttcgggacgggtacgggaaccgaaggcgtacggacccggttccgtacgggtacacggacccgaacggcctccggcccccgttcggtacccg

SEQ ID NO: 81832 - DNA, 710 bp, Homo sapiens
  misc_feature: GYAE6OF01EF1SZ.14.53.E09.1.454.CMB.1.raw
tcagcgtctagtaccacgaccggtgctcgatttagagagagtgtgttgggtttgggggagtctccctcactgccctgctgggatctcagggcttcattttctgtcctccaccatcatggggtcaaccgccatcctcgccctcctcctggctgttctccaaggagtctgtgccgaggtgcaactggtgcagtctggtccagaggtagaaaaaggcccggggagtctctgaagatctcctgtcagggttctggattattaattttagtaacttgttggaccggtcgtggggtgccgccgaaggacgggacccgggaaaggcctggaggtggagtggggatcgtctttccgtggtgactcgaagaaaccagtctaacgaccgtcccgttacctacggaacgccgtacggtacatcatacgtccggaccgaacgtaacgtccgtacaacgtacccgacccttaccgtcgacgtaggtaggaacgtcgacgtccccgtacgggaccggtcccgtacggaaccgtacccgactacgttacgtaacttagtcggccgacgtatcccgtaactccaaccgtaaccgtatttttaggttttacgtaacgttttccggggtaccggggtacccgaaacggggtaacttaaccggttcgggtttccccgttacccggtttacctttaccgtttacccgaccggtcccccgttaaaccccgg

SEQ ID NO: 81833 - DNA, 751 bp, Homo sapiens
  misc_feature: GYAE6OF01ED2T0.14.53.E09.1.454.CMB.1.raw
tcagcgtctagtaccacgaccggtgctcgatttagagagagtgtgttgggtttgggggagtctccctcactgccctgctgggatctcagggcttcattttctgtcctccaccatcatggggtcaaccgccatcctcgccctcctcctggctgttctccaaggagtctgtgccgaggtgcaactggtgcagtctggtccagaggtagaaaaaggcccggggatctctgaagatctcctgtcgagggttctggattattaattttagtaactggttcggaccggtcgtgggtgccgccgaggacgggacccgggaaaggccgtaggggaggtgggaggtgggggattccggttcgtttccgtgggtcactacgaagaaaccagatacgacggtccccgtaccgttacgaacggcccgaggtcatacatacgtccgggacccgaacgaaacggttcccgtacgaaacctacccgtacccttaaccctcgaccgtagggtacggaagaccgaccggtcccgtacgggaccggccccgtaccggaacccgaccccggtcctaagttcgttaaccgttacgtttacgggaccgtacggtaactcctaactacccgacccttaacccggttaattttaacgttttttcggtaacgtttttccgggtaccgggggtacccgaaccggggtaaacctaaggtccgggttacccttacccgggttacctttcccgttacgtaccgtccccgtaaaccccgg

SEQ ID NO: 81834 - DNA, 725 bp, Homo sapiens
  misc_feature: GYAE6OF01BG109.14.53.E09.1.454.CMB.1.raw
  modified_base (269)..(269): a, c, t, g, unknown or other
  misc_feature (269)..(269): n is a, c, g, or t
tcagcgtctagtaccacgaccggtgctcgatttagagagagtgtgtgggtccaggaggcagaactctgggtgtctcaccatggcctggatccctctacttctcctcctcctcactctctgcacaggctctcaggcctcctatgagctgacacagcccaccctcggtgtcagtcgtccccaggacagacggccaggatcactgctctggagtatttgttgaacaaagcagtatgtcgttttggaccagcagaacgcacggccacgccctntcttgattatataagtaagacatgagacgccctagacggactccgtagacgcgtattcgtcgtggcctcgacgcgtacgaagggaccaaactacctaccgtaaccctttacggaaccctaacgtcgtaacggttcaccgtaacgtacccggaacgggaccgtaaaagggaaacggaacgggtaacggtacgtaacggtaacgtttaacgttttaagttacggtaacctaacgttacgaacgtaccgtaacgtaccgtaacgtaccgtaaacgtttaacgtttaccgtttaacgggttaccggggttagggtttacccggggaacgggtaaccggggaaccgtaaacggtccggttaacggtaccccggttaccggtaacggtccgtaaacccggtacccggtaacggtaccccgttacccgggtaccccccggttcgggttacccgttaaccccgg

SEQ ID NO: 81835 - DNA, 548 bp, Homo sapiens
  misc_feature: GYAE6OF01AGUDL.14.53.E09.1.454.CMB.1.raw
  modified_base (526)..(527): a, c, t, g, unknown or other
  misc_feature (526)..(527): n is a, c, g, or t
  modified_base (529)..(548): a, c, t, g, unknown or other
  misc_feature (529)..(548): n is a, c, g, or t
tcagcgtctagtaccacgaccggtgctcgatttagagagagtgtgttgggtttgggattcacgttgcagatgtagggctgggtgcgccagaggcccgggaaaggcctggagtggatggggatcgtctttcctggtgactcagaaaccagatacagcccgtccttcgaaggccaggtcatcatatcggccgacaagtccgtcaataccgcctacctgcagtggagcagcctcgaggcctcggacaccgccatgtactattgcgcgatcactcacaccgtattatttttgatttcgtggggccacgggacaagtggtctccgtctcttcagccctccaccacggcccagtccggtccttcccccgtggccacccctcctacccaagcgccaccgtcggtcggggaccacgacggcccggcccgtggggcctcggcccttgggtaccaacgggtaccttaccgttcccgtacgtacggaccgtcgtaggacggccgggtcgtcgggaccgaacgggtccgacagtacgnnannnnnnnnnnnnnnnnnnnn

SEQ ID NO: 81836 - DNA, 725 bp, Homo sapiens
  misc_feature: GYAE6OF01E1CBD.14.53.E09.1.454.CMB.1.raw
tcagcgtctagtaccacgaccggtgctcgatttagagagagtgtgttgggtttgggggagtctccctcactgccctgctgggatctcagggcttcatttttctgtcctccaccatcatggggtcaaccgccatcctcgccctcctcctggctgttctccaaggagtctgtgccgaggtgcaacgtggtgcagtcgtggtccaggaggtagaaaaacggcccggggatctcgtagaagtactcctccgtgtcgtagggtttctaggtattaagtttaattttaggttaacgtggttcgggaccggtcgtggggtcgccgccgaaggacgggacccgggaaaggccgtagggaggtgggaggtggggtacttccggttcttttccggtggttcgacgtacgaacgaaaccgagtaactacgaccgtcccgttaccgttacggaacgccgaggtcacgtcaagtcgtccggactaacgtaacggtacctacgtaaccgtacccgtacccgttacctcggacgtacgggtacggacgccgacgtcccgtaccgggacgcccgtaccggacccgccgacctagttacgtacgttcgttcggccgtacgtacctaccacctacaccgtaccgttaagttttcgttttacgtacgtttcgggtaccgggacggaacgggtacctaaggttccggtccgttcccgttcttactcgtccgtcccgtaaccccgg

SEQ ID NO: 81837 - DNA, 699 bp, Homo sapiens
  misc_feature: GYAE6OF01DRUR8.14.53.E09.1.454.CMB.1.raw
  modified_base (187)..(187): a, c, t, g, unknown or other
  misc_feature (187)..(187): n is a, c, g, or t
  modified_base (296)..(296): a, c, t, g, unknown or other
  misc_feature (296)..(296): n is a, c, g, or t
  modified_base (369)..(369): a, c, t, g, unknown or other
  misc_feature (369)..(369): n is a, c, g, or t
  modified_base (375)..(375): a, c, t, g, unknown or other
  misc_feature (375)..(375): n is a, c, g, or t
tcagcgtctagtaccacgaccggtgctcgatttagagagagtgtgttgggtttgggggagtctccctcactgccctgctgggatctcagggcttcattttctgtcctccaccatcatggggtcaaccgccatcctcgccctcctcctggctgttctccaaggagtctgtgccgaggtgcaactggtncagtctggtccagaggtagaaaaacggcccggggagtctcagaagattcctcctggtcgtagggttctggtaattaattaattttaagtaacttggttacgggaccggngtgggtgaccgccgaagggacggaccggggaaagccgtagggaggtggaggtggggtacttcgttcgtttcgngggtanactacgaacgaaaccagactacacgtcccgttacgtacggacgcgtagtcaatcaatcgtacgaccgtaataaccggtcctacgaactacccgtaccctacgtacgcgtagggtcggacgacgtaccgaccgttacgccggtacccgaccggaacccacccgactagtacgttaacttcgtacgacgtaccgtaactccgtaacctacgtaaccctacgttattttagttttcggtaacttttccggggaccgggtacgtaaccgggtactaacggttacgttccctaccgtttcacccgtttacgccgtacccgttacccccg

SEQ ID NO: 81838 - DNA, 753 bp, Homo sapiens
  misc_feature: GYAE6OF01AT7WV.14.53.E09.1.454.CMB.1.raw
  modified_base (164)..(164): a, c, t, g, unknown or other
  misc_feature (164)..(164): n is a, c, g, or t
  modified_base (224)..(224): a, c, t, g, unknown or other
  misc_feature (224)..(224): n is a, c, g, or t
  modified_base (397)..(397): a, c, t, g, unknown or other
  misc_feature (397)..(397): n is a, c, g, or t
  modified_base (402)..(402): a, c, t, g, unknown or other
  misc_feature (402)..(402): n is a, c, g, or t
tcagcgtctagtaccacgaccggtgctcgatttagagagagtgtgttgggtttgggggaggtctccctcactgccctgctgggatctcagggcttcattttctgtcctccaccatcatggggtcaaccgccatcctcgccctcctcctggctgttctccaaggngtctgtgccgaggtgcaactggtgcagtctggtccagaggtagaaaaggccggggagtcnctagaagatctctgtcgagggttctaggattattaaatttttacgtaacgttggtttagggaccggtgtggggtcgccggaccgaaggacgggaccccggggaaaggccgtagggaggtcgggaagtggggattccggttcgtttccgtgggtacgactcgaacgtaaaccgngtaanaccacggtccccgtcgttaccggaacggcccgtaaggtcaacgttcgaacttacggtaccgggaccgaacgtaacggtccgtacgtaacgtaacccgtacctaccgtacgacgtacggtaggacgacgacgccgtcggacggtccgtcgaccgaccgactacgttaccggtactacgttacgcccgtacgtaaccgtcctacctaccgaacctaacccgttagtttttaacttttcggttaacgtttttccggtaccggggtacccgttaacggggaaccgttaacggttcggtttccccgttacccgggttccctttaccggtttccctacccggtacccgtacccccgg

SEQ ID NO: 81839 - DNA, 852 bp, Homo sapiens
  misc_feature: GYAE6OF01DCD1A.14.53.E09.1.454.CMB.1.raw
tcagcgtctagtaccacgaccggtgctcgatttagagagagtgtgttgggtttgggggagtctccctcactgccctgctgggatctcagggcttctattttctcgtcctccaccatcagtggggtcaaccgccatcctcgccctcctcctggcttgttctaccgaagggtacgtctggtcggccggaggtgaccaacgtgggtgctagtcgtaggtccgaaggtaagggtaaggaaaaaccgggcccgggggtatccttacagaacgtcttccgtctggtacggtagggttctaggtaattaatttaaagtttttacggaacgttcggttcgggaccggtggtggggtcgccgacggaacggacggggaccgggaaacggcgtagggagggtggtaggtcggggtactccgtttcgttaccggtggtacgacttacgaaacgtaaccagtacgtacgaccggtcccgtacgtacggaacgtcgtacggtactctactacgtacgacggtacccgaacgtaacgtccctaacgtaacccgtacccgtaaccgtacgtccggtaacggaggtacggtaccggtaccgaccggtacccgtacgggacccggccggtacccggacccgtaccgaccgtagttaaccgtacgttacgttaccggaccggtacggtaacctacccgtacgtaacccgtaccgttaaccgttaagtttccgttttaggttaacccggttccggggttaaccggggtaccccgggaaagggttacccggttaaacgggttccccggtttaaacccgttccggtttacccgttacccgtttacccggtacccgtaccccgttaaccccggg

SEQ ID NO: 81840 - DNA, 682 bp, Homo sapiens
  misc_feature: GYAE6OF01BYJH3.14.53.E09.1.454.CMB.1.raw
tcagcgtctagtaccacgaccggtgctcgatttagagagagtgtgtgggtccaggaggcagaactctgggtgtctcaccatggcctggatccctctacttctcctcctcctcactctctgcacaggctctcaggcctccatttttgagctgacacacgccaccctcggtgtcagtcgtccccaggacagacggccaggatcacctgctctggagtatttgttagacaaagcagtatgttcgttttcgtaccagcaagacgccgacggcccgacggcccctcttcttagtattatataagtaagacacgtagagaccggcctacggacgggtactcccgtaggacgtcgtacttctcgtcggtcctaccgagtctacggaacggacaactacctcctacgtacgaacctactacgtagtcgacgtacgtaccgagtaccaaagggaacggacgtaggaccgttagtaacgtttagttaacgttcgtaagtaacttcgaagtccgtaagttcgaacgtaccttaacgtttaacgttttcgtaacgggtttccgggtacgggttccgggaacggggtaaacggtaccaagggttccgtaacccggtacccggtaggtttaccggaccggtacccgacccggtacggacccgttaccccggtcccccttcgggtacccttacccgg

SEQ ID NO: 81841 - DNA, 764 bp, Homo sapiens
  misc_feature: GYAE6OF01BJYHO.14.53.E09.1.454.CMB.1.raw
tcagcgtctagtaccacgaccggtgctcgatttagagagagtgtgttgggtttgggggagtctccctcactgccctgctgggatctcagggcttcattttctgtcctccaccatcatggggtcaaccgccatcctcgccctcctcctggctgttctccaaggagtctgtgccgaggtgcaactggtgcagtctggtccaggaggtagaaaaacggccggggagtctctagaagatctcctgtcgtagggttctaggtattaatttaagttttagtaacgttggttcgggaccggtgtgggtgccgacgaggacgggacccggggaaaggccgtagggaggtggaggtggggtatccggttcgtttccgtggtacgacctacgaaacgaaaccgagaactacgaccgtcccgttaccgtacggaacggccgtacggtactaagtactaacgtacgtaccgggaccgtaacgtaaccggtcccgtaacgtaaaccgtacccgtacccttaccgtacgacgtagggtacggacgaccgaaccggtcccgtacgggaccggtcccgtaccgggaacccacccgtacgtacgttaccgttaacttacgttcggacccggtacgacgttacccaactacccgaaccgttacccgttaatttttacgttttacgtacgttttcccggggacgggtacccgtaacgggtaaccttaggttccggttacccttccggttaccttaccgtcccgaccgtcccctaaaccccggg

SEQ ID NO: 81842 - DNA, 756 bp, Homo sapiens
  misc_feature: GYAE6OF01D4V30.14.53.E09.1.454.CMB.1.raw
tcagcgtctagtaccacgaccggtgctcgattttagagagagtgtgttgggtttgggggagtctccctcactgccctgctgggatctcagggcttcatttttctgtcctccaccatcatggggtcaaccgcatcctcgcccctcctcctggctgttctccaaggagtctgtgccgaggtgcaactggtgcagtctggtccagaggtagaaaacggccgggatctctagaagatcctctgtcgtaggttcgtaggtattaatttaagttttaagtaacgttggttgggaccggtcgttgggtgccggacaagggtacgggaaccccgggaaaggtccgtagggtaggtggagttggggactttccgttacgttttcgtaggtacaccttacgaaacgaaaaccgagtaacgtaccgtaccggtaccccgttaccgttaaccgggaacggtacccgtacggtacaacttacgtaacgttaaccgcccggggaaccctaaaccgtaaaccggtttcccggtaaacctaaccgtacccgtacccgttaccgtacgacgtacggtacggacgaccaacgtcccgttacggacggtcccgtacggaacccgtacccggactaccgtagttaactgttcgacgtaccgatccactactaccgtacgttagtttacgtttcgtagtttacgggccggtaccgggaagtaccgttaaggtccgttaccgttccgttacgttcctttaacgccgtccctaacccgg

SEQ ID NO: 81843 - DNA, 666 bp, Homo sapiens
  misc_feature: GYAE6OF01AZ00Y.14.53.E09.1.454.CMB.1.raw
tcagcgtctagtaccacgaccggtgctcgatttagagagagtgtgttgggtttgggggagtctccctcactgccctgctgggatctcagggcttcattttctgtcctccaccatcatggggtcaaccgccatcctcgccctcctcctgggctgttctccaaggagtctgtgccgaggtgcaactggtgcagtctggtccagaggtgaaaaagcccggggagtctctgaagatctccgtgtcagggttctggattataattttagtaactggttggaccggctgggtgcgccaggtacggcccggaaaggcctgggacgtggagtggggatcggtcttccgtggtgactcagaaaccagatacacgcccgtcgtcgaacggccaggtcagtcatactcggacctacgaacgtccgtactaacgtacccgccttaccgtgacgtaggtacggacgcgaacgcccgtcggacggtcccgtacggaccacccggctaatacgtactagttacggccgacgtactccgacctccaaccgtacccgttaatttcgtttttacgtacgttttccgggtccgggggtaccccgaaacggggttaactaaacggttcggttaccccgttcccggtttaccttacccgttccgaccggtcccccttaaaccccggg

SEQ ID NO: 81844 - DNA, 643 bp, Homo sapiens
  misc_feature: GYAE6OF01CO9BQ.14.53.E09.1.454.CMB.1.raw
tcagcgtctagtaccacgaccggtgctcgatttagagagagtgtgttgggtttgggggagtctccctcactgccctgctgggatctcagggcttcattttctgtcctccaccatcatggggtcaaccgccatcctcgccctcctcctggctgttctccaaggagtctgtgccgaggtgcaactggtgcagtctggtccagaggtgaaaaagcccggggatctctgaagatctcctgtcagggttctggatattaattttagtaatggttggaccggtcgtgggtgcgcaggacgggacccgggaaaggccgtggagtgggagtggggatcggttctttccgtgggtgactacaacgaaaccagactaccgacgtccccgtccgttacggaacggccgtaggtcatcatacgtcggaccacgaacgtccgtacaactacccgcctaccgtgacgtaggtggagcgacgcccgtacggaccggccgtaccggaccacccgcctagtcgtactgttcgcgcgtactaccacctacacctaccgttatttacgttttacgtattttccggcgggggtaccctaacggggtaactaacggttcggtcccttcccgttccttacctttccgaccgtcccgttaaccccg

SEQ ID NO: 81845 - DNA, 762 bp, Homo sapiens
  misc_feature: GYAE6OF01AP7Z4.14.53.E09.1.454.CMB.1.raw
tcagcgtctagtaccacgaccggtgctcgatttagagagagtgtgttgggtttgggggagtctccctcactgccctgcgtgggatctcagggcttctattttctgtcctccaccatcagtgggtcaaccgccatcctcgccctcctcctgctgttctccaaggagtctgtgcgaggtgacacgtggtgcagtctggtcgagaggtagaaaacggccgggagtctcgtagaagactctcctggtcgtaggttcgtaggtattaatttaagttttagtacgttggttcggaccggtggtgggtcgccgacgaggacgggacccgggaaggccgtaggtaggtacggaggtagggtacgttccgttccgtttaccgtggtacgactacgtaaacgaactagtactaccgaccgtcccgttacgtacggaacgcgacgtcacgtacagtacgtccggacgaacgtacgtaccgtaactaccgtacccgccctaccgtgtacgacggtcggaacgaccgtacgaccgtaccggaccggtacccgtaccggaccacccgtacacgttacgtacgttaggtcccgtacgtccgtacttacctaccgtacctaacccgtaaccgtttagtttttaacgttttacgggttaccggtttaccggggttcccggggaaccggttaaccggaaacggttttcggtcccgtttacccccgggtttacctttaccgttaccccgtttaaccgcccgttaacccccggtaaccccgg

SEQ ID NO: 81846 - DNA, 679 bp, Homo sapiens
  misc_feature: GYAE6OF01D0BUF.14.53.E09.1.454.CMB.1.raw
  modified_base (366)..(366): a, c, t, g, unknown or other
  misc_feature (366)..(366): n is a, c, g, or t
tcagcgtctagtaccacgaccggtgctcgatttagagagagtgtgttgggtttgggggagtctccctcactgccctgctgggatctcagggcttcattttctgtcctccaccatcatgggtcaaccgccatcctcgccctcctcctggctgttctccaaggagtctgtgccgaggtgcaactggtgcagtctggtccagaggtagaaaaacggcccggggagtctctgaagatctcctgtcgtaggttctaggattaagttaattttagtaacgttggttcggaccggtcgttagggtgccgccgaggacggcccggagacggccgtaggagtggagtaggatcatcctagtacctaagtgtactntagagtacggcgactacgacgtccccgttaccttaccgaaggaccctaaacgtcccaaccgtacttcctacgaacgtaccgaacgtaacggtaccctaacgtaaccgtaccccgtaccctaccgtagacgtaaagtcggtaacgcacggtaccgtagggaaccgccgtaccggaccgtacccgcgttagttacttacgtgtcggtacgtacggtccggttaccttcgtacgtacgtagtacgttagtaggtagtcgtaccgttaagttacccgtaccggtacccttcccgttacccccgttgttccgttaacg

SEQ ID NO: 81847 - DNA, 748 bp, Homo sapiens
  misc_feature: GYAE6OF01CPGHP.14.53.E09.1.454.CMB.1.raw
  modified_base (379)..(379): a, c, t, g, unknown or other
  misc_feature (379)..(379): n is a, c, g, or t
tcagcgtctagtaccacgaccggtgctcgatttagagagagtgtgttgggtttgggggagtctccctcactgccctgctgggatctcagggcttcattttctgtcctccaccatcatggggtcaaccgccatcctcgccctcctcctggctgttctccaaggagtctgtgccgaggtgcaactggtgcagtctggtccagaggtagaaaaacggcccggggagtctctagaagtatctccgtgtcgaggttctggattattaattttagtaactggttcggaccggtcgtgggtcgcgccgaggtacggacccgggaaaggccgtggagtggagtggggattccgttcgtttaccgtggtcgaccgtacgacgaaaccngtactaaccgacgtccccgttcgttacggaacggcctacggtactacgtcgaattacgtaccggaccgtaaaccgtacgttcccggtactaacgtacccggtaccctacccgtgacctaggtcggacgtccgacgtcccgcggaaccggtcccgtaccggaccacccgtaccgattaccggtaactttcgtacggtcccgtacggtactccaaccgttacccgacccgtacgtttaacttttaggtttttaccgtaccggtttttacgggacccggggtacccggtaaacgggttaccgtacggtttaccggttcccgttacccgttccgtttacccttccggtaacccgttcccccttaaaccccggg

SEQ ID NO: 81848 - DNA, 666 bp, Homo sapiens
  misc_feature: GYAE6OF01DRB9P.14.53.E09.1.454.CMB.1.raw
  modified_base (546)..(546): a, c, t, g, unknown or other
  misc_feature (546)..(546): n is a, c, g, or t
  modified_base (580)..(580): a, c, t, g, unknown or other
  misc_feature (580)..(580): n is a, c, g, or t
tcagcgtctagtaccacgaccggtgctcgattttagagagagtgtgttgggtttgggggagtctccctcactgccctgctgggatctcagggcttcattttctgtcctccaccatcatggggtcaaccgccatcctcgccctcctcctggctgttctccaaggagtctgtgccgaggtgcaactggtgcagtctggtccagaggtagaaaacggcccggggatctctagaagatctctgtcgagggttctggattaattaatttttaagtaacttggttcgggaccggtcgtgggtgccgccgaggacgggacccgggaaaggccgtaggaggtgggagtggggtattccggttcctttccgtgggtgaccttacgaaacgaaaccgagtactacgacgtcccgttaccgttacggaacggtccacgggtacactacgtaacgtacgtaccgggacccgaacgtaaccggttccgtaactaacctacccgtaccctacgtcgacgtaggtcggacgacgacgccgtacggacggcccgtacgaccnccgtaccagtcgtactgtcgcgacgtactctacncacctacgtactttatttcgtagtttcggcgggaccgtaacggtactacgttcgtcttaccgttctacttccgcgtcccgtacccg

SEQ ID NO: 81849 - DNA, 756 bp, Homo sapiens
  misc_feature: GYAE6OF01BICK0.14.53.E09.1.454.CMB.1.raw
  modified_base (597)..(597): a, c, t, g, unknown or other
  misc_feature (597)..(597): n is a, c, g, or t
tcagcgtctagtaccacgaccggtgctcgatttagagagagtgtgttgggtttgggggagtctccctcactgccctgctgggatctcagggcttcattttctgtcctccaccatcatggggtcaaccgccatcctcgccctcctcctggctgttctccaaggagtctgtgccgaggtgcaactggtgcagtctggtccagaggtagaaaaacgcccggggagtctctgaagatctcctgtcgtagggttctggtattagttaattttagtaacgtggttcggaccggtcgttggggcgccggtaccgaggtaccggggaccccggggaaaaggtcccgtagggtaggtagggacggtggggattccggtttacgtttccgtaggtgacctacgaacggtaaaccagtaactaccgacggtccccggttaccttacgggaacggtccgtaggtaccagttaccataccgtcgggaccgtaacgtaaacgtcccgtaactaactacccgtacccgttacccgtgtaccgtaaggtcggacacgtaccgcccgtacggacggcccgtacggaccacccgctaacgtcggtaactcgttcnccggacgtaccgtccaccgtctaaacccgtacggttaattttacggtttttacgtaccgttttaccggggtaccgggtaaccccgtacggggtaaccttaacggtccggttacgttcccgttaccttaccgtttaccgaccgtcccccgttaaccccgg

SEQ ID NO: 81850 - DNA, 838 bp, Homo sapiens
  misc_feature: GYAE6OF01AE6GF.14.53.E09.1.454.CMB.1.raw
tcagcgtctagtaccacgaccggtgctcgatttagagagagtgtgttgggtttggggagtctccctcactgccctgctgggatctcagggcttcattttctgtccctcccacatcagtgggtaccaaccgccactcctccgcccctcctccgtcggcttgttcctaccgaaaggtacgttcgtggttcggaccggtagggtcgacctaacgtgggtgccgtagttcgttcggtaccgaggtaggtaaaggaaaaaccgggcccggggtagttcctcgtagaagtacttcctccgtgtacgtagggttctaggtattaatttaatttttaagtaacgttggttaccggaccggtcggtgggtcgccgaccgaggaccgggacccgggaaacggtccgtaggaggtagggtaggtggggtacttccggtttccgtttccggtggtacgtacctaacgaaacgaaaccgtgtaactacgacccggtcccgttaccgtaccggaacgtcccgtaggtacctaagtacctaacgttacggtcccgggaacccgtaaccgttaaccggttacccgtaacctaacccgtaccccgtacccttaacgtcgacgtagggtacggacgacgaccgtccgaccgggaccggtcccgtacccggacccgaccccgacgttagttacgttaacttcgttccggaccggcgttaacgtcccacttaccgaccgttaacgttattttacgttttcggttaccgtttccgggtccggggacccgtaacggtactaacgggtttcccgttacccgtttccgttaccttccctacgtcccgtcccgtaaaccccgg

SEQ ID NO: 81851 - DNA, 781 bp, Homo sapiens
  misc_feature: GYAE6OF01ECEPK.14.53.E09.1.454.CMB.1.raw
  modified_base (191)..(191): a, c, t, g, unknown or other
  misc_feature (191)..(191): n is a, c, g, or t
  modified_base (345)..(345): a, c, t, g, unknown or other
  misc_feature (345)..(345): n is a, c, g, or t
  modified_base (644)..(644): a, c, t, g, unknown or other
  misc_feature (644)..(644): n is a, c, g, or t
tcagcgtctagtaccacgaccggtgctcgattttagagagagtgtgttgggtttgggggagtctccctcactgccctgctgggatctcgagggcttcattttctgtcctccaccatcagtggggtcaaccgccatcctcgccctcctcctggctgttctccaaggagtctgtgccgaggtgcaacgtggtncgagttctggtaccaggtaggtaagaaaaacggcccgggagtctcgtagaagactctactgtcgagggttctggtattaattaattttaagtagttggtcggaccggtgtggtcgccgacgaggaacggaccgggaagtccgtaggaggtaggnggtagggtcttccggttcgtttccggtaggtacgtaacgttacaaacgaaaccgagtaacgtaccgaccggtccccggttacgttaacgggaaacggtacccgtaacggtactaacgtcgtaacgttaccggtacccgggaaccgttaacggtaaaccggtttacccgtaccgaaacccggtaccccgtacccttacccggtacggacgacggttcgggaacctcgaccggtcccgaccgggtccggtacccgacgacccgacccgactacgttacgttaacgttcgtacggcccggtntaaccggtacctacctaaccggaaccgttaacgttatttttacgtttacgttaccggtttacgggtcccgggaaccggttacgaacgtacggttccggacctttccgtacccgttcttccaccgttcccgaacccgg

SEQ ID NO: 81852 - DNA, 770 bp, Homo sapiens
  misc_feature: GYAE6OF01ESUF3.14.53.E09.1.454.CMB.1.raw
  modified_base (264)..(264): a, c, t, g, unknown or other
  misc_feature (264)..(264): n is a, c, g, or t
  modified_base (753)..(753): a, c, t, g, unknown or other
  misc_feature (753)..(753): n is a, c, g, or t
tcagcgtctagtaccacgaccggtgctcgatttagagagagtgtgttgggtttgggggagtctccctcactgccctgctgggatctcagggcttcatttttctgtcctccaccatcatggggtcaaccgccatcctcgccctcctcctggctgttctccaaggagtctgtcgccggaggtgacaacgtgggtgcagtctggtccgaaggaggtaaggaaaaacgggcccggggagtctcgtagaagatctcctgtcgtaggttntggattatttaattttagtaacgttggttcggaccggtcgtggggtcgcgccgaggacgggacccgggaaaggccgtgggaggtaggaggtggggtacttcggttccgttttccggtgggtacgacctacgaaacgaaaccgagaacgtaccgtaccgcccggttccgttaccggaacggcccgtaggtaccataccgtatacggtaccggacccgtaacgaccgttacccgtaccgtaaaccgtacccgtacccttaccgtacgacgagggttagggacgaccgacggtacccggtaccgggaccgggtcccggtacccggaacccgacccggacccgtacgttacgttaacgttacgttcggccggacggtaaccttccgtacctaccgaacccgtaaccgttagtttatttttacgtacgttttcgggtaccgggtaccggaacggtacgtaacgttcggttcccgttaccgttccttccgttacnccgtcccgtaaccccgg

SEQ ID NO: 81853 - DNA, 855 bp, Homo sapiens
  misc_feature: GYAE6OF01B0GKV.14.53.E09.1.454.CMB.1.raw
tcagcgtctagtaccacgaccggtgctcgatttagagagagtgtgttgggtttgggggagtctccctcactgccctgctgggatctcagggcttctattttctgtcctccaccatcatgggtcaaccgccatcctcgccctcctcctggctgttctccgaaggagtctgtgccgaggtgcaacgtggtgcagtcgtggtcgagaggtagaaaaacggccgggagtctctagaagtactcgtcgtgtacgtagggttctaggtattaagttaagttttaaggtaacgttggttacggtaccggtcggttggggtcgcggaccggaagggaaccggggacccggggaaaggtccgtgggacggtgggtaggtcggggtacttccggtttcgtttccggtaggttacgactacgtaaacgaaccgtagtaactaccgtacggccccgttaccgttacggaacggtacccgtaaggttcctaacgaccgttagtaaccggtcccggaaccgttaccgaaacggttcccgtaacgtaacccgttacccgtacccgttaccgtacggtacgtacgggtacgaccggtacgaaccggtcccgaccggtaccggtaccccgtaaccggtacccgaacccgtaccgttacgttaaccgttacgttacggttacccggcgacccgtaacgtaaccctccgtaacccgtacctaaccgtttaagttttacgtttttacgttaacccggttttccgggtaacccgggtacggttaacccgggtaaacgttaccggttaccgggtttacccgtttacccggtttccttaacccggtttaccgaacccggtttcccctaaacccccggg

SEQ ID NO: 81854 - DNA, 933 bp, Homo sapiens
  misc_feature: GYAE6OF01E46V5.14.53.E09.1.454.CMB.1.raw
tcagcgtctagtaccacgaccggtgctcgatttagagagagtgtgttgggtttggggagtcctccctcactcgccctgcgtggatctcgaggtcttctattttctcgtccctcccaccatcgagtcgggtaccaaccgccactcccgtccgccccttcctccgtggtcttcgttccgtaccgaaggtacgttcgtcggtacggaccggtaggtcgaccgtaacgtcggtcgaccgtacgttccgtacggtaccgaaggtaaacgggtaaacggaaaaaccgggtcccggggtacgtaccgttacgtaagaacgtaccttccgttccgttacggttaccggttacgggtttacgttaaggtaaacttttaaagttttaaacgttttttaacggttaacggtttacgggttaccgggtacccgggttcgggttacggggtaccggtacccggaccggaaccggggaacccggggaacccggggtaaacgggtccggtaagggtagggtacgggtacgggttacgggttacgtttcccggtttccggttttaccggtaggtaccgtaaccgtaaccgaaaccgtaaacgtaacgtaaccgtaccggtacccggttaccccggtttaccggtaaccggaacggtaccgtaacgtactacgttaacgtacgtaccggacccggaaccgtaaccgtaccggttaccgtaaccgtaaccgtacccgtaccgtacgtcgacgtaggacgacgtcgacggtcccgtacggaccgtacccgtaccgacccgaccgtacgttacgtacgtaccgtagtaccgacgtacctacgtacaccgttacacgttagtttacgttttacgtttcggtacgttccggacggtaaccgtaggtaacgttcgtccggttacgtacgttccttaccgttcgtccgtcccgtacc

SEQ ID NO: 81855 - DNA, 641 bp, Homo sapiens
  misc_feature: GYAE6OF01AK6O7.14.53.E09.1.454.CMB.1.raw
  modified_base (299)..(299): a, c, t, g, unknown or other
  misc_feature (299)..(299): n is a, c, g, or t
  modified_base (326)..(326): a, c, t, g, unknown or other
  misc_feature (326)..(326): n is a, c, g, or t
  modified_base (379)..(379): a, c, t, g, unknown or other
  misc_feature (379)..(379): n is a, c, g, or t
  modified_base (530)..(530): a, c, t, g, unknown or other
  misc_feature (530)..(530): n is a, c, g, or t
tcagcgtctagtaccacgaccggtgctcgattttagagagagtgtgttgggtttggggagtctcctcactgccctgctgggatctcgagggcttctatttttcttgtcctccaccatcatgggtcaaccgccatcctcgcctctcctggctgttctccgaaggagtctgtgccgaggtgcaacgtggtgcagtcgtcggtccgaaggaggtaaggaaaaacggcccggggagttcctcgtgaaagacgtctccgtgtcgtaggttcgtgattattaagttttagaagttggtacggcgngtggcgcgcgaggacggacggacgcgnggaggtggaggtggtacgtcgttcgttcgtggtacgactacgaagaacgaganacgcgtccgtacgtagacgacgacgtacatcacgtacgcggtaccgtaacgacgtaccgtactaccgtaccgtaccgtaccagacgtacggagacgcgcgtacgtccgtcgaccgtacgacgccgacgtactcgtaacgtcgtagcgtacncctactcgaccaacgtacgttagtttgtttacgttaggttccggttcggacccgtaggtaactaccgtttcggtacccgttccgtccttactccggtccgtccgtacccgg

SEQ ID NO: 81856 - DNA, 172 bp, Homo sapiens
  misc_feature: GYAE6OF02FRIQK.14.53.E09.1.454.CMB.1.raw
  modified_base (172)..(172): a, c, t, g, unknown or other
  misc_feature (172)..(172): n is a, c, g, or t
tcagcgtctagtaccacgaccggtgctcgatttagagagagtgtgttgggtttggggaagaggaagactgacggtcccccaggagttcaggtgctgggcacagcggccctgggctgcctggtcaaggactacttccgtactagacgctgagcgggctggcaaggcgcatagn

SEQ ID NO: 81857 - DNA, 170 bp, Homo sapiens
  misc_feature: GYAE6OF02IAHO0.14.53.E09.1.454.CMB.1.raw
  modified_base (170)..(170): a, c, t, g, unknown or other
  misc_feature (170)..(170): n is a, c, g, or t
tcagcgtctagtaccacgaccggtgctcgatttagagagagtgtgttgggttggggaagaggaagactgacggtccccaggagttcaggtgctgggcacagcggccctgggctgcctggtcaaggactacttccgtactagacgctgagcgggctggcaaggcgcatagn

SEQ ID NO: 81858 - DNA, 174 bp, Homo sapiens
  misc_feature: GYAE6OF02G49VU.14.53.E09.1.454.CMB.1.raw
  modified_base (173)..(174): a, c, t, g, unknown or other
  misc_feature (173)..(174): n is a, c, g, or t
tcagcgtctagtaccacgaccggtgctcgatttagagagagtgtgttgggtttgggggaagaggaagactgacggtcccccaggagttcaggtgctgggcacagcggccctgggctgcctggtcaaggactacttccgtactagacgctgagcgggctggcaaggcgcatagnn

SEQ ID NO: 81859 - DNA, 543 bp, Homo sapiens
  misc_feature: GYAE6OF02I9GWJ.14.53.E09.1.454.CMB.1.raw
  modified_base (331)..(331): a, c, t, g, unknown or other
  misc_feature (331)..(331): n is a, c, g, or t
  modified_base (347)..(347): a, c, t, g, unknown or other
  misc_feature (347)..(347): n is a, c, g, or t
tcagcgtctagtaccacgaccggtgctcgatttagagagagtgtgttgggtttgggggagtctccctcactgccctgctgggatctcagggcttcattttctgtcctccaccatcatggggtcaaccgccatcctcgccctcctcctggctgttctccaaggagtctgtgccgaggtgcaactggtgcagtctggtccagaggtgaaaaagcccggggagtctctgaagatctcctgtcagggttctggatataattttagtaactgttggaccggctgggtgcgccagaggcccgggaaaggcctggagtggatggggatcgtctttccnggtgactcagaaaccngatacagcccgtcttcgaaggccaggtcatcatatcggccgacaagtccgtacaactaccgcctacctgcagtggagcagcctcgaggcctcggaccaccgccatgtactattgcgcgatcactcacacgattattttgatttcgtgggaccacgggtacaagtcggtcctccgttctccttcacgtccctacccg

SEQ ID NO: 81860 - DNA, 543 bp, Homo sapiens
  misc_feature: GYAE6OF02HLMKM.14.53.E09.1.454.CMB.1.raw
tcagcgtctagtaccacgaccggtgctcgatttagagagagtgtgttgggtttgggggagtctccctcactgccctgctgggatctcagggcttcattttctgtcctccaccatcatggggtcaaccgccatcctcgccctcctcctggctgttctccaaggagtctgtgccgaggtgcaactggtgcagtctggtccagaggtgaaaaagcccggggagtctctgaagatctcctgtcagggttctggatataattttagtaactgttggaccggctgggtgcgccagaggcccgggaaagcctggagtggatggggatcgtctttcctggtgactcagaaaccagatacagcccgtccttcgaaggccaggtcatcatatcggccgacaaggtccgtacaactaccgccctacctgacagtggagcagcctcgaggcctcggacaccgccatcgtactattgcgcatcactcacaccgatattttgattttcgtgggcctacgggactagtggttctccgtcttcttcgagtccctacccg

SEQ ID NO: 81861 - DNA, 555 bp, Homo sapiens
  misc_feature: GYAE6OF02G87SM.14.53.E09.1.454.CMB.1.raw
  modified_base (331)..(331): a, c, t, g, unknown or other
  misc_feature (331)..(331): n is a, c, g, or t
tcagcgtctagtaccacgaccggtgctcgatttagagagagtgtgttgggtttgggggagtctccctcactgccctgctgggatctcagggcttcattttctgtcctccaccatcatggggtcaaccgccatcctcgccctcctcctggctgttctccaaggagtctgtgccgaggtgcaactggtgcagtctggtccagaggtgaaaaagcccggggagtctctgaagatctcctgtcagggttctggatataattttagtaactgttggaccggctgggtgcgccagaggcccgggaaaggcctggagtggatggggatcgtctttccnggtgactcagaaccagatacagcccgtccttcgaaggccaggtcatcatagtcggccgaacagtccgtacaactaccgcctacctgcagtggagcagcctcgacggtcctcggaccaccgccatcgtactagttcgcgcatcactcacaccattattttgatttcgtcggggacctacggggactaacgtggttccttccgttcctcgtttcacgccctacccg

SEQ ID NO: 81862 - DNA, 575 bp, Homo sapiens
  misc_feature: GYAE6OF02J1RTQ.14.53.E09.1.454.CMB.1.raw
tcagcgtctagtaccacgaccggtgctcgatttagagagagtgtgtgggtccaggaggcagaactctgggtgtctcaccatggcctggatccctctacttctcctcctcctcactctctgcacaggctctcaggcctcctatgagctgacacagccaccctcggtgtcagtgtccccaggacagacggccaggatcacctgctctggagatttgtgacaaagcagtatgctttttggaccagcagaagccaggccaggcccctctcttgacttatatataaggacactgagaggccctacgagggactcccgtgacgcgattctcgtggctccagctcgaggacaacgactcaccttgaccatcagtcgacacgtccaggcagaagacgaggctagacctattagttcgactaactcagtctagtacagactaacgttaaatttcttaagtccgggttggttaccgggaccgggtacgggaccgtaaggtccgttacggaacccgtttccgtaacgggttccaccgggtaccctaacgggtcccttaccggccccccgttacggtacctaacccg

SEQ ID NO: 81863 - DNA, 626 bp, Homo sapiens
  misc_feature: GYAE6OF02JTQIQ.14.53.E09.1.454.CMB.1.raw
  modified_base (350)..(350): a, c, t, g, unknown or other
  misc_feature (350)..(350): n is a, c, g, or t
tcagcgtctagtaccacgaccggtgctcgatttagagagagtgtgttgggtttgggggagtctccctcactgccctgctgggatctcagggcttcattttctgtcctccaccatcatggggtcaaccgccatcctcgccctcctcctggctgttctccaaggagtctgtgccgaggtgcaactggtgcagtctggtccagaggtgaaaaacgcccggggagtctctgaagatctcctgtcagggttctggatataatttagaactgttggaccgctgggtgcgccagacggcccgggaaaggcctggagtggagtggggatcgtctttccgtggtcgactcgagaaaccnggatacgacgcccgtcctacgaacggccaggtcactcatacgtcggaccacgaacgtccctacgaaacgtacccgccctaacgtcgacaggtggacgcacgcctcggacggtcctaccggacacccgccagtcgtaacgtacttcgccgtacgtatccactaccaacaccgtaattacgttttcgattttccggtcggggtacctaacggggtactaacggttcgggttcccttaccggttaccttcccgttaccgtaccggtaccccttaacccg

SEQ ID NO: 81864 - DNA, 584 bp, Homo sapiens
  misc_feature: GYAE6OF02H0XP5.14.53.E09.1.454.CMB.1.raw
  modified_base (271)..(271): a, c, t, g, unknown or other
  misc_feature (271)..(271): n is a, c, g, or t
  modified_base (292)..(292): a, c, t, g, unknown or other
  misc_feature (292)..(292): n is a, c, g, or t
tcagcgtctagtaccacgaccggtgctcgatttagagagagtgtgtgggtccgaggaggcagaactctgggtgtctcaccatggcccggatccctctacttcctcctcctcctcactctctgcacaggctctcaggcctcctatgagctgacacagccacctcggtgtcagtcgccccaggacagacggcaggatcactgctctgggagtatttcgtgaacaaaagcagtactgtctttttgaccagcagaacgcaaaaaggcacggcccnctcttcgtatatatataaganactgagagcctcaggactcctcgagcgtattctcgtcgtcgtccagtcacgaggaaccaacaactacctaccttacaaccactacctagtacgcgaacgtccgaacggacgaagaacgacggaacgcgtacgaactaagttaattacgtactaattacaacgtacgagtacgaacgactaaactaaactttacttacggttacggttcggttacggcgggtaacgggacgacgtcgtacgaccgtccgtagtcgacgaccgacggacgtccgaccccgtcgtaccgatcccg

SEQ ID NO: 81865 - DNA, 581 bp, Homo sapiens
  misc_feature: GYAE6OF02HHENT.14.53.E09.1.454.CMB.1.raw
  modified_base (277)..(277): a, c, t, g, unknown or other
  misc_feature (277)..(277): n is a, c, g, or t
  modified_base (334)..(334): a, c, t, g, unknown or other
  misc_feature (334)..(334): n is a, c, g, or t
tcagcgtctagtaccacgaccggtgctcgatttagagagagtgtgttgggtttgggggagtctccctcactgccctgctgggatctcagggcttcattttctgtcctccaccatcatggggtcaaccgccatcctcgccctcctcctggctgttctccaaggagtctgtgccgaggtgcaactggtgcagtctggtccagaggtgaaaaagcccggggagtctctgaagatctcctgtcagggttctggatataattttagtaactgttggaccggntgggtgcgccagaggcccgggaaaggcctggaggtggagtggggatcgtctttccgnggtgactcaagaaaccagatacacgcccgtccttcgaagccaggtcatcatacgtcggccgacaagtccgtacaactacccgacctacctgacagtggagcacgcctcgacggccgtacggaccaccgccatcgtactagttcgcgcgatccactccaacaccgtatttatttttcgacttttcggtacggggccacggggactaagttcggtccttccggtccttcgttaccgacgtccctacccg

SEQ ID NO: 81866 - DNA, 590 bp, Homo sapiens
  misc_feature: GYAE6OF02JCQ6U.14.53.E09.1.454.CMB.1.raw
  modified_base (277)..(277): a, c, t, g, unknown or other
  misc_feature (277)..(277): n is a, c, g, or t
  modified_base (332)..(332): a, c, t, g, unknown or other
  misc_feature (332)..(332): n is a, c, g, or t
  modified_base (336)..(336): a, c, t, g, unknown or other
  misc_feature (336)..(336): n is a, c, g, or t
  modified_base (524)..(524): a, c, t, g, unknown or other
  misc_feature (524)..(524): n is a, c, g, or t
tcagcgtctagtaccacgaccggtgctcgatttagagagagtgtgttgggtttgggggagtctccctcactgccctgctgggatctcagggcttcattttctgtcctccaccatcatggggtcaaacgccatcctcgccctcctcctggctgttctccaaggagtctgtgccgaggtgcaactggtgcagtctggtccagaggtgaaaaagcccggggagtctctgaagatctcctgtcagggttctggatataattttagtaactgttggaccggntgggtgcgccaggacggccgggaaaggcctggagtggagtggggatcgtctttcnggtnactcagaaccagactacgacgcccgtcttcgaacggccaggtcatcatacgtcggccgacaacgtccgtacaacgtacccgccctacgtgcaggtcggagcaagccctggacggccctcggacacccgccaattgtactattcgcgcgtatccactcaaccgaccgtatttacttttgacttttcggnggggtacccaaggggtaactaagttccggttacttcccgttcttaccgtccagtcccctaacccgg

SEQ ID NO: 81867 - DNA, 657 bp, Homo sapiens
  misc_feature: GYAE6OF02GKKNJ.14.53.E09.1.454.CMB.1.raw
  modified_base (347)..(347): a, c, t, g, unknown or other
  misc_feature (347)..(347): n is a, c, g, or t
tcagcgtctagtaccacgaccggtgctcgatttagagagagtgtgttgggtttgggggagtccccctcactgccctgctgggatctcagggcttcattttctgtcctccaccatcatggggtcaaccgccatcctcgccctcctcctggctgttctccaaggagtctgtgccgaggtgcaactggtgcagtctggtccagaggtgaaaaagcccggggatctctgaagatctcctgtcagggttctggatataattttagtaactgttggaccggctgggtgcgccagaggcccgggaaggcctggagtggagtggggatcgtctttccgtggtgactcagaaaccngatacgacgcccgtccttcgaaggccaggtcatcatatcggccgaacaacgtccgtcaacgtacccgcctaacctcgacgaggtcgggacgtcgaacggccgtaccggacggcccgttacgggacccacccggacccacgttcggtaaccttagttcggaccggaccgacttaccgtaccttaccaacctaccgtaacttttagtttttgtacttttccggtcggggaccgtacggggtaacctaagttcggttacccgttcccggttccttaccgttcccgtaccgtccccgttacccgtaaccccggg

SEQ ID NO: 81868 - DNA, 565 bp, Homo sapiens
  misc_feature: GYAE6OF02GNSW8.14.53.E09.1.454.CMB.1.raw
  modified_base (332)..(332): a, c, t, g, unknown or other
  misc_feature (332)..(332): n is a, c, g, or t
  modified_base (554)..(554): a, c, t, g, unknown or other
  misc_feature (554)..(554): n is a, c, g, or t
tcagcgtctagtaccacgaccggtgctcgatttagagagagtgtgttgggtttgggggagtctccctcactgccctgctgggatctcagggcttcattttctgtcctccaccatcatggggtcaaccgccatcctcgccctcctcctggctgttctccaaggagtctgtgccgaggtgcaactggtgcagtctggtccagaggtgaaaaagcccgggggagtctctgaagatctcctgtcagggttctggatataattttagtaactgttggaccggctgggtgcgccagaggcccgggaaaggcctggagtggatggggatcgtctttccnggtgactcaagaaccagatacagcccgtccttcgaaggccaggtcatcatactcggaccgacaagtcccgtacaactacccgcctacctgcgacgtggagcacgcccgtcggacggccctccggaccacccgccatcgtactattcgcgcgactcactcaccacgtattattttgtatttcgtcggggtccacgggtactagtcggtccttcgtcttcttcncgccctacccg

SEQ ID NO: 81869 - DNA, 590 bp, Homo sapiens
  misc_feature: GYAE6OF02IS5LY.14.53.E09.1.454.CMB.1.raw
tcagcgtctagtaccacgaccggtgctcgattttagagagagtgtgttgggtttgggggagtctccctcactgccctgctgggatctcagggcttcattttctgtcctccaccatcatggggtcaaccgccatcctcgccctcctcctggctgttctccaaggagtctgtgccgaggtgcaactggtgcagtctggtccagaggtgaaaaagcccggggagtctctgaagatctcctgtcagggttctggatataattttagtaactgttggaccggctgggtgcgccagaggcccgggaaaggcctggagtggagtggggatcgtctttctggtgactcagaaaccagatacgacgcccgtcttacgaaggccaggtcatctatacgtcggacgacgaacgtccgtacaacgtacccgacctaccgtcgcgaggtcggacgcacgcctcggacgcccgtacggaccaccgaccatcgtactagtcgcgcgactcacctcaaccacctatttatttttgacgttttcggcggggtccaacgggtactaagttcggttaccttcccggtccttccgtcacgtccctacccg

SEQ ID NO: 81870 - DNA, 668 bp, Homo sapiens
  misc_feature: GYAE6OF02I9PNB.14.53.E09.1.454.CMB.1.raw
  modified_base (275)..(275): a, c, t, g, unknown or other
  misc_feature (275)..(275): n is a, c, g, or t
  modified_base (331)..(331): a, c, t, g, unknown or other
  misc_feature (331)..(331): n is a, c, g, or t
tcagcgtctagtaccacgaccggtgctcgatttagagagagtgtgttgggtttgggggagtctccctcactgccctgctgggatctcagggcttcattttctgtcctccaccatcatgggtcaaccgccatcctcgccctcctcctggctgttctccaaggagtctgtgccgaggtgcaactgtgcagtctggtccagaggtgaaaaagcccggggagtctctgaagatctcctgtcagggttctggatataattttagtaactgttggaccggntgggtgcgaccagaggcccgggaaagcctggagtggagtggggatcgtctttccgnggtcgactcaagaaaccagtactacgacgtcccgtcgttacgaacgcaaggtcatcaatacgtcggccgaactaacgtccgtacaacgtacccgcctaaccgtcgaccgagtcggaagcacgccgtacggacggtcccgtacggaccgaacccgcctaactacgtaactaagttcggaccgtcgtaactccgtaaccttccaaacctaaccgtagtttaacgttttcgtaactttttaccgggtccggggtacctaaccggggtaaccttaacggtttaccgggtacccgttacccggtttcttaacccgtttcgaacccgttccccgttaaccccg

SEQ ID NO: 81871 - DNA, 644 bp, Homo sapiens
  misc_feature: GYAE6OF02F41PL.14.53.E09.1.454.CMB.1.raw
tcagcgtctagtaccacgaccggtgctcgatttagagagagtgtgtgggtccaggaggcagaactctgggtgtctcaccatggcccggatccctctacttctcctcctcctcactctctgcacaggctctcaggcctcctatgagctgacacagccaccctcggtgtcagtgtccccaggacagacggccaggatcacctgctctggagtatttgtgacaaagcagtatgtcttttggaccagcagaagccaggccaggcccctctcttgattatatataaggacacgtgagacggccctacgagggtactcccgtggagcgtattccgtcgtggccttccagtcctacggaacggaacaaccgtactcaccttagacctatcagtcgcacgtccgaggaccaaggaacgacggaggtactagtaaccttatttacgttacgtactaagtccgaagtctacggtaccagtaccttaactttaacttttcgttaacgggtttccgggggttagttaccggggaacgggtaacgggtaaaccgacggtacgttaccgggtaacccggttaccgttacgggacccgtaaccggtacccggaacggttcccgtacccggtacccccgtcggtacctacccgttcccgg

SEQ ID NO: 81872 - DNA, 500 bp, Homo sapiens
  misc_feature: GYAE6OF02GD9FN.14.53.E09.1.454.CMB.1.raw
  modified_base (485)..(500): a, c, t, g, unknown or other
  misc_feature (485)..(500): n is a, c, g, or t
tcagcgtctagtaccacgaccggtgctcgatttagagagagtgtgttgggtttgggattcacgttgcagatgtagggctgggtgcgccagaggcccgggaaaggcctggagtggatggggatcgtctttcctggtgactcagaaaccagatacagcccgtccttcgaaggccaggtcatcatatcggccgacaagtccgtcaataccgcctacctgcagtggagcagcctcgaggcctcggacaccgccatgtactattgcgcgatcactcacaccgatattttgatttctggggccacgggacaatggtctccgtctcttcagcctccaccaagggcccatcggtcttcccccgtgccaccctcctccagacgcacctcgtggggcacgacgccggccctggggcctcggccgttcggtccaacgggaccttaccgtttcccgtaactacggccgtcttggacgcgggctgggcaggcgcatgnnnnnnnnnnnnnnnn

SEQ ID NO: 81873 - DNA, 788 bp, Homo sapiens
  misc_feature: GYAE6OF02GDXWZ.14.53.E09.1.454.CMB.1.raw
  modified_base (380)..(380): a, c, t, g, unknown or other
  misc_feature (380)..(380): n is a, c, g, or t
tcagcgtctagtaccacgaccggtgctcgatttagagagagtgtgttgggtttgggggaggtcgtccctcactgccctgctgggatctcagggcttcattttctgtcctccaccatcatgggtcaaccgccatcctcgccctcctcctggctgttctccaaggagtctgtgccgaggtgcaactggtgcagtctggtccgagaggtagaaaaacggcccgggggagtctctagaagatctcctgtcaggggttctggattattaattttagtaactggttaggacccggtgtggggtcgcgaccgaaggacgggacccggggaaaggtcccgtagggaggtagggtaaggtcggggtacgttccggttccgttttccggngggttacggacctacggtaaaggaaaaccctggtaaacgttacgaaccggtccccggttaccgttacggaaacgggtacccgtaaggttacccgtaattaccgaagttaccgttaccgggggaacccaaaccggtaaacggttccccgtaacgtaaacctaccccggttaaccctaaccgtccggtacgtaacggttacgggaacacggaacggtcccggtacgggtaaccgggccctaccggggaaccaacccggtcaacgttacgtactaagttcgaccgtacgtactccgtaacgccaacgaccttaagtttacgttttagtacgttcggttcggggaacctacgggaacttaacggtccggttacgtcccgtttcggtaccttccggtaccgtcctaaccccgg

SEQ ID NO: 81874 - DNA, 561 bp, Homo sapiens
  misc_feature: GYAE6OF02ID1EM.14.53.E09.1.454.CMB.1.raw
  modified_base (494)..(494): a, c, t, g, unknown or other
  misc_feature (494)..(494): n is a, c, g, or t
tcagcgtctagtaccacgaccggtgctcgatttagagagagtgtgttgggtttggggagtctccctcactgccctgctgggatctcagggcttcattttctgtcctccaccatcatggggtcaaccgccatcctcgccctcctcctggctgttctccaaggagtctgtgccgaggtgcaactggtgcagtctggtccagaggtgaaaaagcccggggagtctctgaagatctcctgtcagggttctggatataattttagtaacttgttggacggctgggtgcgccagaggcccgggaaaggcctggagtggatgggggattcgtctttccgtggtgactcaagaaaccagatacgacgccgtccttcgaggccaggtccatcatagtcggaccgactaacgtccgtacaactaccgccctactcgcaaggtggacgcacgccgtcgacggccctcggacaccgccagtcgtactagttgcgcgatcactcacncctattattttgtatttcgtgggtcccaggacctaagtcggtactccgtcttcttcacgcctacccg

SEQ ID NO: 81875 - DNA, 659 bp, Homo sapiens
  misc_feature: GYAE6OF02IKDOR.14.53.E09.1.454.CMB.1.raw
  modified_base (164)..(164): a, c, t, g, unknown or other
  misc_feature (164)..(164): n is a, c, g, or t
  modified_base (293)..(293): a, c, t, g, unknown or other
  misc_feature (293)..(293): n is a, c, g, or t
  modified_base (463)..(463): a, c, t, g, unknown or other
  misc_feature (463)..(463): n is a, c, g, or t
  modified_base (539)..(539): a, c, t, g, unknown or other
  misc_feature (539)..(539): n is a, c, g, or t
tcagcgtctagtaccacgaccggtgctcgatttagagagagtgtgttgggtttgggggagtctccctcactgccctgctgggatctcagggcttcatttttctgtcctccaccatcatggggtcaaccgccatcctcgccctcctcctggctgttctccaaggntctgtgccgaggtgcaactggtgcagtctggtccagaggtagaaaaacggcccggggagtctctagaagatctcctgtcgtagggttctaggtattaattaattttagtaacttggtttacggaccggngttgggtgccgccgtaggacgggcccgggaaaggccgtggaggtggagtgggggattcggttctttccgtgggtcgactcgaacgaacagactacacgtcccgtcttacggagtccgaggtcatcatagtccggaccgaagcgtaccgtacaactacccgtaccgtaccngcaggtggacgtcgacgtacccgtcggacggcccgtacggaccgacccgcctagtacgtactgttcgacgtcgacncgtacctctaccgaccgtaatttacgtttttacgtacttttcgggcgggttacccggacgggtaacttaacggttggtacccgttccgttccgttacgttccgaccgttccctaaccccg

SEQ ID NO: 81876 - DNA, 701 bp, Homo sapiens
  misc_feature: GYAE6OF02JYPJY.14.53.E09.1.454.CMB.1.raw
  modified_base (294)..(294): a, c, t, g, unknown or other
  misc_feature (294)..(294): n is a, c, g, or t
  modified_base (353)..(353): a, c, t, g, unknown or other
  misc_feature (353)..(353): n is a, c, g, or t
  modified_base (373)..(373): a, c, t, g, unknown or other
  misc_feature (373)..(373): n is a, c, g, or t
tcagcgtctagtaccacgaccggtgctcgatttagagagagtgtgttgggtttggggagtctccctcactgccctgctgggatctcagggcttcattttctgtcctccaccatcatggggtcaaccgccatcctcgccctcctcctggctgttctccaaggagtctgtgccgaggtgcaactggtgcagtctggtccaggagtaggaaaaacgcccgggggagtctctgaagtactcttcctgtccgagggttctggatataattttaggtaactggttggaccggtcgtgggngtcgaccgaggacggacccgggtaaagccgtggaggtggagtgggatcgtcgtttaccnggtgactcgaagaaaaccgngactacgcgtaccctcgttcgaaaggccaaggtcatcatacgtcggccaacgtaacgtcccgtacaaacgtaccccggaccttacccgtgaccggtaggtacggtacgacgaaccgcccgttaccggaacggtccccgtacggacccaacccggaccaggttaccggttaacttacgttcgacccggagtacctcaaaccgtccctaaaccgacgttactttaacgttttgtaactttccggtaacgggggaccctacgggtaaacgttaaccggttggtaccccgtttacttaccgttccttaaccgccgttaccccgtaaccccgg

SEQ ID NO: 81877 - DNA, 569 bp, Homo sapiens
  misc_feature: GYAE6OF02HXA8O.14.53.E09.1.454.CMB.1.raw
  modified_base (261)..(261): a, c, t, g, unknown or other
  misc_feature (261)..(261): n is a, c, g, or t
tcagcgtctagtaccacgaccggtgctcgatttagagagagtgtgttgggtttgggggggtccaggaggcagaactctgggtgtctcaccatggcctggatccctctacttctcctcctcctcactctctgcacaggctctcaggcctcctatgagctgacacagcccaccctcggtgtcagtgtccccaggacagacggccaggatccacctgctctggagtattttgttgaacaaagcagtatgtcgtttttggtaccngcagaaagccaggccacggcccctctcttgattaatatataaaggacactgaggacggcccctcgagggctcccgtgagcgtattctcgtggcctccagtctcgacggacaacactcaccttgaccatcagtcgcacgtccgaggtacaaggaagacgacggtacacgtaacttatttattgtactaatcaacgcagtcagctaaacttattcgtttagtcgggttgttcggacgggacgtacgaaggtctacggacccgttcgttacggcgacgacccgaacggcctcccggtccccgttggtaccc

SEQ ID NO: 81878 - DNA, 594 bp, Homo sapiens
  misc_feature: GYAE6OF02HMLDZ.14.53.E09.1.454.CMB.1.raw
  modified_base (468)..(468): a, c, t, g, unknown or other
  misc_feature (468)..(468): n is a, c, g, or t
tcagcgtctagtaccacgaccggtgctcgatttagagagagtgtgttgggtttgggggagtctccctcactgccctgctgggatctcagggcttcattttctgtcctccaccatcatggggtcaaccgccatcctcgccctcctcctggctgttctccaaggagtctgtgccgaggtgcaactggtgcagtctggtccagaggtgaaaaagcccgggggatctctgaagatctcctgtcagggttctggatattaattttagtaacttgttggaccggctggggtgcgccagaggcccgggaaaggcctggagtggagtggggatcgttcttccgtggtgactcaagaacagatacagccctcttgaacggcacggtcatcatatccggccgaacaacggtccgtacaactacccgacctaccctagacaggtacggagacacggccctcgacggccctacggaaccnccgccgtactgtactattacgcgacgtactacactaccacaccgtattattttgtacgttttcgtcggggtaccaacgggtaacaacggtcggtccttcggttcctccgttcgacgtccctacccg

SEQ ID NO: 81879 - DNA, 710 bp, Homo sapiens
  misc_feature: GYAE6OF02I7BOW.14.53.E09.1.454.CMB.1.raw
  modified_base (279)..(279): a, c, t, g, unknown or other
  misc_feature (279)..(279): n is a, c, g, or t
  modified_base (286)..(286): a, c, t, g, unknown or other
  misc_feature (286)..(286): n is a, c, g, or t
  modified_base (352)..(352): a, c, t, g, unknown or other
  misc_feature (352)..(352): n is a, c, g, or t
tcagcgtctagtaccacgaccggtgctcgattttagagagagtgtgttgggtttgggggagtctccctcactgccctgctgggatctcagggcttcattttctgtcctccaccatcatggggtcaaccgccatcctcgccctcctcctggctgttctccaaggagtctgtgccgaggtgcaactggtgcagtctggtccagaggtagaaaaacggccgggagtctctgaagatcctcctgtcagggttctggatataattttagaacttgtggaccggntgggtcncgcgaggacgggacccgggaacgccgtggtggtagggaggtggggtattccggttccgttttccgnggtacgacctacgaacggaaaacctagaataccgacggtcccccgttcgttaccgggaaggacccgtacggtacctaattacgaacttacgtccgggacccgtaaacgtaaccggttcccgttaacaaacgttacccgacccttacctagccgagttgggaactcaacgcccgtaccggacggcccgtacgaacccgtacccgaccgtagttacgttaacttacgttcggcgtacaactccgaactacctaccgaacttagtttaacgtttttgtacgtttcggtaacggggaccctaacgggtactaacgttcggttaccctccggttccttcgtttacgacggtccccttaaccgg

SEQ ID NO: 81880 - DNA, 624 bp, Homo sapiens
  misc_feature: GYAE6OF02F7KD3.14.53.E09.1.454.CMB.1.raw
tcagcgtctagtaccacgaccggtgctcgatttagagagagtgtgttgggtttgggggagtctccctcactgccctgctgggatctcagggcttcattttctgtcctccaccatcatggggtcaaccgccatcctcgccctcctcctggctgttctccaaggagtctgtgccgaggtgcaactggtgcagtctggtccagaggtgaaaaagcccgggggagtctctgaagatctcctgtcagggttctggatattaattttagtaacttgttggaccggctggggtgcgccaggacgggacccgggaaaaggccgtagggagtgggagtggggatcggttctttccgtggtgactacaagaaaccagatacacgcccgttcttacgaaggccaggtcatcatatccggccaacacgtccgtacaactaccgacctacctgcagtggacgcacgccgtacgacggcctcggaccacccgccactcgtacttattcgcgcgtactcgacctaccaaccgaccgtatttacttttttagacttttcggtcggggtaccgaaccgggtaacgtaacgttcggttaccttacccggttccttacgtttccgtaccgtccctaaccccgg

SEQ ID NO: 81881 - DNA, 624 bp, Homo sapiens
  misc_feature: GYAE6OF02FWU0F.14.53.E09.1.454.CMB.1.raw
  modified_base (453)..(453): a, c, t, g, unknown or other
  misc_feature (453)..(453): n is a, c, g, or t
  modified_base (480)..(480): a, c, t, g, unknown or other
  misc_feature (480)..(480): n is a, c, g, or t
tcagcgtctagtaccacgaccggtgctcgatttagagagagtgtgtgggtccaggaggcagaactctgggtgtctcaccatggcccggatccctctacttctcctcctcctcactctctgcacaggctctcaggcctcctatgagctgacacagcccaccctcggtgtcagtcgtccccaggacagacggccaggatcacctgctcgtggagtatttgtgaacaaagcagtatgtcttttaggacagcagaagccaggccacggcccctctctcgattatatataacgactacgtagacgacggccctaggacgggtaactcccgttgacggtcgtacgttccgtcgtggtcctccgagtcctacgacggaacacgactaccaccttcgacctactcgtagtcgcgtacgtaccaggacgaagaacggacggacggtactagtactaagtttnttacgtactaacgcgtaagcgtacgtnaacgtacgtaactttaattacgttacgttacgggttcggttacggacgggtacggtaactacgtccgtacggtacccggtacgttacggtaccgacgttacccgaaggtcccgtccgaccccgttcggtacctaccgttacccg

SEQ ID NO: 81882 - DNA, 695 bp, Homo sapiens
  misc_feature: GYAE6OF02IHR8S.14.53.E09.1.454.CMB.1.raw
  modified_base (131)..(131): a, c, t, g, unknown or other
  misc_feature (131)..(131): n is a, c, g, or t
tcagcgtctagtaccacgaccggtgctcgatttagagagagtgtgtgggtccaggaggcagaactctgggtgtctcaccatggcctggatccctctacttctcctcctcctcactctctgcacaggctctnacggcctcctatgagctgacacagcccaccctcggtgtcagtcgtccccaggacagacggccaggatccacctgctcgtggatatttgtagacaaagcagtatgttctttggtaccagcagaacgccacggccacggccctcgtcttgtaattataataagaaggacactagagaccggtcctacggagggtactcccctaggacgtcgtaactttcgtcgaggtcctcccagtacctcgaagggtaaacccaaacgaccttccgtaacccttcggaaacctactacgacggttacgcctaacggttacccggaacgacggaaacggtaaacggacgggaacggtaaccgttaaccgtacgtttaaatttaacggtttactaaacgtacttcgaaagtcttaacgacctaacgacttaaactttaaacgtttcgttaacggtttaccggttgggttaccggacggggaccggtaccgaacgtcccggtaggtacccggttaacgaccggttagaacccgtacggaacggtccctacccggtccccggttaccggtacctacccg

SEQ ID NO: 81883 - DNA, 586 bp, Homo sapiens
  misc_feature: GYAE6OF02H0J0X.14.53.E09.1.454.CMB.1.raw
  modified_base (278)..(278): a, c, t, g, unknown or other
  misc_feature (278)..(278): n is a, c, g, or t
tcagcgtctagtaccacgaccggtgctcgatttagagagagtgtgttgggtttggggggggtccaggaggcagaactctgggtgtctcaccatggcctggatccctctacttctcctcctcctcactctctgcacaggctctcaggcctcctatgagctgacacagccaccctcggtgtcagtgtccccaggacagacggccaggatcacctgctctggagatttgttgacaaagcagtatgtctttttggaccagcagaagccaggccaggcccctntcttgattatatataaggacactgagacgccctgagggactcccgtagacgcgatttctcgtggcctccgagtctcgaacgggaccaacactaccaccttcgacccatcagtcgcagtccaggacagaaagacgaggctagacttattagttgtacaaatcagactagtcgaagactaacttaattacgttagttcgggttgttacgggacgggtagggaccgtaacggtccgttacggacccggttccgtaacggtccgaccggtacccgaaacggtcccgtacccggtcccccgtaggttaccccg

SEQ ID NO: 81884 - DNA, 791 bp, Homo sapiens
  misc_feature: GYAE6OF02HA8YF.14.53.E09.1.454.CMB.1.raw
tcagcgtctagtaccacgaccggtgctcgatttagagagagtgtgttgggtttgggggagtctccctcactgccctgctgggatctcagggcttcattttctgtcctccaccatcatggggtcaaccgccatcctcgccctcctcctggctgttctccaaggagtctgtgccgaggtgcaactggtgcagtctggtaccaggaggtagaaaaaggcccggggagtctctgaagatctcctgtcgagggttctaggattattaattttagtaacgttggttacgggaccggtgtaggggtcgccgccgtaggacgggacccgggaaaggccgtagggaggtggagtgggggacttcggttcctttccgtggtcgtacctacgaacgaaaccagagtaaccacggtccccgttaccgttacgaacggccgtaaggtcaacgttcaagtacgtaccgggaccgaacgtacgttcccgtacaactacccggacccttaccgtgacgtagggtacggaacgcctacgtcccgtacgggtaccggtcccgttacgggaacccgacccgtacccgtaagttaccgttaaccgtttaggttaccggaccggtaccgtaccttaccccgtaacgttaacccgaacccgtaacccgtttaacgtttttaaccgtttttacggtaaccgtttttacccgggacgggggttaacccctaacgggggtaaccttaacggtttcccgggttaccctttccggttccgtttaccgtttaccccgaccgtaccccttaacccccggg

SEQ ID NO: 81885 - DNA, 1066 bp, Homo sapiens
  misc_feature: GYAE6OF02HQ0YU.14.53.E09.1.454.CMB.1.raw
tcagcgtctagtaccacgaccggtgctcgatttagagagagtgtgttgggtttgggggagtctccctcactgccctgctgggatctcagggcttcattttctgtcctccaccatcatggggtcaaccgccatcctcgccctcctcctggctgttctccaaggagtctgtgccgaggtgcaactggtgcagtctggtccaggaggtgaaaaagcccggggagtctcgtgaagatctcctgtcgagggttctggattattaagttttagaacgttggttcgggaccggtcgtggggttcgccggaccaacgggtacggggtacccccggggaaaaagggtccccgttagggggtaacggtaggggtaacgttaggggggtaacctttccggtaccgttttttccccggtggggttcgtaaccgttacgaaaacggtaaaaacccgtagggtaacttaaccgacggtacccccgtttacccgtttaccgggaaaacggtccccggaaagggttttccaacgtttaccgtaacggtttaaccgttacccgggggaccccgttaaaaacccgggttaaaccggttaccccgggttaaacccgtttaaaaccggttaaacccccggtacccccgtttaaaccccggttaaccgggtacccggttaaacgggtttaccggggggaacgttaacccggaaaccggttccccggttacccgggaaacggggtaccccccggtttaacccgggggaaccctaaaaccccccggtcgttaaacggtttaccggttaaaacccgtttacgttaccggggtaccccgtaccgggttaaacctacccgttaaccgtacccggtaaaacccttaaacccggtttaagtttttaaccggtttttttacgggttaaaccgttttttaccccggggtacccgggggggttaaccccgtaaacccggggggttaaaaccctttaaaccgggtttccggggtttttaaccccccgttttccccggttaccggttttaaccccccggtttcggtaacccgggttaccccccctttaaacccccgggg

SEQ ID NO: 81886 - DNA, 865 bp, Homo sapiens
  misc_feature: GYAE6OF02ITNTJ.14.53.E09.1.454.CMB.1.raw
  modified_base (163)..(163): a, c, t, g, unknown or other
  misc_feature (163)..(163): n is a, c, g, or t
tcagcgtctagtaccacgaccggtgctcgatttagagagagtgtgttgggtttgggggagtctccctcactgccctgctgggatctcagggcttcattttctgtcctccaccatcatggggtcaaccgccatcctcgccctcctcctggctgttctccaaggngtctgtgccgaggtgcaacgtggtgcagtctggtccagaggtagaaaaacggcccgggggagtctctagaagactcctcctgtcgtagggttctggaattaattaattttaaggtaacttggtttacgggaccggtcgttggggtacgtccgccgaaggtacgggggacccccggggaaaaggcccgtggggtaaggtcgggaggtgggggtacttcccggttcgttttccgtggggttacgtaccgtacgaaacgtaaaacccgaggtaactaaccgtacggtcccccgttaccgttacgggaaaccggtccgaacggttctaacgttaccaagttaaccggtccggtaacccggaaaccgttaaccggtccgtaaccctaaacgtaccccgtaccctttaaccgcggtaccgacggttcgggaacgtaccgaaccggtaccgttacccgggaaccgggccccgttaaccgggaccccgtaaccccggaccctaacgtttaccgggtttaaaccttaacggttcggaacccgtccgtaaaccgttacccgtaaccgttaccaaaccctaacccgggttaactttttaacgttttttcgtaaccgtttttccgggtaccgggtacccggaacgggtaccttaaggttccggttaccgttcccccgtttgttaccgttaccgtccgtccccgttaacccccgg

SEQ ID NO: 81887 - DNA, 628 bp, Homo sapiens
  misc_feature: GYAE6OF02GJ74R.14.53.E09.1.454.CMB.1.raw
  modified_base (278)..(278): a, c, t, g, unknown or other
  misc_feature (278)..(278): n is a, c, g, or t
  modified_base (617)..(617): a, c, t, g, unknown or other
  misc_feature (617)..(617): n is a, c, g, or t
tcagcgtctagtaccacgaccggtgctcgatttagagagagtgtgttgggtttgggggagtctccctcactgccctgctgggatctcagggcttcattttctgtcctccaccatcatggggtcaaccgccatcctcgccctcctcctggctgttctccaaggagtctgtgccgaggtgcaactggtgcagtctggtccaggaggtgaaaaaagcccggggagtctctgaagatctcctgtcagggttctggatataattttagtaactgttggaccgngtggtgcgccagacggccgggaaaggcctggagtggagtggggatcgttcgttcgtggtgactcgaagaaaccagatacacgcccgttccttacggaacggcacggtcaacgttacatagtaccggccgaacgtaacgtcccgaccaactaacccgacctacctgcgtagtcggacgtacgacgacctcggacggtccgtaccggaaccgcccgtacctagtcgtaacgttacgttcgacgtcgtacttaccacctaccgaactaccgtatttacttttgtaacgtttcgtcgggaccgaacgggactaagtcgttcgtccgttccttacttcgtaccncccgtaacccg

SEQ ID NO: 81888 - DNA, 708 bp, Homo sapiens
  misc_feature: GYAE6OF02HBJF4.14.53.E09.1.454.CMB.1.raw
  modified_base (523)..(523): a, c, t, g, unknown or other
  misc_feature (523)..(523): n is a, c, g, or t
  modified_base (680)..(680): a, c, t, g, unknown or other
  misc_feature (680)..(680): n is a, c, g, or t
tcagcgtctagtaccacgaccggtgctcgatttagagagagtgtgtttggggtttgggggagtctccctcactgccctgctgggatctcagggcttcattttctgtcctccaccatcatgggtcaaccgccatcctcgccctcctcctaggctgttctccaagggagttctgtagccgaggtgcaactggtagcagtcctggccaagacggtagaaaaacgccggggagtctctagaagatcctctagcacggttctaggtataattaatttagtactggttcggaccgtacgtagggtcgacgccgaaggacggaccccgggaaaacggccgtaggagtggacggtggggactaccggttccttttaccgaggttacgaacgtacgaacgtaaaaccattaacacgtaacgcccgttacgtaacgaacgtccaggtacaagtactaacgtacgcggtaacccacgtaaacgttcccgtaactaaccgtacccgtaccgtaacgtacgacgtacggtaggacncgacgccgtcgacggcccgtaccggaccaccgactacgtcgtactacgttacgcacgtactcctaaccgttacaacgtaaccgttagtttacgtttagaacgttttcggacggggtaccctaaacgggaaccttaaggtcgggttcctaacccgttnttaacccggtatcccgtacccgtaaccc

SEQ ID NO: 81889 - DNA, 734 bp, Homo sapiens
  misc_feature: GYAE6OF02FXXYR.14.53.E09.1.454.CMB.1.raw
tcagcgtctagtaccacgaccggtgctcgatttagagagagtgtgttgggtttgggggagtctccctcactgccctgctgggatctcagggcttcattttctgtcctccaccatcatggggtcaaccgccatcctcgccctcctcctggctgttctccaaggagtctgtgccgaggtgcaactggtgcagtctggtccagaggtagaaaaacgcccgggggatctctgaagatctcctgtcaggttctggatataattttgtaactgttggaccggcgtgggtcgcgtccgaggtaccgggacccgggaaaaggtccgtagggagttgggagttcgggggaacttcggttaccttttccgtggttcgactacgaacgaaaccgagtaacttacacggtccccttacgttacggaacggcctaggtcagtcaatacgtcggaccaacgtaacgtccgaactaacgtaccgtcctaacctgacctaaggtgggaacacgaacgtcccgtacggcggttacccacgggtaaccacccgactacgtcgttacttacgttcggactaccgtagtacccaacgtccgaacccgtaaccgttaacgttttactttttacggaacgtttttacccgggaacgggggtaccccgtaacggggtaaaccttacggttacggtttaccccgttaccggtttacccgtttaccgttacccggaccggttcccccgttaaaccccgg

SEQ ID NO: 81890 - DNA, 799 bp, Homo sapiens
  misc_feature: GYAE6OF02F1Z49.14.53.E09.1.454.CMB.1.raw
tcagcgtctagtaccacgaccggtgctcgatttagagagagtgtgttgggtttggggggggtccaggaggcagaactctgggtgtctcaccatggcctggatccctctacttctcctcctcctcactctctgcacaggctctcaggccctctatgagctgacacggccacccgtcggtgcagtcgtccccaggacagacggccaggactcacctgctcgtgggatagtttgttacgaacaaacgcgtaagtacttggttccgttttttacggaccagtacaacggaaacgccgtacggaccgaccggtccccgttctcgttcgtatttagtaattaagtaagtaccgtacgtaggaacggtacgggtcccctaacggtacgggtaccttcccgtaaggtaccggtaccgttacgtttcctacggtcggtcccttaccggtaccgtccgtacggaaccgggtaaaccctaaccgtaccgttaccctaacccgttacgtaaccccgtaattcccggtaacggtacgtaccgtaaccggtacccggaaggttacccgaaaagggaacccggttaccggaacgttcccggtagtaaaaccctttagttttaaccgtacgttaacgtaagttaccggaactccgaaaggttaccaaccggtacttaaacgtttaacgtttccgttacggggtttacggtcgggttacgggtacgggacccgggtattaccggtcgttaaccgtacccttcggtaaccggcgtaccgtacggaccgtccgtaccccggaccgtccgtacgtaccc

SEQ ID NO: 81891 - DNA, 705 bp, Homo sapiens
  misc_feature: GYAE6OF02I25DJ.14.53.E09.1.454.CMB.1.raw
  modified_base (622)..(622): a, c, t, g, unknown or other
  misc_feature (622)..(622): n is a, c, g, or t
tcagcgtctagtaccacgaccggtgctcgatttagagagagtgtgttgggtttgggggagtctccctcactgccctgctgggatctcagggcttcattttctgtcctccaccatcatggggtcaaccgccatcctcgccctcctcctggctgttctcccaaggagtctgtgccgaggtgcaactggtgcagtctggtccagacggtagaaaaggcccggggagtctctgaagatcctcctgtcgagggttctggataattaattttagtaacttggttcggaccggtacgtggggtcgcgaccgaggacgggtacccgggaaaggtccctagggaggtggaggttagggggtagttccggttccgtttccgtggtacgaacctcgaacgaaaccgagtactaccgacgtccccgttcgtacggaacggccgtaagggtcagttcaatacgtccggaccgacgaacgtccgtactaactacccgcctaccgtgacgtaggtggacgtacgacgtcccgccggtacggcccgtcggaacctaccgccgacgttcgaacttcgtaggaccgacgactaccacgtaccaaccgtaccgtatttagttttacggacttttaccgggnggggttacccaacggggtaacttcggttaccggttcccgttaccggtttccttcccgtttacggtacccgtcccgtaaccccg

SEQ ID NO: 81892 - DNA, 779 bp, Homo sapiens
  misc_feature: GYAE6OF02G7XZT.14.53.E09.1.454.CMB.1.raw
  modified_base (433)..(433): a, c, t, g, unknown or other
  misc_feature (433)..(433): n is a, c, g, or t
  modified_base (525)..(525): a, c, t, g, unknown or other
  misc_feature (525)..(525): n is a, c, g, or t
tcagcgtctagtaccacgaccggtgctcgatttagagagagtgtgttgggtttgggggggtccaggaggcagaactctgggtgtctcaccatggcctggatccctctacttctcctcctcctcactctctgcacaggctctcaggcctcctatgagctgacacacgcccaccgtcggtgtcgaggtcgtaccccgaggtacgaggtacggcccaaggactccgaccgtgtccgtcgtaggtagttacgttttggttacgaacgaaacggctaagttagtacgttcgtttttacggaaccgtagcgtacggaacgtccgaacggtccaccgggtccccttacttcgttcgtaactttaataacgtaacggtaaacggcctaggtacggtaaccggtaccggtaccccgtacgggtacgggtaccttacccgggngtaaccggtaccgtacgtttaccgtcgttcggtaccgttaccgacgtaccggttagggaacccggaactaacgtacccgtaccgtttaaccnccgggtaactaccgtaccggtagtacgtacgtaccggtaccggacgtaacgaacggtaacggacgggtacgtacgtacgttacggttacgttacgttacggtaattaccgtagaccggtacgtaaccgtacgtacaccgtttaacgttacttaccgttacggtcggttacgtacggtacggtacggaacctaggtccgtacgtccgtacggttacgtcgacgtccgaacggtccgtaccggtccctggtacccg

SEQ ID NO: 81893 - DNA, 733 bp, Homo sapiens
  misc_feature: GYAE6OF02I2Z8Y.14.53.E09.1.454.CMB.1.raw
  modified_base (536)..(536): a, c, t, g, unknown or other
  misc_feature (536)..(536): n is a, c, g, or t
  modified_base (617)..(617): a, c, t, g, unknown or other
  misc_feature (617)..(617): n is a, c, g, or t
tcagcgtctagtaccacgaccggtgctcgatttagagagagtgtgttgggtttgggggagtctccctcactgccctgctgggatctcagggcttcatttctgtcctccacatcatgggtcaaccgccatcctcgcccctacctcctggactgttctcaaggtagtctagtgccgaggtgcaacgtggtgctagtctggtcagagtagaaaacgcccgggagtctagtgaagtactctccgtgtacgtagggttcctagggtaatacgttaagttttacgtaaacttgggtttacgggaaccggtcgttaggggtcgaccggtcctaaggtaccgggtcccgggtaaaaggtcccgtggtaaggtcggtaaggtcgggtaactccgggttacttttccggacgggtaccgtacttacaaacgaacctagaataccgaacgtccccggttactagaggtcccaggtccaagtcgtaatacgacggtaccgaacgtaaacggtcctacgaactaaccccggtacctacgtgacgtacgngggtacaccgtcgaccgttaccgacggtcctaccggactacccgaccctagtaccgttacaagttccgcgcgtaaccgtancccgtacgactaacccgtatttctttacgatttccggtacgggtacccgtaaggaacttaaccggtggttacccgtcgttaccccgttaggttacccacggtccccttaaacccgg

SEQ ID NO: 81894 - DNA, 645 bp, Homo sapiens
  misc_feature: GYAE6OF02FO498.14.53.E09.1.454.CMB.1.raw
  modified_base (274)..(274): a, c, t, g, unknown or other
  misc_feature (274)..(274): n is a, c, g, or t
  modified_base (331)..(331): a, c, t, g, unknown or other
  misc_feature (331)..(331): n is a, c, g, or t
tcagcgtctagtaccacgaccggtgctcgatttagagagagtgtgttgggtttgggggagtctccctcactgccctgctgggatctcagggcttcattttctgtcctccaccatcatggggtcaaccgccatcctcgccctcctcctggctgttctccaaggagtctgtgccgaggtgcaactggtgcagtctggtccagaggtagaaaaaggcccggggatctctggaagatctcctgtcagggttctggatatatttagtactgtggaccgntgggtgcgccaggacggccgggaaggcctggagtggagtggggatcgttctttccgnggtcgactcgaacgaaacctagaactacgacgccccgttccttacggaacggcctaaggtcactcaattagaccggaccctaacgaacgtccctacgaaacttacccgacctaccgtgacgtaggaggacgcacgtcccgtcggtacggaccgtccggaccacccgaccatacggtacttacgtacgccgagtactaccgtactaccgacgaccgtatttagttttttactacggtttcggtacgggtccggtaacgggtaactaacgtttcggtacgttcccgttaccgttccgttacaccgtccctacccgg

SEQ ID NO: 81895 - DNA, 768 bp, Homo sapiens
  misc_feature: GYAE6OF02GJ72L.14.53.E09.1.454.CMB.1.raw
tcagcgtctagtaccacgaccggtgctcgatttagagagagtgtgttgggtttgggggagtctccctcactgccctgctgggatctcagggcttcatttttctgtcctccaccatcatggggtcaaccgccatcctcgccctctcctggctgttctccaaggagtctgtgccgaggtgcaactggtgcagtctggtccagaggtagaaaaaggcccggggatctctgaagatcctcctgtcgaggttctggtatattaattttagtaacgttggttcggaccggtgtgggtgcgtccgagggaccgggacccgggaaacggtccgtaggaggtggaggtgggggtatcggttctttccggtggtacgtactcgaagaaaccgagtaactaaccgaccggtaccccgttaccgttacgggaacggtcccgtaaggtacctaattacgaacgttacgtccgggaacccgaacggttaaccggtaccccgtaactaaacccgtaccccgtaaccctacccgtacgacgtaacggtcggacgacgacgtcccgtacggacggtacccgtaccggacccgtaccgtcccgaagttccgttaacttacgttcgaccgtacgtacgttacccaccgttccgaaccgtaaccgtattttacgttttacgttaccggtttccggtacggggtacccgtaacggggaaccttaacggttccggttacccgttaccggttaccttaccgtttacccgtacccggtaccctaacccccgg

SEQ ID NO: 81896 - DNA, 817 bp, Homo sapiens
  misc_feature: GYAE6OF02G2X77.14.53.E09.1.454.CMB.1.raw
tcagcgtctagtaccacgaccggtgctcgatttagagagagtgtgttgggtttgggggagtctccctcactgccctgctgggatctcagggcttcattttctgtcctccaccatcatggggtcaaccgccatcctcgccctcctcctggctgttctccaaggagtctgtgccgaggtgcaactggtgcagtctggtccaggaggtagaaaaggcccggggatctctagagatctccgtgtctagggttctggattattaattttagtaactggttacggaccggtcgtggggtcgcgccgtagggacgggcccggggaaacggccgtagggacggtgggaggtggggacttcgttccgtttccgtggtgactcaacgaaccagactaacgcgtcccgttccgttacggaacggtccgtaggtacaacttcgaacttacgtccgggtacccgaaaccgtaaccgggttcccgtaacgtaaaccgtaccccgtacccgtttaaccccgcggacggtaaacgggttcgggaacggtacccgaccgggtcccgttacccgggacgggttacccggtacccgggtaacccgacccgggacctacgtttaccggttacgttaggtttccgggaccgtaccgtaccgtcctaaccgttacccgaaccgtaacccgtttaattttacgtttttacggtttacgttttaccgggggtcccgggtaacccgggttaaccggggtaacttaacgggtttcccggtttacccgttccccgggttatttaccccggtttacccgtccggttcccccgttaaacccccggg

SEQ ID NO: 81897 - DNA, 748 bp, Homo sapiens
  misc_feature: GYAE6OF02IJJ60.14.53.E09.1.454.CMB.1.raw
  modified_base (156)..(156): a, c, t, g, unknown or other
  misc_feature (156)..(156): n is a, c, g, or t
  modified_base (735)..(735): a, c, t, g, unknown or other
  misc_feature (735)..(735): n is a, c, g, or t
tcagcgtctagtaccacgaccggtgctcgatttagagagagtgtgttgggtttgggggagtctccctcactgccctgctgggatctcagggcttcattttctgtcctccaccatcatggggtcaaccgccatcctcgccctcctcctggctgttcnccaaggagtctgtgcgaggtgcaacgtggtgcagtctcggtaccaggtaggtaggaaaaacggtcccgggggattccgtctaggaaagacttccgtcctggtacgagggtttctaggattaagttaagttttaacgtaacgttggttacgggtaccggtcggttaggtcggacggccgaaggacgggaaccccgggaaacggtccgtagggtaggtacggtaggtcgggttacgtttccgttccgtttccggtgtacgtacgtacgaaacgaaaccgtaggacctacggaccgtcccgttccgttacggaaacccggtcgaacggtcctaactacgtaactacgtcggacccgaacgtaaccgtccgtacgtacgtacccgtccgttaaccgcgtacgacgtggacgtcgaccgtccgtacggaccgtaccgaccgaccgaccgtcctataccggttacaggttacgcggtaacgaccgtaccaaccgttcccaagtaaccttagttttactttcgtacgttttccggcgggtacccggaacggtaaccgtcgtccgttcgttccttaccgttcgtacncccgtctacccgg

SEQ ID NO: 81898 - DNA, 752 bp, Homo sapiens
  misc_feature: GYAE6OF02H6KEQ.14.53.E09.1.454.CMB.1.raw
  modified_base (538)..(538): a, c, t, g, unknown or other
  misc_feature (538)..(538): n is a, c, g, or t
  modified_base (545)..(545): a, c, t, g, unknown or other
  misc_feature (545)..(545): n is a, c, g, or t
  modified_base (555)..(555): a, c, t, g, unknown or other
  misc_feature (555)..(555): n is a, c, g, or t
  modified_base (644)..(644): a, c, t, g, unknown or other
  misc_feature (644)..(644): n is a, c, g, or t
tcagcgtctagtaccacgaccggtgctcgatttagagagagtgtgttgggtttgggggagtctccctcactgccctgctgggatctcagggcttcattttctgtcctccaccatcatggggtcaaccgccatcctcgccctcctcctggctgttctccaaggagtctgtgccggaggtcgaccaacgtggtgcgaggtcgtcggtaccaggtaggtaaggaaaaacggcccgggggagtctcgtagaagtactccgtctcgtacggtagggttctaggtaattagtttaagttttaagttaacgttggttaccggaccggtcggttggggtcgccgaccggaacgggtacggggaacccgggaaacggtcggtgggaaggtcggtaggtacggggtacttcgttccgtttccgtggtacgaacctcgaaacgaaaccgagtactacgcgttccgtaccgttacggacgcgtaggtactactcgtaacgtcgtaccggccgtaaacgtcggtacgtacctaacgtacccgcctaaccgngtaacgnggtacggacnccgaccgtcgacggccggtccgtaccggaaccgccctacgtagtcggttacttacggtacgcccgacgtactaccgtactacccgtaanaccgtttatttacgtttcgttacggtttccgggtcgggacccggtttaagaccgttcgttaccggttcttccggttaccttccgtaacttacccgccgtttaacccgg

SEQ ID NO: 81899 - DNA, 133 bp, Homo sapiens
  misc_feature: GYAE6OF02IT692.14.53.E09.1.454.CMB.1.raw
  modified_base (119)..(133): a, c, t, g, unknown or other
  misc_feature (119)..(133): n is a, c, g, or t
tcagcgtctagtaccacgaccggtgctcgattttagagagagtgtgttgggtttgggggagtctccctcactgccctgctgggatctcagggcttcattttctgtcctccacatcagtnnnnnnnnnnnnnnn

SEQ ID NO: 81900 - DNA, 251 bp, Homo sapiens
  misc_feature: GYAE6OF01B5U14.39.37.D04.1.454.CMB.1.raw
  modified_base (250)..(251): a, c, t, g, unknown or other
  misc_feature (250)..(251): n is a, c, g, or t
tcagtcgcactagtcacgaccggtgctcgatttagtagcatactgttgggtttgggacagacttcactctcaccatcagcagactggagcctgaagattttgcagtctatcactgtcagcagtatggtgactcaaagacgttcggccaagggaccaaggtggaaatcaaacgaactgtggctgcaccatctgtcttcatcttcccgccatctgaactagtgcgactgagcgggctggcaaggcgcatagnn

SEQ ID NO: 81901 - DNA, 617 bp, Homo sapiens
  misc_feature: GYAE6OF01ELL7P.39.37.D04.1.454.CMB.1.raw
  modified_base (206)..(206): a, c, t, g, unknown or other
  misc_feature (206)..(206): n is a, c, g, or t
  modified_base (245)..(245): a, c, t, g, unknown or other
  misc_feature (245)..(245): n is a, c, g, or t
tcagtcgcactagtcacgaccggtgctcgatttagtagcatactgttgggtttggggagagaagagctgctcagttaggacccagagggaaccatggaaaccccagcgcagcttctcttcctcctgctactctggctcccagataccaccggagaaattttgttgacgcagtctccaggcaccctgtgtttgtctccaggggaaanagccaccctctcctgcagggccagtcagtttgtcccaanaacttctagcctggtaccagcagaacctggccaggctcccaggctcctcatctatgatacatccaccagggccactggcatcccagacaggttcagtggtgttgggtctggggacagtacttcactctcaccatcagcagactggacgcctagaagtattttgacgtagttgttatttagttgtctagtactaaattagtgggtacgcccgttaccccccgaggtaccggtttaccgggacccgtaaacggggaccctaagtacgggtaacggtaaacttaccgaaaacggtaaccgttacggtacggaccgttcggacctaacccgtaacgttccgttacgttacctttacctacgttcccgttacccccg

SEQ ID NO: 81902 - DNA, 250 bp, Homo sapiens
  misc_feature: GYAE6OF01AQCGI.39.37.D04.1.454.CMB.1.raw
  modified_base (249)..(250): a, c, t, g, unknown or other
  misc_feature (249)..(250): n is a, c, g, or t
tcagtcgcactagtcacgaccggtgctcgatttagtagcatactgttgggtctgggacagacttcactctcaccatcagcagactggagcctgaagattttgcagtctatcactgtcagcagtatggtgactcaaagacgttcggccaagggaccaaggtggaaatcaaacgaactgtggctgcaccatctgtcttcatcttcccgcatctgaactagtgcgactgagcgggctggcaaggcgcatagnn

SEQ ID NO: 81903 - DNA, 540 bp, Homo sapiens
  misc_feature: GYAE6OF01EUVT9.39.37.D04.1.454.CMB.1.raw
  modified_base (489)..(489): a, c, t, g, unknown or other
  misc_feature (489)..(489): n is a, c, g, or t
tcagtcgcactagtcacgaccggtgctcgatttagtagcatactgttgggtttgaggtctcagagaggagccttagccctggactccaaggcctttccacttggtgatcagcactgagcacagaggactcaccatggaattggggctgagctgggttttccttgttggtattttagaaggtgtccagtgtgcggtgcagttggtggagtctgggggaggcttggtccagccgggggggtccctgagactctcctgtgcagcctctggattcccctttacgagttattggctgagctgggtccgccagctccgaggaaggggttggagtgggtggccaacataaagcaagatggaagtcggaaagagtatctggactctgtgaggggccggttcaccatctccagagacaacgccaagaaactccgtgcatctgcaaatgaaacagtctgagagcgaggacacggctgttatactgcgcgagagaggagnggggtcggtttcgacgtacgtcggggcgaagggaacccgtggtcgtacccg

SEQ ID NO: 81904 - DNA, 293 bp, Homo sapiens
  misc_feature: GYAE6OF01BKZ02.39.37.D04.1.454.CMB.1.raw
  modified_base (257)..(293): a, c, t, g, unknown or other
  misc_feature (257)..(293): n is a, c, g, or t
tcagtcgcactagtcacgaccggtgctcgatttagtagcatactgttgggtttgggacaaggacttcactctcaccatcagcagactggagcctgaagattttgcgagtctatcactgtcaggcagtatggtgactcaaagacgttcggcaagggaccaaggtggaaatcaaacgaactgtggctgccacatctgtcttcatcttccgccatctgaactgtgcgactgagcgggctggcgaaggccgacgataaggnnnnnnnnnnnnnnnnnnnnnnnnnnnnnnnnnnnnn

SEQ ID NO: 81905 - DNA, 603 bp, Homo sapiens
  misc_feature: GYAE6OF01DY087.39.37.D04.1.454.CMB.1.raw
  modified_base (345)..(345): a, c, t, g, unknown or other
  misc_feature (345)..(345): n is a, c, g, or t
  modified_base (421)..(421): a, c, t, g, unknown or other
  misc_feature (421)..(421): n is a, c, g, or t
  modified_base (595)..(595): a, c, t, g, unknown or other
  misc_feature (595)..(595): n is a, c, g, or t
  modified_base (597)..(597): a, c, t, g, unknown or other
  misc_feature (597)..(597): n is a, c, g, or t
tcagtcgcactagtcacgaccggtgctcgatttagtagcatactgttgggtttgggggaggcttggtccagccggggggtccctgagactctcctgtgcagcctctggattcccctttacgagttattggctgagctggtccgccaggctccagggaagggttggagtgggtgccaacataaagcaaagatggaagtcggaaagagtatctggactctgtgaggggccgttcaccatctccagagacaacgccaagactccgtgcatctgacaaatgaacagtctgagagcgaggacacggctgtttatactgcgcgagagaaggactgggcgtttcgactacgngggccagggaccctggtcaccgtctcctcacgcctccaccgaacgggccccagttccggtccttcccccgtggccnccctgcctccgaggacgcacctccgagacgcacgacgccggcccgtgggcctcggcccgtaggtaccgaaacgggtaccttaaccttccctaacgttacggtcgaccggtaccgtggaacgggtcccggggtacgttagggaccgaaacgggccgtacgtaacgttaacgcgancngcgacg

SEQ ID NO: 81906 - DNA, 789 bp, Homo sapiens
  misc_feature: GYAE6OF01B4HFM.39.37.D04.1.454.CMB.1.raw
  modified_base (206)..(206): a, c, t, g, unknown or other
  misc_feature (206)..(206): n is a, c, g, or t
tcagtcgcactagtcacgaccggtgctcgatttagtagcatactgttgggtttggggagagaagagctgctcagttaggacccagagggaaccatggaaacccagcgcagcttctcttcctcctgctactctggctcccagataccaccggagtaaattttgtgacgcagtctccaggcaccctgtgtttgtctccgaggggaaangccaccctctcctgcagggccagtcagtttcgtcccaataacttcttagcctggtaccagcagaaacctggccaggctcccaggcctcctcatctatgatacactccaaccgaggccacgtggcactccccagacgtaggttcaggttcggtggttcgggtcgtaggggactaaggtaccttcaacttcgtaccaccgtaattccgagaccgtaaggacccgttaggggacgtccgtaaggtaaacgttagtttttacggacgttaaaggttccttaacttaccgtaacgtttggttaccaacggtacctaagggttaacgttggggttaacgtaaacccgtttaaccggaaaaacgggttacccgggtttaacccgggaaaccccgtaaaaggggggtaaaccccgtaaaagggggttaacgggtaaaaaaccgtaaacccggtaaaaaaccggggtaacctttacgggggtaaccggggaacccgttacggaacccccgtaaacccgttaaacggttttccccgttaacgggttttaccccttaaaccgtttaccgtttaacccccgtttaaccccccggg

SEQ ID NO: 81907 - DNA, 680 bp, Homo sapiens
  misc_feature: GYAE6OF01AQTWZ.39.37.D04.1.454.CMB.1.raw
  modified_base (311)..(311): a, c, t, g, unknown or other
  misc_feature (311)..(311): n is a, c, g, or t
  modified_base (354)..(354): a, c, t, g, unknown or other
  misc_feature (354)..(354): n is a, c, g, or t
  modified_base (471)..(471): a, c, t, g, unknown or other
  misc_feature (471)..(471): n is a, c, g, or t
tcagtcgcactagtcacgaccggtgctcgatttagtagcatactgttgggtttgaggtctcagagaggagccttagccctggactccaaggcctttccacttggtgatcagcactgagcacagaggactcaccatggaattggggctgagctgggttttccttgttggtattttagaaggtgtccagtgtgcggtgcagttggtggagtcgtgggggaggcttgggtccaggccgggggggtccctgagactctcctggtgcagcctcgtggactttcccctttagagtttattggctgagcgtgggtccnccgaggcctccgaggggaggggttggaggtgggtcggaccaanagtaaagcgaagagtagggaagtacggaaagagtatcgtaggactcgtggtaggacggggtccgttacacctatcctaccgaaggacgaaccaaccggaccaaacgacccgttccgngaccaattccgtagaaccaaagtcgaacagttccagacggaccgaccggaaggacctacggtcttagttttaacgtacgtgggccgtaggaaaggaagggtaacgggtccgttgggggggtacccgttttaccggaacggttacccggggtacggggggaaccccgtaacggggtaaccccggttgggtaaccccgtccccggttcccc

SEQ ID NO: 81908 - DNA, 664 bp, Homo sapiens
  misc_feature: GYAE6OF01B3VJD.39.37.D04.1.454.CMB.1.raw
  modified_base (206)..(206): a, c, t, g, unknown or other
  misc_feature (206)..(206): n is a, c, g, or t
tcagtcgcactagtcacgaccggtgctcgatttagtagcatactgttgggtttggggagagaagagctgctcagttaggacccagagggaaccatggaaaccccagcgcagcttctcttcctcctgctactctggctccagataccaccggagtaaattttgtgacgcagtctccaggcaccctgtgtttgtctccgaggggaaancgccaccctctcctgcagggccagtcagtttcgtaccaactaacttcttagcctaggtaccagcaagaacctggccaggcctccgaggcctcctcatctatgaactacactcccaaccgacggccacgtcggaccactccccgaagacctaggttcagggttggttcggttcgggtcgtaggggacctaggtacctttccgacttctaccacctatccgaagccgaagtacgtacggacgtccgtagtaacgttacgtttagacgtagttactactactacgtcgtacgagtacgtagttagtcggtacgaaccgtacgtaaacggtaccggttaccgggaaccgtaaacgggaccgtaaacgggtaacggaaactaaccggaaaacggtacgtcggtacggaccgtacgacctaacgtacgttacgttacgttacctacctacgttcccgttacccg

SEQ ID NO: 81909 - DNA, 584 bp, Homo sapiens
  misc_feature: GYAE6OF01EYL6P.39.37.D04.1.454.CMB.1.raw
  modified_base (346)..(346): a, c, t, g, unknown or other
  misc_feature (346)..(346): n is a, c, g, or t
  modified_base (465)..(465): a, c, t, g, unknown or other
  misc_feature (465)..(465): n is a, c, g, or t
  modified_base (575)..(575): a, c, t, g, unknown or other
  misc_feature (575)..(575): n is a, c, g, or t
tcagtcgcactagtcacgaccggtgctcgatttagtagcatactgttgggtttgaggtctcagagaggagccttagccctggactccaaggcctttccacttggtgatcagcactgagcacagaggactcaccatggaattggggctgagctgggttttccttgttggtattttagaaggtgtccagtgtgcggtgcagttggtggagtcgtgggggaggcttgggtccaggccgggggggtccctgagactctcctgtgcagcctctggacttccccttacgagttattggctgagctgggtccgccaggctccgaggggaaggggttggaggtgggtggccaanataaagcaagatggaagtacggaaagagtatctgggactcgtggtggacggggccggttcaccatcctacagacgacaaccgccaaagaacctccgtgcatctgacaaatgaactgtcngagagccgaggacacggcttagtttatacgtggcgacgaggaaggaagggtcgtgggggtccgtttacgacgttacggcggggacccaaggggaaccccctgggtacccncccggttcc

SEQ ID NO: 81910 - DNA, 647 bp, Homo sapiens
  misc_feature: GYAE6OF01BKZZE.39.37.D04.1.454.CMB.1.raw
  modified_base (474)..(474): a, c, t, g, unknown or other
  misc_feature (474)..(474): n is a, c, g, or t
tcagtcgcactagtcacgaccggtgctcgatttagtagcatactgttgggtttgaggtctcagagaggagccttagccctggactccaaggcctttccacttggtgatcagcactgagcacagaggactcaccatggaattggggctgagctgggttttccttgttggtattttagaaggtgtccagtgtgcggtgcagttggtggagtcgtgggggaggcttggtccgaggccgggggggtccctgagactctcctgtgcagcctctggtacttcccctttagagtttattggctgagcgtgggtccgccaggctccgaggggaaggggttggaggtggggtcggacccaaacgaagtaaaaggcaaaggagtagggaaaggtacggaaaagagttaagtcgtagggacttcgtggtgggacggggtcccgttcaccatcctaccagacgacaaccgccaaagacctccggancatctagacaaagtgaactgtcagagacgaccggaggaccacgggtctttaggtttactacgtggaccggacgtaaggaaggtaacgggtcgttgggggtaccggttttacggaccgttacgggtcgggggaccctaacggggtaaccccttggggtaccccgtacccgttcc

SEQ ID NO: 81911 - DNA, 603 bp, Homo sapiens
  misc_feature: GYAE6OF01AR2TW.39.37.D04.1.454.CMB.1.raw
  modified_base (598)..(598): a, c, t, g, unknown or other
  misc_feature (598)..(598): n is a, c, g, or t
  modified_base (603)..(603): a, c, t, g, unknown or other
  misc_feature (603)..(603): n is a, c, g, or t
tcagtcgcactagtcacgaccggtgctcgatttagtagcatactgttgggtttggggaggcttggtccagccggggggtccctgagactctcctgtgcagcctctggattcccctttacgagttattggctgagctgggtccgccaggctccagggaagggttgagtgggtggccaacataaagcaaagatggaagtcggaaagagtatctggactctgtgaggggccgttcaccatctccagagacaacgccaagaactccgtgcatctgcaaatgaacagtctgagagccgaggacacggctgtttatactgcgcgagagaaggcgtgggcggtttcgactacgtggggccagggaaccctggtcaccgtctcctcagcctccaccaacgggcccagtccgtccttccccctcggccgccctgccgtccgacggacgccacccgtccgacgacgccaccgacggcccggcccgtcgggcctcggcccgtagggtaccaaacgggtacccttaaccgttccctaacgttacgtcgaccgtacgtacggacggccggggccttcggggaccgtaaacggggccgacgaacgtaagcanctgcn

SEQ ID NO: 81912 - DNA, 532 bp, Homo sapiens
  misc_feature: GYAE6OF01COQ5A.39.37.D04.1.454.CMB.1.raw
  modified_base (206)..(206): a, c, t, g, unknown or other
  misc_feature (206)..(206): n is a, c, g, or t
  modified_base (245)..(245): a, c, t, g, unknown or other
  misc_feature (245)..(245): n is a, c, g, or t
  modified_base (378)..(378): a, c, t, g, unknown or other
  misc_feature (378)..(378): n is a, c, g, or t
tcagtcgcactagtcacgaccggtgctcgatttagtagcatactgttgggtttggggagagaagagctgctcagttaggacccagagggaaccatggaaaccccagcgcagcttctcttcctcctgctactctggctcccagataccaccggagaaattttgttgacgcagtctccaggcaccctgtgtttgtctccaggggaaanagccaccctctcctgcagggccagtcagtttgtcccaanacttcttagcctggtaccagcagaacctggccaggctccaggctcctcatctatgatacatccaccagggcccactggcactcccagacaggttcaggttggtggttgggtctggggacagtacttcacttcncaccatcagcagactggagcctagaagtattttgctagtctatctactcgtcagcagtagtggtgactacgaaagtcgttacgacgaagggaccgaaggtaggaatacgaaacgacgtgtgcgtcgcgacactctgtacttcactcgttccccg

SEQ ID NO: 81913 - DNA, 619 bp, Homo sapiens
  misc_feature: GYAE6OF01CUK06.39.37.D04.1.454.CMB.1.raw
  modified_base (260)..(260): a, c, t, g, unknown or other
  misc_feature (260)..(260): n is a, c, g, or t
  modified_base (429)..(429): a, c, t, g, unknown or other
  misc_feature (429)..(429): n is a, c, g, or t
  modified_base (456)..(456): a, c, t, g, unknown or other
  misc_feature (456)..(456): n is a, c, g, or t
  modified_base (613)..(615): a, c, t, g, unknown or other
  misc_feature (613)..(615): n is a, c, g, or t
  modified_base (619)..(619): a, c, t, g, unknown or other
  misc_feature (619)..(619): n is a, c, g, or t
tcagtcgcactagtcacgaccggtgctcgatttagtagcatactgttgggtttggggggaagaggaagactgacggtccctgagactctcctgtgcagcctctggattcccctttacgagttattggctgagctgggtccgccaggctccagggaaggggttggagtgggtggccaacataaagcaagatggaagtcggaaagagtatctggactctgtgaggggccgttcaccatctcagagacaacgcaagactccgngcatctgacaaatcgaacagtctagaagagaccgaggacacggtctgtttattactgcgacgagaggaaggacgtgggtcggtttacgacgtacgtcggggcacgggaacctggtccaccgtctcctcacgccctaccacgaacggccctagtccggtccttcccccgngcccgcccgttcgcctaccgacggacnccaacccgtcgaacgacgaccgacgaccggcccggccccgtgggccctcggcccgttggtacccgaaggtacccttaccgttacccaactaggtaccgccggaaccgttgggaccggtcgggtcgtaccgggcgaacgggcccgacgtagtacggannncggn

SEQ ID NO: 81914 - DNA, 650 bp, Homo sapiens
  misc_feature: GYAE6OF01D2UNJ.39.37.D04.1.454.CMB.1.raw
  modified_base (205)..(205): a, c, t, g, unknown or other
  misc_feature (205)..(205): n is a, c, g, or t
tcagtcgcactagtcacgaccggtgctcgatttagtagcatactgttgggtttggggagagaagagctgctcagttaggacccagagggaaccatggaaaccccagcgcagcttctcttcctcctgctactctggctcccagataccaccggagaaattttgttgacgcagtctccaggcaccctgtgtttgtctccaggggaanagccaccctctcctgcagggccagtctagtttcgttacccaactaacttcttagcctggtaccagcagaacctggccaggctccaggctcctcatctatgatacatccaccgagggccacgtcggacactcccagactaggttcaggtggtgttcgggtctgggacagtacttcgacttctaccacctataccacgactagacgtacggacgtccgtagtaagttagttttacgacgtacgttactactactacgtcgtacgtagtacgtagttagtaggtacgtaactacgtaaacggttaccggttaccggaccggtaaacgggtaccggtaagggtaacggtaaaacgtaaccgtaaaacggtaacgttacgggtacggtacgtacgaccctaaccgtacgttacgttacgttacctttactaccgttcccgttacccccgg

SEQ ID NO: 81915 - DNA, 593 bp, Homo sapiens
  misc_feature: GYAE6OF01AK1L8.39.37.D04.1.454.CMB.1.raw
  modified_base (262)..(262): a, c, t, g, unknown or other
  misc_feature (262)..(262): n is a, c, g, or t
  modified_base (344)..(344): a, c, t, g, unknown or other
  misc_feature (344)..(344): n is a, c, g, or t
  modified_base (589)..(591): a, c, t, g, unknown or other
  misc_feature (589)..(591): n is a, c, g, or t
  modified_base (593)..(593): a, c, t, g, unknown or other
  misc_feature (593)..(593): n is a, c, g, or t
tcagtcgcactagtcacgaccggtgctcgatttagtagcatactgttgggtttggggggaagaggaagactgacggtccctgagactctcctgtgcagcctctggattcccctttacgagttattggctgagctgggtccgccaggctccagggaaggggttggagtgggtggccaacataaagcaagatggaagtcggaaagagtatctggactctgtgaggggccgttcaccatctccagagacaacgccaagactccgngcatctgacaaatgaacagtctgagagccgaggacacggctgtttatactgcgcgagagaaggctgggcgtttcgactacgnggggccagggaaccctggtcaccgtctcctcacgcctccaccgaacgggcccagtccggtccttcccccgtggccgcccgtcgcctcccgaggacgccacccgtccgacgacgcacgacggccggcccgtgggcctcggccgttacggtaccgaacggtacccttaccttaccgaacgttacggtccggccggtacgtcggacgggccgggtacgtcgggaccggaacgggcgacgagtacgcannngn

SEQ ID NO: 81916 - DNA, 685 bp, Homo sapiens
  misc_feature: GYAE6OF01E0REA.39.37.D04.1.454.CMB.1.raw
  modified_base (167)..(167): a, c, t, g, unknown or other
  misc_feature (167)..(167): n is a, c, g, or t
  modified_base (181)..(181): a, c, t, g, unknown or other
  misc_feature (181)..(181): n is a, c, g, or t
  modified_base (184)..(184): a, c, t, g, unknown or other
  misc_feature (184)..(184): n is a, c, g, or t
  modified_base (291)..(291): a, c, t, g, unknown or other
  misc_feature (291)..(291): n is a, c, g, or t
  modified_base (295)..(295): a, c, t, g, unknown or other
  misc_feature (295)..(295): n is a, c, g, or t
  modified_base (298)..(298): a, c, t, g, unknown or other
  misc_feature (298)..(298): n is a, c, g, or t
tcagtcgcactagtcacgaccggtgctcgatttagtagcatactgttgggtttgaggtctcagagaggagccttagccctggactccaaggcctttccacttggtgatcagcactgagcacagaggactcaccatggaattggggctgagcggtcgttcgtctaggnttacgaagttagcngtntgcgtgcagttggtgagtctggggagcttggccagccggggggtccctgagctctcctgtgcagcctctggacttcccctttagagttattggctgagctgggtccnccgngcncgagggtagggtgaggtcggtcgaccaagaagtaaagacgaagagtaggaacgtaacggaagtagtactcgtagtactcgtggtggtacggggtcccgttacaaccgtatccgtaccgaaggaccgaacccgaaccgaaccgtaaacgtaacccgttccgtacgtacgtacgtacgtacgtaaccgtaaacgtaacgtaacgtaacgtacgtacggtaacgaacggaccggacggaccgtaccggttacgtttacgtttaagttacgtcggtacgtacggaacggtaaggtaacggtacggttacgggtaccggttaccggttaaccgtaccggtaccgggtaccgggtaaccgggtaacccggtaccggttacccgtcccgtaccg

SEQ ID NO: 81917 - DNA, 757 bp, Homo sapiens
  misc_feature: GYAE6OF01BTFR3.39.37.D04.1.454.CMB.1.raw
  modified_base (364)..(364): a, c, t, g, unknown or other
  misc_feature (364)..(364): n is a, c, g, or t
tcagtcgcactagtcacgaccggtgctcgatttagtagcatactgttgggtttgaggtctcagagaggagccttagccctggactccaaggcctttccacttggtgatcagcactgagcacagaggactcaccatggaattggggctgagctggttttccttgttggtattttagaaggtgtccagtgtgcggtgcagttggtggagtcgtgggggaggtcgttgggtccagggcccgggggggtccctggagacctcctcctggtgcagccctcgtggtactttccccgtttacgtagttattggctgagcgtgggtcccgccgaggctccggaggggtagggttggaggtgggtggaccaanaagtaaagcgaaagagtagggaagtacgggaaagtagtagtcgtaggaccttcggtggtgggacgggggtcccggtttacaaccgtacgttcctaccgaaggaacggaaccaaacccggtacccgaaaacggtaacccgttcccgtacggtacctaacgttccgtaggaacctaaagttacggaaactacgtacgtaagggaacggtaacggaccgggaacggaaccgtaccgggtacgttttacgttttaacgttacgtcggccggtacgggaaagaacgggaaacggggttaccggttacgggggttcggttttaaccgaccggttaaccgggtcgggggaacccggtaacccggggaacccgtttcggtaccccgtacccggttaccccg

SEQ ID NO: 81918 - DNA, 578 bp, Homo sapiens
  misc_feature: GYAE6OF01EFXNF.39.37.D04.1.454.CMB.1.raw
  modified_base (206)..(206): a, c, t, g, unknown or other
  misc_feature (206)..(206): n is a, c, g, or t
  modified_base (215)..(215): a, c, t, g, unknown or other
  misc_feature (215)..(215): n is a, c, g, or t
  modified_base (244)..(244): a, c, t, g, unknown or other
  misc_feature (244)..(244): n is a, c, g, or t
  modified_base (295)..(295): a, c, t, g, unknown or other
  misc_feature (295)..(295): n is a, c, g, or t
tcagtcgcactagtcacgaccggtgctcgatttagtagcatactgttgggtttggggagagaagagctgctcagttaggacccagagggaaccatggaaaccccagcgcagcttctcttcctcctgctactctggctcccagataccaccggagaaattttgttgacgcagtctccaggcaccctgtgtttgctccaaggggaaangccaccctntcctgcagggccagtcagtttgtcccaanaacttcttagcctggtaccagcagaaacctggccaggctcccaggctcctnatctatgatacatccaccgagggccactggcactcccagacaggttcagtggtgttgggtctgggactagacttcactctcacatcagcagacgtggacgcgtagtaagtatttgactagtctatcactgtcagcagtagtggtagtactacgaacggtacgttacggaccgaacggggaaccgtaaagggtacggtaaacgtacgaaaacggtaacgtacggtacggacgtcggaccgtaaccgtactaccgttacgtacctttctacttcccgttaccccg

SEQ ID NO: 81919 - DNA, 543 bp, Homo sapiens
  misc_feature: GYAE6OF01CYGNU.39.37.D04.1.454.CMB.1.raw
  modified_base (426)..(426): a, c, t, g, unknown or other
  misc_feature (426)..(426): n is a, c, g, or t
  modified_base (444)..(444): a, c, t, g, unknown or other
  misc_feature (444)..(444): n is a, c, g, or t
  modified_base (469)..(469): a, c, t, g, unknown or other
  misc_feature (469)..(469): n is a, c, g, or t
  modified_base (478)..(478): a, c, t, g, unknown or other
  misc_feature (478)..(478): n is a, c, g, or t
  modified_base (482)..(482): a, c, t, g, unknown or other
  misc_feature (482)..(482): n is a, c, g, or t
  modified_base (514)..(514): a, c, t, g, unknown or other
  misc_feature (514)..(514): n is a, c, g, or t
tcagtcgcactagtcacgaccggtgctcgatttagtagcatactgttgggtttgaggtctcagagaggagccttagccctggactccaaggcctttccacttggtgatcagcacctgagcacagaggactcaccatggaattgggggctgagctgggttttccttgttggtattttagaaggtgtccagtgtgcggtgcagttggtggagtctgggggaggcttggtccaggccgggggggtccctgagactctcctgtgcagcctctggattcccctttagagttattggctgagctgggtccgccaggctccgagggagggttggagtgggtgccaacataaagcaagatggaagtcggaaagagtatctggactctggtggaggggtccgttcaccatctcagagacaacgccaagaactcgngcatctgacaaatgaacngtctggagacgccgaaggacacggnttgttatcngcgngagagaaggtcgtgggcgtttcgacgttacgnggggacccaagggaccctggcctccgtcc

SEQ ID NO: 81920 - DNA, 660 bp, Homo sapiens
  misc_feature: GYAE6OF01C7B57.39.37.D04.1.454.CMB.1.raw
  modified_base (567)..(567): a, c, t, g, unknown or other
  misc_feature (567)..(567): n is a, c, g, or t
tcagtcgcactagtcacgaccggtgctcgatttagtagcatactgttgggtttgaggtctcagagaggagccttagccctggactccaaggcctttccacttggtgatcagcactgagcacagaggactcaccatggaattgggctgagctgggttttccttgttggtattttagaaggtgtccagtgtgcggtgcagttggtggagtcgtgggggaggcttgggtccgagggcccgggggggtccctggacgacctctccgtgtgcacgcctcgtggtactttcccctttagtagtttattggctgagtcgtcgggtccgccgaggcctaccggaggggtaaggggttggaggtggggtggaccaaacgaagtaaagcaaaggagtgggaaagtacggaaagagtatcgtaggtactcgtggtggacggggtccgttcacctactctccgaagacgaccgaaaccgccgaaagacccttccggtagacacttcgtagaaacctaaagtacggaacctaggtcgtaggacggacgaccggagaaccgtaggtctttagtttatacgngaccggagaggaggtaacggacggttggggtaccggtttcgaacgttcggtcggggacccgaacggggtacccctgggtcccgtaccgtcccg

SEQ ID NO: 81921 - DNA, 259 bp, Homo sapiens
  misc_feature: GYAE6OF01EPQ2R.39.37.D04.1.454.CMB.1.raw
  modified_base (250)..(250): a, c, t, g, unknown or other
  misc_feature (250)..(250): n is a, c, g, or t
  modified_base (256)..(259): a, c, t, g, unknown or other
  misc_feature (256)..(259): n is a, c, g, or t
tcagtcgcactagtcacgaccggtgctcgatttagtagcatactgttgggtctgagacagatttcactctcaccatcagcagcctgcaggctgaagatgtggcagtttattactgtcagcagtattatagtagtcctcagtacttttggccgggggaccaagctggagatcaaacgaactgtggctgcaccatctgtcttcatccttcccgcatctagaactagtgcgactgaggcgggctggcaaggcncatagnnnn

SEQ ID NO: 81922 - DNA, 712 bp, Homo sapiens
  misc_feature: GYAE6OF01BJCSA.39.37.D04.1.454.CMB.1.raw
  modified_base (502)..(502): a, c, t, g, unknown or other
  misc_feature (502)..(502): n is a, c, g, or t
tcagtcgcactagtcacgaccggtgctcgatttagtagcatactgttgggtttgaggtctcagagaggagccttagccctggactccaaggcctttccacttggtgatcagcactgagcacagaggactcaccatggaattgggctgagcttggttttcttgttgtatttagaggtgtcagtgtgcggtgcagttggtggagtcgtgggggagtcgttggtccgacgggccggggggtccctggacgaccttcctccgtgtgccacgcctcgtcggtacctttcccgtttacgtagttattggctagagtcgtcgggtcccgcgacggccgtaccggaggggtaggggttggaggtcgggtcggaccaaacgaagtaaacgacgaaagtacgtaggaaggtaacggaaagtagtaagtcgtaggtacgtcgtggtacgggaccggggtccgttacaccgtagtcctacgagacgaaaccacgaccgaaagtaccctcggtanactacgtcacgaacaaagtacgaacgtagtcgaaggacgaacgtaccggaaggtacccgtacgggttactttaggtttaacctcgtacggaccggaggtaaagaacggttaacggggcggtttccggggttaccggttacggtaaacccggtcgggtaccggggtaacccgtaacgggtaaccccgttcggtacccgttacccgtccccg

SEQ ID NO: 81923 - DNA, 799 bp, Homo sapiens
  misc_feature: GYAE6OF01AH29D.39.37.D04.1.454.CMB.1.raw
tcagtcgcactagtcacgaccggtgctcgatttagtagcatactgttgggtttgaggtctcagagaggagccttagccctggactccaaggcctttccacttggtgatcagcactgagcacagaggactcaccatggaattggggctgagctgggttttccttgttggtattttagaaggtgtccagtgtgcggtgcagttggtggagtcgtgggggagcttggtccaggccggggggtcctgagactctcctgtgcagcctcgtggactttccccttacgagttattggctgagcgtcgggtccgcgaggctccgaggggtaacggggttgggaggtcgggtggacccaaacgtagtaaagccaagagtggaagtcggaaagagtatcgtaggtactcgtggtaggacgggggtcccgttacgacctagtccctacccgaaggacgaaccgtaaccgaccgaaacggtaacccgtcccggtacgacctaacgttccgtacggtaaccgtaaaacgtcggaaacccgtaggttacccgtaggtaacggaaccgggtacccgggaaacggggtaacctaacccgggggttccttttagggtttttaaaccgtttacccggtacgggtcccggtaacggggtaaacggtaaccggggtaaacggggtaccggttcgggggggtttaacccggttttaccgggaaacccggtttaaccggggttacccgggggggtaccccgaaaacccggggggttaacccccggtcggggtttaacccccggtacccggtttacccccgg

SEQ ID NO: 81924 - DNA, 730 bp, Homo sapiens
  misc_feature: GYAE6OF01DGCY9.39.37.D04.1.454.CMB.1.raw
tcagtcgcactagtcacgaccggtgctcgatttagtagcatactgttgggtttggggagagaagagctgctcagttaggacccagagggaaccatggaaaccccagcgcagcttctcttcctcctgctactctggctcccagataccacggagtaaattttgtgacgcagtctccaggcaccctgtgtttgtctccgaggggaagcgccaccctctcctgcagggccagtctagtttcgtcccaactacttcttagcctggtaccagcagaaacctggccaggcctccgaggcctcctcattctagtgaacttacactccaaccgagggcccacgtcggaccacgtccccaaggtactagggttcaggttgggtacggttggggtctaggggacctaggtacctttcgaccttctaccaacctagtcgaagccaaggtacgtacgggacgtccgtaaggaagtttacgttttacgaccgttagttaccttaacgttccgtacgttcgtaccgtacgtacgtaacggttagttgggtacgtaaccgtaacggtaaaccgggtaccgtttacccggggaaccggtaaacggggtaacccggtaaaggggttaaaccggaaaacgttaaccgaaaaaccgggtaacggttacggggtaacggtaccggtacgaaccgtaccgtaacgtttccgttacggtttacctttaccgtaccttccccggttacccccg

SEQ ID NO: 81925 - DNA, 650 bp, Homo sapiens
  misc_feature: GYAE6OF01D152S.39.37.D04.1.454.CMB.1.raw
  modified_base (350)..(350): a, c, t, g, unknown or other
  misc_feature (350)..(350): n is a, c, g, or t
  modified_base (569)..(569): a, c, t, g, unknown or other
  misc_feature (569)..(569): n is a, c, g, or t
  modified_base (644)..(644): a, c, t, g, unknown or other
  misc_feature (644)..(644): n is a, c, g, or t
tcagtcgcactagtcacgaccggtgctcgatttagtagcatactgttgggtttgaggtctcagagaggagccttagccctggactccaaggcctttccacttggtgatcagcactgagcacagaggactcaccatggaattggggctgagctgggttttccttgttggtattttagaaggtgtccagtgtgcggtgcagttggtggagtcgtggggggaggcttggtccgaggccgggggggtccctggagacctctcctgtgcagcctctggtactttcccctttacgagttattggctgagctgggtccgccaggcctcgaggggaggggttggaggtgggtgccaanataaagcaagagtaggaagtcggaaagagtatcgtggacttcgtggtgggacgggggtcccggttacaccgtagttcctaccgaaggaacgaacccaaaccggcccaaaaagggtaaccccttcccggtagacctaattcctaggaacctaaaagtcgaaaccgtagttcctagggacgaacggcccggaaggaccacgggtctttagtttaactacgnggcgacgaagaggaacggtcgttggggtccgtttacgacgttcggcggggacccaagggaaccccttgggtcccncggtcc

SEQ ID NO: 81926 - DNA, 738 bp, Homo sapiens
  misc_feature: GYAE6OF01BLHSU.39.37.D04.1.454.CMB.1.raw
tcagtcgcactagtcacgaccggtgctcgatttagtagcatactgttgggtttgaggtctcagagaggagccttagccctggactccaaggcctttccacttggtgatcagcactgagcacagaggactcaccatggaattggggctgagctgggttttccttgttggtattttagaaggtgtccagtgtgcggtgcagttggtggagtcgtgggggagcttggtccaggccgggggggtccctgagactctcctgtgcagcctctggactttcccctttagagtttattggctgagcgtcgggtcccgccgaggcctccggagggggtaagggggttgggaggttggggtcggacccaaacgaagtaaaaggcaaagagtagggaagtacggaaagagtatcgtggacttcgtggtgggacggggtcccgttacacctatccgtaccaggacgaaccaaccggaccaaacggtaaccctcccggtgacctaagttccgtagaacctaaaagttcgaaacctaggttcctaagggaaggaccggacccgggaagggaaccgtaccgggttctttaggttttaacttacggtcggaccggaacggaaggaacgggtaacgggtccggttaggggggttacccggttttaccggaacccggtttaccggggtacggggggaccccgttaaaccggggggtaacccccgtttcggggttaccccgtaccccggtttccccg

SEQ ID NO: 81927 - DNA, 596 bp, Homo sapiens
  misc_feature: GYAE6OF01EGNA5.39.37.D04.1.454.CMB.1.raw
  modified_base (206)..(206): a, c, t, g, unknown or other
  misc_feature (206)..(206): n is a, c, g, or t
  modified_base (297)..(297): a, c, t, g, unknown or other
  misc_feature (297)..(297): n is a, c, g, or t
tcagtcgcactagtcacgaccggtgctcgatttagtagcatactgttgggtttggggagagaagagctgctcagttaggacccagagggaaccatggaaaccccagcgcagcttctcttcctcctgctactctggctcccagataccaccggagaaattttgtgacgcagtctccaggcaccctgtgtttgtctccgaggggaaangcccaccctctcctgcagggccagtctagtttcgtacccaacaacttctagcctggtaccagcagaacctggccaggctccgaggctcctnatctatgatacatccacgagggccacgtggccatcccagactaggttcaggtggtgttgggtctggggacagtacttcactctaccacctatccagaccagacgtggacgtccgtagtaagttagttttgactagttctactctactgtacagtacgtagtagtggtacgacgtacgtaacgtacggttaccggaccgtaacgggaccgaaagggtacggaaacgtaccgaaacgtaacgtcggtaggacgtcgacctacctacgttcgttacgttaccttctcgttcccgttaccccg

SEQ ID NO: 81928 - DNA, 733 bp, Homo sapiens
  misc_feature: GYAE6OF01ERCC0.39.37.D04.1.454.CMB.1.raw
  modified_base (599)..(599): a, c, t, g, unknown or other
  misc_feature (599)..(599): n is a, c, g, or t
tcagtcgcactagtcacgaccggtgctcgatttagtagcatactgttgggtttgaggtctcagagaggagccttagccctggactccaaggcctttccacttggtgatcagcactgagcacagaggactcaccatggaattggggctgagctgggttttccttgttggtattttagaaggtgtcagtgtgcggtgcagttggtggagtcgtgggggagcttggtccaggccggggggtccctgagactctcctgtgcagcctctggtactttcccctttacgagtttattggctgagtcgtgggtcccgccgaggcctccggaagggggtaacgggggtttgggagggttgggggtcgggacccaaaacgtaagtaaaacggcaaaaggtagtagggaaaggtacggaaaagtagtagtcgtgggacttcgtggtagggacgggggtcccggttacaccgtagttccgtaccgaaggacgtaacccaaccggacccgaaaaggtaacccttcccggtagacctaacttccgtacgaaacctaaaagttcgaaaacctggttccgtaggaacgtacggaccggaaggacctaccgggttntttaggttttaactaccggtcggccggtacgaaggaacggaacgggtccgttagggggttaccggtttccgaacgttcggaccggggggtacccaaccggggttaaccccttggggtacccctaccggttcccg

SEQ ID NO: 81929 - DNA, 594 bp, Homo sapiens
  misc_feature: GYAE6OF01ARV5W.39.37.D04.1.454.CMB.1.raw
  modified_base (447)..(447): a, c, t, g, unknown or other
  misc_feature (447)..(447): n is a, c, g, or t
  modified_base (586)..(586): a, c, t, g, unknown or other
  misc_feature (586)..(586): n is a, c, g, or t
  modified_base (588)..(588): a, c, t, g, unknown or other
  misc_feature (588)..(588): n is a, c, g, or t
  modified_base (590)..(590): a, c, t, g, unknown or other
  misc_feature (590)..(590): n is a, c, g, or t
  modified_base (592)..(592): a, c, t, g, unknown or other
  misc_feature (592)..(592): n is a, c, g, or t
tcagtcgcactagtcacgaccggtgctcgatttagtagcatactgttgggtttggggggaagaggaagactgacggtccctgagactctcctgtgcagcctctggattcccctttacgagttattggctgagctgggtccgccaggctccaggggaaggggttggagtgggtggccaacataaagcaagatggaagtcggaaagagtatctggactctgtgaggggccgttcaccatctccagagacaacgccaagaactccgtgcatctgcaaatgaacagtctgagagccgaggacacggcttgtttatactgcgcgagagaaggactgggcgtttcgactacgtggggccagggaaccctggtcacccgtctcctcacgccctaccaccgaagggccccagtccggtaccttcccccgtcggccgtccctcgcctccacgggcnccgtaccctccgacgacgccgacgacggccggcccgtcgggctcggccctacggtaccgaaacggtaccttacctcccgacgttacgcgtacgtacgtcggaggcccggggtctgggacgaacgggccgacaacgtagnancncngc

SEQ ID NO: 81930 - DNA, 795 bp, Homo sapiens
  misc_feature: GYAE6OF01C5M2A.39.37.D04.1.454.CMB.1.raw
  modified_base (169)..(169): a, c, t, g, unknown or other
  misc_feature (169)..(169): n is a, c, g, or t
  modified_base (185)..(185): a, c, t, g, unknown or other
  misc_feature (185)..(185): n is a, c, g, or t
  modified_base (195)..(195): a, c, t, g, unknown or other
  misc_feature (195)..(195): n is a, c, g, or t
  modified_base (226)..(226): a, c, t, g, unknown or other
  misc_feature (226)..(226): n is a, c, g, or t
  modified_base (255)..(255): a, c, t, g, unknown or other
  misc_feature (255)..(255): n is a, c, g, or t
  modified_base (257)..(257): a, c, t, g, unknown or other
  misc_feature (257)..(257): n is a, c, g, or t
  modified_base (347)..(347): a, c, t, g, unknown or other
  misc_feature (347)..(347): n is a, c, g, or t
tcagtcgcactagtcacgaccggtgctcgatttagtagcatactgttgggtttgaggtctcagagaggagccttagccctggactccaaggccctttccacttggtgatcagcactgagcacagaggactcaccatggaagttgggctgagcgtggtttcgtgtaggtntttagaagtgtcagtntgcggtgcgngttggtggagtcgtggggaggcttggtccgngggtcccgggggtcctggacgctctctgncncgcctgtaggtactttccccttaagtgttcgttggacttggacgtccgttcgggccgaacgtcgcgttaccggaggggtaacgggggtgnggttgggacgaccctaaagtaaagaaaggacgaaggtagttaggggaaaccgttaaggtaaaacgagtttaagccgttaaggacccgtttaggtcggggttaagggacggggggttacccccgtttcgaaaaccctagttcccgaaaccgaaggggaaccaaacggtaaaccccggaaacccgtaaaaacggccctttccccgggtaaagacctaacgttaccgtaagaacgtaaacgtaacgtaacgtaacggtaacgtacggtaacggtaaccggaaccggtaaccggtaaccgttaacggttacgtttacgtttacgttacgtacggtacggtaacggtaaacgggtaacggtaacgggtacgggttacgggttaccgggttacggtaaccggtacggtacgggtaaccgggtaccggtaaccggtaccggtccgtacgtacccg

SEQ ID NO: 81931 - DNA, 596 bp, Homo sapiens
  misc_feature: GYAE6OF01BIOMH.39.37.D04.1.454.CMB.1.raw
  modified_base (590)..(590): a, c, t, g, unknown or other
  misc_feature (590)..(590): n is a, c, g, or t
  modified_base (592)..(593): a, c, t, g, unknown or other
  misc_feature (592)..(593): n is a, c, g, or t
  modified_base (595)..(596): a, c, t, g, unknown or other
  misc_feature (595)..(596): n is a, c, g, or t
tcagtcgcactagtcacgaccggtgctcgatttagtagcatactgttgggtttgggggaagaggaagactgacggtccctgagactctcctgtgcagcctctggattcccctttacgagttattggctgagctgggtccgccaggctccagggaaggggttggagtgggtggccaacataaagcaagatggaagtcggaaagagtatctggactctgtgaggggccgttcaccatctccagagacaacgccaagaactccgtgcatctgcaaatgaacagtctgagagccgaggacacggctgtttattactgcgcgagagaaggactgggcggtttcgactacgtggggccaggggaaccctggtcaccgtctcctcacgcctccaccgaagggccccagtccggtccttcccccgtcggccgccctcgcctcccgaggacgccacccgtcccgagacgccaccgacggccggccccgtggggccttcggccccgttgggtacccgaaacgggtaccttaaccgtttcccaacgttacggtcgccgtacgtggacggccggggctgggacaacgggccgcaagtacggnanngnn

SEQ ID NO: 81932 - DNA, 777 bp, Homo sapiens
  misc_feature: GYAE6OF01DOWB0.39.37.D04.1.454.CMB.1.raw
  modified_base (187)..(187): a, c, t, g, unknown or other
  misc_feature (187)..(187): n is a, c, g, or t
  modified_base (204)..(204): a, c, t, g, unknown or other
  misc_feature (204)..(204): n is a, c, g, or t
tcagtcgcactagtcacgaccggtgctcgatttagtagcatactgttgggtttggggagagaagagctgctcagttaggacccagagggaaccatggaaaccccagcgcagcttctcttcctcctgctactctggctcccagataccaccggagtaaattttgttgacgcagtctccagcacctgtntttgtctcgaggggaancgccacctctcctgcagggccagtctagtttcgtaccaactacttctagcctaggtaccagcaacgtaaccgtggaccaggtcctcccgaggtcctcctacatcctatgaactaccactcccgaaccgacgggacccacgtcggaccacgtaccccgaagtaccgtacggttcaacgggttgggtttacggtttcggggtaccgtagggggtaacctaaggtacccgtttaccaccgttacccgtaccgaaacccgtaagttcccgaaacggtacccggaacgggtaaccgttacggggtaccgtacccgttaaggtaaacggtttacgttttacgaaccgttaacgttccgttaaccgttaccgtacttacggtacgtaaggtaccgttaaggttacggttaggttaccgtaaccgttaacggtaaaccgggttaccgggttacccggggtaaaccggaacgggtaaccggtaaagggtaaccggtaaacgtaaaccgtaaacggacgttagggtaccggtactacggtaaccgcgtaacgttccgtacttacttctacgttcccgtacccg

SEQ ID NO: 81933 - DNA, 818 bp, Homo sapiens
  misc_feature: GYAE6OF01CMC3U.39.37.D04.1.454.CMB.1.raw
tcagtcgcactagtcacgaccggtgctcgatttagtagcatactgttgggtttgaggtctcagagaggagccttagccctggactccaaggcctttccacttggtgatcagcactgagcacagaggactcacatggaattgggctgagctggttttccttgttgtattttagaaggtgtccagtgtgcggtgcgtaggttgggtggagttcggtggggggaggtcgtttgggtcccgagggtccccggggggggttcccctggacgtaccttctccgtggtcgcgacgtccgttcgtacggtaccttttcccccgttttaacggtacgttttagtttggtccgttaggacggtccgttccggggtcccgcccgacgggtccgtacccggtaagggggtaagggggtttcggagggttcggggtacggaccctaaaacgaagttaaaacggcgtaaaaggtaggtaagggaaacggttaacggaaaaagtagttaacgtcgtaggtacctcgtaggtacgggacgggggtcccgttacgaacccgtcgttacgtacccgaaggaaccgaaacccgaacccggaccgtaaaacgtaacccgttacccggagtaccaacgttaccgtagtaaaccgaaaagtcgaaccgtagtccgtaagggacgaacggaccggaggaacccgtcgggttactttagttttaacctacgtcgaccggaggaaacgtagggtaacgggtcgttcgggggttaccggtttacgacccggttacggacgggggtaacccgacgggtaccccggtcgtacccgtcccggtaccc

SEQ ID NO: 81934 - DNA, 657 bp, Homo sapiens
  misc_feature: GYAE6OF01AU2I6.39.37.D04.1.454.CMB.1.raw
  modified_base (192)..(192): a, c, t, g, unknown or other
  misc_feature (192)..(192): n is a, c, g, or t
  modified_base (201)..(201): a, c, t, g, unknown or other
  misc_feature (201)..(201): n is a, c, g, or t
  modified_base (221)..(221): a, c, t, g, unknown or other
  misc_feature (221)..(221): n is a, c, g, or t
  modified_base (288)..(288): a, c, t, g, unknown or other
  misc_feature (288)..(288): n is a, c, g, or t
  modified_base (391)..(391): a, c, t, g, unknown or other
  misc_feature (391)..(391): n is a, c, g, or t
  modified_base (529)..(529): a, c, t, g, unknown or other
  misc_feature (529)..(529): n is a, c, g, or t
tcagtcgcactagtcacgaccggtgctcgatttagtagcatactgttgggtttgaggtctcagagaggagccttagccctggactccaaggcctttccacttggtgatcagcactgagcacagaggactcaccatggaattggggctgagcggtggtttcgtgtaggtacttagaagtgcagtgtgcgtgcngttggtggngtcgtggggagcttggccgnggccggggggtcctgacgctctccgtgtgcacgcctctggactttcccttagagtttattggctggngcgtgggtccaccgaggctccggtagggggtaggggttggaggtgggtacggacccaaagtaagtaaaagcgtaaaggataggaacggtaggaaaagtgtaancgtacggctcgtggcggacgggtccgttacacgtactccgcgaaggaccaagaacccgtaccgtaaaggtcccctagcgacagcttccgaaacaatacggaactggttcagaccgcggacgaaccggtataccggttntttacgttacgtacgcggtaccgaagggaacgtaaggtaacgggtttccggtaacgggttccggttaccgttaacgggcccgggtacgggacccccgtaagggtacccctggttaccctccccgggta

SEQ ID NO: 81935 - DNA, 728 bp, Homo sapiens
  misc_feature: GYAE6OF01EVFPZ.39.37.D04.1.454.CMB.1.raw
tcagtcgcactagtcacgaccggtgctcgatttagtagcatactgttgggtttggggagagaagagctgctcagttaggacccagagggaaccatcggaaaccccagcgcagcttctcttcctcctgctactctggctccagactaccacggataattttgtgacgcagtctccgaggccaccgttgtgtttcgtccgtaccggaaggggaacgacgccctaccctcgtcctgcgacgggcctagttctagtttccgtacccaataacttctagccgtaggaccacgtacaacgaaccgtcggaccgacgggtaccctcccgacggtccctaccgtactacttaccgtatacgtaacttaccacctacccggacccggacgggtaccctaacgtcggaccctaccgtacccgaaggtaccgtagggttcgtacgggttggttcggtttacgggtcgtagggacctaacgttctaacctccacgttaaccacgtactacgaacggccgtaaggtacgtacgtacgaccgttaagtacgttagttacgacgtacgttactacgtctacgtacgtacaggtcttaaggtgtacggtactaacgtacgaaacggtccgtaacgaacggaacgggaactaagggttaacaacgttaaccggaacgtaggtaccggtacgacgtacccgaacgtaccgttacgttctacgttacttacctaccgtcccgtaccg

SEQ ID NO: 81936 - DNA, 256 bp, Homo sapiens
  misc_feature: GYAE6OF01CC5UU.39.37.D04.1.454.CMB.1.raw
  modified_base (133)..(133): a, c, t, g, unknown or other
  misc_feature (133)..(133): n is a, c, g, or t
  modified_base (249)..(256): a, c, t, g, unknown or other
  misc_feature (249)..(256): n is a, c, g, or t
tcagtcgcactagtcacgaccggtgctcgatttagtagcatactgttgggtctgggacagacttcactctcaccatcagcagactggagcctgaagattttgcagtctatcactgtcagcagtatggtgactnaaagacgttcggccaagggaccaaggtgaaatcaaacgaactgtggctgcaccatctgtcttcatccttcccgcatctagactagtgcgactgaggcggctggcaaggcgcaatgnnnnnnnn

SEQ ID NO: 81937 - DNA, 628 bp, Homo sapiens
  misc_feature: GYAE6OF01A13RU.39.37.D04.1.454.CMB.1.raw
  modified_base (328)..(328): a, c, t, g, unknown or other
  misc_feature (328)..(328): n is a, c, g, or t
  modified_base (481)..(481): a, c, t, g, unknown or other
  misc_feature (481)..(481): n is a, c, g, or t
  modified_base (486)..(486): a, c, t, g, unknown or other
  misc_feature (486)..(486): n is a, c, g, or t
  modified_base (497)..(497): a, c, t, g, unknown or other
  misc_feature (497)..(497): n is a, c, g, or t
  modified_base (541)..(541): a, c, t, g, unknown or other
  misc_feature (541)..(541): n is a, c, g, or t
  modified_base (621)..(621): a, c, t, g, unknown or other
  misc_feature (621)..(621): n is a, c, g, or t
tcagtcgcactagtcacgaccggtgctcgatttagtagcatactgttgggtttgaggtctcagagaggagccttagccctggactccaaggcctttccacttggtgatcagcactgagcacagaggactcaccatggaattggggctgagctgggttttccttgttggtattttagaaggtgtccagtgtgcggtgctagttggtggagtcgtgggggaggcttgggtccgagggcccgggggggtccctggacgaccttcctccgtgtcgccagcctcgtggactttccccgtttacgagtttagttggctgagtcgtcgggtcccnccgacggcgtaccgaggggtaaggggttggaggttggggtggacccaaacagtaaagcgaaagagtaggaagtacggaaagagtatcgtgactcgtggtggaggggtccgttcacctatctaccgagacgaccaaccgccaaacgactccgancatcngacaatgaacngtaccaggacgacggaccgaggacgtacggtctttagtttaacngtcggcgacgaggaaggtaacggtcgtgggtccggttacgaccggttaggccgggaccgacgggtacccctgggtccccnccgtccc

SEQ ID NO: 81938 - DNA, 919 bp, Homo sapiens
  misc_feature: GYAE6OF01E3LA5.39.37.D04.1.454.CMB.1.raw
tcagtcgcactagtcacgaccggtgctcgatttagtagcatactgttgggtttgaggtctcagagaggagccttagccctggactccaaggcctttccacttggtgatcagcactgagcacagaggactccaccatggaagttggggctgagcttgggttttccttgttggttattttagaaggtgtccagtgtgcggtgctaggttggtggagtccgggtgggggacgtcgttcgggtccgaggggtcccgggggggtccctggacggtacctccgttcccgtggtcggaccgtacgtcccttccgtggttacccttttacccccgtttaggtacgttttaacgttgggtccttaggacggtccggttccgggggtcccccgccggtacgggtccgttacccggggaaaggggggtaacgggggttggggaacggggttcgggtacgggaacccctaaaacgtaaaggtaaaagaaccgaaaggtacggtaaggggaaacgggtaaacggaaaacggtaggttacgttacggtacggtaaccgttcggttaggggtacggggtaccggggggtttaccccgttaccgaccctacggttccccgaacgtaacgggaacccgtaaaccggaaaccccgtaaccggtaaaccgttaacccggtcccggtaacgtcctaacgttcccgaacggttaaaccgtaaaacgtacccggaaatcgggttaacaacgggtaaccggacggtacccgggaacggtacccgtaagggttcccttttaggttttaaccgagttcggacgtaacggtaaggtaaacgggtacggttaccgggttgggttacccgggttacgtaacccgggtaccgggttaccggggacccgtaaccgggtacccgtaccgggttccccgaccggttccccg

SEQ ID NO: 81939 - DNA, 279 bp, Homo sapiens
  misc_feature: GYAE6OF01BQL8V.39.37.D04.1.454.CMB.1.raw
  modified_base (213)..(213): a, c, t, g, unknown or other
  misc_feature (213)..(213): n is a, c, g, or t
  modified_base (239)..(239): a, c, t, g, unknown or other
  misc_feature (239)..(239): n is a, c, g, or t
  modified_base (244)..(245): a, c, t, g, unknown or other
  misc_feature (244)..(245): n is a, c, g, or t
  modified_base (247)..(247): a, c, t, g, unknown or other
  misc_feature (247)..(247): n is a, c, g, or t
  modified_base (249)..(249): a, c, t, g, unknown or other
  misc_feature (249)..(249): n is a, c, g, or t
  modified_base (251)..(279): a, c, t, g, unknown or other
  misc_feature (251)..(279): n is a, c, g, or t
tcagtcgcactagtcacgaccggtgctcgatttagtagcatactgttgggtttgggacagacttcactctcaccatcagcagactggacgcctgaagattttgcagtctatcactgtcagcagtatggtgactcaaagcgttcggccaaggaccaaggtgaaatcaaacgactgtgctgcacatctgtctcatcttcccgcatctgaactagngcgactgagcgggctggcaaggccanatagnntncngnnnnnnnnnnnnnnnnnnnnnnnnnnnnn

SEQ ID NO: 81940 - DNA, 844 bp, Homo sapiens
  misc_feature: GYAE6OF01CNM9G.39.37.D04.1.454.CMB.1.raw
  modified_base (327)..(327): a, c, t, g, unknown or other
  misc_feature (327)..(327): n is a, c, g, or t
tcagtcgcactagtcacgaccggtgctcgatttagtagcatactgttgggtttgaggtctcagagaggagccttagccctggactccaaggcctttccacttggtgatcagcactgagcacagaggactcaccatggaagttgggctgagtcgttggttttccttggttgttatttagaagtgtccagtgtgcggtgcgtaggttggtggtagtcggtgggggagtcgttggtaccgacgggtcccggggggtccctaggacgtacgtcctccgtgtcgcgtacgtcctcgttcgtaacctttccccgttaagtagtttagttcggngtggacgtcggtcggtccgaccgacggtccgtacgggaggggtaaggggttggagggttcggggtacgaaccgtaaaacgtaaagtaaacggacgaaagggtaagtaagggtaaaacggtacggtaaaaggtagttaacgtacggtacggtaccgttcggtaggtacggggaccggggttacccgttaccgtaacctacgtccgtaacgaaacggtaaccgaaacccggtaaccggaacccaaaacggtaccccgttaccggacgtaactacgttacggtaacgaaactaaaggtaccgaaacgtcggtacgtaacggacggaaaccgtccgggtaaccggaaccgttcggttacgttttaacggtttaaccgttaccgcgggaaacggtacggaaagggaaacggtaacccggggtagttccgggggttaacgtttaaccccggacggtttacccggggaacccggtaacccgggtaaccgggttaacccgttcggttccccgtaccccggttacc

SEQ ID NO: 81941 - DNA, 813 bp, Homo sapiens
  misc_feature: GYAE6OF01A0GL5.39.37.D04.1.454.CMB.1.raw
  modified_base (604)..(604): a, c, t, g, unknown or other
  misc_feature (604)..(604): n is a, c, g, or t
tcagtcgcactagtcacgaccggtgctcgatttagtagcatactgttgggtttgaggtctcagagaggagccttagccctggactccaaggcctttccacttggtgatcagcactgagcacagaggactcaccatggaattggggctgagtcttgggttttccttggttggttattttagaaggtgtccagtgtgcggtgctaggttggtggagtcgtgggggaggtcttggccgagggcccgggggggttccctggagtaccgtcctccgtggtcgctacggtcccgtcgtcggtacctttaccccgtttaacggtagtttagttcggtcgtggtacgtcgtcggggtcccgccgtaggccgtaccggagggggtaaggggtgggtagggttcggggtcggaccgaaacgtaacgttaaaggaccgaaaggtaaggtagggtaaacggtaacgggaaaaggtaacggttaagtaccgttaacggggtaaccttcggttacggggtacggggttaccggggggtcccgtttaccgaacccgttacgttacccgtacgacggtaaccggaaaccgaaacgaccccgaaacggtaacccgtccggngtaccacgtcgtacgaacaaagtcgaactagtcgagacgacggaccgacggacgtaacggtctttaggttacttacgtacgggcgtaacggaaggtaacggaacgggtacgggtacgggttaccggggtttaaccaccgggttaacccgggtacgggacccggtaaacccggggtaccctaccggggtccccgttaaccggttaccccg

SEQ ID NO: 81942 - DNA, 846 bp, Homo sapiens
  misc_feature: GYAE6OF01CWBSH.39.37.D04.1.454.CMB.1.raw
tcagtcgcactagtcacgaccggtgctcgatttagtagcatactgttgggtttgaggtctcagagaggagccttagccctggactccaaggcctttccacttggtgatcagcactgagcacagaggactcaccagtggaagttggggctgaggtcgttgggttttccttggttggttaagttttaaaaggtgtccaggttgtgaggtgcgagcttggttggagtcggtgggggagtcgttggtacgacgggtccggggggtacctggaacggcctccgtccgtgtcgactcgcctgtcggtacttctaccttgacgtcacgtcgtatccggaccagttccggtaccggtccggtcccggaccgtacggtaccgtacgggagggtacggtacggtacgggtaggtcggttacgtcggttagttaggttaggtaggtagggttacggttacgtaacgtttaacgtaaaacctaacggtaacgtaccggtaccgtaccggttcccggggtaaacggggtaaacccgggtccccggttacctaacccgtaacccgttaaccgtttaccccgaacgtaaacggtaaacggttaacccttttaaacccggaacgtaaacggtccgttaacccttcgtaccgttttaagtaccgttaaccttaaggaaacccttaaagggtacccaaacgtcggttacgtagggtcccgaacgggaaccggaccgtaacccggtaacgtttaccagtttaaaccgttggtaacggttaagtaagggttaacggggtgggggtacgggttaacggggtcggttacccgttaacggttccgggttaggttttacggtaaccgggg

SEQ ID NO: 81943 - DNA, 822 bp, Homo sapiens
  misc_feature: GYAE6OF01D6E7E.39.37.D04.1.454.CMB.1.raw
  modified_base (673)..(673): a, c, t, g, unknown or other
  misc_feature (673)..(673): n is a, c, g, or t
tcagtcgcactagtcacgaccggtgctcgatttagtagcatactgttgggtttggggagagaagagctgctcagttaggacccagagggaaccatcggaaaccccagcgcagcttctcttcctcctgctactctggcctcccagactaccgaccggaagttaaatttttgtacgacgcgtacgttcctccgaggtcctacccgttggtttcgttttcgtcctaccggaagggggaaacgaccgtcccctaccccgttctaccgtcggccgacgggtacctacggttacgttacgttttccgtaacccaaacgttaacctttcgttacgccgttacggtaccagaccgaacgtaaccgtccgggaccgaacggtccctaccgtacggtccttaccgtactacttacgtagtacgtaactaacccgtaccgttacccgaacccgggtacggtacccctacgtaccgggtaccaaccggttacccgaaggtaaccgtcgggtttacgacgggtttgggttacggtttcgggtacggtacgggtactacgggtacccttcggtacttaccgtacctacgactccgaagccgaacgtacgtacggcctacgtagtagtttcgtttacgacgtacgttacgttactcgttacgttacgtacgacgtagtacgttacggngtaccgtaacgtacgtaacccggttacggtaacggaccggaacgggtacgtaagaacggtaactaaccggtaaacgttaacgggtgtaccggtacggcggtaaccgtactcgttactacggtttaccttaccgtcgtccccggttaacc

SEQ ID NO: 81944 - DNA, 758 bp, Homo sapiens
  misc_feature: GYAE6OF01AHQGX.39.37.D04.1.454.CMB.1.raw
tcagtcgcactagtcacgaccggtgctcgatttagtagcatactggttgggtttgaggtctcagagaggagccttagccctggactccaaggccctttccacttggtgatcagcactgagcacagagactcaccatggaattggggctgagtcgttgggtttttccttggttggttatttttaggaaggtgtccagtgtgcggtgctagttggtggagtcgtgggggaggtcttcggtccgacgggcccggggggtccctgacgcttctcctgtgcgcgcctcgtggtacctttccccgtttacgtagttagttggtcgtgagcgttcgggtccgtccgacggtccgtccgaggggtaaggggttgggtagggtgggtcggaccaacggggggggggggaataaacggacgaagagtaggtaaggtacggaaagtagtagtcgtacggtacgtcgtggtcgggacggggtccggttacaccgtacgtctaccgaacgacgaccgaccgaaccgtaacgtaccgtccgtcgcgtactacgtacgacgaacgtacgaacgtacgtacgtacgaacgacggaccgggaacggtaccgtacggttaccgtttacgttttacgtttaccgtcggtacggtcggaaaggtaacggtaaacgggtcgggttacggggttaccgggtttaccggtaccggttaccgggtaccggggtaccgggtaccgggtaaccccggtccggttacccggttacccggtacccg

SEQ ID NO: 81945 - DNA, 865 bp, Homo sapiens
  misc_feature: GYAE6OF01EW2NS.39.37.D04.1.454.CMB.1.raw
  modified_base (383)..(383): a, c, t, g, unknown or other
  misc_feature (383)..(383): n is a, c, g, or t
tcagtcgcactagtcacgaccggtgctcgatttagtagcatactgttgggtttgaggtctcagagaggagccttagccctggactccaaggcctttccacttggtgatcagcactgagcacagtacggactcgaacctatgggtaagttggggccttagaggtctttggggttttttccttaggtttggttaatttttaggaaagggttgtacccgtaaggttggttcggtacggtgtccgtagggtttggtgggtacgttcggtagggggacgtcgttcgggtccgaggggtcccggggggttcctagacggtaccctcgtaccgtgtcgcgtacgccttcggtagtacctttaccccgtttaggtacgtttacgttcgggntacggtaacgtccggtcgggtaccccgccgtaacgggtccgttacgggtaaggggggttacgggggtaaggtcgggttacggggtacggaaccctaaaagtaaggttaaacgacgaaaggtacggttaacggaaacgggttaacgaaaggttacggtattaccgggtcgtaactccgggtaggttacgggaacgggtccgtttacacgtattccggtaccgagaacctaccgacgtactaaacggtcctcgggtactaccgtactggtaactaactaagtaaccggtaattcggttaacggcggtaaagtcccgggtaacggtacgtacccggtagttaacgttttacgttacggtactcggggaactaacggtaggtaaaaccggtcggggtacgttaccgggggttaaccttacccgggaacgttaccggggacccggtacggttaaccggtacccggtttcgaaacgtcccgtttaccg

SEQ ID NO: 81946 - DNA, 911 bp, Homo sapiens
  misc_feature: GYAE6OF01A0XWW.39.37.D04.1.454.CMB.1.raw
  modified_base (450)..(450): a, c, t, g, unknown or other
  misc_feature (450)..(450): n is a, c, g, or t
tcagtcgcactagtcacgaccggtgctcgatttagtagcatactgttgggtttgaggtctcagagaggagccttagccctggacctccaaggtccctttcctacttggtgatcagcactgagcacagaggactccacctagtggaagttcggggctgacgtcgtttcggggtttttcccttggttaggttagtttttaggtaaggttcgttccgagtggtggcggtgcgtggttaggtgggacgtggttcgggggaggtcgtttcggtccggacggggtcccggggggtccctaggtacgaactaccttccgtggttcgacgtaccgtccgttaccgttggtaccctttaccccgtttacggtaagtttagttacgggtctcggtacggtcggtccgggtcccgccgtaccggtccggtaccgggtaaggggggtagggggtttacgggngggttaccgggggtccgaaccctaaacgtaagtaaaccggacgtaaacggtaggtaacgggtaacggggttaaacggaaagttaacggtacgtaccgtacggtaccttacgggttagggtacgggtacccggggttaccgttccctaaacgtcccttaccggtaaccgagtaaaccggaaacccgaacgtaaccccgtaaaacggtaccccgttccggtacgtaccgaactttaccgtaaccggaacttaaaaccggtacgaaaccgtttaacggttcgttaaacgggaaaccggtacgggtaaccccggtaacgggtaaccgtacccgggtttttacggtttaacggttttaccttaacgggcggaccgggtaacgaggaacgggtacgggttcgtacggggttacgttacgaccggttacgggcggaccccggtagggtacctcggtccgtcgtccccg

SEQ ID NO: 81947 - DNA, 249 bp, Homo sapiens
  misc_feature: GYAE6OF02GJ8CF.39.37.D04.1.454.CMB.1.raw
  modified_base (249)..(249): a, c, t, g, unknown or other
  misc_feature (249)..(249): n is a, c, g, or t
tcagtcgcactagtcacgaccggtgctcgatttagtagcatactgttgggtttgggacagacttcactctcaccatcagcagactggagcctgaagatttgcagtctatcactgtcagcagtatggtgactcaaagacgttcggccaagggaccaaggtggaaatcaaacgaactgtggctgcaccatctgtcttcatcttcccgccatctgaactagtgcgactgagcgggctggcaaggcgcatagn

SEQ ID NO: 81948 - DNA, 541 bp, Homo sapiens
  misc_feature: GYAE6OF02IQY6J.39.37.D04.1.454.CMB.1.raw
  modified_base (536)..(541): a, c, t, g, unknown or other
  misc_feature (536)..(541): n is a, c, g, or t
tcagtcgcactagtcacgaccggtgctcgatttagtagcatactgttgggtttgggggaggcttggtccagccgggggggtccctgagactctcctgtgcagcctctggattcccctttacgagttattggctgagctgggtccgccaggctccagggagggttggagtgggtggccaacataaagcaagatggaagtcggaaagagtatctggactctgtgaggggccggttcaccatctccagagacaacgccaagaactccgtgcatctgcaaatgaacagtctgagagccgaggacacggctgtttattactgcgcgagagaaggactgggcggtttcgactactggggccagggaaccctggtcaccgtctcctcagcctccaccaagggcccatccggtccttcccctggcccgccctgcctcccaggagccacctcccgagacgcacacgccggcccgtgggcctgccctgggtcaaggctacttcccactagtcgcgactgacggcgggctgggcaaggcgcagtagnnnnnn

SEQ ID NO: 81949 - DNA, 533 bp, Homo sapiens
  misc_feature: GYAE6OF02GH8A7.39.37.D04.1.454.CMB.1.raw
tcagtcgcactagtcacgaccggtgctcgatttagtagcatactgttgggtttggggagagaagagctgctcagttacggacccagagggaaccattggaaaccccagcgcagcttctcttcctcctgctactcctggctcccagagtaccaccggagaaattttggtttgacgtcagttcttccaaggcacccctgtgtttgtctccaggggaaagagccacccttctccgtgcagggccagtcagtttgtcccaacaccttcttagcctggtaccagcagaaacctgccaggctcccaggtctcctcatctatgatacgatccaccagggccacgtggcagtcccagacaggttacagtacggtgttgggtctaggggaacaagacttcacgtctcaccatcgagcagactgacgcctgaagatttagcagtctatcactgtcagcagtatgtgactcaaagtacgttcggaccaaggaccaagtagaatacaaacgacgtgcggctgacacatctgtcttctatctcccg

SEQ ID NO: 81950 - DNA, 261 bp, Homo sapiens
  misc_feature: GYAE6OF02FPG2T.39.37.D04.1.454.CMB.1.raw
  modified_base (253)..(261): a, c, t, g, unknown or other
  misc_feature (253)..(261): n is a, c, g, or t
tcagtcgcactagtcacgaccggtgctcgatttagtagcatactgttgggtcgtgggacagacttcactctcaccatcagcagactggagcctgaaggattttgcagtctatcgactgtcagcagtatggtgactcaaagacgttcgaccaagggaccaaggtggaaatcaaacgaactgtggctgcaccatctgtcttcatcttcccgccatctgaactagtgcgactgagcgggctggcaaggcgcatagnnnnnnnnn

SEQ ID NO: 81951 - DNA, 520 bp, Homo sapiens
  misc_feature: GYAE6OF02FW3R1.39.37.D04.1.454.CMB.1.raw
  modified_base (515)..(520): a, c, t, g, unknown or other
  misc_feature (515)..(520): n is a, c, g, or t
tcagtcgcactagtcacgaccggtgctcgatttagtagcatactgttgggtttggggaggcttggtccagccggggggtccctgagactctcctgtgcagcctctggattcccctttacgagttattggctgagctgggtccgccaggctccagggaagggttggagtgggtggccaacataaagcaagatggaagtcggaaagagtatctggactctgtgaggggccgttcaccatctccagagacaacgccaagaactccgtgcatctgcaaatgaacagtctgagagccgaggacacggctgtttatactgcgcgagagaaggactgggcgtttcgactactggggccagggaaccctggtcaccgtctcctcagcctccaccaagggcccatccggcttcccctggcgccctgctccaggacgcacctccgagagcacacgccgccctgggctgcctggtcaaggactacttccactagtgcgactgagcgggctggcaacggcgcatagnnnnnn

SEQ ID NO: 81952 - DNA, 533 bp, Homo sapiens
  misc_feature: GYAE6OF02G7ED0.39.37.D04.1.454.CMB.1.raw
tcagtcgcactagtcacgaccggtgctcgatttagtagcatactgttgggtttggggagagaagagctgctcagttaggacccagagggaaccatggaaaccccagcgcagcttctcttcctcctgctactctggctcccagataccaccggagaaattttgttgacgcagtctccaggcaccctgtgtttgtctccaggggaaagagccaccctctcctgcagggccagtcagtttgttcccaacaacttcttagcctggtaccagcagaacctggccaggctccaggctcctcatctatgatacatccaccagggccactggcactcccagacaggttcagtggtgttgggtctgggacagacttcactctcaccatcagcagactggacgctgaagtatttgctagtctatcactgtcagcagtatggtgactcaaagacgttcggaccgaagggaccaaggtagaaatacgaaacgtaacgtggtaggactcgactaccgattcgtagttcttctattcccttaccccg

SEQ ID NO: 81953 - DNA, 585 bp, Homo sapiens
  misc_feature: GYAE6OF02IH4HX.39.37.D04.1.454.CMB.1.raw
tcagtcgcactagtcacgaccggtgctcgatttagtagcatactgttgggtttgaggtctcagagaggagccttagccctggactccaaggcctttccacttggtgatcagcactgagcacagaggactcaccatggaattggggctgagctgggttttccttgttggtattttagaaggtgtccagtgtgcggtgcagttggtggagtctgggggaggcttggtccaggccgggggggtccctgagactctcctgtgcagcctctggactttcccctttagagttattggctgagctgggtccgccaggctccgaggggaaggggttggaggtgggtggccaacataaagcaagatggaagtcggaaagagtatcgtggactcgtgtgaggggccgttcaccatctccgagacgacaacgccaaagacctcgtgcatcagacaaatgaacagtctagagacgaccggaggacacggtcttagttttaactacgtgcgacgaggaaggaagggctggggtccggtttacgaaccgttacggtgggggacccaagggggaacccccttgggtacccgacccgtccg

SEQ ID NO: 81954 - DNA, 251 bp, Homo sapiens
  misc_feature: GYAE6OF02GCGJ6.39.37.D04.1.454.CMB.1.raw
  modified_base (248)..(251): a, c, t, g, unknown or other
  misc_feature (248)..(251): n is a, c, g, or t
tcagtcgcactagtcacgaccggtgctcgatttagtagcatactgttgggtttgggacagacttcactctcaccatcagcagactggagcctgaagatttgcagtctatcactgtcagcagtatggtgactcaaagacgttcggccaagggaccaaggtggaaatcaaacgaactgtggctgcaccatctgtcttcatcttcccgcatctgaactagtgcgactgagcgggctggcaaggcgcatagnnnn

SEQ ID NO: 81955 - DNA, 254 bp, Homo sapiens
  misc_feature: GYAE6OF02FWW8E.39.37.D04.1.454.CMB.1.raw
  modified_base (250)..(254): a, c, t, g, unknown or other
  misc_feature (250)..(254): n is a, c, g, or t
tcagtcgcactagtcacgaccggtgctcgatttagtagcatactgttgggtctgggacagacttcactctcaccatcagcagactggagcctgaagattttgcagtctatcactgtcagcagtatggtgactcaaagacgttcggccaagggaccaaggtggaaatcaaacgaactgtggctgcaccatctgtcttcatcttcccgccatctgaactagtgcgactgagcgggctggcaaggcgcatagnnnnn

SEQ ID NO: 81956 - DNA, 518 bp, Homo sapiens
  misc_feature: GYAE6OF02HTFF7.39.37.D04.1.454.CMB.1.raw
  modified_base (513)..(518): a, c, t, g, unknown or other
  misc_feature (513)..(518): n is a, c, g, or t
tcagtcgcactagtcacgaccggtgctcgatttagtagcatactgttgggtttgggggaagaggaagactgacggtccctgagactctcctgtgcagcctctggattcccctttacgagttattggctgagctgggtccgccaggctccagggaaggggttggagtgggtggccaacataaagcaagatggaagtcggaaagagtatctggactctgtgaggggccggttcaccatctccagagacaacgccaagaactccgtgcatctgcaaatgaacagtctgagagccgaggacacggctgtttattactgcgcgagagaaggactgggcgtttcgactactggggccaggggaaccctggtcaccgtctcctcagcctcacaagggcccatcggtctcccctgccgccctgctccaggacgcacctccgagacgcacacgccggccctgggctgcctggtcaaggctacttccactagtgcgactgagcgggctggcaaggcgcatagnnnnnn

SEQ ID NO: 81957 - DNA, 536 bp, Homo sapiens
  misc_feature: GYAE6OF02I08VS.39.37.D04.1.454.CMB.1.raw
  modified_base (207)..(207): a, c, t, g, unknown or other
  misc_feature (207)..(207): n is a, c, g, or t
  modified_base (244)..(244): a, c, t, g, unknown or other
  misc_feature (244)..(244): n is a, c, g, or t
tcagtcgcactagtcacgaccggtgctcgatttagtagcatactgttgggtttggggagagaagagctgctcagttaggacccagagggaaccatggaaaccccagcgcagcttctcttcctcctgctactctggctcccagataccaccggagaaattttgttgacgcagtctccaggcaccctgtgtttgtctccaggggaaagngccacctctcctgcagggccagtcagtttgtcccaanaacttcttagcctggtaccagcagaaacctggccaggctcccaggctcctcatctatgatacatccaccagggccactggcatcccagacaggttcagtggtgttgggctgggacagacttcactctcaccatcagcagactggagcctgaagtattttgcgtagtctatcactgtcagcagtatggtgtactcgaaagacgttcggaccgaagggaccgaagggtagaatacgaaacgtaacgtggtaggaccgtgaccacgactcgttcgtcttactactccgttacccg

SEQ ID NO: 81958 - DNA, 600 bp, Homo sapiens
  misc_feature: GYAE6OF02JY9D6.39.37.D04.1.454.CMB.1.raw
  modified_base (208)..(208): a, c, t, g, unknown or other
  misc_feature (208)..(208): n is a, c, g, or t
  modified_base (374)..(374): a, c, t, g, unknown or other
  misc_feature (374)..(374): n is a, c, g, or t
tcagtcgcactagtcacgaccggtgctcgatttagtagcatactgttgggtttggggagagaagagctgctcagttaggacccagagggaaccatggaaaccccagcgcagcttctcttcctcctgctactctggctcccagataccaccggagaaatttttgttgacgcagtctccaggcaccctgtgtttgtctccaggggaaagngccaccctctcctgcagggccagtcagtttgtcccaacacttcttagcctggtaccagcagaacctggccaggctcccaggctcctcatctatgatacatcccaaccgagggccacgtggaccatccccaagacctaggttcaggttcggtgttgggtctgggacngacttcactctcaccatcagcagactggacgcctagaagtatttgacgtagtctactactactgtcagcgtagtacgttggtgtaccgtacgaaacgtacggttacggaccgtaacgggaaccgtaagggtacggaaactacgaaacggtaacgtacggttacggacgtacggacctaaccgtaacgttccgttacgttacctttaccgtacttcccgttaccccg

SEQ ID NO: 81959 - DNA, 631 bp, Homo sapiens
  misc_feature: GYAE6OF02I4MAK.39.37.D04.1.454.CMB.1.raw
  modified_base (619)..(619): a, c, t, g, unknown or other
  misc_feature (619)..(619): n is a, c, g, or t
  modified_base (631)..(631): a, c, t, g, unknown or other
  misc_feature (631)..(631): n is a, c, g, or t
tcagtcgcactagtcacgaccggtgctcgatttagtagcatactgttgggtttgggggaagaggaagactgacggtccctgagactctcctgtgcagcctctggattcccctttacgagttattggctgagctgggtccgccaggctccagggaagggttggagtgggtggccaacataaagcaagatggaagtcggaaagagtatctggactctgtgagggccgttcaccatctcagagacaacgccaagaactccgtgcatctgacaaaatgaacagtctagagagccgaggacacggcttgtttatactgcgcgagagaaggctgggcgtttacgactacgtgggaccaagggaccctgggtaccaccgtctcctcgacgtccctaccgaaccgaacgggcccctagttcccgggttccttcccccgtcggcccgtccctcgcctcccgaggacgccgaccctccgagacgccacgacggcccggcccgtggcctcgccgtacggtaccgaaacgggtacccttaccgttacccacgttaacgtccggtaccgaaccgttcggaaccgggtccgggtactcggggaccgtaaacgggcccgtacgtaacgtacggngcgtacgcacgn

SEQ ID NO: 81960 - DNA, 571 bp, Homo sapiens
  misc_feature: GYAE6OF02IJ1Y5.39.37.D04.1.454.CMB.1.raw
  modified_base (207)..(207): a, c, t, g, unknown or other
  misc_feature (207)..(207): n is a, c, g, or t
  modified_base (247)..(247): a, c, t, g, unknown or other
  misc_feature (247)..(247): n is a, c, g, or t
  modified_base (396)..(396): a, c, t, g, unknown or other
  misc_feature (396)..(396): n is a, c, g, or t
  modified_base (445)..(445): a, c, t, g, unknown or other
  misc_feature (445)..(445): n is a, c, g, or t
tcagtcgcactagtcacgaccggtgctcgatttagtagcatactgttgggtttggggagagaagagctgctcagttaggacccagagggaaccatggaaaccccagcgcagcttctcttcctctgctactctggctcccagataccaccggagaaattttgttgacgcagtctccaggcaccctgtgtttgtctccgaggggaaagngccaccctctcctgcagggccagtctagtttgttcccaanaacttcttagcctggtaccagcagaaacctggccaggcctccaggcctcctcatctatgatacatccaccgagggccagtggcactcccagacaggttcagtggtgttggctgggctagacttcactcacaccatcagcagactggacncgtagaagttatttgctagtctatctacttgtacagctagtagtggtanactactaaacgtacgttacggaccgtaaacgggacgtaaggtagtaaatacgaaacggtaacgtggtacggacgtagactaaccgtacgttaccgttagttacctttactacgttcccttaccccg

SEQ ID NO: 81961 - DNA, 523 bp, Homo sapiens
  misc_feature: GYAE6OF02FRJPF.39.37.D04.1.454.CMB.1.raw
  modified_base (513)..(513): a, c, t, g, unknown or other
  misc_feature (513)..(513): n is a, c, g, or t
tcagtcgcactagtcacgaccggtgctcgatttagtagcatactgttgggtttggggagagaagagctgctcagttaggacccagagggaaccatggaaaccccagcgcagcttctcttcctcctgctactctggctcccagataccaccggagaaatttttgttgacgcagtctccaggcaccctgtgtttgtctccaggggaaagagcccaccctctcctgcagggccagtcagtttgtcccaacaacttcttagcctggtaccagcagaaacctggccaggctcccaggctcctcatctatgatacatccaccagggccactggcatcccagacaggttcagtggtgttgggtctgggacagacttcactctcaccatcagcagcctgcagtctgaagtattttgtactttattactgtcagcagtatgtactacgtggcctcactacttttggccgagggaccgtaggttggagtatacaacgtaacgtgtggtctgaccacctatctntcttcatccc

SEQ ID NO: 81962 - DNA, 255 bp, Homo sapiens
  misc_feature: GYAE6OF02FXA91.39.37.D04.1.454.CMB.1.raw
  modified_base (249)..(255): a, c, t, g, unknown or other
  misc_feature (249)..(255): n is a, c, g, or t
tcagtcgcactagtcacgaccggtgctcgatttagtagcatactgttgggtctgggacagacttcactctcaccatcagcagactggagcctgaagattttgcagtctatcactgtcagcagtatggtgactcaaagacgttcggccaagggaccaaggtggaaatcaaacgaactgtggctgcaccatctgtcttcatcttccgccatctgaactagtgcgactgagcgggctggcaaggcgcatagnnnnnnn

SEQ ID NO: 81963 - DNA, 529 bp, Homo sapiens
  misc_feature: GYAE6OF02FWHOQ.39.37.D04.1.454.CMB.1.raw
  modified_base (206)..(206): a, c, t, g, unknown or other
  misc_feature (206)..(206): n is a, c, g, or t
  modified_base (396)..(396): a, c, t, g, unknown or other
  misc_feature (396)..(396): n is a, c, g, or t
  modified_base (437)..(437): a, c, t, g, unknown or other
  misc_feature (437)..(437): n is a, c, g, or t
tcagtcgcactagtcacgaccggtgctcgatttagtagcatactgttgggtttggggagagaagagctgctcagttaggacccagagggaaccatggaaaccccagcgcagcttctcttcctcctgctactctggctcccagataccaccggagaaattttgttgacgcagtctccaggcaccctgtgtttgtctccaggggaaanagccaccctctcctgcagggccagtcagtttgttcccaacaacttcttagcctggtaccagcagaaacctggccaggctcccaggctcctcatccctatgatacatccaccagggccactggcatcccagacaggttcagtggtgttgggtctgggacagacttcactctcaccatcagcagactggacncctgaagtatttgctagtctatcactgtcagcagtatggtnactcgaaagcgttcggaccaagggaccaaggtaggaatacgaaacgtaacgtggtagacgtagacgaccatcgtgtacttcactcttacccg

SEQ ID NO: 81964 - DNA, 637 bp, Homo sapiens
  misc_feature: GYAE6OF02HCHDL.39.37.D04.1.454.CMB.1.raw
  modified_base (629)..(629): a, c, t, g, unknown or other
  misc_feature (629)..(629): n is a, c, g, or t
  modified_base (631)..(631): a, c, t, g, unknown or other
  misc_feature (631)..(631): n is a, c, g, or t
  modified_base (634)..(635): a, c, t, g, unknown or other
  misc_feature (634)..(635): n is a, c, g, or t
tcagtcgcactagtcacgaccggtgctcgatttagtagcatactgttgggtttggggggaagaggaagactgacggtccctgagactctcctgtgcagcctctggattcccctttacgagttattggctgagctgggtccgccaggctccagggaaggggttggagtgggtggccaaacataaaagcaagatggaagtcggaaagagtatctggactctgtgaggggccgttcaccatctcagagacaacgccaagaacctccgtgcatctgcaaatgaacagtctgagagccgaggacacggctgtttattactgcgcgagagaaggactgggcgtttcgactacgtcggggccagggaaccctggtcaccgtctcctcacgcctaccaccgaacgggcccagttccggtcccttcccccgtggcccgcccgtcgtcctccgacggacgccaacccgtcccggaaggacgaccgacgacggcccgggccccgtcggggccgtcggcccgttcgggtaccgaaacgggtacccttaacccgtttcccgaaccgttaggtccggtaccgaaccgtcgggacgggccggggtccgtcgggaccgaacgggtccgacgtaacgttacggacngngcnncg

SEQ ID NO: 81965 - DNA, 578 bp, Homo sapiens
  misc_feature: GYAE6OF02I0QST.39.37.D04.1.454.CMB.1.raw
  modified_base (377)..(377): a, c, t, g, unknown or other
  misc_feature (377)..(377): n is a, c, g, or t
  modified_base (506)..(506): a, c, t, g, unknown or other
  misc_feature (506)..(506): n is a, c, g, or t
  modified_base (511)..(511): a, c, t, g, unknown or other
  misc_feature (511)..(511): n is a, c, g, or t
tcagtcgcactagtcacgaccggtgctcgatttagtagcatactgttgggtttgaggtctcagagaggagccttagccctggactccaaggcctttccacttggtgatcagcactgagcacagaggactcaccatggaattggggctgagctgggttttccttgttggtattttagaaggtgtccagtgtgcggtgcagttggtggagtcgtgggggaggcttggtccaggccggggggtccctgagactctccgtgtgcagcctctggacttcccttacgagttattggctgagctgggtccgccaggcctccgagggaaggggttggaggtgggtcggccaacagtaaagcaagataggaagtcggaaagagtancgtaggactcgtgtggagggtccgttacaccgagtcctaccagacgacaacgaccaaagactcgagctatcgtagactaaagcgaacagtctagagacgaccggagaccacggtcttagtttactacgngacgngagagacggtcgtcgggtcgttacgacgtacggcgggaccgaacgggtaccctggtaccaccgtccg

SEQ ID NO: 81966 - DNA, 553 bp, Homo sapiens
  misc_feature: GYAE6OF02I9KPT.39.37.D04.1.454.CMB.1.raw
  modified_base (206)..(206): a, c, t, g, unknown or other
  misc_feature (206)..(206): n is a, c, g, or t
tcagtcgcactagtcacgaccggtgctcgatttagtagcatactgttgggtttggggagagaagagctgctcagttaggacccagagggaaccatggaaaccccagcgcagcttctcttcctcctgctactctggctcccagataccaccggagaaattttgttgacgcagtctccaggcaccctgtgtttgtctccaggggaaangccaccctctcctgcagggccagtcagtttgttcccaacacttcttagcctggtaccagcagaaacctggccaggctccaggctcctcatctatgatacatccaccagggccatggcactcccagacaggttcagtggtgttgggtctgggacagtacttcactctcacctatcagcagactggacgcctagaagtatttgctagtctatcacttcgtcacgctagtagtggtgactacgaacgtacgtcggaccgaacgggacgaagggtagaactacgaaacgtacgtaggtcggactacgactaccgtacgttacgtcgttacttacgtacttcccttaccccg

SEQ ID NO: 81967 - DNA, 613 bp, Homo sapiens
  misc_feature: GYAE6OF02IAYRB.39.37.D04.1.454.CMB.1.raw
tcagtcgcactagtcacgaccggtgctcgatttagtagcatactgttgggtttggggagagaagagctgctcagttaggacccagagggaaccatggaaacccagcgcagcttctcttcctcctgctactctggctcccagataccaccggagaaattttgtgacgcagtctccaggcaccctgtgtttgtctcgaggggaaagcgcccaccctctcctgcgagggccagtctagtttcgtcccaaatacttcttagcctggtaccagcagaaacctggccaggctccaggctcctcatctatgactacatcccacgagggccacgtggcactcccagactaggttcaggttggtgttgggtcgtagggacagtacttcaccttcgtccaccatccgagcaagacgtggacgtcctaggaacgttattttcgactacgttctatccgtaacttgtacacgtactagtagtggtctaacttacgtaaaggtccggttacggaccgtaagggaacctaagggtaacggaaactacgtaaacggtacgttagggtacggtacgtcgtaacctaccgtacgttcgttacgttaccttacgtaccttcccgttacccg

SEQ ID NO: 81968 - DNA, 575 bp, Homo sapiens
  misc_feature: GYAE6OF02IK0IU.39.37.D04.1.454.CMB.1.raw
  modified_base (207)..(207): a, c, t, g, unknown or other
  misc_feature (207)..(207): n is a, c, g, or t
  modified_base (292)..(292): a, c, t, g, unknown or other
  misc_feature (292)..(292): n is a, c, g, or t
tcagtcgcactagtcacgaccggtgctcgatttagtagcatactgttgggtttggggagagaagagctgctcagttaggacccagagggaaccatggaaaccccagcgcagcttctcttcctcctgctactctggctcccagataccaccggagaaatttttgttgacgcagtctccaggcaccctgtgtttgtctccaggggaaanagccaccctctcctgcagggccagtcagtttgtcccaaacacttcttagcctggtaccagcagaactggccagctccagctcctnatctatgatacatccaccgagggccatggcactcccagactaggttcagtggtgttggtctagggacagtacttcactcacgacatcgacgctagacgtggacgcgtagaagttattttgactagtctatctactgtacagctagtagtggtagtacgtacgaaacgtaccggttacggaccgtaaacgggaaccgtaaagggtagtaaacgtacgaaacgtaacgtggtacggtacgtacgaccaacctacgtacgttcgtacttactacttccgtaccccg

SEQ ID NO: 81969 - DNA, 618 bp, Homo sapiens
  misc_feature: GYAE6OF02IKDQQ.39.37.D04.1.454.CMB.1.raw
  modified_base (209)..(209): a, c, t, g, unknown or other
  misc_feature (209)..(209): n is a, c, g, or t
  modified_base (237)..(237): a, c, t, g, unknown or other
  misc_feature (237)..(237): n is a, c, g, or t
  modified_base (461)..(461): a, c, t, g, unknown or other
  misc_feature (461)..(461): n is a, c, g, or t
tcagtcgcactagtcacgaccggtgctcgatttagtagcatactgttgggtttgggggaggcttggtccagccgggggggtccctgagactctcctgtgcagcctctggattcccctttacgagtttattggctgagctgggtccgccaggctccagggaaggggttggagtgggtggccaacataaagcaagatggaagtcggaaagngtatctggactctgtgaggggccggttnaccatctccagagacaacgccaagaacctccgtgcatctagacaaatgaacagtctgagagcgaggacacggcctatattatgtgacgtaagtggtggggagtggggactacgtcgtggtcgttttgacttacggtcggggaccaggggaccgtcccgtggtccgaccgttcctccgtcacgtccctaccgaccgaagggccctagtcccggtccttcccccgnggcccgtccctcgcctaccgaggacgccacccgtcgacgacgccaacgcggccggtcccgtacgggcttccggaccgttcggtacgaaacggttaccctacttaccgacgttacgtcggcgtacgtggaacggcggcgtggacgaggcagtacgagc

SEQ ID NO: 81970 - DNA, 640 bp, Homo sapiens
  misc_feature: GYAE6OF02HG5Q9.39.37.D04.1.454.CMB.1.raw
tcagtcgcactagtcacgaccggtgctcgatttagtagcatactgttgggtttgaggtctcagagaggagccttagccctggactccaaggcctttccacttggtgatcagcactgagcacagaggactcaccatggaattggggctgagctgggttttccttgttggtattttagaggtgtccagtgtgcggtgcagttggtggagtcgtgggggaggcttggtccgaggccgggggggtccctgagactctcctgtgcagcctcgtggtactttcccctttacgagttattggctgagcgtgggtcccgccgaggcctccgaggggtaaggggttggaggtgggtggaccaaacataaagcaagagtaggaagtacggaaagagtatcgtaggactcgtggtaggacgggggtcccggttacaccacttccgtaccgaagacgaccaaaccgaccgaaaagaacccgtccgtagacctatccgtagaacctaaaatcgaaaccagttctaggaagaacggaccggaagggaccacggtctttagttttaactacgtgccgagaggagaacgggtcgtggggtcgtttacgacgttacgggcggggacccacgggtacccctggtacccgcccgttccg

SEQ ID NO: 81971 - DNA, 534 bp, Homo sapiens
  misc_feature: GYAE6OF02F8XF3.39.37.D04.1.454.CMB.1.raw
  modified_base (207)..(207): a, c, t, g, unknown or other
  misc_feature (207)..(207): n is a, c, g, or t
  modified_base (245)..(245): a, c, t, g, unknown or other
  misc_feature (245)..(245): n is a, c, g, or t
  modified_base (347)..(347): a, c, t, g, unknown or other
  misc_feature (347)..(347): n is a, c, g, or t
  modified_base (391)..(391): a, c, t, g, unknown or other
  misc_feature (391)..(391): n is a, c, g, or t
  modified_base (430)..(430): a, c, t, g, unknown or other
  misc_feature (430)..(430): n is a, c, g, or t
tcagtcgcactagtcacgaccggtgctcgatttagtagcatactgttgggtttggggagagaagagctgctcagttaggacccagagggaaccatggaaaccccagcgcagcttctcttcctcctgctactctggctcccagataccaccggagaaatttttgttgacgcagtctccaggcaccctgtgtttgtctccaggggaaangccaccctctcctgcagggccagtcagtttgtcccaanacttcttagcctggtaccagcagaaacctggccaggctcccaggctcctcatctatgatacatccacagggcccactggcatcccagacaggttcagttggngttgggctgggacagcttcactctcaccatcagcagactggacnctgaagtatttgcagtctatcactgtcagcagtatggtnactacaaagtacgtacggaccgaaagggaccgaaggtagaaatcgaaaacgtaacgtggtacggactaggacaccgtatactgttcctactactccttaccccg

SEQ ID NO: 81972 - DNA, 554 bp, Homo sapiens
  misc_feature: GYAE6OF02IMW7A.39.37.D04.1.454.CMB.1.raw
  modified_base (416)..(416): a, c, t, g, unknown or other
  misc_feature (416)..(416): n is a, c, g, or t
tcagtcgcactagtcacgaccggtgctcgatttagtagcatactgttgggtttgggggagagaagagctgctcagttaggacccagagggaaccatggaaaccccagcgcagcttctcttcctcctgctactctggctcccagataccaccggagaaattttgttgacgcagtctccaggcaccctgtgtttgtctccaggggaaagagccaccctctcctgcagggccagtcagtttcgtcccaataactttcttagcctggtaccagcagaaacctggccaggcctacccgaggctcctcatctatgatacatccacgagggccactcggcatcccagacaggttcagtggtgttcgggtctgggacagtacttcactctcacatcagcagacgtggacgctagaagtatttgntagtctatcactgacagatagtagtgtgactacgaaacgtcgtacgacgaacgggacaaagggtagaaactacgaaacggtacgtggtacgctacgacaaccgtactcgttacgttcctacgtacttccgttaccccg

SEQ ID NO: 81973 - DNA, 531 bp, Homo sapiens
  misc_feature: GYAE6OF02HWHY1.39.37.D04.1.454.CMB.1.raw
  modified_base (206)..(206): a, c, t, g, unknown or other
  misc_feature (206)..(206): n is a, c, g, or t
tcagtcgcactagtcacgaccggtgctcgatttagtagcatactgttgggtttggggagagaagagctgctcagttaggacccagagggaaccatggaaaccccagcgcagcttctcttcctcctgctactctggctcccagataccaccggagaaattttgttgacgcagtctccaggcaccctgtgtttgtctccaggggaaanagccaccctctcctgcagggccagtcagtttgttcccaacaacttcttagcctggtaccagcagaaacctggccaggctcccaggctcctcatctatgatacatccacagggccactggcatcccagacaggttcagtggtgttgggtctgggacagacttcactctcacatcagcagactgagctagaatatttgcagtctatcatgtcagcagtatggtgactcgaaagtcgttacggaccgaaagggaccgaaagggtagaaataccgaaaacgaactggtacgctaggacaaccattctcgtacttctacgtcttaccccg

SEQ ID NO: 81974 - DNA, 690 bp, Homo sapiens
  misc_feature: GYAE6OF02FV0QT.39.37.D04.1.454.CMB.1.raw
  modified_base (467)..(467): a, c, t, g, unknown or other
  misc_feature (467)..(467): n is a, c, g, or t
tcagtcgcactagtcacgaccggtgctcgatttagtagcatactgttgggtttgaggtctcagagaggagccttagccctggactccaaggcctttccacttggtgatcagcactgagcacagaggactcaccatggaattggggctgagctgggttttccttgttggtattttagaaggtgtccagtgtgcggtgcagttggtggagtcgtgggggaggcttgggtccaggccgggggggtccctggagactctcctgtgcagcctctggactttcccctttacgagttattggctggagctggggtccgccaggcctccgaggggtaaggggttggaggtggggtcggccaacataaagcaaaggatagggaagtcggaaaagagtatcgtggactcgtggtcggacggggtccgttacaccgtatcctcaaggacgacaaaccgcccaaaagaccctccggtanacctatccgtggaaccaaagtcgaaccagttcctaggacgacggccggaaagggacccaacgggtctttaggtttaaacttcggtggaccggtacggtagggaacggtaaacggggtcgtacggggggtacccggttttaaggaacccggttaacgggtccgggggggaaccctaaccggggggttaaacccctcggggttacccgtaaccccggtttccccg

SEQ ID NO: 81975 - DNA, 692 bp, Homo sapiens
  misc_feature: GYAE6OF02JB9FS.39.37.D04.1.454.CMB.1.raw
  modified_base (443)..(443): a, c, t, g, unknown or other
  misc_feature (443)..(443): n is a, c, g, or t
  modified_base (473)..(473): a, c, t, g, unknown or other
  misc_feature (473)..(473): n is a, c, g, or t
tcagtcgcactagtcacgaccggtgctcgatttagtagcatactgttgggtttgaggtctcagagaggagccttagccctggactccaaggcctttccacttggtgatcagcactgagcacagaggactcaccatggaattgggctgagctggtttctgttgtatttagagtgtcagtgtgcgtgcagttggtgagtcgtgggggagcttggtccgaggccggggggtccctggacgacttccgtccgtggtcgcgacgtcccttcgtaggtaacttttccccccgtttaagaggttttattcggtcttggagtccgtggggttcccgccgaggtcctccgaaggggtaacggggttggaggttcgggtacggaccgaaacgaagttaaacgcgaaaggtagtagggaaacgtacggaaagtagtagtacgtaggtactacgnggttaggaacggggtccgtttcgaaccgtntacgtaccaaggacgtaaaccaacgacccgtaaaggacccgtcgtaacgctagtactagaacaaacgttcgaaacgtcgtactaggacgtacggaccgagaaccacggtccttagtttactacgtgaccgacgtacgaaggtacggtaacgttcgggaccggttttaacgaccgtttaggcggggtacaccgggacccgtttcgaccgtaccccgttcg

SEQ ID NO: 81976 - DNA, 562 bp, Homo sapiens
  misc_feature: GYAE6OF02GO2F1.39.37.D04.1.454.CMB.1.raw
  modified_base (206)..(206): a, c, t, g, unknown or other
  misc_feature (206)..(206): n is a, c, g, or t
tcagtcgcactagtcacgaccggtgctcgatttagtagcatactgttgggtttggggagagaagagctgctcagttaggacccagagggaaccatggaaaccccagcgcagcttctcttcctcctgctactctggctcccagataccaccggagaaattttgttgacgcagtctccaggcaccctgtgtttgtctccaggggaaanagccaccctctcctgcagggccagtcagtttgtcccaacaacttcttagcctggtaccagcagaacctggccaggctcccaggcctcctcatctatgatacatccaccgagggccacgtggcactcccagaccaggttcaggtggtgttgggtctgggacagtcttcactctacacctatcagcagactggacgcgtagaagtatttgctagtctatctactgtcacgtctagtagtggtagactacgaacgtacgttacggaccgaaggacgaaggtacgaaagtacgaaacgtaacgtaggtacggtacgtacgacacgtacgttccgtagttacttacgtacttccgtacccg

SEQ ID NO: 81977 - DNA, 759 bp, Homo sapiens
  misc_feature: GYAE6OF02J1P7L.39.37.D04.1.454.CMB.1.raw
tcagtcgcactagtcacgaccggtgctcgatttagtagcatactgttgggtttggggagagaagagctgctcagttaggacccagagggaaccatggaaaccccagcgcagcttctcttcctcctgctactctggctcccagataccaccggagaaattttgtgacgcagtctccaggcaccctgtgtttgtcctccgaggggaaagcgccaccctctcctagccgagggccagtcagtttcgtcccaacaacttctagtcctggtaccagcacgaaacctcgacgacgctcccgacggctcctcgtactctacgtagactaccgactaccctaaccgacgggtacccaccgtacggacccgaacctcccgaacgtcctaacgggttcgaacggttggtggtttacggggtacgtaggggtaaccacgtaccgttccaacggttcctaacacccgtaatccgacggacgtacggaccgttacggacggtaccgtacgtaacggttagttttacgaccgttaggtacttaccacgttaactacggttaccgagtaccgtaagttacggttaggtacgtaccgtaacgtaaagggttaccgttaccgggtaacgtaaaccggggtaaaccggtaacgggtaaggtaaccggtaaccgaaacggttaaccggttaaggtaccgtacgggtaaccgttaacccgaacggttaccgttacggttaccgtttccgtttaccttaccggttaccctttaacccccg

SEQ ID NO: 81978 - DNA, 663 bp, Homo sapiens
  misc_feature: GYAE6OF02HANHS.39.37.D04.1.454.CMB.1.raw
tcagtcgcactagtcacgaccggtgctcgatttagtagcatactgttgggtttgaggtctcagagaggagccttagccctggactccaaggcctttccacttggtgatcagcactgagcacagaggactcaccatggaattggggctgagctgggttttccttgttggtattttagaaggtgtccagtgtgcggtgcagttggtggagtcgtgggggaggcttgggtccaggcccgggggggtccctggagactctcctgtgcagcctctggattcccctttacgagtttattggctgagctgggtccgccaggctccgaggggaggggttggaggtggggtggccaacataaagcgaagagtggaagtacggaaagagtatcgtaggactcgtgtaggcggggccgttacacactctaccgagacgacgaaacgcaaacgaacctccgtagcactcgtacgactaaacgtcgaaactagtcgtagacggtaacgacccgggaagggtaccaacgggtcttaggttttttaaacaccgttaggaccgcgggaagtacgggaaacggttcgggtaggggtaccggttttaccggaccgtttacgggtacgggggcccgtaaaccgggggtacccccgttgggttacccgtaacccggttccccg

SEQ ID NO: 81979 - DNA, 252 bp, Homo sapiens
  misc_feature: GYAE6OF02IWCQU.39.37.D04.1.454.CMB.1.raw
  modified_base (249)..(252): a, c, t, g, unknown or other
  misc_feature (249)..(252): n is a, c, g, or t
tcagtcgcactagtcacgaccggtgctcgatttagtagcatactgttgggtctgggacagacttcactctcaccatcagcagactggagcctgaagatttgcagtctatcactgtcagcagtatggtgactcaaagacgttcggccaagggaccaaggtggaaatcaaacgaactgtggctgcaccatctgtcttcatcttcccgcatctgaactagtgcgactgagcgggctggcaaaggcgcatagnnnn

SEQ ID NO: 81980 - DNA, 605 bp, Homo sapiens
  misc_feature: GYAE6OF02GXD3U.39.37.D04.1.454.CMB.1.raw
  modified_base (598)..(598): a, c, t, g, unknown or other
  misc_feature (598)..(598): n is a, c, g, or t
  modified_base (602)..(603): a, c, t, g, unknown or other
  misc_feature (602)..(603): n is a, c, g, or t
tcagtcgcactagtcacgaccggtgctcgatttagtagcatactgttgggtttggggggaagaggaagactgacggtccctgagactctcctgtgcagcctctggattcccctttacgagttattggctgagctgggtccgccaggctccagggaaggggttggagtgggtggccaacataaagcaaagatggaagtcggaaagagtatctggactctgtgaggggccgttcaccatctccagagacaacgccaaagactccgtgcatctgacaaatgaacagtctgagagccgaggacacggctgtttatactgcgcgagagaggactgggcgtttcgactacgtcgggccacggggaaccctggtccaccgtctcctcacgcctaccaccgaacggccctagtccggtccttcccccgtggcccgccctcgccctccgacggacgccacccgtccggagacgccgacgacggccggcccgtgggcctcggccgtacggtacctaacggtaccttaccttacctaaccgttaggtcggaccgtactacgggacggtccgggtccgtacgggacgaacgggtccgtagacgtaggccngcgnncg

SEQ ID NO: 81981 - DNA, 876 bp, Homo sapiens
  misc_feature: GYAE6OF02H9GNH.39.37.D04.1.454.CMB.1.raw
tcagtcgcactagtcacgaccggtgctcgatttagtagcatactgttgggtttggggagagaagagctgctcagttaggacccagagggaaccatggaaacccagcgcagcttctcttcctcctgctactctggctcccagactaccaccggagtaaattttgttgaccgcagtctccgagcctaccctgttgtttcgtcctcgaaggggaaacgacgtcccacccgtctccgtgacgacgggccagttctaacggttttcgtacccaaactaactttaccgttacgtcccgttaggtacccgaagtaccgtaacggtaaaacccgttcgggaccccaacggtcccgttacccccgaacggtccctttaccgttaccctacttaccgttaagttacggtaaccttacctaaccttccccggaaaccgacgggcccctaaccgtcggacctaacgtcccgaacgtaacgtacgggtttcgaggttacggttggttcggggttaccgacggggtaaccacgttaccgttaccgtacgtttccgtaccgtaaccgtacgtttaccgaacggttacggaaacggttaccgtttacggggaaccgttaccggtttaaaggtaacggtttaacgtttttcggaacgttaaccgttcgtttaactaaccggttacttacggtacgtaacgtacgttacggtaagttcgggtaacctaacgtaacgtaaacccgggtacgtaccgggtaaacccggaaagggtaaaccgacgggttaacgaaaccgttaacaaacgggtacctacgggttaccgcgttaaaccggaccaacggttacgtttaccggaccgttttaccgtaccgttaccgttacccgttaccccg

SEQ ID NO: 81982 - DNA, 708 bp, Homo sapiens
  misc_feature: GYAE6OF02GPGWJ.39.37.D04.1.454.CMB.1.raw
  modified_base (505)..(505): a, c, t, g, unknown or other
  misc_feature (505)..(505): n is a, c, g, or t
tcagtcgcactagtcacgaccggtgctcgatttagtagcatactgttgggtttgaggtctcagagaggagccttagccctggactccaaggcctttccacttggtgatcagcactgagcacagaggactcaccatggaattggggctgaactgggttttccttgttggtattttagaaggtgtccagtgtgcggtgctagttggtggagtcgtgggggaggcttggtccgaggccgggggggtccctgagactctcctgtgcagcctcgtggtactttcccctttacgagttagttggctgagcgtcgggtcccgccgacggcctaccggaagggggtaagggggtttgggagggttgggggtacggaccaaacgaagtaaaaggacgaaaaggaaagggaaaggtacgggaaaagtagtaagtcgtaggacttcgtggtggacgggggtcccgttacgacctatcctaccgaagacgaaccaaccgaccaaagaccgtccgganacctatcgtagacaaagtacgaactagtcagacggaccgccggaaggaccgacggtctttaggttttaactacgtcggaccgtaacggaggaacggtacgggtacggttcgggggttacggtttaccgaaccggttaccgggtacggggaccccgtaacggggtaccccgttgggtacccctacccggtttccacccgtaccg

SEQ ID NO: 81983 - DNA, 603 bp, Homo sapiens
  misc_feature: GYAE6OF02IFXYW.39.37.D04.1.454.CMB.1.raw
  modified_base (205)..(205): a, c, t, g, unknown or other
  misc_feature (205)..(205): n is a, c, g, or t
  modified_base (385)..(385): a, c, t, g, unknown or other
  misc_feature (385)..(385): n is a, c, g, or t
tcagtcgcactagtcacgaccggtgctcgatttagtagcatactgttgggtttggggagagaagagctgctcagttaggacccagagggaaccatggaaaccccagcgcagcttctcttcctcctgctactctggctccagataccaccggagaaattttgttgacgcagtctccagcaccctgtgtttgtctccaggggaaagngccaccctctcctgcagggccagtcagtttcgttcccaactaacttcttacgcctggtaccagcagaaacctggccaggcctccgaggcctcctcatctatgatcatccaccgaggccacgtcgcactacccagacaggttcagtggtgtgggtctgggacagtacttcactctcaccancgagcagacgtaggacgctagtaagtagtttcgactacgttactcgtactacttcgtacgtacgtcgtaagtacgtacggttgtaaccgttacgaaacgttaccggtaccgggaacccgtaaacgggaaccgtaaacggtacggtaaacgtacgaaacgtaacgtaggtcggtacgtagaccaccgtacgttcgtacgtacttctactcccttacccg

SEQ ID NO: 81984 - DNA, 261 bp, Homo sapiens
  misc_feature: GYAE6OF02FV4TK.39.37.D04.1.454.CMB.1.raw
  modified_base (253)..(261): a, c, t, g, unknown or other
  misc_feature (253)..(261): n is a, c, g, or t
tcagtcgcactagtcacgaccggtgctcgatttagtagcatactgttgggtctgggacagacttcactctcaccatcagcagactggagcctgaagattttgcagtctatcactgtcagcagtatggtgactcaaagacgttcggccaaagggaccaaggtggaaatcaaacgaactgtggctgcaccatctgtcttcattcttcccgccatctagaactagtcgcgactgagcggctggcaaggcgcatagnnnnnnnnn

SEQ ID NO: 81985 - DNA, 708 bp, Homo sapiens
  misc_feature: GYAE6OF02HIQL3.39.37.D04.1.454.CMB.1.raw
  modified_base (574)..(574): a, c, t, g, unknown or other
  misc_feature (574)..(574): n is a, c, g, or t
tcagtcgcactagtcacgaccggtgctcgatttagtagcatactgttgggtttgaggtctcagagaggagccttagccctggactccaaggcctttccacttggtgatcagcactgagcacagaggactcaccatggaattggggctgagctgggttttccttgttggtattttagaaggtgtccagtgtgcggtgcagttggtggagtcgtggggggaggcttgggtccaggcccgggggggtccctgaggactctcctgtgcagcctctggacttcccctttacgagttattggctgagctgggtccgccaggctccgaggggaaggggttggaggtggggtggacccaacgaataaaggcaaagatagggaagtacggaaagagtatcgtaggactcgtggtggtacgggggccgttacaccgtatcctacgaaggacgaaccgaaacggacccaaaaggtacccttccgggtagaccgagttcctaggaactaaaagttcggaaacctaggttctaggaaggtaccgccgggaaggaccgaaccggttcgttaacgttttaattacccgnggtaccggtacggaaggaacggtaaacgggtccggttacgggggtacggttttaacccgaaccgttaccgggtaccggggggaaccctaaccgggggtaaacccccgtttggggtaccccttacccggtccccg

SEQ ID NO: 81986 - DNA, 633 bp, Homo sapiens
  misc_feature: GYAE6OF02H8TZV.39.37.D04.1.454.CMB.1.raw
  modified_base (443)..(443): a, c, t, g, unknown or other
  misc_feature (443)..(443): n is a, c, g, or t
  modified_base (551)..(551): a, c, t, g, unknown or other
  misc_feature (551)..(551): n is a, c, g, or t
  modified_base (594)..(594): a, c, t, g, unknown or other
  misc_feature (594)..(594): n is a, c, g, or t
tcagtcgcactagtcacgaccggtgctcgatttagtagcatactgttgggtttgaggtctcagagaggagccttagccctggactccaaggcctttccacttggtgatcagcactgagcacagaggactcaccatggaattggggctgagctgggtttttccttgttggtattttagaaggtgtccagtgtgcggtgcagttggtggagtcgtgggggaggcttggtccaggccgggggggtcctggagactctcctgtgcagcctctggactttcccctttacgagtttattggctgagtcgtcgggtcccgccgagggcctccgaggggtaagggggttcggaggttggggtcggaccaaacaagtaaaacgcgaaaggtagtagggaaggtacggaaagagtatcgtaggactcgtggtggacggggtccgttcaacctntcctacgagacgaaccaacgacccaaagtaacctccgtgactattcgtagaactaaagcgaacacgtctaggagacggaccgaggacacggtcttagtttaactacgngcgacgagaggaaggtcgtggggtacgtttacgacgttacggngggtacccgacggtacccgtcggtacccgaccgttcccg

SEQ ID NO: 81987 - DNA, 591 bp, Homo sapiens
  misc_feature: GYAE6OF02HZ0Q3.39.37.D04.1.454.CMB.1.raw
  modified_base (584)..(584): a, c, t, g, unknown or other
  misc_feature (584)..(584): n is a, c, g, or t
  modified_base (586)..(586): a, c, t, g, unknown or other
  misc_feature (586)..(586): n is a, c, g, or t
  modified_base (588)..(591): a, c, t, g, unknown or other
  misc_feature (588)..(591): n is a, c, g, or t
tcagtcgcactagtcacgaccggtgctcgatttagtagcatactgttgggtttgggggaggcttggtccagccgggggggtccctgagactctcctgtgcagcctctggattcccctttacgagttattggctgagctgggtccgccaggctccgagggaaggggttggagtgggtggccaaacataaaagcaagatggaagtcggaaagagtatctggactctgtgaggggccgttcaccatctccagagacaacgccaagactccgtgcatctgacaaatgaacagtctgagagccgaggacacggctgtttatacgtgcgcgagagaaggcgtgggtcgttcgacgtacgtggggccacgggaaccctggtcctaccgtctcctcacgccctccaaccgacgggccctagtccgtcccttccccgtcggccgccctcgcctccgacggacgccaccgccgacgacgccgacgacgccggccgcggcgtcgtccgtcggtacgaacggtacctacgttccccccgtagtacgtacgccgacgtcggacggcgggtcgtcggacggacggcgacgacgtacgngngnnnn

SEQ ID NO: 81988 - DNA, 681 bp, Homo sapiens
  misc_feature: GYAE6OF02ICS79.39.37.D04.1.454.CMB.1.raw
  modified_base (269)..(269): a, c, t, g, unknown or other
  misc_feature (269)..(269): n is a, c, g, or t
  modified_base (303)..(303): a, c, t, g, unknown or other
  misc_feature (303)..(303): n is a, c, g, or t
  modified_base (315)..(315): a, c, t, g, unknown or other
  misc_feature (315)..(315): n is a, c, g, or t
  modified_base (593)..(593): a, c, t, g, unknown or other
  misc_feature (593)..(593): n is a, c, g, or t
  modified_base (673)..(673): a, c, t, g, unknown or other
  misc_feature (673)..(673): n is a, c, g, or t
tcagtcgcactagtcacgaccggtgctcgatttagtagcatactgttgggtttgaggtctcagagaggagccttagccctggactccaaggcctttccacttggtgatcagcactgagcacagaggactcaccatggaattggggctgagctggttttccttgttggtattttagaggtgtccagtgtgcggtgcagttggtggagtcgtgggggagcttgggtccgagggcccgggggggtccctggagacctctcctgtgcagcctntcggactttcccctttagtagtttagttggctgngcgtgggtcccnccgaggcctccggagggggtaaggggttgggaggtggggtcggacccaaacgaagtaaacggacgaaggagtagggaaggtacggaaagtagtaacgtcgtacggacgttcgtggtcgggaacgggggtcccggtttacaacccgtatttcccgtaccgaaggaccaacccgaacccgtacgaaacggtaacccttcccggagccctaagtcctaggaactaaaattcgaaactgtcgtaggagacggaccgacggacgcgtctttagtttactacgngcgacgagtaggtaacgtcggtacggggttcgttacgacgttaccgggtcgggacccgtaagggaccccgttggtacccnccgttccg

SEQ ID NO: 81989 - DNA, 593 bp, Homo sapiens
  misc_feature: GYAE6OF02GDES3.39.37.D04.1.454.CMB.1.raw
  modified_base (304)..(304): a, c, t, g, unknown or other
  misc_feature (304)..(304): n is a, c, g, or t
tcagtcgcactagtcacgaccggtgctcgatttagtagcatactgttgggtttgaggtctcagagaggagccttagccctggactccaaggcctttccacttggtgatcagcactgagcacagaggactcaccatggaattggggctgagctgggttttccttgttggtattttagaaggtgtccagtgtgcggtgcagttggtggagtctgggggaggcttggtccagccgggggggtccctgagactctcctgtgcagcctctggacttcccctttacgagttattggctgagctgggtccnccaggctccgagggaagggttggagtgggtggccaacataaagcaagatgggaagtcggaaagagtatctggactctgtggaggggtccgttcacctatctcagacacaacgccaaagtactccgtgcatctgacaaatgaacagtctgagacgccgaaggacacgggcttagtttaacttacgtgaccgacgagaaggaagggtctagggggtacccggtttacggaaccttaccggtaggggggacccctaagggggtaacccctggggtaccctacccggttcccg

SEQ ID NO: 81990 - DNA, 676 bp, Homo sapiens
  misc_feature: GYAE6OF02JYF8X.39.37.D04.1.454.CMB.1.raw
  modified_base (206)..(206): a, c, t, g, unknown or other
  misc_feature (206)..(206): n is a, c, g, or t
  modified_base (215)..(215): a, c, t, g, unknown or other
  misc_feature (215)..(215): n is a, c, g, or t
  modified_base (246)..(246): a, c, t, g, unknown or other
  misc_feature (246)..(246): n is a, c, g, or t
  modified_base (337)..(337): a, c, t, g, unknown or other
  misc_feature (337)..(337): n is a, c, g, or t
  modified_base (364)..(364): a, c, t, g, unknown or other
  misc_feature (364)..(364): n is a, c, g, or t
tcagtcgcactagtcacgaccggtgctcgatttagtagcatactgttgggtttggggagagaagagctgctcagttaggacccagagggaaccatggaaaccccagcgcagcttctcttcctcctgctactctggctcccagataccaccggagaaattttgttgacgcagtctccaggcaccctgtgtttgtctccaggggaaangccaccctntcctagcagggccagtcagtttcgtcccaanacttctagcctggtaccagcagaacctggccagcctccaggctcctagatctatcgactacgactccaacgacgggtccacgcggactacnccgaagtactcgggttaccaggttcgnggtttcgacgtaggtacacggtactcgtacttccacgaccagtacagaccgatacgtagaacgtccgagtaacgtgtttacgactaacggttactacgtacacgtacgtcgtacacgtaagttaccgtggtacgttaacgtacgtaaacgttaacgggtaccgtaaaccggtaaacgggtaaaccggtaagggtaagttaaaccgtaaccggaaacgttaaccggtaggttaccgggtactacccgtaacgacccgttaacgggttcccttacggtttacccgttacgttaaccgttcccgttaaaccccgg

SEQ ID NO: 81991 - DNA, 665 bp, Homo sapiens
  misc_feature: GYAE6OF02JPCDA.39.37.D04.1.454.CMB.1.raw
  modified_base (203)..(203): a, c, t, g, unknown or other
  misc_feature (203)..(203): n is a, c, g, or t
  modified_base (461)..(461): a, c, t, g, unknown or other
  misc_feature (461)..(461): n is a, c, g, or t
tcagtcgcactagtcacgaccggtgctcgatttagtagcatactgttgggtttgaggtctcagagaggagccttagccctggactccaaggcctttccacttggtgatcagcactgagcacagaggactcaccatggaattggggctgagctgggtttccttgttggtattttagaaggtgtccagtgtgcggtgcagttggnggagtcgtggggggaggcttgggtccgaggcccgggggggtccctggacgactctcctgtgcagcctcgtggacttcccctttacgagtttattggctggagtcgtgggtcccgcaggcctaccgagggaaggggtggaggtgggtggccaagtactaaagcaagagtaggaaggtacggaaagagtatcgtaggtactgtgtaggacggggtccgttcacgatccgtcgagagacacgaccaaaggtaacttcccgnacgtactacgtgaacctaaaatcgaaactcgtacgtagaacgggaacgccggaaggaccaacgggtacttaggttttaactacgtggaccgtagggtaagtaggaaacgggtccgtgggggttacccgtttaccggaacgttaccggggacggggtaaccctaaccgggggtaaccccttcggggtacccgtaacccggttccg

SEQ ID NO: 81992 - DNA, 639 bp, Homo sapiens
  misc_feature: GYAE6OF02GT6YY.39.37.D04.1.454.CMB.1.raw
  modified_base (209)..(209): a, c, t, g, unknown or other
  misc_feature (209)..(209): n is a, c, g, or t
  modified_base (305)..(305): a, c, t, g, unknown or other
  misc_feature (305)..(305): n is a, c, g, or t
tcagtcgcactagtcacgaccggtgctcgatttagtagcatactgttgggtttggggagagaagagctgctcagttaggacccagagggaaccatggaaaccccagcgcagcttctcttcctcctgctactctggctcccagataccaccggataaattttgttgacgcagtctccgaggcaccctgtgtttgtcctccgaggggaaancgccaccctctcctgcagggccagtctagtttcgttaccaactaacttcttacgcctggtaccagcaagaaacctggccaggcctccaggcctccncatctatgatacatccaccgacggccacgtcggaccactacccagactaggttacaggtggtgttgggtctgggactagtcttcgactctcacatcgacgtcacgactcggtacgcttaggaactttatttcgacgtaagttctacttcgtactgtacgacgtagaggttactaggtcgtaagtaccgtaaagggttaccgtaccggaaccggaaacgggtaacccgtaaagggtaacgtaaactaacgtaaaccggtacggtacggtaacggacctacggaaccctacgttacgttccgttaacgttccttaacgtaccttaccgttaccccg

SEQ ID NO: 81993 - DNA, 816 bp, Homo sapiens
  misc_feature: GYAE6OF02JQTZX.39.37.D04.1.454.CMB.1.raw
  modified_base (179)..(179): a, c, t, g, unknown or other
  misc_feature (179)..(179): n is a, c, g, or t
  modified_base (328)..(328): a, c, t, g, unknown or other
  misc_feature (328)..(328): n is a, c, g, or t
  modified_base (808)..(808): a, c, t, g, unknown or other
  misc_feature (808)..(808): n is a, c, g, or t
  modified_base (814)..(814): a, c, t, g, unknown or other
  misc_feature (814)..(814): n is a, c, g, or t
tcagtcgcactagtcacgaccggtgctcgatttagtagcatactgttgggtttgggggaggcttggtccagccgggggggtccctgagactctcctgtgcagcctctggattcccctttacgagttattggctgagctgggtccgccaggctccagggagggttgagtgggtggccaanataaagcaagatggaagtcggaaagagtatcgtggactctgtggacggggtccgttcaccatctaccagagacaacgaccaagaactccgtgcatctgacaaatgaacagtctagagacgaccgagacacggtcttagtttacttacgnggcgaggaacggtaaggaacgggtcgttacgggggttccggttttaaccggaaccgttaccggggtaccgggggaccggtaaaccggggtaaccccgttgggtacccgtacccgttcccttacccgtacgaccgtaccccttaacccgaaccgggtaaaccggggtccccctaggttacccccgggtttccccgtttcccccggtacgggcccccgtcccgtacggtccccgtaccggaaccgggacctacccgtacccgtacccggacgaccggacccgttaccggacccgggtcccggtacccgtcgggtccgttaccggtccgttacgggtaaccgttaaaccggttaccccgtttaacccgttaacccgttaaccggtaacggttcccgggtaacgttacccggtacgggacccgggttacggggtcccgtaacgggtacggtaaaccgggacccttaggaccgtaggtccacggntacgcncg

SEQ ID NO: 81994 - DNA, 605 bp, Homo sapiens
  misc_feature: GYAE6OF02JEABC.39.37.D04.1.454.CMB.1.raw
  modified_base (171)..(171): a, c, t, g, unknown or other
  misc_feature (171)..(171): n is a, c, g, or t
  modified_base (597)..(597): a, c, t, g, unknown or other
  misc_feature (597)..(597): n is a, c, g, or t
  modified_base (599)..(599): a, c, t, g, unknown or other
  misc_feature (599)..(599): n is a, c, g, or t
  modified_base (603)..(603): a, c, t, g, unknown or other
  misc_feature (603)..(603): n is a, c, g, or t
tcagtcgcactagtcacgaccggtgctcgatttagtagcatactgttgggtttgggggaagaggaagactgacggtccctgagactctcctgtgcagcctctggattcccctttagagttattggctgagctgggtccgccaggctccagggagggttgagtggtgccaanataaagcaagatggaagtcggaaagagtatctggacttctggtgaggggccgttcaccatcctcagagacaacgccaagactccgtgcatctgcaaatgaacagtctgagagccgaggacacggctgtttattactgacgcgagagaaggactgggcggtttcgacgtacgtggggccacgggaagtcccccccggtgaccgtctcctcgacgcctaccaccgaacggccacgtccggtaccttccccgtcggcccgtcccgtcgccgtccgacggtacgacacccgtccggagacgccgaacgacggccggcccgtacgggcgtacggccgtaggtccgaacggtacccgttaccgttaccctaccgtacgtcgccgacgtacggtcggccgggtcgttcggacgaacggcgtacgacgttacgncngcgncg

SEQ ID NO: 81995 - DNA, 734 bp, Homo sapiens
  misc_feature: GYAE6OF02F6KUH.39.37.D04.1.454.CMB.1.raw
  modified_base (272)..(272): a, c, t, g, unknown or other
  misc_feature (272)..(272): n is a, c, g, or t
  modified_base (293)..(293): a, c, t, g, unknown or other
  misc_feature (293)..(293): n is a, c, g, or t
  modified_base (380)..(380): a, c, t, g, unknown or other
  misc_feature (380)..(380): n is a, c, g, or t
  modified_base (726)..(727): a, c, t, g, unknown or other
  misc_feature (726)..(727): n is a, c, g, or t
  modified_base (731)..(733): a, c, t, g, unknown or other
  misc_feature (731)..(733): n is a, c, g, or t
tcagtcgcactagtcacgaccggtgctcgatttagtagcatactgttgggtttgggggagcttggtccagccggggggtccctgagactctcctgtgcagcctctggattcccctttacgagtttattggctgagctgggtccgccaggctccgagggaggggttggaggtgggtgccaacataaagcaagataggaagtcggaaagagtatcgtggactctgtggacggggccgttcaccatcctccagagacaacgccaagacctccgtncatctgacaaatgaacagtcngagacgaccgaggacacggtcttagtttacttacgtgacgacggaaggacggaaggtcgtcggggtccggtttacgaacgttacggnggggacccgaaacggggtaaccccgttgggtaccctacccggttcctaccctacgaccgtcccctaccgaacccggaaaccggggtcccctaacggtttccccggttcccctttccccccggtaccgggtccccgtccccgttaccggtcccgttacccggaacgggtaccgtacccgtaccccgtacccggaacggaccgaccgaaccgaccggtccccggcccggtcggggtccttccggtcccgtacgggtaccgaaccgggttaccttaccgttacctacgttacgtcgaccgtacgtcggacggccgggtcgtacgggaccgacggacgtacgagtacggnngacnnng

SEQ ID NO: 81996 - DNA, 698 bp, Homo sapiens
  misc_feature: GYAE6OF02I7B9I.39.37.D04.1.454.CMB.1.raw
  modified_base (201)..(201): a, c, t, g, unknown or other
  misc_feature (201)..(201): n is a, c, g, or t
  modified_base (210)..(210): a, c, t, g, unknown or other
  misc_feature (210)..(210): n is a, c, g, or t
  modified_base (257)..(257): a, c, t, g, unknown or other
  misc_feature (257)..(257): n is a, c, g, or t
tcagtcgcactagtcacgaccggtgctcgatttagtagcatactgttgggtttggggagagaagagctgctcagttaggacccagaggaaccatggaaacccagcgcagcttctcttcctctgctactctggctccagactaccacggagtaaatttgtgacgcagtctccaggccacctgtgttcgctccgaagggaaancgccacctntcctagccaggccagtctagttctccgaatacttctagcctaggacngacaagtaaaccgtcggaccaggtcctacgaccggtcctacctacgaacttccgtatacgtaacttaccgacttaccccgaacgaacgggtcccaaggttcggaacctacgttacccgaagtaccgtacggtttacgaaggtttcggtaggttacgggttacgacgggtaactacgtaaccgtttcgaacttccgtaacgtacctacgtacgtaacgacgtaacgtacgtacggacgttaccgtaagtaacgtacgtttacgacgttacgtactagtacgtacgtgtacgtacgacgtacgtacggttacgtacgtactaacgtaacgtacgtaccggaaccgtaacggtaacgacggtaagaaccgtactaaacggtaacgtgtcggtacgtaaccgagttaaccacgttcgtacgttacgtacgtactcccgttaaccg

SEQ ID NO: 81997 - DNA, 775 bp, Homo sapiens
  misc_feature: GYAE6OF02IWWUF.39.37.D04.1.454.CMB.1.raw
  modified_base (168)..(168): a, c, t, g, unknown or other
  misc_feature (168)..(168): n is a, c, g, or t
  modified_base (203)..(203): a, c, t, g, unknown or other
  misc_feature (203)..(203): n is a, c, g, or t
tcagtcgcactagtcacgaccggtgctcgatttagtagcatactgttgggtttggggagagaagagctgctcagttaggacccagagggaaccatggaaacccagcgcagcttctcttcctcctgctactctggctccagataccacggagtaaattttgttgacgtnagtctccaggcacctgtgttctctccgaggggaangcccacctctcctgcacgggccagtcgtagtttcgtacccaactacttctacgcctaggtaccagacaacgaaccgtgaccgaggccttacccgaggtccctaccgtactacgttacctaagtttacgaacttaaccgacttaccccgaacggtaaccgggtaccctaacgtcgggacctaaccgttaccccgaaggtaccgttaacggttcgtaacgggttacgggttacggttcggggttactacgggggtaaccttaacgggtttaaccctttccggaaccttttaccggacgtaaacccctgttaccgaaccggtactacggtaacgtacggtacgtaccgtaacgtaagttcgtttacgacgtacgtctacgtaccgtacgtactacgtcgagttacgtaagttcggtaactacgtaacgtaaacgtacggttacccggaacggttaaacggtaaccggtaagggtaaccgtaacgtaccgtaaacggtacggttaacggcgtacgtacccggacgttaacctaggtttaccgtaccttaccggtaccttaccgttacccgtacccg

SEQ ID NO: 81998 - DNA, 681 bp, Homo sapiens
  misc_feature: GYAE6OF02GNGT2.39.37.D04.1.454.CMB.1.raw
  modified_base (206)..(206): a, c, t, g, unknown or other
  misc_feature (206)..(206): n is a, c, g, or t
  modified_base (267)..(267): a, c, t, g, unknown or other
  misc_feature (267)..(267): n is a, c, g, or t
  modified_base (296)..(296): a, c, t, g, unknown or other
  misc_feature (296)..(296): n is a, c, g, or t
  modified_base (300)..(300): a, c, t, g, unknown or other
  misc_feature (300)..(300): n is a, c, g, or t
  modified_base (315)..(315): a, c, t, g, unknown or other
  misc_feature (315)..(315): n is a, c, g, or t
  modified_base (358)..(358): a, c, t, g, unknown or other
  misc_feature (358)..(358): n is a, c, g, or t
  modified_base (562)..(562): a, c, t, g, unknown or other
  misc_feature (562)..(562): n is a, c, g, or t
tcagtcgcactagtcacgaccggtgctcgatttagtagcatactgttgggtttgaggtctcagagaggagccttagcccccggactccaaggccctttccacttggtgatcagcactgagcacagaggactcaccatggaagttgggctgagcttgggtttccttgttggtatttagaaggtgtccagtgtgcggtgcaggttggnggtagtcgtgggggagtcgttggtccagggccggggggtccctggagacctctcctgtgcngtcctgtggacttcccccgttagtagttnttgntgagcgtgggtcccncgaggtcctccgtaggggtagggttggaggtgggtaggccaanagtaaagcgaagtagtaggagtcggaaagtagtagtcgtggactgtcggtaggacggggtcccgttcacctatccgtacccagtacgaaccgaaccgaaccgaaacggtaaccgttcccgtgtaccagttcagaactaaacgtgaaacgtagtcctagaacggacgaccggaaggccgtacggttctttacgtttacttaccgnggtaccgacggtaacggaacggtaacggtcggtaggggttacccggttaccggtaaccgttacggtacggggacccgttaacgggtacccgtccggttacccgtccgttacccgtcccg

SEQ ID NO: 81999 - DNA, 783 bp, Homo sapiens
  misc_feature: GYAE6OF02GXNXE.39.37.D04.1.454.CMB.1.raw
  modified_base (332)..(332): a, c, t, g, unknown or other
  misc_feature (332)..(332): n is a, c, g, or t
  modified_base (335)..(335): a, c, t, g, unknown or other
  misc_feature (335)..(335): n is a, c, g, or t
tcagtcgcactagtcacgaccggtgctcgatttagtagcatactgttgggtttgaggtctcagagaggagccttagccctggactccaaggcctttccacttggtgatcagcactgagcacagaggactcaccatggaattgggctgagctggtttccttgttgtattttagaaggtgtccagtgtgcggtgctagttggtggagtcggtgggggaggtcttcggtccgacggggccccgggggggttcccctggacgtacctcctcctgtcgcacgcctcgtggtacctttccccttacgtagtttagttcggctgagccgtcgggtcccncgnggccgtccggagggggtagggttggaggtcgggtcggacctaagaagtaaacgcgaaagtagtaggaaggtacggaaaagagttaacgtcgttaggtacttcggtacggtgggacggggtcccgtaccgaaccgtacgtacctaccgaagtaacccgaacgaaccgaacccgaaacgtaacccgttcccgagtacccacgttccgaagtaacaaacgtacgaaaccgtagtacggtagacggaacggaccggaacggtaccgtacggtaccgtttttaagtttaaccggttacgtaggtacccggaggtaacggtaagggtaaaccggggttcggttacccggggttaccggtttacccggtaacccgggtttaccggggtaacccgggggcccgggttaaaccggtacccccggggttcggttaccccccggtacccgtttccccgg

SEQ ID NO: 82000 - DNA, 1018 bp, Homo sapiens
  misc_feature: GYAE6OF02IZTKM.39.37.D04.1.454.CMB.1.raw
  modified_base (144)..(144): a, c, t, g, unknown or other
  misc_feature (144)..(144): n is a, c, g, or t
  modified_base (172)..(172): a, c, t, g, unknown or other
  misc_feature (172)..(172): n is a, c, g, or t
tcagtcgcactagtcacgaccggtgctcgatttagtagcatactgttgggtttgggggagcttggtccagccggggggtccctgagactctcctgtgcagcctctggacttcccctttagagtttattggctgagctgggtccnccaggctccagggaagggttgagtgggngccaacataaagcaagtatggaaacgtcggaaaagagtactcgttggaccttcgtagtggacgggggtcccggtttcaaccgattcctaccaagaacggaacccaaaacggccctaaaaggtaacccttcccggtgacctaatttcctaggaaccaaaaaacgttcggaaaaacctaaggttccgttaggaaacgggtaacggacccccgggtaaagggaaccggtaaccggggtccgttttaaggttttttaaaccttttaacccggttcgggaccggttaccgggaaagggtaaaacgggtaaaaccggggtaccgttacggggggttacccgggttttttaacccggaaccggttttaaaccgggggtccggggggaaccccggtaaacccggggggtaacccccgtttcggggttaaccccgtaaccccccgggtttactttaacccccggttccggtaaaacccggtcccccgttaaccccggtaaacccggaaaaaccggggtacccccgtaacggtttacccccggggtttcccctttaccccccccggttcgggtaccccggtcccccgttccggtaccccgttacccggaaccggtaaccggcccgtaacccggtacccggaacgtaacggacccgtaaccgaacgggcccgggtaccccgtacgggtcccgttacgggtaacccggttacggtaacggtaaaccgttaccgtttaacccgttacccgtaacggttaacgttccggaaccgaacggttcggtaacggtccgggtaacggtaccgggaaccggtacgggtaaccgtacgttaacgacggtacgaccgtgtacgacgag

SEQ ID NO: 82001 - DNA, 881 bp, Homo sapiens
  misc_feature: GYAE6OF02F3HZN.39.37.D04.1.454.CMB.1.raw
  modified_base (177)..(177): a, c, t, g, unknown or other
  misc_feature (177)..(177): n is a, c, g, or t
  modified_base (202)..(202): a, c, t, g, unknown or other
  misc_feature (202)..(202): n is a, c, g, or t
  modified_base (871)..(871): a, c, t, g, unknown or other
  misc_feature (871)..(871): n is a, c, g, or t
  modified_base (875)..(875): a, c, t, g, unknown or other
  misc_feature (875)..(875): n is a, c, g, or t
tcagtcgcactagtcacgaccggtgctcgatttagtagcatactgttgggtttgggggaggcttggtccagccggggggtccctgagactctctgtgcagcctctggacttcccctttacgagtttattggctgagctgggtccgccaggctcagggagggttgagtgggtgccaanataagcaagatggaagtcggaaagngtatcgtggactcgtggtggacggggtccgtttacaccagttcctaccgaggaacaaccgtaaaccggacccaaaaggtaacccttcccggtaggacctaacgttccgttaggacgaaaacgtttacggaaacctacgttaccgtaaggaacggtaacggacccggaaggaacccggtaccggtctttttaacggttttaacgttaccgtggtacccgaccggtaagggtaacgaaacgggttcgttcgggggtttccggttttacccgaaaccggtttacgggttacgggggacccgaaacgggggtaccccgtttacggggtaccctaccgggtttaccgtccctaaccgtaccgggttaccccttaacccgaacccgggtaacccggggtcccccgttaacggtttttcccggtacccccgtttcccccggtccggtaccccgtccccgtaccgttaccggtacccgacggtaaccgtaccgtacccggtaccggtacggaccggaccgaaaccggtaccggcccggtaccggtccgggtccgttccggttacgtccggtaaccgaaccggtaccgttacccgtcgttaaccgtcggtaacgacggttacggtcgaacgggccgggtacggtacggaccggtaacggctaccggtaggtacccgtnacgngagcga

SEQ ID NO: 82002 - DNA, 651 bp, Homo sapiens
  misc_feature: GYAE6OF02FTR71.39.37.D04.1.454.CMB.1.raw
  modified_base (205)..(205): a, c, t, g, unknown or other
  misc_feature (205)..(205): n is a, c, g, or t
tcagtcgcactagtcacgaccggtgctcgatttagtagcatactgttgggtttggggagagaagagctgctcagttaggacccagagggaaccatggaaaccccagcgcagcttctcttcctcctgctactctggctcccagataccaccggagaaattttgtgacgcagtctccaggcaccctgtgtttgtctccaggggaaangccacctctcctgcgagggccagtctagtttcgttacccaactaacttcttaacgccttaggtaccagcaacgaaaccctggaccaggcctacccgaggcctcctcattctatgaatacactcccaccgacgggcccacgtcggaccacgtccccaagaccgtacggttccaggttggttcggtttggggtctggggactagtaccttcactctccaccatcacgcagtacgtcggacgtacgtagaagttatttcgacgtacgtctactctacgtgttaccgagtactacggttagtcggttactaacgttacgtaaacggttccggttaccgggaccgtaaacgggaacgtaaggtaacggaactacgaaacggtacgtaaggtcggacgtcgtaccgtaacgtacgttacgttacgttaccttacgtaccgttccgttacccg

SEQ ID NO: 82003 - DNA, 802 bp, Homo sapiens
  misc_feature: GYAE6OF02H6K3D.39.37.D04.1.454.CMB.1.raw
  modified_base (242)..(242): a, c, t, g, unknown or other
  misc_feature (242)..(242): n is a, c, g, or t
  modified_base (262)..(262): a, c, t, g, unknown or other
  misc_feature (262)..(262): n is a, c, g, or t
  modified_base (296)..(296): a, c, t, g, unknown or other
  misc_feature (296)..(296): n is a, c, g, or t
  modified_base (305)..(305): a, c, t, g, unknown or other
  misc_feature (305)..(305): n is a, c, g, or t
  modified_base (312)..(312): a, c, t, g, unknown or other
  misc_feature (312)..(312): n is a, c, g, or t
  modified_base (318)..(318): a, c, t, g, unknown or other
  misc_feature (318)..(318): n is a, c, g, or t
tcagtcgcactagtcacgaccggtgctcgattttagtagcatactgttagggtttgggggaggcttggtccagccgggggggtccctgagacctctcctgtcgcagcctctggattcacccttttaggaactattggatgagttcgggtccgccaggctgcgagggaaggggctggagtgggtcggccaacataggacggtagatggaagagagaaatactatgtggactctgtgagggtcntacacatctcacagacaacncacgtaatacactgtattaactaaactagacacncctcgagancgacganaccgtntgtagtactaattgtgacgggaacggggtacgcgtaggtcgtggcgtacgtcggggaccgacggggtaccccggaccgtccggtaccgtccctacgacgtcccctaccgaacccgtaacgggtcccctacgttaccggttcccgttcccccgttacccggtcccggtaccccgttcgtcccgtacccgtaccgggtaacggacctacccgttaccggaaccggtaccggtacgtaacccggtaaccggtaccgggaccccgggttaccgggtcccggttaacccgggttaccgttacccgggttaaccgggtaaacccgggtttaacccggtttaaccccgtttaaccccgttaaacgttaaaccggggtttaccggtaccgggtaacccgttaacgggtacgggtaaccgggtccgggttaaccgggaacccggttaacggacccgggtaccggtaacgtaccggtacggactcgtactccgg

SEQ ID NO: 82004 - DNA, 660 bp, Homo sapiens
  misc_feature: GYAE6OF02I3KL4.39.37.D04.1.454.CMB.1.raw
  modified_base (198)..(198): a, c, t, g, unknown or other
  misc_feature (198)..(198): n is a, c, g, or t
  modified_base (359)..(359): a, c, t, g, unknown or other
  misc_feature (359)..(359): n is a, c, g, or t
tcagtcgcactagtcacgaccggtgctcgatttagtagcatactgttgggtttggggagagaagagctgctcagttaggacccagagggaaccatggaaaccccagcgcagcttctcttcctctgctactctggctccagactaccacggagtaaattttgtgacgcagtctcagcacctgtgttgctcgaagggaancgccacctctctgcgacgggcagtctagtttcgtaaccaactacttctagccttggtaccagcaagaaccgtgaccgagtcctccgagtcctaccgtacatctagtcgaactacactacccgacgtacggcctacgtgacctcctaccgagaccgtgtacngttcggtgtggacgtggactagtctacgactcgtacacatcgacgtcagacgtcgacgtcgtaaggtacgttagtttcgaacgtacgttactacgtaccgttagtcgtacgacgtacgtaaggttacgtcgggttaactacgtaaacgtaaaccgggttccggttaaaccggaaccggtaacgggttaaaccgaaagggtaacgtaaacgtaaccggaaagttacggtaacgttacggaaaccgtcgtaacccgtagttaaccgtcgttagttaccccggtattacccgttaccgttaccc

SEQ ID NO: 82005 - DNA, 1036 bp, Homo sapiens
  misc_feature: GYAE6OF02HHVL8.39.37.D04.1.454.CMB.1.raw
  modified_base (978)..(978): a, c, t, g, unknown or other
  misc_feature (978)..(978): n is a, c, g, or t
tcagtcgcactagtcacgaccggtgctcgatttagtagcatactgttgggtttgaggtctcagagaggagccttagccctggactccaaggcctttccacttggtgactcagcactgacgcacagaggactcaccatggattggggctgagcgttgggttttcctggttggtattttaggaagtctccgagtgtggtccggtgactacggttgggacggagttcggtgggggaaggtccttcgggtccgacgggtccggggggtcccctaggacgttaccctcgttcccgtggtacgaccgtacggtccgttaccggtacggttaccgtttaccccccgtttaaggaacggttttacgttacggtaccgtaggttaaccgggtcgtaccgggggttacccccgaccggttaaccgggtcccggttaaccggttaaacggggggtaacgggggttttaccggggaggttttaccgggggtacggtaaccccgttaaaacggtaaaccggtttaaaacgggtaaccgtaaacgggttacgggtaaaccggggtaaacggttaacgggtaaaaggtaaccggttttaacgtccggttaacgggtaacccgttttccgggaaggttaccggggggtaacccggggttcccggttttacccgaaacccggttttaccgtttacccggtaacccgggtaaaccgggtaaccgttaaacccggtaaaacccggtacccgaaaacccggggttaacccgggtttcccgtaaacggacccgtttaaccggtacccgtaaccggtaaaacgttaaaccgtttaccggaaaccgggtttcgtaacgggtttaaacgggaacgggaacccggttaccgggaacccggggtaccgaacggggtttaactttaccggttttaacgtaccccggtagtcccggaacgggttaacggtacggtaaccgggtcggttaaccgggtcccgtttaanacgggttacccgttacggggaactaaccgggttaccgtacccgttacggtaccctccg

SEQ ID NO: 82006 - DNA, 729 bp, Homo sapiens
  misc_feature: GYAE6OF02JQPLN.39.37.D04.1.454.CMB.1.raw
  modified_base (130)..(130): a, c, t, g, unknown or other
  misc_feature (130)..(130): n is a, c, g, or t
  modified_base (173)..(173): a, c, t, g, unknown or other
  misc_feature (173)..(173): n is a, c, g, or t
  modified_base (198)..(198): a, c, t, g, unknown or other
  misc_feature (198)..(198): n is a, c, g, or t
  modified_base (216)..(216): a, c, t, g, unknown or other
  misc_feature (216)..(216): n is a, c, g, or t
  modified_base (227)..(227): a, c, t, g, unknown or other
  misc_feature (227)..(227): n is a, c, g, or t
  modified_base (277)..(277): a, c, t, g, unknown or other
  misc_feature (277)..(277): n is a, c, g, or t
  modified_base (347)..(347): a, c, t, g, unknown or other
  misc_feature (347)..(347): n is a, c, g, or t
  modified_base (381)..(381): a, c, t, g, unknown or other
  misc_feature (381)..(381): n is a, c, g, or t
  modified_base (385)..(385): a, c, t, g, unknown or other
  misc_feature (385)..(385): n is a, c, g, or t
  modified_base (451)..(451): a, c, t, g, unknown or other
  misc_feature (451)..(451): n is a, c, g, or t
tcagtcgcactagtcacgaccggtgctcgatttagtagcatactgttgggtttgggagagaagagctgctcagttaggacccaggagggaaccagtacggaaaccccgagcgcagtctctcttcctcctnacttctgtggcctcccagactaccgaccggaagtaaatttgtnacgcagtctccgagccaccgtgttntttgcctacgaagggaancgaccacctcncctgcgacgcatacgttcgttctaccaactacttctgaccgttacgaacngaccaacgtaacctcggactacgtcccgtaccgacgtccttaccctagacttaccggtataagtactacnccgtacctaccggaccgccttacgcgtcgaaccnccgngaacgtcggtatgggtacggtgtttcggacgcggtaacgtctacttacgcctcctacgacccttanccccggtaaagttccgacgtacgtacggtacccgtacgttaacgtacgtttacggtaacgttacgttacggtttaccgtttaaggtttaccgttgggttacctacggttacttaaggttaccgtaccggttaccgtaccccgttacccggtacggtaccgttacccgggaacggtaccgtaaccggttgtaacgggtactacggtaacctaacggtcgtacgtcggttacgccgtctaaccgtacgttcttaccgttacaccttccgtaccgtacccg

SEQ ID NO: 82007 - DNA, 734 bp, Homo sapiens
  misc_feature: GYAE6OF02FS9XZ.39.37.D04.1.454.CMB.1.raw
tcagtcgcactagtcacgaccggtgctcgatttagtagcatactgttgggtttgaggtctcagagaggagccttagcccctggactccaaggcctttccacttggtgatcagcactgagcacagaggactcaccataggaattggggctggagcgttgggtttttccttggttggttattttagaaggtgtccagtgtgcggtgcagttggtggagtcgtgggggagcttggtccagggcccggggggtccctgacgactctccgtgtcgcacgcctcgtgtactttccccttagtagttagttggctggacgtcgtcgggtccgccgaggccgtaccgaggggtaacggggttggaggtggtcgaccaaacagtaaacgcgaagtagtaggaagtacggaagtagtagtcgtggactcgtggtaggacggggtaccgttaccgacctacgtccctacgaacggaacgaccgtaaacccgacgtaaacgtacccttccggtcgacctaactccgttaagaacctaaagtacgttaaccgtaagtaccgtaggtacggacgacccgggaaggaccgtacggttacgtttaccgttttagtaccgtaggacgaaccggtacgggtaaacggaacggggttacgtacgggggtttacgtaaccgggttacccggttaaggtaccggggttaccggaacccgggtacccggtttccggtaccggttacccgtaccccg

SEQ ID NO: 82008 - DNA, 259 bp, Homo sapiens
  misc_feature: GYAE6OF01D7ZX7.15.13.B02.1.454.CMB.1.raw
  modified_base (256)..(259): a, c, t, g, unknown or other
  misc_feature (256)..(259): n is a, c, g, or t
tcagtctacgtagccacgaccggtgctcgatttagtctagcgactttggatttgggacagaattcactctcaccatccgcagcctgcagcctgaagattttgcaacttattactgccaacagtataatagcaattctccgtggacgttcggccaagggaccagggtggatatcaaacgaactgtggctgcaccatctgtcttcatcttcccgccatctgagctacgtagactgagcgggctggcaaggcgcatagnnnn

SEQ ID NO: 82009 - DNA, 275 bp, Homo sapiens
  misc_feature: GYAE6OF01AN7AD.15.13.B02.1.454.CMB.1.raw
  modified_base (260)..(275): a, c, t, g, unknown or other
  misc_feature (260)..(275): n is a, c, g, or t
tcagtctacgtagccacgaccggtgctcgatttagtctagcgactttggatttgggacgagaattcactctcaccatccgcagcctgcagcctgaagattttgcaacttattacgtgccaacagtataatagcaattctccgtggacgttcgggccaaggggaccagggtggatatcaaacgactgtggctgcaccatctgtcttcatcttcccgccatctgagctacgtagactgagcgggctggcaaggcgcattagnnnnnnnnnnnnnnnn

SEQ ID NO: 82010 - DNA, 259 bp, Homo sapiens; identical to SEQ ID NO: 82008
  misc_feature: GYAE6OF01B70Q4.15.13.B02.1.454.CMB.1.raw
  modified_base (256)..(259): a, c, t, g, unknown or other
  misc_feature (256)..(259): n is a, c, g, or t

SEQ ID NO: 82011 - DNA, 642 bp, Homo sapiens
  misc_feature: GYAE6OF01CM2OH.15.13.B02.1.454.CMB.1.raw
  modified_base (226)..(226): a, c, t, g, unknown or other
  misc_feature (226)..(226): n is a, c, g, or t
  modified_base (417)..(417): a, c, t, g, unknown or other
  misc_feature (417)..(417): n is a, c, g, or t
tcagtctacgtagccacgaccggtgctcgatttagtctagcgactttgtgtttggggtcagactcagtcaggacacagcatggacatgagggtccccgctcagctcctggggctcctgctgctctggctcccaggtgcccaatgtgacatccagatgacccagtctccttccaccctgtctgcatctgtgggagacagagtcaccatcacttgccgggcagtcagngtgttactaacgtggttggcctggtatcagcaagaaaccagggaaacgcccctaacctcctaatctatgatcgcctccaggtttggagtaggtcgggtcccagtcgtaggttcaggcggcgaggtggtagtttgggactaaggtaattcacctctacacctactccgacacgtcctgcagcctagtaattntttacgactaacgtttacttactacgacctaacgtagttaattaaatacgtactaaacttttccgtacccgggttcgggtaacccggtttaccgggaaccggtaaacggggtacccggtaagggggttacggtaaacgttaacgtaaccggaaaaaccggttaacgtgggttacggcctacggccctaaacccgtacttccgttacgttcctttaccgtaacccg

SEQ ID NO: 82012 - DNA, 276 bp, Homo sapiens
  misc_feature: GYAE6OF01DNAB3.15.13.B02.1.454.CMB.1.raw
  modified_base (267)..(276): a, c, t, g, unknown or other
  misc_feature (267)..(276): n is a, c, g, or t
tcagtctacgtagccacgaccggtgctcgatttagtctagcgactttggatttgggacagaattcactctcaccatccgcagcctgcagcctgaagattttgcaacttattactgccaacagtataatagcaattcctccgtggacgttcggaccaaagggaccagggtggatatacaaaacgactgtggctgcaccatctgtcttcatccttcccgcatctgatctagtagactgacggcgggctgggactaaggccgcaagtagnnnnnnnnnn

SEQ ID NO: 82013 - DNA, 292 bp, Homo sapiens
  misc_feature: GYAE6OF01CZ95N.15.13.B02.1.454.CMB.1.raw
  modified_base (120)..(120): a, c, t, g, unknown or other
  misc_feature (120)..(120): n is a, c, g, or t
  modified_base (228)..(228): a, c, t, g, unknown or other
  misc_feature (228)..(228): n is a, c, g, or t
  modified_base (261)..(262): a, c, t, g, unknown or other
  misc_feature (261)..(262): n is a, c, g, or t
  modified_base (265)..(292): a, c, t, g, unknown or other
  misc_feature (265)..(292): n is a, c, g, or t
tcagtctacgtagccacgaccggtgctcgatttagtctagcgactttggatttgggacagaattcactctcaccatccgcagcctgcagcctgaagattttgcaacttattactgccaanagtataatagcaattctccgtggacgttcggccaagggaccagggtggatatacaaacgaactgtggctgcaccatctgtcttcatctccgcatctgagctaacgtanactggacgcgggactggacaagggcacataagnntannnnnnnnnnnnnnnnnnnnnnnnnnnn

SEQ ID NO: 82014 - DNA, 262 bp, Homo sapiens
  misc_feature: GYAE6OF02IPBFQ.15.13.B02.1.454.CMB.1.raw
  modified_base (258)..(262): a, c, t, g, unknown or other
  misc_feature (258)..(262): n is a, c, g, or t
tcagtctacgtagccacgaccggtgctcgatttagtctagcgactttggatttgggacagaattcactctcaccatccgcagcctgcagcctgaagattttgcaacttattactgccaacagtataatagcaattctccgtggacgttcggccaaggggaccagggtggatatcaaaacgaactgtggctgcaccatctgtcttcatcttcccgccatctgagctactagactgagcgggctggcaaggcgcataggnnnnn

SEQ ID NO: 82015 - DNA, 509 bp, Homo sapiens
  misc_feature: GYAE6OF02F5UWO.15.13.B02.1.454.CMB.1.raw
  modified_base (212)..(212): a, c, t, g, unknown or other
  misc_feature (212)..(212): n is a, c, g, or t
  modified_base (215)..(215): a, c, t, g, unknown or other
  misc_feature (215)..(215): n is a, c, g, or t
  modified_base (243)..(243): a, c, t, g, unknown or other
  misc_feature (243)..(243): n is a, c, g, or t
  modified_base (250)..(250): a, c, t, g, unknown or other
  misc_feature (250)..(250): n is a, c, g, or t
  modified_base (252)..(253): a, c, t, g, unknown or other
  misc_feature (252)..(253): n is a, c, g, or t
  modified_base (255)..(255): a, c, t, g, unknown or other
  misc_feature (255)..(255): n is a, c, g, or t
  modified_base (258)..(259): a, c, t, g, unknown or other
  misc_feature (258)..(259): n is a, c, g, or t
  modified_base (261)..(261): a, c, t, g, unknown or other
  misc_feature (261)..(261): n is a, c, g, or t
  modified_base (265)..(265): a, c, t, g, unknown or other
  misc_feature (265)..(265): n is a, c, g, or t
  modified_base (268)..(269): a, c, t, g, unknown or other
  misc_feature (268)..(269): n is a, c, g, or t
  modified_base (274)..(274): a, c, t, g, unknown or other
  misc_feature (274)..(274): n is a, c, g, or t
  modified_base (278)..(278): a, c, t, g, unknown or other
  misc_feature (278)..(278): n is a, c, g, or t
  modified_base (314)..(314): a, c, t, g, unknown or other
  misc_feature (314)..(314): n is a, c, g, or t
  modified_base (319)..(319): a, c, t, g, unknown or other
  misc_feature (319)..(319): n is a, c, g, or t
  modified_base (325)..(325): a, c, t, g, unknown or other
  misc_feature (325)..(325): n is a, c, g, or t
  modified_base (334)..(334): a, c, t, g, unknown or other
  misc_feature (334)..(334): n is a, c, g, or t
  modified_base (341)..(341): a, c, t, g, unknown or other
  misc_feature (341)..(341): n is a, c, g, or t
  modified_base (372)..(372): a, c, t, g, unknown or other
  misc_feature (372)..(372): n is a, c, g, or t
  modified_base (399)..(399): a, c, t, g, unknown or other
  misc_feature (399)..(399): n is a, c, g, or t
tcagtctacgtagccacgaccggtgctcgatttagtctagcgactttggatttgggacagaattcactctcaccatccgcagcctgcagcctgaagattttgcaacttattactgccaacagtataatagcaatttctccgtggacgttcggccaagggaccagggtgatatcaaacgactgtgctgcaccatctgtctcatctccgcatcnganctacgtagactgagcggctggcaaggcncatacgnannantcnncngacnacnngtacngctncgatcagtcagctgctctgcactggcattgaccggnacganacgtcngacgtctanccgtaanacgtagacgagacgacgactacgtacgacgngacgacgtacgtacgacgcgtacgacncgtacgtagtacgtactacgtacgtacgtactcgtcgtacgtacgtcgtacgtacgtacgtactacgtacgtacgtacgtacgtacgtacgtacgtacgtacgtagtacg

SEQ ID NO: 82016 - DNA, 195 bp, Homo sapiens
  misc_feature: GYAE6OF01A0NJ8.38.33.C11.1.454.CMB.1.raw
  modified_base (176)..(195): a, c, t, g, unknown or other
  misc_feature (176)..(195): n is a, c, g, or t
tcagtcgatcacgtcacgaccggtgctcgatttagagtgagctcggttgggtttgggggaagaggaagactgaccggtcccccaggagttcaggtgctgggcacagcggccctgggctgcctggtcaaggactacttccacgtgatcgactgagcgggctggcaaggtcgcatagnnnnnnnnnnnnnnnnnnnn

SEQ ID NO: 82017 - DNA, 194 bp, Homo sapiens
  misc_feature: GYAE6OF01AVH1L.38.33.C11.1.454.CMB.1.raw
  modified_base (194)..(194): a, c, t, g, unknown or other
  misc_feature (194)..(194): n is a, c, g, or t
tcagtcgatcacgtcacgaccggtgctcgatttagagtgagctcgttgggtttgggtcagcctccaccaagggcccatcggtcttcccctggcaccctcctccaagagcacctctgggggcacagcggccctgggctgcctggtcaaggactacttccacgtgatcgactgagcgggctggcaaggcgcatagn

SEQ ID NO: 82018 - DNA, 194 bp, Homo sapiens
  misc_feature: GYAE6OF01BKY4H.38.33.C11.1.454.CMB.1.raw
  modified_base (193)..(194): a, c, t, g, unknown or other
  misc_feature (193)..(194): n is a, c, g, or t
tcagtcgatcacgtcacgaccggtgctcgatttagagtgagctcgttgggtttgggtcagcctgcaccaagggcccatcggtcttcccctggcaccctcctccaagagcacctctggggcacagcggccctgggctgcctggtcaaggactacttccacgtgatcgactgagcgggctggcaaggcgcatagnn

SEQ ID NO: 82019 - DNA, 197 bp, Homo sapiens
  misc_feature: GYAE6OF01COQDY.38.33.C11.1.454.CMB.1.raw
  modified_base (194)..(197): a, c, t, g, unknown or other
  misc_feature (194)..(197): n is a, c, g, or t
tcagtcgatcacgtcacgaccggtgctcgatttagagtgagctcgttgggtttgggtcagcctccaccaagggcccatcggtcttcccctggcaccctcctccaagagcacctctgggggcacagcggccctgggctgcctggtcaaggactacttccacgtgatcgactgagcgggctggcaaggcgcatagnnnn

SEQ ID NO: 82020 - DNA, 197 bp, Homo sapiens; identical to SEQ ID NO: 82019
  misc_feature: GYAE6OF01E5MFI.38.33.C11.1.454.CMB.1.raw
  modified_base (194)..(197): a, c, t, g, unknown or other
  misc_feature (194)..(197): n is a, c, g, or t

SEQ ID NO: 82021 - DNA, 175 bp, Homo sapiens
  misc_feature: GYAE6OF01CXE04.38.33.C11.1.454.CMB.1.raw
  modified_base (173)..(175): a, c, t, g, unknown or other
  misc_feature (173)..(175): n is a, c, g, or t
tcagtcgatcacgtcacgaccggtgctcgatttagagtgagctcgttgggtttgggggaagaggaagactgacggtcccccaggagttcaggtgctgggcacagcggccctgggctgcctggtcaaggactacttccacgtgatcgactgagcgggctggcaaggcgcatagnnn

SEQ ID NO: 82022 - DNA, 215 bp, Homo sapiens
  misc_feature: GYAE6OF01DMJH2.38.33.C11.1.454.CMB.1.raw
  modified_base (196)..(215): a, c, t, g, unknown or other
  misc_feature (196)..(215): n is a, c, g, or t
tcagtcgatcacgtcacgaccggtgctcgatttagagtgagctcgttgggtttgggtcagcctccaccaagggcccatcggtcttccccctggcaccctccctccaagagcacctctggggcacagcggccctgggctgcctggtcaaaggactacttccacgtgatcgactgagcgggctggcaaggcgcatagnnnnnnnnnnnnnnnnnnnn

SEQ ID NO: 82023 - DNA, 173 bp, Homo sapiens
  misc_feature: GYAE6OF01CEY36.38.33.C11.1.454.CMB.1.raw
  modified_base (173)..(173): a, c, t, g, unknown or other
  misc_feature (173)..(173): n is a, c, g, or t
tcagtcgatcacgtcacgaccggtgctcgatttagagtgagctcgttgggtttgggggaagaggaagactgacggtcccccaggagttcaggtgctgggcacagcggccctgggctgcctggtcaaggactacttccacgtgatcgactgagcgggctggcaaggcgcatagn

SEQ ID NO: 82024 - DNA, 227 bp, Homo sapiens
  misc_feature: GYAE6OF01CC3FX.38.33.C11.1.454.CMB.1.raw
  modified_base (196)..(227): a, c, t, g, unknown or other
  misc_feature (196)..(227): n is a, c, g, or t
tcagtcgatcacgtcacgaccggtgctcgatttagagtgagctcgttgggtttgggtcagcctaccaccaagggcccatccggtcttaccccctggccacccgtcctccaagagcacctctggggcacagcggcctgggctgcctggtcaagctacttccacgtgatcgactgagcgggctggcaaggcgcatagnnnnnnnnnnnnnnnnnnnnnnnnnnnnnnnn

SEQ ID NO: 82025 - DNA, 176 bp, Homo sapiens
  misc_feature: GYAE6OF01AT2OI.38.33.C11.1.454.CMB.1.raw
  modified_base (173)..(176): a, c, t, g, unknown or other
  misc_feature (173)..(176): n is a, c, g, or t
tcagtcgatcacgtcacgaccggtgctcgatttagagtgagctcgttgggtttgggggaagaggaagactgacggtcccccaggagttcaggtgctgggcacagcggccctgggctgcctggtcaaggactacttccacgtgatcgactgagcgggctggcaaggcgcatagnnnn

SEQ ID NO: 82026 - DNA, 173 bp, Homo sapiens; identical to SEQ ID NO: 82023
  misc_feature: GYAE6OF01EP915.38.33.C11.1.454.CMB.1.raw
  modified_base (173)..(173): a, c, t, g, unknown or other
  misc_feature (173)..(173): n is a, c, g, or t

SEQ ID NO: 82027 - DNA, 175 bp, Homo sapiens
  misc_feature: GYAE6OF01EAKDO.38.33.C11.1.454.CMB.1.raw
  modified_base (174)..(175): a, c, t, g, unknown or other
  misc_feature (174)..(175): n is a, c, g, or t
tcagtcgatcacgtcacgaccggtgctcgatttagagtgagctcgttgggtttgggggaagaggaagactgacggtccccccaggagttcaggtgctgggcacagcggccctgggctgcctggtcaaggactacttccacgtgatcgactgagcgggctggcaaggcgcatagnn

SEQ ID NO: 82028 - DNA, 198 bp, Homo sapiens
  misc_feature: GYAE6OF01AG6OR.38.33.C11.1.454.CMB.1.raw
  modified_base (195)..(198): a, c, t, g, unknown or other
  misc_feature (195)..(198): n is a, c, g, or t
tcagtcgatcacgtcacgaccggtgctcgatttagagtgagctcgttgggtttgggtcagcctccaccaagggcccatcggtcttccccctggcaccctcctccaagagcacctctgggggcacagcggccctgggctgcctggtcaaggactacttccacgtgatcgactgagcgggctggcaaggcgcatagnnnn

SEQ ID NO: 82029 - DNA, 195 bp, Homo sapiens
  misc_feature: GYAE6OF01E3DQX.38.33.C11.1.454.CMB.1.raw
  modified_base (195)..(195): a, c, t, g, unknown or other
  misc_feature (195)..(195): n is a, c, g, or t
tcagtcgatcacgtcacgaccggtgctcgatttagagtgagctcgttgggtttgggtcagcctccaccaagggcccatcggtcttccccctggcaccctcctccaagagcacctctgggggcacagcggccctgggctgcctggtcaaggactacttccacgtgatcgactgagcgggctggcaaggcgcatagn

SEQ ID NO: 82030 - DNA, 175 bp, Homo sapiens; identical to SEQ ID NO: 82021
  misc_feature: GYAE6OF01CMDLR.38.33.C11.1.454.CMB.1.raw
  modified_base (173)..(175): a, c, t, g, unknown or other
  misc_feature (173)..(175): n is a, c, g, or t

SEQ ID NO: 82031 - DNA, 198 bp, Homo sapiens
  misc_feature: GYAE6OF01EKQGL.38.33.C11.1.454.CMB.1.raw
  modified_base (194)..(198): a, c, t, g, unknown or other
  misc_feature (194)..(198): n is a, c, g, or t
tcagtcgatcacgtcacgaccggtgctcgatttagagtgagctcgttgggtttgggtcagcctccaccaagggcccatcggtcttcccctggcaccctcctccaagagcacctctgggggcacagcggccctgggctgcctggtcaaggactacttccacgtgatcgactgagcgggctggcaaggcgcatagnnnnn

SEQ ID NO: 82032 - DNA, 179 bp, Homo sapiens
  misc_feature: GYAE6OF01B4EDP.38.33.C11.1.454.CMB.1.raw
  modified_base (174)..(179): a, c, t, g, unknown or other
  misc_feature (174)..(179): n is a, c, g, or t
tcagtcgatcacgtcacgaccggtgctcgatttagagtgagctcgttgggtttgggggaagaggaagactgacggtccccccaggagttcaggtgctgggcacagcggccctgggctgcctggtcaaggactacttccacgtgatcgactgagcgggctggcaaggcgcatagnnnnnn

SEQ ID NO: 82033 - DNA, 171 bp, Homo sapiens
  misc_feature: GYAE6OF02HJBAT.38.33.C11.1.454.CMB.1.raw
  modified_base (168)..(171): a, c, t, g, unknown or other
  misc_feature (168)..(171): n is a, c, g, or t
tcagtcgatcacgtcacgaccggtgctcgatttagagtgagctcgttgggtttgggaagaggaagactgacggtccccaggagttcaggtgctgggcacagcggcctggctgcctggtcaaggactacttccacgtgatcgactgagcgggctggcaaggcgcatagnnnn

SEQ ID NO: 82034 - DNA, 194 bp, Homo sapiens
  misc_feature: GYAE6OF02HDABW.38.33.C11.1.454.CMB.1.raw
  modified_base (192)..(194): a, c, t, g, unknown or other
  misc_feature (192)..(194): n is a, c, g, or t
tcagtcgatcacgtcacgaccggtgctcgatttagagtgagctcgttgggttgggtcagcctccaccaagggcccatcggtcttcccctggcaccctcctccaagagcacctctggggcacagcggccctgggctgcctggtcaaggactacttccacgtgatcgactgagcgggctggcaaggcgcatagnnn

SEQ ID NO: 82035 - DNA, 200 bp, Homo sapiens
  misc_feature: GYAE6OF02F3PM2.38.33.C11.1.454.CMB.1.raw
  modified_base (174)..(200): a, c, t, g, unknown or other
  misc_feature (174)..(200): n is a, c, g, or t
tcagtcgatcacgtcacgaccggtgctcgatttagagtgagctcgttgggttggggaagaggaagactgacggtccccaggagttcaggtgctgggcaccagcggccctgggctggcctggtcaaggactacttccacgtgatcggactgagcgggctggcaaggcgcatacgnnnnnnnnnnnnnnnnnnnnnnnnnnn

SEQ ID NO: 82036 - DNA, 175 bp, Homo sapiens; identical to SEQ ID NO: 82021
  misc_feature: GYAE6OF02FZDOH.38.33.C11.1.454.CMB.1.raw
  modified_base (173)..(175): a, c, t, g, unknown or other
  misc_feature (173)..(175): n is a, c, g, or t

SEQ ID NO: 82037 - DNA, 195 bp, Homo sapiens
  misc_feature: GYAE6OF02GH6JA.38.33.C11.1.454.CMB.1.raw
  modified_base (128)..(128): a, c, t, g, unknown or other
  misc_feature (128)..(128): n is a, c, g, or t
  modified_base (173)..(195): a, c, t, g, unknown or other
  misc_feature (173)..(195): n is a, c, g, or t
tcagtcgatcacgtcacgaccggtgctcgatttagagtgagctcgttgggttgggggaagaggaagactgacggtcccccaggagttcaggtgctgggcacagcggccctgggctgcctggtcaaggnttacttccacgtgatcgactggagcgggctggcaaggcgcatagnnnnnnnnnnnnnnnnnnnnnnn

SEQ ID NO: 82038 - DNA, 197 bp, Homo sapiens; identical to SEQ ID NO: 82019
  misc_feature: GYAE6OF02HVYAI.38.33.C11.1.454.CMB.1.raw
  modified_base (194)..(197): a, c, t, g, unknown or other
  misc_feature (194)..(197): n is a, c, g, or t

SEQ ID NO: 82039 - DNA, 174 bp, Homo sapiens
  misc_feature: GYAE6OF02I5GY1.38.33.C11.1.454.CMB.1.raw
  modified_base (173)..(174): a, c, t, g, unknown or other
  misc_feature (173)..(174): n is a, c, g, or t
tcagtcgatcacgtcacgaccggtgctcgatttagagtgagctcgttgggtttgggggaagaggaagactgacggtcccccaggagttcaggtgctgggcacagcggccctgggctgcctggtcaaggactacttccacgtgatcgactgagcgggctggcaaggcgcatagnn

SEQ ID NO: 82040 - DNA, 174 bp, Homo sapiens; identical to SEQ ID NO: 82039
  misc_feature: GYAE6OF02GK87H.38.33.C11.1.454.CMB.1.raw
  modified_base (173)..(174): a, c, t, g, unknown or other
  misc_feature (173)..(174): n is a, c, g, or t

SEQ ID NO: 82041 - DNA, 196 bp, Homo sapiens
  misc_feature: GYAE6OF02GJTUA.38.33.C11.1.454.CMB.1.raw
  modified_base (194)..(196): a, c, t, g, unknown or other
  misc_feature (194)..(196): n is a, c, g, or t
tcagtcgatcacgtcacgaccggtgctcgatttagagtgagctcgttgggtttgggtcagcctccaccaagggcccatcggtcttcccctggcaccctcctccaagagcacctctgggggcacagcggccctgggctgcctggtcaaggactacttccacgtgatcgactgagcgggctggcaaggcgcatagnnn

SEQ ID NO: 82042 - DNA, 174 bp, Homo sapiens; identical to SEQ ID NO: 82039
  misc_feature: GYAE6OF02JH279.38.33.C11.1.454.CMB.1.raw
  modified_base (173)..(174): a, c, t, g, unknown or other
  misc_feature (173)..(174): n is a, c, g, or t

SEQ ID NO: 82043 - DNA, 177 bp, Homo sapiens
  misc_feature: GYAE6OF02HKI3C.38.33.C11.1.454.CMB.1.raw
  modified_base (173)..(177): a, c, t, g, unknown or other
  misc_feature (173)..(177): n is a, c, g, or t
tcagtcgatcacgtcacgaccggtgctcgatttagagtgagctcgttgggtttgggggaagaggaagactgacggtcccccaggagttcaggtgctgggcacagcggccctgggctgcctggtcaaggactacttccacgtgatcgactgagcgggctggcaaggcgcatagnnnnn

SEQ ID NO: 82044 - DNA, 174 bp, Homo sapiens
  misc_feature: GYAE6OF02GB1GK.38.33.C11.1.454.CMB.1.raw
  modified_base (174)..(174): a, c, t, g, unknown or other
  misc_feature (174)..(174): n is a, c, g, or t
tcagtcgatcacgtcacgaccggtgctcgatttagagtgagctcgttgggtttgggggaagaggaagactgacggtccccccaggagttcaggtgctgggcacagcggccctggtcagcctggtcaaggactacttccacgtgatcgactgagcgggctggcaaggcgcatagn

SEQ ID NO: 82045 - DNA, 251 bp, Homo sapiens
  misc_feature: GYAE6OF01CHK1L.36.34.D01.1.454.CMB.1.raw
  modified_base (246)..(251): a, c, t, g, unknown or other
  misc_feature (246)..(251): n is a, c, g, or t
tcagtacgctgtctcacgaccggtgctcgatttagatcgtctgtgttgggtttgggtgccgaagttgctggaggtcacggtcaccacgctgctgagggagtagagtcctgaggactgtaggacagcccatcggtcttcccctggcgccctgctccaggagcacctccgagagcacagcggccctgggctgcctggtcaaggactacttccagacagcgtactgagcgggctggcaaggcgcatagnnnnnn

SEQ ID NO: 82046 - DNA, 265 bp, Homo sapiens
  misc_feature: GYAE6OF01CEZ8J.36.34.D01.1.454.CMB.1.raw
  modified_base (262)..(265): a, c, t, g, unknown or other
  misc_feature (262)..(265): n is a, c, g, or t
tcagtacgctgtctcacgaccggtgctcgatttagatcgtctgtgttggggtattgtggtggcactaccagctgctaccgaaactggttcgacccctgggccagggaaccctggtcaccgtctcctcagcctccaccaagggcccatcggtcttcccctggcaccctcctccaagagcacctctggggcacagcggccctgggctgcctggtcaaggactacttccagacagcgtactgagcgggctggcaaggcgcatagnnnn

SEQ ID NO: 82047 - DNA, 249 bp, Homo sapiens
  misc_feature: GYAE6OF01BVD98.36.34.D01.1.454.CMB.1.raw
  modified_base (246)..(249): a, c, t, g, unknown or other
  misc_feature (246)..(249): n is a, c, g, or t
tcagtacgctgtctcacgaccggtgctcgatttagatcgtctgtgttgggtttgggtgccgaagttgctggaggtcacggtcaccacgctgctgagggagtagagtcctgaggactgtaggacagcccatcggtcttcccctggcgccctgctccaggagcacctccgagagcacagcggccctgggctgcctggtcaaggactacttccagacagcgtactgagcgggctggcaaggcgcatagnnnn

SEQ ID NO: 82048 - DNA, 270 bp, Homo sapiens
  misc_feature: GYAE6OF01BQBX9.36.34.D01.1.454.CMB.1.raw
  modified_base (267)..(270): a, c, t, g, unknown or other
  misc_feature (267)..(270): n is a, c, g, or t
tcagtacgctgtctcacgaccggtgctcgatttagatcgtctgtgttggggggtattgtggtggcactaccagctgctaccaaaactggttacgacccctggggccagggaaccctggtcaccgtctcctcagcctccaccaagggcccatcggtcttcccctggcaccctcctccaagagcacctctgggggcacagcggccctgggctgcctggtcaaggactacttccagacagcgtactgagcgggctggcaaggcgcatagnnnn

SEQ ID NO: 82049 - DNA, 324 bp, Homo sapiens
  misc_feature: GYAE6OF01C2M1W.36.34.D01.1.454.CMB.1.raw
  modified_base (273)..(324): a, c, t, g, unknown or other
  misc_feature (273)..(324): n is a, c, g, or t
tcagtacgctgtctcacgaccggtgctcgatttagatcgtctgtgttgggggtagttgtggtggcactaccagctggctaccgaaactggttcgacccctggggccagggaaccctcggtcaccgttctccttcagcctccaccaagggccatcggtcttccccctggcaccctccgtccaagagcacctctgggggcacagcggccctgggctgcctggtcaaggcgtacttccagaccagcgtactgagcgggctggcaaggcgcattagnnnnnnnnnnnnnnnnnnnnnnnnnnnnnnnnnnnnnnnnnnnnnnnnnnnn

SEQ ID NO: 82050 - DNA, 515 bp, Homo sapiens
  misc_feature: GYAE6OF01CS4DK.36.34.D01.1.454.CMB.1.raw
  modified_base (478)..(478): a, c, t, g, unknown or other
  misc_feature (478)..(478): n is a, c, g, or t
tcagtacgctgtctcacgaccggtgctcgatttagatcgtctgtgttgggtttggggacccaaaaccacacccctccttgggagaatcccctagatcacagctcctcaccatggactggacctggagcatccttttcttggtggcggcagcaacaggtgcccactcccaggttcacctggtgcagtctggagctgaggtgaagaagcctggggcctcagtgaaggtctcctgcaaggcttctggttacatctttaggaggtatgcaatcacctgggtgcgacaggcccctggacaagggcttgagtggatgggatggatcagcgcttacaatggtaacacaaattatgaacagaagttccagggcagagtcacatgaccacaaacacatccacgagcacagcctacatggagctgaggagcctgagatctgacgacacggccgtgtattattgtgcggaggggggtattggtggtggnacgtaccagctgctaccgaatcggtcgcccgtcgggg

SEQ ID NO: 82051 - DNA, 253 bp, Homo sapiens
  misc_feature: GYAE6OF01A9O0S.36.34.D01.1.454.CMB.1.raw
  modified_base (246)..(253): a, c, t, g, unknown or other
  misc_feature (246)..(253): n is a, c, g, or t
tcagtacgctgtctcacgaccggtgctcgatttagatcgtctgtgttgggtttgggtgccgaagttgctggaggtcacggtcaccacgctgctgagggagtagagtcctgaggactgtaggacagcccatcggtcttcccctggcgccctgctccaggagcacctccgagagcacagcggccctgggctgcctggtcaaggattacttccagacagcgtactgagcgggctggcaaggcgcatagnnnnnnnn

SEQ ID NO: 82052 - DNA, 427 bp, Homo sapiens
  misc_feature: GYAE6OF01ED7GU.36.34.D01.1.454.CMB.1.raw
  modified_base (422)..(427): a, c, t, g, unknown or other
  misc_feature (422)..(427): n is a, c, g, or t
tcagtacgctgtctcacgaccggtgctcgatttagatcgtctgtgtctctgggcgagagggccaccatcaactgcaggtccagccagagtgttttatacagctccaacaataagaactacttaacttggtaccagcagaaaccaggacagcctcctaaactgctcatttactgggcatctacccgggaatccggggtcctgaccgattcagtggcagcgggtctgggacagatttcactctcaccatcagcagcctgcaggctgaagatgtggcagtttattactgtcagcaatattatagtattccgctcactttcggcggagggccaaggtggagatcaaacgaactgtggctgcaccatctgtcttcatcttcccgccatctgaagacagctatgagcgggctgggcaaggcgcatagnnnnnn

SEQ ID NO: 82053 - DNA, 174 bp, Homo sapiens
  misc_feature: GYAE6OF01B16B2.36.34.D01.1.454.CMB.1.raw
  modified_base (173)..(174): a, c, t, g, unknown or other
  misc_feature (173)..(174): n is a, c, g, or t
tcagtacgctgtctcacgaccggtgctcgatttagatcgtctgtgttgggtttgggggaagaggaagactgacggtcccccaggagttcaggtgctgggcacagcggccctgggctgcctggtcaaggactacttccagacagcgtactgagcgggctggcaaggcgcatagnn

SEQ ID NO: 82054 - DNA, 282 bp, Homo sapiens
  misc_feature: GYAE6OF01AF5LY.36.34.D01.1.454.CMB.1.raw
  modified_base (267)..(282): a, c, t, g, unknown or other
  misc_feature (267)..(282): n is a, c, g, or t
tcagtacgctgtctcacgaccggtgctcgatttagatcgtctgtggttggggggtattgtggtggcactaccagctgctaccgaaactggttcgacccctgggccagggaaccctggtcaccgtctcctcagcctccaccaagggcccatcggtcttccccctggcaccctcctccaagagcacctctggggcacagcggccctgggctgcctggtcaaggactacttccagacagcgtactggagcgggctggcaaggcgcatagnnnnnnnnnnnnnnnn

SEQ ID NO: 82055 - DNA, 297 bp, Homo sapiens
  misc_feature: GYAE6OF01BNHPZ.36.34.D01.1.454.CMB.1.raw
  modified_base (270)..(297): a, c, t, g, unknown or other
  misc_feature (270)..(297): n is a, c, g, or t
tcagtacgctgtctcacgaccggtgctcgatttagatcgtctgtgttgggggggtattgtggtggcactaccagctgctaccgaaactggttcgacccctggggccagggaaccctggtcaccgtctcctcagcctccaccaagggcccatcggtcttccccctggcaccctcctccaagagcaacctctgggggcacagcggccctgggctgcctggtcaaggactacttccagacagcgtactggagcgggctggcaaggcgcatagnnnnnnnnnnnnnnnnnnnnnnnnnnnn

SEQ ID NO: 82056 - DNA, 271 bp, Homo sapiens
  misc_feature: GYAE6OF01CH5ZF.36.34.D01.1.454.CMB.1.raw
  modified_base (268)..(271): a, c, t, g, unknown or other
  misc_feature (268)..(271): n is a, c, g, or t
tcagtacgctgtctcacgaccggtgctcgatttagatcgtctgtgttgggggggtattgtggtggcactaccagctgctaccgaaactggttcgacccctggggccagggaaccctggtcaccgtctcctcagcctccaccaagggcccatcggtcttccccctggcaccctcctccaagagcacctctgggggcacagcggccctgggctgcctggtcaaggactacttccagacagcgtactgagcgggctggcaaggcgcatagnnnn

SEQ ID NO: 82057 - DNA, 265 bp, Homo sapiens
  misc_feature: GYAE6OF01EKVN0.36.34.D01.1.454.CMB.1.raw
  modified_base (194)..(194): a, c, t, g, unknown or other
  misc_feature (194)..(194): n is a, c, g, or t
  modified_base (264)..(265): a, c, t, g, unknown or other
  misc_feature (264)..(265): n is a, c, g, or t
tcagtacgctgtctcacgaccggtgctcgatttagatcgtctgtgttgggggtattgtggtggcactaccagctgctaccgaaactggttcgacccctggggccagggaaccctggtcaccgtctcctcagcctccaccaagggcccatcggtcttcccctggcaccctcctccaagagcacctctggggcacngcggccctgggctgcctggtcaaggactacttccagacagcgtactgagcgggctggcaaggcgcatagnn

SEQ ID NO: 82058 - DNA, 267 bp, Homo sapiens
  misc_feature: GYAE6OF01CHZ93.36.34.D01.1.454.CMB.1.raw
  modified_base (265)..(267): a, c, t, g, unknown or other
  misc_feature (265)..(267): n is a, c, g, or t
tcagtacgctgtctcacgaccggtgctcgatttagatcgtctgtgttgggggggtattgtggtggcactaccagctgctaccgaaactggttcgacccctggggccagggaaccctggtcaccgtctcctcagcctccaccaagggcccatcggtcttcccctggcaccctcctccaagagcacctctggggcacagcggccctgggctgcctggtcaaggactacttccagacagcgtactgagcggctggcaaggcgcatagnnn

SEQ ID NO: 82059 - DNA, 270 bp, Homo sapiens
  misc_feature: GYAE6OF01COT5L.36.34.D01.1.454.CMB.1.raw
  modified_base (267)..(270): a, c, t, g, unknown or other
  misc_feature (267)..(270): n is a, c, g, or t
tcagtacgctgtctcacgaccggtgctcgatttagatcgtctgtgttgggggggtattgtggtggcactaccagctgctaccgaaactggttcgacccctggggccagggaaccctggtcaccgtctcctcagcctccaccaagggcccatcggtcttccccctggcaccctcctccaagagcacctctggggcacagcggccctgggctgcctggtcaaggactacttccagacagcgtactgagcgggctggcaaggcgcatagnnnn

SEQ ID NO: 82060 - DNA, 631 bp, Homo sapiens
  misc_feature: GYAE6OF01AU4ID.36.34.D01.1.454.CMB.1.raw
  modified_base (354)..(354): a, c, t, g, unknown or other
  misc_feature (354)..(354): n is a, c, g, or t
  modified_base (359)..(359): a, c, t, g, unknown or other
  misc_feature (359)..(359): n is a, c, g, or t
tcagtacgctgtctcacgaccggtgctcgatttagatcgtctgtgttgggtttggggacccaaaaaccacacccctccttgggagaatcccctagatcacagctcctcaccatggactggacctggagcatccttttcttggtggcggcagcaacaggtgcccactcccaggttcacctggtgcagtctggagctgaggtgaagaagcctggggcctcagtgaaggtctcctgcaaggcttctggttacattcgtttaggaggtatgcaatcaccgtgggtgcgacaggcccctggacgaagggcttggagtggatgggatggatcagcgcttacaatggtaacaacaaattanagaanagaagttccagggcagagtcacagtacgacaacaacacactaccacgagacaacacgacctaacagtaggacgacgtagaggagaccgtagaagagtacgtagaaccgaccgacgggtaccgttagttacgttagttaggtacgggtacggggtagggggggttacgtttaggggtgggttacgggtacgtaaccggtaccgacggtccgtaccggtaccgttaaccggtaaaaccggtttccgggttacccggtaccccggtacccggggg

SEQ ID NO: 82061 - DNA, 538 bp, Homo sapiens
  misc_feature: GYAE6OF01CCZED.36.34.D01.1.454.CMB.1.raw
tcagtacgctgtctcacgaccggtgctcgatttagatcgtctgtgttgggtttggggacccaaaaaccacacccctccttgggagaatcccctagatcacagctcctcaccatggactggacctggagcatccttttcttggtggcggcagcaacaggtgcccactcccaggttcacctggtgcagtctggagctgaggtgaagaagcctggggcctcagtgaaggtctcctgcaaggcttctggttacatctttaggaggtatgcaatcacctgggtgcgacaggcccctggacaagggcttgagtggatgggatggatcagcgcttacaatggtaacacaaaattatgaacagaagttccagggcagagtcacatgaccacaaacacataccacgagcacagcctacagtggagctgaggagcctagagatctagacgacgacggtccgtgtattattgtggcgggtaggggggtattgggtggtggacgactccgagcgtcgtactaccgaactcggttccgccccggtacgggg

SEQ ID NO: 82062 - DNA, 613 bp, Homo sapiens
  misc_feature: GYAE6OF01EN9RC.36.34.D01.1.454.CMB.1.raw
tcagtacgctgtctcacgaccggtgctcgatttagatcgtctgtgttgggtttggggacccaaaaaccacacccctccttgggagaatcccctagatcacagctcctcaccatggactggacctggagcatccttttcttggtggcggcagcaacaggtgcccactcccaggttcacctggtgcagtctggagctgaggtgaagaagcctggggcctcagtgaaggtctcctgcaaggcttctggttacatctttaggaggtatgcaatcaccgtgggtgcgacacggccctggacaagggcttggagtggatgggatggatcgagcgcttaacaatggtaaacaactaaattatagaaacagtaagttccgagggcagagtacaccatacgaaccaacaaacacactaccacgacgacacacgacctacagtaggagcgtagaggacgccgtagagactcgtacgaccgaccgacgggtaccgttagttagtttagttggtagggcggggtagggggggttagttgggttgggtcggtacgtaacggtaccgtaggtccgtacggtaccgtaacccgtaaacggttcgggttcccggtaccccggtacgggg

SEQ ID NO: 82063 - DNA, 553 bp, Homo sapiens
  misc_feature: GYAE6OF01A04AZ.36.34.D01.1.454.CMB.1.raw
tcagtacgctgtctcacgaccggtgctcgatttagatcgtctgtgttgggtttggggacccaaaaaccacacccctccttgggagaatcccctagatcacagctcctcaccatggactggacctggagcatccttttcttggtggcggcagcaacaggtgcccactcccaggttcacctggtgcagtctggagctgaggtgaagaagcctggggcctcagtgaaggtctcctgcaaggcttctggttacatctttaggaggtatgcaatcacctgggtgcgacaggcccctggacaagggcttgagtggatgggatggatcagcgcttacaatggtaacacaaattatagaacagaagttccagggcagagtcacatgaccacaaacacatccacgacgacacacgacctacagtggagctggaggagcctagagatctagacgacgacggtccgtagttattagttggtggcgggtaggggggttagttgggtgggtcggcgacgtaccgagtctcgtacgtaccgaacgttcggttccgtcccggtcgggg

SEQ ID NO: 82064 - DNA, 537 bp, Homo sapiens
  misc_feature: GYAE6OF01A8HZS.36.34.D01.1.454.CMB.1.raw
  modified_base (326)..(326): a, c, t, g, unknown or other
  misc_feature (326)..(326): n is a, c, g, or t
  modified_base (434)..(434): a, c, t, g, unknown or other
  misc_feature (434)..(434): n is a, c, g, or t
tcagtacgctgtctcacgaccggtgctcgatttagatcgtctgtgttgggtttggggacccaaaaaccacacccctccttgggagaatcccctagatcacagctcctcaccatggactggacctggagcatccttttcttggtggcggcagcaacaggtgcccactcccaggttcacctggtgcagtctggagctgaggtgaagaagcctggggcctcagtgaaggtctcctgcaaggcttctggttacatctttaggaggtatgcaatcacctgggtgcgacaggcccctggacaagggcttgagtggatgggatggatcagcgnttacaatggtaacacaaattatagaacagaagttccagggcagagtcaccataacacaaacacactcacgagacacagcctacatggagcgtgaggagcctgagatcngacgacgacggcgtagtattagttgtggcgggaggggggtattggtggtggcgtagacgagcgtgacgtaccgaacgtggttccgacccgtcggggtacccgg

SEQ ID NO: 82065 - DNA, 684 bp, Homo sapiens
  misc_feature: GYAE6OF01CTB7T.36.34.D01.1.454.CMB.1.raw
tcagtacgctgtctcacgaccggtgctcgatttagatcgtctgtgttgggtttggggacccaaaaaccacacccctccttgggagaatcccctagatcacagctcctcaccatggactggacctggagcatccttttcttggtggcggcagcaacaggtgcccactcccaggttcacctggtgcagtctggagctgaggtgaagaagcctggggcctcagtgaaggtctcctgcaaggcttctggttacattctttaggaggtatgcaatcaccgtgggtgcgacacggccctggacaagggcttggagtggagtgggatggatcgagcgtacttacaagtggtaaacaactaaaattagtacgaaacgaaggtaaacgttaccgaaggggacaaggtaacggttaccaaccaagttacggaaacccaaacaaaaccaacactaccaacgaacgaccaacacgacctaacgaacgtaggacgcgtaggaggacgccgtagaagagtacgtagaccgtaacgaccggtaccgttagttaacgtttagttaggtcgggtacggggtaagggggggttgttaggggttacgggtcgggtacgtaccgtaaccggtacggtaccgttacggtacccgttaaccggtaaaccggttcgggttacccggtaaccccgggttacccggggg

SEQ ID NO: 82066 - DNA, 529 bp, Homo sapiens
  misc_feature: GYAE6OF01CYNAF.36.34.D01.1.454.CMB.1.raw
  modified_base (486)..(486): a, c, t, g, unknown or other
  misc_feature (486)..(486): n is a, c, g, or t
tcagtacgctgtctcacgaccggtgctcgatttagatcgtctgtgttgggtttggggacccaaaaaccacacccctccttgggagaatcccctagatcacagctcctcaccatggactggacctggagcatccttttcttggtggcggcagcaacaggtgcccactcccaggttcacctggtgcagtctggagctgaggtgaagaagcctggggcctcagtgaaggtctcctgcaaggcttctggttacatctttaggaggtatgcaatcacctgggtgcgacaggccctggacagggcttgagtgatgggatggatcagcgcttacaatggaacacaaattatgaacagaagttccagggcagagtcaccatgaccaacaaacacatccacgagcacagacctacatggagctagagagcctgagatctagacgacacggtccgtgtattagttgtggtcgggaggggggtattgggtggtcggngacgtaccgagtctgctaccgaatcggtccgacccgtacgggg

SEQ ID NO: 82067 - DNA, 610 bp, Homo sapiens
  misc_feature: GYAE6OF01BCB0S.36.34.D01.1.454.CMB.1.raw
  modified_base (284)..(284): a, c, t, g, unknown or other
  misc_feature (284)..(284): n is a, c, g, or t
  modified_base (354)..(354): a, c, t, g, unknown or other
  misc_feature (354)..(354): n is a, c, g, or t
  modified_base (535)..(535): a, c, t, g, unknown or other
  misc_feature (535)..(535): n is a, c, g, or t
tcagtacgctgtctcacgaccggtgctcgatttagatcgtctgtgttgggtttggggacccaaaaaccacacccctccttgggagaatcccctagatcacagctcctcaccatggactggacctggagcatccttttcttggtggcggcagcaacaggtgcccactcccaggttcacctggtgcagtctggagctgaggtgaagaagcctggggcctcagtgaaggtctcctgcaaggcttctggttacatctttaggagtatgcaatcaccgtgggtgcgacnggcccctggacaagggcttgagtggatgggatggatcgaggcgcttacaagtggtaaacactaaaattanacgaaacaggtaacgttccgaaggggcaagacgtcaaccatacgaaccaacaaacacaactacccgaacgacgacaacacgtacctaacagtacggagcgtaggaggacgccgtaggacgatcgtagacgaccgaccggtccgtagttaacgttagtggtacgggcgggtagggggggttnttgggtgggtcgggtcgacgtaccgaggtcgtcgtaccgtaccggtaacgtcggtacccggcccggtaccggggg

SEQ ID NO: 82068 - DNA, 296 bp, Homo sapiens
  misc_feature: GYAE6OF01B6COT.36.34.D01.1.454.CMB.1.raw
  modified_base (268)..(296): a, c, t, g, unknown or other
  misc_feature (268)..(296): n is a, c, g, or t
tcagtacgctgtctcacgaccggtgctcgatttagatcgtctgtgttgggggggtagttgtggtggcactacagctgctaccgaaactggttcgacccctggggccagggaaccctggtcaccgtctccgtcagcctccaccaagggcccatcggtcttcccctggccaccctcctccaagagcacctctgggggcacagcggccctgggctgcctggtcaaggactacttccagacagcgtactgagcggctggcaaggcgcatagnnnnnnnnnnnnnnnnnnnnnnnnnnnnn

SEQ ID NO: 82069 - DNA, 274 bp, Homo sapiens
  misc_feature: GYAE6OF01BH270.36.34.D01.1.454.CMB.1.raw
  modified_base (268)..(274): a, c, t, g, unknown or other
  misc_feature (268)..(274): n is a, c, g, or t
tcagtacgctgtctcacgaccggtgctcgatttagatcgtctgtgttgggggggtattgtggtggcactaccagctgctaccgaaactggttcgacccctggggccagggaaccctggtcaccgtctcctcagcctccaccaagggcccatcggtcttccccctggcaccctcctccaagagcacctctgggggcacagcggccctgggctgcctggtcaaggactacttccagacagcgtactgagcgggctggcaaggcgcatagnnnnnnn

SEQ ID NO: 82070 - DNA, 340 bp, Homo sapiens
  misc_feature: GYAE6OF01BJX7Z.36.34.D01.1.454.CMB.1.raw
  modified_base (274)..(275): a, c, t, g, unknown or other
  misc_feature (274)..(275): n is a, c, g, or t
  modified_base (277)..(277): a, c, t, g, unknown or other
  misc_feature (277)..(277): n is a, c, g, or t
  modified_base (280)..(280): a, c, t, g, unknown or other
  misc_feature (280)..(280): n is a, c, g, or t
  modified_base (289)..(298): a, c, t, g, unknown or other
  misc_feature (289)..(298): n is a, c, g, or t
  modified_base (300)..(302): a, c, t, g, unknown or other
  misc_feature (300)..(302): n is a, c, g, or t
  modified_base (304)..(304): a, c, t, g, unknown or other
  misc_feature (304)..(304): n is a, c, g, or t
  modified_base (306)..(340): a, c, t, g, unknown or other
  misc_feature (306)..(340): n is a, c, g, or t
tcagtacgctgtctcacgaccggtgctcgatttagatcgtctgtggttggggggggtattggtggtggcactaccagctgctaccgaaactggttcgacccctggggccagggaaccctggtcaccgtctcctcagcctccaccaagggcccatcggtcttccccctggccaccctcctccaaagagcacctctgggggcacagcggccctgggctgcctggtcaaggactacttccagacagcgtactgagcgggctggacaagcgacatagnnancgntagcagcannnnnnnnnncnnncncnnnnnnnnnnnnnnnnnnnnnnnnnnnnnnnnnnn

SEQ ID NO: 82071 - DNA, 271 bp, Homo sapiens
  misc_feature: GYAE6OF01DAOHE.36.34.D01.1.454.CMB.1.raw
  modified_base (266)..(271): a, c, t, g, unknown or other
  misc_feature (266)..(271): n is a, c, g, or t
tcagtacgctgtctcacgaccggtgctcgatttagatcgtctgtgttgggggggtattgtggtggcactaccagctgctaccgaaactggttcgacccctggggccagggaaccctggtcaccgtctcctcagcctccaccaagggccatcggtcttcccctggcaccctcctccaagagcacctctgggggcacagcggccctgggctgcctggtcaaggactacttccagacagcgtactgagcgggctggcaaggcgcatagnnnnnn

SEQ ID NO: 82072 - DNA, 549 bp, Homo sapiens
  misc_feature: GYAE6OF01D7O99.36.34.D01.1.454.CMB.1.raw
tcagtacgctgtctcacgaccggtgctcgatttagatcgtctgtgttgggtttgggggagctacaacaggcaggcaggggcagcaagatggtgttgcagacccaggtcttcatttctctgttgctctggatctctggtgcctgcggggacatcgtgatgacccagtctccagactccctggctgtgtctctgggcgagagggccaccatcaactgcaggtccagccagagtgttttatacagctccaacaataagaactacttaactggtaccagcaagaaaccaggacagcctacctaaaactgactcatttactgggcatcctaacccgggaatcccggggtcctgaccgattcagtgcaggcggtctgggacagtattcactctacaccatcagcagcctgcaggctgaacatgtggctagtttatactgtacagactaattattatagttacttcccgacttacctacgtttcgggacgggtaacgggaccctaagggtgggaaagtattaaccgaaacggtaacttggtacggctcggtaaccc

SEQ ID NO: 82073 - DNA, 563 bp, Homo sapiens
  misc_feature: GYAE6OF01ETCL9.36.34.D01.1.454.CMB.1.raw
  modified_base (328)..(328): a, c, t, g, unknown or other
  misc_feature (328)..(328): n is a, c, g, or t
  modified_base (349)..(349): a, c, t, g, unknown or other
  misc_feature (349)..(349): n is a, c, g, or t
  modified_base (396)..(396): a, c, t, g, unknown or other
  misc_feature (396)..(396): n is a, c, g, or t
tcagtacgctgtctcacgaccggtgctcgatttagatcgtctgtgttgggtttggggacccaaaaaccacacccctccttgggagaatcccctagatcacagctcctcaccatggactggacctggagcatccttttcttggtggcggcagcaacaggtgcccactcccaggttcacctggtgcagtctggagctgaggtgaagaagcctggggcctcagtgaaggtctcctgcaaggcttctggttacatctttaggaggtatgcaatcaccgtgggtgcgacaggccctggacaagggcttggagtggatggggatggatcagcgnttacaatggtaacacaaattnagaacagaagttccgaagggcaagacgtcaaccatgaaccacaaacncactaccacgagcacacgacctacatggagcgtagaggagccgtagagatcgtagacgacgacggtcgtagttattagttggtggtcgggtagggggggtattgggtgggtggacgacgtacgagtcgtacgtacgtaacgaaacgttcggttccgcccgtacgggg

SEQ ID NO: 82074 - DNA, 271 bp, Homo sapiens; identical to SEQ ID NO: 82056
  misc_feature: GYAE6OF01CWKX3.36.34.D01.1.454.CMB.1.raw
  modified_base (268)..(271): a, c, t, g, unknown or other
  misc_feature (268)..(271): n is a, c, g, or t

SEQ ID NO: 82075 - DNA, 273 bp, Homo sapiens
  misc_feature: GYAE6OF01DRR7C.36.34.D01.1.454.CMB.1.raw
  modified_base (268)..(273): a, c, t, g, unknown or other
  misc_feature (268)..(273): n is a, c, g, or t
tcagtacgctgtctcacgaccggtgctcgatttagatcgtctgtgttgggggggtattgtggtggcactaccagctgctaccgaaactggttcgacccctggggccagggaaccctggtcaccgtctcctcagcctccaccaagggcccatcggtcttccccctggcaccctcctccaagagcacctctgggggcacagcggccctgggctgcctggtcaaggactacttccagacagcgtactgagcgggctggcaaggcgcatagnnnnnn

SEQ ID NO: 82076 - DNA, 312 bp, Homo sapiens
  misc_feature: GYAE6OF01BQ1W0.36.34.D01.1.454.CMB.1.raw
  modified_base (270)..(270): a, c, t, g, unknown or other
  misc_feature (270)..(270): n is a, c, g, or t
  modified_base (273)..(312): a, c, t, g, unknown or other
  misc_feature (273)..(312): n is a, c, g, or t
tcagtacgctgtctcacgaccggtgctcgatttagatcgtctgtgttggggggggtagttgtggtggcactacagctgctaccgaaactggttcgacccctggggccagggaaccctggtccaccgtctcctcagcctccaccgaagggcccatcggtcttccccctggcaccctcctccaagacgcacctctcgggggcacagcggccctgggctgcctggtcaaggtctacttccagacagcgtactgagcggctggcaaggcgcaanagnnnnnnnnnnnnnnnnnnnnnnnnnnnnnnnnnnnnnnnn

SEQ ID NO: 82077 - DNA, 608 bp, Homo sapiens
  misc_feature: GYAE6OF01CQDS1.36.34.D01.1.454.CMB.1.raw
tcagtacgctgtctcacgaccggtgctcgatttagatcgtctgtgttgggtttggggacccaaaaaccacacccctccttgggagaatcccctagatcacagctcctcaccatggactggacctggagcatccttttcttggtggcggcagcaacaggtgcccactcccaggttcacctggtgcagtctggagctgaggtgaagaagcctggggcctcagtgaaggtctcctgcaaggcttctggttacattctttaggagtatgcaatcacctgggtgcgacacggcccctggacgagggcttggagtggagtgggatggatcgagcgtcttacaatggtaacacaaattatagaactagaacgttccagggcaagagtacacatacgaccaacaaacacactaccacgacgcaacacgacctacgagtcggacgcgtaggaggacgccgtagagactacgtacgacgacgacgggtccgttgttattagttggtagggtcggggtaagggggggttacgttgggtcgggtgggacgtaacgttacccgagtcgtacggtaccgtaaccggtaacgttcgggttacccggtccccgggtaccggggg

SEQ ID NO: 82078 - DNA, 353 bp, Homo sapiens
  misc_feature: GYAE6OF01CG8AY.36.34.D01.1.454.CMB.1.raw
  modified_base (259)..(259): a, c, t, g, unknown or other
  misc_feature (259)..(259): n is a, c, g, or t
  modified_base (278)..(278): a, c, t, g, unknown or other
  misc_feature (278)..(278): n is a, c, g, or t
  modified_base (280)..(281): a, c, t, g, unknown or other
  misc_feature (280)..(281): n is a, c, g, or t
  modified_base (283)..(283): a, c, t, g, unknown or other
  misc_feature (283)..(283): n is a, c, g, or t
  modified_base (285)..(285): a, c, t, g, unknown or other
  misc_feature (285)..(285): n is a, c, g, or t
  modified_base (287)..(287): a, c, t, g, unknown or other
  misc_feature (287)..(287): n is a, c, g, or t
  modified_base (289)..(290): a, c, t, g, unknown or other
  misc_feature (289)..(290): n is a, c, g, or t
  modified_base (293)..(293): a, c, t, g, unknown or other
  misc_feature (293)..(293): n is a, c, g, or t
  modified_base (295)..(295): a, c, t, g, unknown or other
  misc_feature (295)..(295): n is a, c, g, or t
  modified_base (298)..(353): a, c, t, g, unknown or other
  misc_feature (298)..(353): n is a, c, g, or t
tcagtacgctgtctcacgaccggtgctcgatttagatcgtctgtggttggggggggtattgtggtggcactacccagctagctaccggaaactcggttcgacccctgggccagggaaccctggtcaccgtctcctcagcctccaccaagggcccatcggtcttccccctaggcaccctcctccaagacgcacctctggggcacagcggccctgggctggcctggtcaaggactacttccagacagcgtactgagcgggntggcaaaggcgtcactagnannanangnannacngntcnnnnnnnnnnnnnnnnnnnnnnnnnnnnnnnnnnnnnnnnnnnnnnnnnnnnnnnn

SEQ ID NO: 82079 - DNA, 1022 bp, Homo sapiens
  misc_feature: GYAE6OF01ECRD7.36.34.D01.1.454.CMB.1.raw
  modified_base (180)..(180): a, c, t, g, unknown or other
  misc_feature (180)..(180): n is a, c, g, or t
tcagtacgctgtctcacgaccggtgctcgatttagatcgtctgtgttgggtttgggtgcgggggcgtgggctgccctcataagggcctcccagacaggagtgcagtgggcctggaaggtaggaataggccagagaggcccagctgggcagggagagcagtccagggtggcgtctgccctntgcgggcttggagtcggcgtggggcgctccatccctcagccccacgggcctctgcttggtcggcctctctgttcgcctcccgtgggacgcacggccacgaggccggggaccaaacccgtagggacctacgtttaacggtacggtccggttacggttccggttaggggggaacgcccgggttcggggggtcccttaccccggggtttaggggaaccccgggtcccccccggtttgggaacccggtaacgggggaaacgggggccccgaaacccgggggggccccccggggaaagtccccgaaaacccggtacccttacccaacccccgtttaccccccccaaagtttaacccccgaaaaccccggttcggggaacccggggtttacccgttggggtaaacccgttcccccgggtttaagggtttccgggtttaacccccccgggtttaaaggggtaaccccggttacgggttaaaccccgggtttaccccccggggggaaaggtaacccggggtacccccggggttaacccgggggttccccccccttttaccccccccgtttttgggttttccccccggtagggggtaaccccggtccccggggttttaaccgggggtccccctttccgggacccccccggtttggggaacccccggtaccgggtcccccgtttaagggaaccccgtaaacccggttccccccgggtacccggggttacggggtccgttacccggggtacgggggtaacgggaacccgtacggggtacccctaccgggacccgggtacccccgtaccgttacccggtaccggaacgggttccgtacgttcccgttacccggg

SEQ ID NO: 82080 - DNA, 271 bp, Homo sapiens
  misc_feature: GYAE6OF01AJ3EN.36.34.D01.1.454.CMB.1.raw
  modified_base (266)..(271): a, c, t, g, unknown or other
  misc_feature (266)..(271): n is a, c, g, or t
tcagtacgctgtctcacgaccggtgctcgatttagatcgtctgtgttggggagggtattgtggtggcactaccagctgctaccgaaactggttcgacccctgggccagggaaccctggtcaccgtctcctcagcctccaccaaggcccatcggtcttccccctggcaccctcctccaagagcacctctgggggcacagcggccctgggctgcctggtcaaggactacttccagaagcgtactgagcgggctggcaaggcgcatagnnnnnn

SEQ ID NO: 82081 - DNA, 570 bp, Homo sapiens
  misc_feature: GYAE6OF01CYHKF.36.34.D01.1.454.CMB.1.raw
tcagtacgctgtctcacgaccggtgctcgatttagatcgtctgtgttgggtttggggacccaaaaaccacacccctccttgggagaatcccctagatcacagctcctcaccatggactggacctggagcatccttttcttggtggcggcagcaacaggtgcccactcccaggttcacctggtgcagtctggagctgaggtgaagaagcctggggcctcagtgaaggtctcctgcaaggcttctggttacatctttaggaggtatgcaatcaccgtgggtgcgacaggcccctggacagggcttgaggtggatgggatggatcagcgtcttacaatggtaacactaaattatagaacagaagtccagggcagagtcacatgacaacaacacatccacgagacaacacgactacataggagcgtgaaggagacctagagactcgtacgaccgacgaccgggaccgttagtaactttagttggtggacgggtaggggggttacgttgggtaggtggcaacgtacgacgtacgtcgtactaccggtaacgttcggtcccgtaccggtaccgggg

SEQ ID NO: 82082 - DNA, 666 bp, Homo sapiens
  misc_feature: GYAE6OF01DJ9O4.36.34.D01.1.454.CMB.1.raw
  modified_base (262)..(262): a, c, t, g, unknown or other
  misc_feature (262)..(262): n is a, c, g, or t
tcagtacgctgtctcacgaccggtgctcgatttagatcgtctgtgttgggtttggggacccaaaaaccacacccctccttgggagaatcccctagatcacagctcctcaccatggactggacctggagcatccttttcttggtggcggcagcaacaggtgcccactcccaggttcacctggtgcagtctggagctgaggtgaagaagcctggggcctcagtgaaggtctcctgcaaggcttctggttacatctttaggagtntgcaatcaccgtgggtgcgacacggccctggacaagggcttgagtggagtgggatggatcgagcgcttaacaagtggtaaacactaaattatagaacagtaagttccgaagggcaaggagtccaaccgtatacggaaacccaaaccaaaactacgaactacccgaacgaacgacaaccacgacctaacagtggagacgtgaaggacgtccgtagacgacgttcacggtacgaaccgtaccgggtaccggttacgttatttagtttaggtgggtaccgggggtaaggggggggtacgtttagggtcggggttacgggtacgttaaccgtaccgacggtccgtacggtaccgtaaaccggtaaaccggtttccgggttacccgggtaccccgggtaacccgggggg

SEQ ID NO: 82083 - DNA, 587 bp, Homo sapiens
  misc_feature: GYAE6OF01BV82S.36.34.D01.1.454.CMB.1.raw
  modified_base (324)..(324): a, c, t, g, unknown or other
  misc_feature (324)..(324): n is a, c, g, or t
  modified_base (526)..(526): a, c, t, g, unknown or other
  misc_feature (526)..(526): n is a, c, g, or t
tcagtacgctgtctcacgaccggtgctcgatttagatcgtctgtgttgggtttggggacccaaaaaccacacccctccttgggagaatcccctagatcacagctcctcaccatggactggacctggagcatccttttcttggtggcggcagcaacaggtgcccactcccaggttcacctggtgcagtctggagctgaggtgaagaagcctggggcctcagtgaaggtctcctgcaaggcttctggttacatctttaggagtatgcaatcacctggtgcgacaggccctggacaagggcttgagtggatgggatggatcagcgtnttacaatggtaaacactaaattatagaacagaagttccgaagggcaaggagtacaaccatacgaaccaacaaacaacactaccaacgagacaacacgacctaacataggagactggaggacgccgtgagattcgtagacgacgacgggtcgtagttattagttggtggtacggggtagggggggtattagggtgggttcggngaacgttaccgagcttaggaccttaaccggtaaacgttcgggtaccgacccggtaccgggg

SEQ ID NO: 82084 - DNA, 630 bp, Homo sapiens
  misc_feature: GYAE6OF01DTNGD.36.34.D01.1.454.CMB.1.raw
tcagtacgctgtctcacgaccggtgctcgatttagatcgtctgtgttgggtttggggacccaaaaaccacacccctccttgggagaatcccctagatcacagctcctcaccatggactggacctggagcatccttttcttggtggcggcagcaacaggtgcccactcccaggttcacctggtgcagtctggagctgaggtgaagaagcctggggcctcagtgaaggtctcctgcaaggcttctggttacattctttaggaggtatgcaatcaccgtgggtgcgacacggccccgtggacgaagggcttggaggtggatggggatgggatcgaggcgtacttaacaagtcggtaaacactaaaattatagaacagtaagttccgagggcagacgtacaccatcgaaccaacaaacacactaccacgaacgacaacacgacctaacagtaggacgcgtaggaggacgtccgtaggaacgtagtcgtaggaccgacgaccgggtccggttagtttagttagttggtagggtacggggtaggggggggttattgggtgggtcggtacgtacgtaccgacgtcgtacggtaccgtaaccggtaacgttcgggtcccggtaccccggtaccggggg

SEQ ID NO: 82085 - DNA, 271 bp, Homo sapiens
  misc_feature: GYAE6OF01EMPYM.36.34.D01.1.454.CMB.1.raw
  modified_base (268)..(271): a, c, t, g, unknown or other
  misc_feature (268)..(271): n is a, c, g, or t
tcagtacgctgtctcacgaccggtgctcgatttagatcgtctgtgttgggggggtattgtggtggcactaccagctgctaccgaaactggttcgacccctggggccagggaaccctggtcaccgtctcctcagcctccaccaagggcccatcggtcttccccctggcaccctcctccaagagcacctctgggggcacagcggccctgggctgcttggtcaaggactacttccagacagcgtactgagcgggctggcaaggcgcatagnnnn

SEQ ID NO: 82086 - DNA, 772 bp, Homo sapiens
  misc_feature: GYAE6OF01DVSEG.36.34.D01.1.454.CMB.1.raw
  modified_base (195)..(195): a, c, t, g, unknown or other
  misc_feature (195)..(195): n is a, c, g, or t
tcagtacgctgtctcacgaccggtgctcgatttagatcgtctgtgttgggtttggggacccaaaaaccacacccctccttgggagaatcccctagatcacagctcctcaccatggactggacctggagcattccttttcttggtggcggcagcaacaggtcgcccactcccaggttcacctggtgcagtctgganctgaactgaagaacgccgtgggaccttaagtaaacgtctcctgacaaggtcttcgttggttaccttcctttacgttacgtagtggacatcagcgttgggtcgcgacgaccggtcccctaggaccgaagggctacgagggtggagtggggtagactcgacgtacctaaagtagtacggttaaccaactaaaacttagtaggacccgaagggtaacgtttcgaaccggaaggtaaaccgaaggtaaatacggaaacccgaagtacgaaacccgaaccgaaacgacccgtaaccggtaccgaaccggtacgaaccgaacgaacgtaccggtaaacaacggttaggaacgtagggaaggacgtccgtaaggaacccgtaccgtacggaaccggaccgaacccgggaactaagttaacgttaacgttaacgtcggttaacggaccggtaaacggtaaaccgggttaaacccggtacggttaccgttaaggtttacgtttaaggttaagttttaacgggtttaggggttactacggttagttacgttactttacgtttagacgtttacgtcgggttaaccggg

SEQ ID NO: 82087 - DNA, 689 bp, Homo sapiens
  misc_feature: GYAE6OF01CX3OP.36.34.D01.1.454.CMB.1.raw
tcagtacgctgtctcacgaccggtgctcgatttagatcgtctgtgttgggtttgggggagctacaacaggcaggcaggggcagcaagatggtgttgcagacccaggtcttcatttctctgttgctctggatctctggtgcctgcggggacatcgtgatgacccagtctccagactccctggctgtgtctctgggcgagaggccacatcaactgacaggtccagccagtagttgttttatacagcctaccaaacaaataagaaccttaacttaacttaggtaccagacaacgaaaccaggacacgaccctacctaaactcgacctctaatttacgtcgggactaacgtccgtaacccggggtaacgttcccggggtacccctaggaaccccgtatttccgaaggtcggacgacgggtccgggtacgtacgggaactaggtatttccgaacttcctaccaacccatccgagtacgacgtccgtaggaccaggtactaggaaacgtgtaggtacggtacttaacgttttacgttaacgttcgtaacgtaagtaacttaagttaactttaagtaacgtttcttacccgtacttaccgttaccggtttaccggggacgggtaacgggtaaccgttaagggtacggaaacgtacttaacgaaaaccggttagttaggtacggccgttagaacccg

SEQ ID NO: 82088 - DNA, 621 bp, Homo sapiens
  misc_feature: GYAE6OF01BIFA8.36.34.D01.1.454.CMB.1.raw
  modified_base (193)..(193): a, c, t, g, unknown or other
  misc_feature (193)..(193): n is a, c, g, or t
  modified_base (330)..(330): a, c, t, g, unknown or other
  misc_feature (330)..(330): n is a, c, g, or t
  modified_base (348)..(348): a, c, t, g, unknown or other
  misc_feature (348)..(348): n is a, c, g, or t
tcagtacgctgtctcacgaccggtgctcgatttagatcgtctgtgttgggtttggggacccaaaaaccacacccctccttgggagaatcccctagatcacagctcctcaccatggactggacctggagcatccttttcttggtggcggcagcaacaggtgcccactcccaggttcacctggtgcagtctgganctgaggtgaagaagcctggggcctcagtgaaggtctcctgcaaggcttctggttacatctttaggaggtatgcaatcaccgtggtgcgacacggccctggacaagggcttgagtggatgggatggatcagcgcttanaatggtaacagaaattanagaacagaagtccaggcagagtcacatacgaccacaaacacactccaacgagacaacgacgacctacgagtaggacgcgtaggaggacgtaccgtaggagacttcgtacggaaccgaacgaccgggtccgttagttaagttagttgggtcggtacggggtagggggggttattggggttagggtcgggtactaccggttaccgacggtccgtaccggtaccgtaacccggtaaaccggtttcgggttaccccggtacccccggtaccgggggg

SEQ ID NO: 82089 - DNA, 660 bp, Homo sapiens
  misc_feature: GYAE6OF01AX7DO.36.34.D01.1.454.CMB.1.raw
  modified_base (283)..(283): a, c, t, g, unknown or other
  misc_feature (283)..(283): n is a, c, g, or t
  modified_base (376)..(376): a, c, t, g, unknown or other
  misc_feature (376)..(376): n is a, c, g, or t
tcagtacgctgtctcacgaccggtgctcgatttagatcgtctgtgttgggtttggggacccaaaaaccacacccctccttgggagaatcccctagatcacagctcctcaccatggactggacctggagcatccttttcttggtggcggcagcaacaggtgcccactcccaggttcacctggtgcagtctggagctgaggtgaagaagccgtggggcctcgagtgaggtctcctgcaaggtcttctggttacattctttaggaggtatgcaatcaccgtgggtncgacacggccctggacgaacggtcttgaggtggagtgggatgggatcgagcgtacttaacgaagtaggtaaacaactaaaatttagtacgaanaaggtaacgttaccgagggcaagtagtacaccagtacgaaaccaacaaacacaactaccaacggagaccaacacgacctaacgacgtaggacgtcgtacggaggtaccgccttaaggacgtacgtcgtacgaacgtaccgacccgggtccgttagttacgtttaggttcgggtacgggtacggggggttagggggggttctttgggggttacgggtcggtaccgtaacgtccgacgtcgtacgaccgttaacggtaccgtcgggttccgaccccgggtccgggg

SEQ ID NO: 82090 - DNA, 537 bp, Homo sapiens
  misc_feature: GYAE6OF01A5JA2.36.34.D01.1.454.CMB.1.raw
  modified_base (314)..(314): a, c, t, g, unknown or other
  misc_feature (314)..(314): n is a, c, g, or t
  modified_base (411)..(411): a, c, t, g, unknown or other
  misc_feature (411)..(411): n is a, c, g, or t
tcagtacgctgtctcacgaccggtgctcgatttagatcgtctgtgttgggtttgggggagctacaacaggcaggcaggggcagcaagatggtgttgcagacccaggtcttcattttctctgttgctctggatctctggtgcctgcggggacatcgtgatgacccagtctccagactccctggctgtgtctctgggcgagagggccaccatcaactgcaggtccagccagagtgttttatacagctccaacaataagaactacttaacttggtaccagcagaaaccaggacagcctcctaaactgctcatttacnggcatctacccgggaatcccgggtcctcgaccgattcagtggcagcgggtctgggacagtatttcactctcaccatcagcagcctgcagctagaagntgtggactagtttattacgtgtacagtcaattattatagtacttccgctctacgtttcgggacggtacgggaccgtaagggtggaacggaattacccgaaaacggtacttaggtcggactcgaccc

SEQ ID NO: 82091 - DNA, 758 bp, Homo sapiens
  misc_feature: GYAE6OF01B64I4.36.34.D01.1.454.CMB.1.raw
  modified_base (246)..(246): a, c, t, g, unknown or other
  misc_feature (246)..(246): n is a, c, g, or t
  modified_base (250)..(250): a, c, t, g, unknown or other
  misc_feature (250)..(250): n is a, c, g, or t
  modified_base (259)..(259): a, c, t, g, unknown or other
  misc_feature (259)..(259): n is a, c, g, or t
  modified_base (265)..(265): a, c, t, g, unknown or other
  misc_feature (265)..(265): n is a, c, g, or t
tcagtacgctgtctcacgaccggtgctcgatttagatcgtctgtgttgggtttgggggagctacaacaggcaggcaggggcagcaagatggtgttgcagacccaggtcttcatttctctgttgctctggatctcgtggtgcctggcggggacatcgtgatcgacccagtctccagcctcccgtggctgtgtctcgtgggcgaggacggccaccatcaactgcgacggtccagcagtagttgtttanacgncctaccaanaataanaactacttacgtagtaccagacacgaaacgacggacacgtacctacctaaactcgaccttactaacgttttacgacgggactaaccgtacccggtaaccccgggtaacggttcccggggtaccctacggtaacccgtacgttacggaggtccggacggtacgggtccgggttacgtaacggggtacctaggttaccttttacccgaccgttccctaacccgtaaccgtacgtacgtacgaccgtaacggtcccgtcggtaccgtacggtaccgtaggtaacggtagttacggtacggttacgtttaaggtttacttaacggttacgtaacgtacggtaacttaagtttaacttaacgttaacgttacccgttaccgttaccttaccggttaccggtttaccgggacggggtaaccgggtaacggtacggggtacggaaccggtaaacgttaacggtaaacggtaacggtaggttcggtaccgtacgtaacccg

SEQ ID NO: 82092 - DNA, 609 bp, Homo sapiens
  misc_feature: GYAE6OF01EWCGP.36.34.D01.1.454.CMB.1.raw
tcagtacgctgtctcacgaccggtgctcgatttagatcgtctgtgttgggtttggggacccaaaaaccacacccctccttgggagaatcccctagatcacagctcctcaccatggactggacctggagcatccttttcttggtggcggcagcaacaggtgcccactcccaggttcacctggtgcagtctggagctgaggtgaagagcctggggcctcagtgaaggtctcctgcaaggcttctggttacatctttaggaggtatgcaatcaccgtgggtgcgacaggcccctggacaagggcttggagtggagtggggatggatcgaggcgtacttaacgaagtacggtaaacaactaaaattatagaacgaagaagttccgaagggcagacgtcaccgatcggaaccaacaaacacactaccgaacgagacaacgacgacctaacagtaggagacgaggaggacgccgtagagtactcgacggaaccgacgaccgggtacgttagttagttagttggtgggcgggtagggggggttagttggtgggtcggacgtaccgtacaggtctcgtacctaacggtaacgttcggttacccggcccggtacgggg

SEQ ID NO: 82093 - DNA, 721 bp, Homo sapiens
  misc_feature: GYAE6OF01D51WL.36.34.D01.1.454.CMB.1.raw
  modified_base (278)..(278): a, c, t, g, unknown or other
  misc_feature (278)..(278): n is a, c, g, or t
tcagtacgctgtctcacgaccggtgctcgatttagatcgtctgtgttgggtttgggacccaaaaccacaccctcttgggagaatccctagatcacagctcctcaccatggactggacctggagcattccttttcttggtggcggcagcaacaggtgcccactcccaggttcacctggtgcagtctggagctgaggtgaagaagccgtggggcctcagtgaaggtctcctgcaaggtcttctggttacatcgttttaggagtatgcaatcacgtgggtncgacacggccctggacaggcttgagtggatgggatggatcgagcgtcttaacaagtaggtaaaaacacgaacttatacgacaacgaaggaacgtactacccggaggggacctaaggaacgtaccaaaccgagtacgaacccgaacgaacgaacgaaccaactaccccgaaacgggaacgaacccaacgaaccggacccttaacgaacggtttaggggaacggggtttacgggggaaccgtccggttaagggacgtaagtccggttaacggaacccgggacgtaacccgggtaccgtttaccgttaagtttaaccggtcgggtacgaacgggtaaacggtaacgttaaacggaagttaaaacgttagttaaggttaaaggtaaggaacgttaaacggggtaccggggtaaccggaaccggggtaaaccccgtgggtaaccccgg

SEQ ID NO: 82094 - DNA, 720 bp, Homo sapiens
  misc_feature: GYAE6OF01DOUJL.36.34.D01.1.454.CMB.1.raw
  modified_base (232)..(232): a, c, t, g, unknown or other
  misc_feature (232)..(232): n is a, c, g, or t
tcagtacgctgtctcacgaccggtgctcgatttagatcgtctgtgttgggtttggggacccaaaaccacacccctccttgggagaatcccctagatcacagctccttaccatggactggacctggagcattccttttctggtggcggcagcaacaggtcgcccactcccaggttcaccgtggtgcagtcgtggagctggaggtgaagagccgtggggcctgagtgaaggtcnctgacaaggtcttctggtacattcgttaggaggtatgactaactcgaccgtgggtcgcgacgaccggacccgtaggacgaagggtcttaggagtgggatgggtatcggatcgaaggtcctacttaacgaagtaggtaaacacgtaaaattacgtacgaacgaaggtaacgttcgaacggtacgaggtacgtacaacctagtaccgaaaccaacgtaaacacgtaacacccaacgtacgaccaaccgacgacccttaagacgtaggaactacggtaggaacggacgtacgtacggtaagacgtaccgtacggaaccgaaccgtaccgggtaccgttaaggtttaacgttacggttagggtaccggggtagggggttaggggggttacttggggtaccggtacggtaacggtaccgttacgtacggtccgtacgtaccggtaaaccgttaccgttacggtacccgggtacccggagggtaacccccgggg

SEQ ID NO: 82095 - DNA, 685 bp, Homo sapiens
  misc_feature: GYAE6OF01DXZ8W.36.34.D01.1.454.CMB.1.raw
  modified_base (161)..(161): a, c, t, g, unknown or other
  misc_feature (161)..(161): n is a, c, g, or t
  modified_base (184)..(184): a, c, t, g, unknown or other
  misc_feature (184)..(184): n is a, c, g, or t
  modified_base (275)..(275): a, c, t, g, unknown or other
  misc_feature (275)..(275): n is a, c, g, or t
  modified_base (371)..(371): a, c, t, g, unknown or other
  misc_feature (371)..(371): n is a, c, g, or t
  modified_base (393)..(393): a, c, t, g, unknown or other
  misc_feature (393)..(393): n is a, c, g, or t
tcagtacgctgtctcacgaccggtgctcgatttagatcgtctgtgttgggtttggggacccaaaaaccacacccctccttgggagaatcccctagatcacagctcctcaccatggactggacctggagcattccttttctggtggcggcagcaacaggtcncccactcccaggttcacctggtncagtctggagctggaggtgaagaacgccgtggggcctcgaggtagacggtctccgtgacaaggtcttcgtggttacctattcgtttaaggngtatgactaactccacgttgggtcgacgtacgaccggtccccgtaggacgaagggtcttaggacggtggagtggggtatggactcgagcgtactanaagtacgtaaacataaagttanagaacgaagtacgtccgaggacagactcgaactgacgaaccaacaacacactaccgacgacacacgacacctacgagtacggacgtcggtacggacggtacacgtaggtagtacgtacgaacgtaacccggacgaccgggtacgttaggttacgttagggttcggtacgggggtacggggtagggggttagttgggtacgggtcggtaccgtaaccggtccgaacggttccggtaccgtaaccgtaccgggttaaaccgttccggggttaccccgtcccgggtacccggggg

SEQ ID NO: 82096 - DNA, 642 bp, Homo sapiens
  misc_feature: GYAE6OF01A1B9S.36.34.D01.1.454.CMB.1.raw
  modified_base (560)..(560): a, c, t, g, unknown or other
  misc_feature (560)..(560): n is a, c, g, or t
tcagtacgctgtctcacgaccggtgctcgatttagatcgtctgtgttgggtttggggacccaaaaaccacacccctccttgggagaatcccctagatcacagctcctcaccatggactggacctggagcatccttttcttggtggcggcagcaacaggtgcccactcccaggttcacctggtgcagtctggagctgaggtgaagaagcctggggcctcagtgaaggtctcctgcaaggcttctggttacatctttaggagtatgacatcaccgtgggtgcgacacggcccctaggacgaaggtcttgaggtggagtgggatgggatcgagcggtcttaacaagttgggtaaaacactaaaagttagtacgaaactagggtaaacgttcccgaaggggacctaaggtaacggtactaaccgagttaacggaacccaaacaaaccacactaccgaacgacgacgaacacgaccgtacaagtacggacgtcgtagggaacgacgtaccctagagacgtacgacgtaacgacggaccggtacgtagttattacgtggtacgggnggggtaggggggtattgggtggtcggtacgacggtacgagcgtacgtaccgtacgaacgttcggtccggtccggtaccgggg

SEQ ID NO: 82097 - DNA, 753 bp, Homo sapiens
  misc_feature: GYAE6OF01BZM0V.36.34.D01.1.454.CMB.1.raw
  modified_base (244)..(244): a, c, t, g, unknown or other
  misc_feature (244)..(244): n is a, c, g, or t
  modified_base (350)..(350): a, c, t, g, unknown or other
  misc_feature (350)..(350): n is a, c, g, or t
tcagtacgctgtctcacgaccggtgctcgatttagatcgtctgtgttgggtttgggggagctacaacaggcaggcaggggcagcaagatggtgttgcagacccaggtcttcatttctctgttgctctggatctctggtgcctgcggggacatcgtgatgacccagtctccagactccctggctgtgtctctgggcgagagggccaccatcaactgcgacgccacgaccagtagtttagttttanacgacgctaaccaaactaaataacgtaaaccttaacctttaacgttacggtaaccagacaacgaaaccgacgacacgaccctacctaaactgctactactttacgngggactacgtacccgtaacccgggtaacggttcccgggtaccgtacgacccgtacgttacgaggtcggacggtacgggtccgggttcgtacggggaacgtaggttactttacctaccgttacctacccgaaccctataccgagtacccgaacgtcccgttaggaccgtacggtccgtaagaaacggtgttcgggtaggtactttaagttttacttacgttacgtacgaacgtaaccgttaaatttaagtttaagttacgttacccttaccggtcccttaaccggtttaccgggtttacccggggacgggtaaaccggggtaaccggtaaagggggttcggaaacgtaaaccgttaaacgtaaaaccggttacgttaggggtccgttacgtcccggtaaacccg

SEQ ID NO: 82098 - DNA, 592 bp, Homo sapiens
  misc_feature: GYAE6OF01BGBCM.36.34.D01.1.454.CMB.1.raw
  modified_base (240)..(240): a, c, t, g, unknown or other
  misc_feature (240)..(240): n is a, c, g, or t
  modified_base (260)..(260): a, c, t, g, unknown or other
  misc_feature (260)..(260): n is a, c, g, or t
tcagtacgctgtctcacgaccggtgctcgatttagatcgtctgtgttgggtttgggggagctacaacaggcaggcaggggcagcaagatggtgttgcagacccaggtcttcatttctctgttgctctggatctctggtgcctgcggggacatcgtgatgacccagtctccagactccctggctgtgtctctgggcgagagggccaccatcaactgcaggtccagccagtagttgttttanacagctaccaaacaataaanaacgttaacttaacttcggtaaccagacaacgaaaccaggacagcctacctaaactgctactatttactggacactcgtacccgggagtcccgggtcctgaccgattcgagtggcaggcgggtacgtaggacagtactttcactctcactatcagaccagccgtgacaggactaggaagtacgtggtggacgttagtttacttacgtgtacagtacttaagttatttaagtaagttacttccgtctaccgttacgtttccgggacgggtacgggtaacctaaggggtcgaagaacgtaaccaaaacggtacgtaggtcggacgttcgaaccg

SEQ ID NO: 82099 - DNA, 684 bp, Homo sapiens
  misc_feature: GYAE6OF01C8E4B.36.34.D01.1.454.CMB.1.raw
  modified_base (340)..(340): a, c, t, g, unknown or other
  misc_feature (340)..(340): n is a, c, g, or t
  modified_base (366)..(366): a, c, t, g, unknown or other
  misc_feature (366)..(366): n is a, c, g, or t
  modified_base (459)..(459): a, c, t, g, unknown or other
  misc_feature (459)..(459): n is a, c, g, or t
tcagtacgctgtctcacgaccggtgctcgatttagatcgtctgtgttgggtttggggacccaaaaaccacacccctccttgggagaatcccctagatcacagctcctcaccatggactggacctggagcatccttttcttggtggcggcagcaacaggtgcccacctcccaggttcacctggtgcagtctggagctggaggtgaagaagccgtggggcctcagtgaaggtctcctgcaaggtcttctggttacattcgtttaggagtatgcaatcaccgtgggtgacgtacacggtcccctggacaagggcttggaggtggagtgggatggatcgagcgnttaacaagtggtaacaactaaattanagaaactagaacgttcggaggtacaggtactaccactagtacgaaccaacaaacacaactaccgacggacgacaacacgtaccactagcggancgtagacggacgccgtagagtactacgtacgaaccgacggaccgggtaccggttaggtttaactttaggtttcggggtacgggtacgggggggttaaggggggggttacgtttggggtcgggggttacggaccggttaccgtaaccgcgggtaccgtacggttaacccgtaacccggttaaccggtttaccggggttcccggttaaccccgggtaacccgggggg

SEQ ID NO: 82100 - DNA, 883 bp, Homo sapiens
  misc_feature: GYAE6OF01CQ19B.36.34.D01.1.454.CMB.1.raw
  modified_base (255)..(255): a, c, t, g, unknown or other
  misc_feature (255)..(255): n is a, c, g, or t
tcagtacgctgtctcacgaccggtgctcgatttagatcgtctgtgttgggtttgggggagctacaacaggcaggcaggggcagcaagatggtgttgcagacccaggtcttcatttctctgtgctctggatctctggtgcctggcggggacagtcgtgatcgacccagtctccagcctcccgtggctgtgtctcgtgggcgaggacgggccaccataccaacgtcgacacggtaccagacctaagtgttagtttanacgagacctaaccaaataataaagtaaaccttaactttaacgtacggtaaccagtacaacgaaaccgaggaacacgtaccctaaccgtaaactcgtacctacgttactttacgacgggtacctaacgtacccggtaacccgggtaaccggttcccggggttaccctacggtaacccgtagttacggacggtaccggacgtaccgggtcgggttaccggttacggggaacttaacggttacgttttacccgaaccgtttacctacccgtaaaccctacgttaccgaacgggttaccaccggtacccgtacggaccggtacgggtaccgttaagggaaacggttaaggttacgggttacgggttaacgttttaaaggtttttaaccgttaacggttacgttaaccgtaacggtttaaaccttaaacgttttaaacgtttaaacggtttaaccggtttaccgtttacccccggttaaccggttttaccccggtttaaacccgggggtttacggggtaacccgggggtaaacgggttaacccgggtaaaggggtacgggttaaaccgtaaaccggttaaaccggtaaaaccggttacggttaccgggtacggtccggttaacccgaacccgg

SEQ ID NO: 82101 - DNA, 256 bp, Homo sapiens
  misc_feature: GYAE6OF01BTF4Z.36.34.D01.1.454.CMB.1.raw
  modified_base (249)..(256): a, c, t, g, unknown or other
  misc_feature (249)..(256): n is a, c, g, or t
tcagtacgctgtctcacgaccggtgctcgatttagatcgtctgtgttgggtttgggtgccgaagttgctggaggtcacggtcaccacgctgctgagggagtagagtcctgaggactgtaggacagcccatcggtcttcccctggcgccctgctccaggagcacctccgagagcacagcggcccgtgggctcgcctggtacaaggactacttccagacagcgtactggagcggctggcaaggcgcatagnnnnnnnn

SEQ ID NO: 82102 - DNA, 723 bp, Homo sapiens
  misc_feature: GYAE6OF01DUX94.36.34.D01.1.454.CMB.1.raw
tcagtacgctgtctcacgaccggtgctcgatttagatcgtctgtgttgggtttggggacccaaaaaccacacccctccttgggagaatcccctagatcacagctcctcaccatggactggacctggagcatccttttcttggtggcggcagcaacaggtgcccactcccaggttcacctggtgcagtctggagctgaggtgaagaagcctggggcctcagtgaaggtctcctgcaaggcttctggttacatcgtttaggagtatgcaatcaccgtgggtgcgacgacggcccctggacaagggcttgagtggatgggatggatcgagcgtacttacaaagtcggtaacaacgtaaaattagtagaaacgagtaaagttcccgaaggggtcaaggacgtacacctatacggaacccaacgaaaacacaactacccgaaccgaagacaaccgaacgtaccgtaacgtaagtacgggagtcgtaggacgggagtacccgtaggtaacgacttacgtaacggaccggaaccgtacccggggccgtttacggttaagtttaacgttcgggttacgggtaccggggtaaggggggggggtttactttagggggttcgggttacgggtaccgtaaccggttaacccggtaacggtccgttacggtacccgttaaacccgggtaaacccgttacggggtttaccccgggacccccggggttacccgggggg

SEQ ID NO: 82103 - DNA, 764 bp, Homo sapiens
  misc_feature: GYAE6OF01D7L4C.36.34.D01.1.454.CMB.1.raw
tcagtacgctgtctcacgaccggtgctcgatttagatcgtctgtgttggggtttggggacccaaaaacccacacccctccttgggagaatcccctagatcacagctcctcaccatggactgggacctgagcatccttttctggtggcggcagcaacaggtgcccactcccaggttcacctggtgcagtctggacgctgaggtgaagagccgtggggcctcgagtgaaggtctcctgcaaggcttctggttacagtcttaggaggtatgactagtcaccgtgggtgacgaacgtacggccccgtaggaacgtaacgggtcttaggacggtaggaagtggggtaactcgggtacttaccgacgggtccttaaccggtttaaccgaaaggttaccgggttaaaaccaacgttaaaatttaggtacggaaaacgtaacgggttaaaccggttacccggaaacggggtcgaaaaggttacgtaaccgaccctaagttaccggaaccaaaaccaaaaccacctaacgtacccgaacgaaccggactaaacgacgtaccctaacgagtacgggacgtacgtaccggaggtaccgtaccgtaggtaacgtagtacgtacgaacggtacctaccggggttcccttaggtttacttacggttcgggtacgggtacgggggttagggggttagttagggtcgggtacggtagtaccggttacgacgtcgtaccgtaccgtaaccggtaacgtttcggtccgtcccgggtaccggg

SEQ ID NO: 82104 - DNA, 761 bp, Homo sapiens
  misc_feature: GYAE6OF01BI72Q.36.34.D01.1.454.CMB.1.raw
  modified_base (193)..(193): a, c, t, g, unknown or other
  misc_feature (193)..(193): n is a, c, g, or t
  modified_base (218)..(218): a, c, t, g, unknown or other
  misc_feature (218)..(218): n is a, c, g, or t
tcagtacgctgtctcacgaccggtgctcgatttagatcgtctgtgttgggtttggggacccaaaaaccacacccctccttgggagaatcccctagatcacagctcctcaccatggactggacctggagcatccttttcttggtggcggcagcaacaggtgcccactcccaggttcacctggtgcagtctgganctgaggtgaagaagcctggggcctnagtgaaggtctcctgcaaggtcttcgtggttacattcgtttaggaggtatgactaatccaccgtgggtgcgacgacggccccgtaggacgaagggtcttggaggtggagtggggatggtatcgaggtccgtacttaacaagttacggtaaaccaactaaaagtttagtaagaaacgtaagtaacggttacccgaaggggacaaggtacgtaccaaccgagtacgaaacccaaccaaacaacctaactacccgaaaccgacgaaccgaaccgtaaccgtacccttaacgaagtacgggaacgtaccgtaggaacgggaccgaccgtaggaacgtagtacccgtacgggaacccggaaccggtaccggggtaccgttaagtttaacgtttacggttagggtacggggtaacggggggttagggggggttacgtttaggggttacgggtacggttaaccgtaccggttaaccgacggtaccgttacggaaccgttaaccccggtaaacggtttcccgggttacccggtacccccgggtaccggggg

SEQ ID NO: 82105 - DNA, 767 bp, Homo sapiens
  misc_feature: GYAE6OF01EQD9P.36.34.D01.1.454.CMB.1.raw
tcagtacgctgtctcacgaccggtgctcgatttagatcgtctgtgttgggtttggggacccaaaaaccacacccctccttgggagaatcccctagatcacagctcctcaccatggactggacctggagcatccttttctggtggcggcagcaacaggtgcccactcccaggttcacctggtgcagtctggagctgaggtgaagaagcctggggcctcagtgaaggtctcctgcaaggcttctggttacattcgtttaggaggtatgcaatcacgtgggtgcgacacggccctggacgaagggtcttggagtggagtggggatgggatcgagtcgtacttaacgaagttacggtaaaacaactaaaagtttacgtaaggaaaccgtaaggtaaacggtttacccgaagggggtaccaagggtaacgttccaaacccgtagttacgaaaccccaaacaaaaccaacctaacgtacccaaacggaacgtaccaacgacgaccctaacagtacgggacgcgtagggaacgggacgtacccgtaggaacgtacgttacgtacggaaccggaccggtaacccgggtaccggttacggtttaagtttacggtttagggtcggggtaccgggggttaagggggggggttacgtttaggggttacgggttcgggtaaccggtaaccgttaacccggacggtacccgttacggtacccggttaaacccggttaaaccggttccgggtttaccccggtaccccgggttacccgggggg

SEQ ID NO: 82106 - DNA, 623 bp, Homo sapiens
  misc_feature: GYAE6OF01E5HQB.36.34.D01.1.454.CMB.1.raw
  modified_base (357)..(357): a, c, t, g, unknown or other
  misc_feature (357)..(357): n is a, c, g, or t
tcagtacgctgtctcacgaccggtgctcgatttagatcgtctgtgttgggtttggggacccaaaaaccacacccctccttgggagaatcccctagatcacagctcctcaccatggactggacctggagcatccttttcttggtggcggcagcaacaggtgcccactcccaggttcacctggtgcagtctggagctgaggtgaagaagcctggggcctcagtgaaggtctcctgcaaggcttctggttacatctttaggagtatgcaatcaccgtgggtgcgacacggcccctggacaagggtcttggagtggatgggatggatcgagcgtcttaacaataggtaaacactaaattanagaacagtaagttccgaggcagagtcacatacgaccaacaacacactaccaacgacgacacacgacctaacagtacggagtcgtacggaaggacgaccgtaggacgtactacgtacggaaccgaccgaccgggtaccgttagttaagtttagtggtaggtacgggggtaggggggttagtgggtcgggtcggtacctaaccgtaccgacgtcgtacggtaccgtaaccggtaaacgtccgggttacccggaccccggtaccggggg

SEQ ID NO: 82107 - DNA, 764 bp, Homo sapiens
  misc_feature: GYAE6OF01DRN1F.36.34.D01.1.454.CMB.1.raw
  modified_base (509)..(509): a, c, t, g, unknown or other
  misc_feature (509)..(509): n is a, c, g, or t
tcagtacgctgtctcacgaccggtgctcgatttagatcgtctgtgttgggtttggggacccaaaaaccacacccctccttgggagaatcccctagatcacagctcctcaccatggactggacctggagcattccttttcttggtggcggcagcaacaggtgcccacctcccgaggttccacctgggtgctagtcgtggagcgtgagggtgaagagccgtgggcctcgaggtgaggtctcgtgacgaaggtcttcgtggttacagttcgtttagggaggtatgactaatccgaccgtgggtcgcgacgacggcccgtaggacgaacgggtcttaggaggtggaggttgggaatggactacgaggctacgttaagaaggttacgtaaacaacgtaaattagaacgtaaacgaaggtaacggttaccgaagggacgtaaggtacgtaccaaccgtagaaccgtaaccaaacaaacgaacactacccgaagacgaccacgaacgaccttaagnggtacggacgtacgttacggaacgggacgacgtacggaagtacgttcggtaacggaacccggtaaccgtaccggggtacgtttaggtttaagtttacgggtttacggggacggggtaagggggttaacgggggggttgttacgggtaacggggttacggacgttaccggtaacccgtgggtacccggttacgtaacccgggttaacccggtaacggtttccccggggtaccggttaacccccggggtaccggggg

SEQ ID NO: 82108 - DNA, 644 bp, Homo sapiens
  misc_feature: GYAE6OF01C3LFU.36.34.D01.1.454.CMB.1.raw
  modified_base (284)..(284): a, c, t, g, unknown or other
  misc_feature (284)..(284): n is a, c, g, or t
  modified_base (559)..(559): a, c, t, g, unknown or other
  misc_feature (559)..(559): n is a, c, g, or t
tcagtacgctgtctcacgaccggtgctcgatttagatcgtctgtgttgggtttggggacccaaaaaccacacccctccttgggagaatcccctagatcacagctcctcaccatggactggacctggagcattccttttcttggtggcggcagcaacaggtgcccactcccaggttcacctggtgcagtctggagctggaggtgaagagccgtggggcctcgagtgaaggtctcctgcaaggtcttctggttacattctttagggagtatgcaatcacgtgggtncgacacggccctggacgaggcttggagtggagtggggatggatcgagcgtacttaacaagtggtaaacaactaaagttatagaacgtaagaaggttaccgagggtacgaagacgtaccaccgagtacgaaccgaaccaaaacaccactacccgaaccgaacgaccaaccgacgaccctaacgagtacggacgtcgtaggacggacggccgtagacgtatcgtaagaccgacgacgggtacgttagttattgttaggtgggtgggtaggggggttnttgggtagggtcggtacgacgtaaccgcgtcgtacggtaccgttaaccggtaaccgttcgggttcccggacccgggtacccgggg

SEQ ID NO: 82109 - DNA, 742 bp, Homo sapiens
  misc_feature: GYAE6OF01B1Q4C.36.34.D01.1.454.CMB.1.raw
tcagtacgctgtctcacgaccggtgctcgatttagatcgtctgtgttgggtttggggacccaaaaaccacacccctccttgggagaatccctagatcacagcctcctcaccatggactggacctggagcatccttttcttggtggcggcagcaacgacggtcgcccactcccaggttcaccgtggtgccagtcgtggagctggaggtgaagagcctgggcctcagtgaggtctcctgcaggcttcgtggttacattcgtttaggaggtatgacaatccaccgtgggtgcgacgacggccccgtggacgaacgggtctgagtgggagtgggagtggatacgacggcgtacttaacgaattacggtaaacaactaaaatttagaagaacaaggtaacgttaccgagggtcaagacgtacaacctagaccgaaccaaacaacacacgtaccgaacgaacgcctaacgacgtacctaacgagtacgggacgtacgtaggacgggacgtccgtaggagtacttacgacggaaccgtaaccgggtccgggtaccgtttaggttaacgtttagttacgggttacggggacggggggttaaggggggggttttattgggggttacgggggtacggtcccgttaacccggttacccggaaacggtcccgttaaccgggtacccgttaaacccgggtaaccgggttttcccgggttaaccccccgggtccccggggttaaaccccggggggg

SEQ ID NO: 82110 - DNA, 709 bp, Homo sapiens
  misc_feature: GYAE6OF01D0WT4.36.34.D01.1.454.CMB.1.raw
  modified_base (357)..(357): a, c, t, g, unknown or other
  misc_feature (357)..(357): n is a, c, g, or t
tcagtacgctgtctcacgaccggtgctcgatttagatcgtctgtgttgggtttggggacccaaaaaccacacccctccttgggagaatcccctagatcacagctcctcaccatggactggacctggagcatccttttcttggtggcggcagcaacaggtgcccactcccaggttcacctggtgcagtctggagctgaggtgaagaagcctggggcctcagtgaaggtctcctgcaaggcttctggttacatctttaggaggtatgcaatcacctgggtgcgacaggcccctggacaagggcttgagtggagtggggatggatcgagcgtcttaacaagtggtaaacaactaaattanagaaacgagtaacgttccgagggacagagtacaccagtacgaaccaacaaacacaactaccgaacgacgacaacgacgacctaacgagtacggagcgttaggaacgggtacgacccgttaggaacgtacgttcgacggaaccgtacccggtaaccgggtaccgttaaggttaacgttttaacggttcgggttacggggtacgggggttaacgggggggggtttatttcggggttaggggttccgggtacgttaacccggttacccggaaggttacccgttacgggtaacccgtaacccgggttaaaccggtttccgggttccccgggtaacccccggggttaacccgggggg

SEQ ID NO: 82111 - DNA, 715 bp, Homo sapiens
  misc_feature: GYAE6OF01CZ8A2.36.34.D01.1.454.CMB.1.raw
  modified_base (457)..(457): a, c, t, g, unknown or other
  misc_feature (457)..(457): n is a, c, g, or t
  modified_base (490)..(490): a, c, t, g, unknown or other
  misc_feature (490)..(490): n is a, c, g, or t
tcagtacgctgtctcacgaccggtgctcgatttagatcgtctgtgttggggtttggggacccaaaaaccacacccctccttgggagaatcccctagatcacagctcctcaccatggactggacctggagcatccttttcttggtggcggcagcaacaggtgcccactcccaggttcacctggtgcagtctggagctgaggtgaagaagccgtggggcctcgaggtgaaggtctccgtgcgaaggtcttcgtggttacattcgtttaggaggtatgactatcaccgtgggtgcgacgacggccctaggaacgagggtcttaggaggtgagtgggatggactcgagtcgtacttaacgaagttacggaaaacaacgtaaaatttacgaggaaaaccgaaggtaaacggttccggaaggggtacaaggtacgtacaccgaagtacgaaccaacgaaaccncaactacccgacgaacgacaacacgaccctaanagtacggacgtacgtaggaacggacgtaccgtaggagtagttacgaacggtaaccggaaccggtacggggttaccgttaggttaagtttaacggttgggttacggggtaacgggggttaggggggggttacgtttagggtcggggttacggtaccgtaacggtacgacgtcggtacgtaaccggtaccgttaacggtccgggtcccggtaccccggtaccggggg

SEQ ID NO: 82112 - DNA, 926 bp, Homo sapiens
  misc_feature: GYAE6OF01C2SLO.36.34.D01.1.454.CMB.1.raw
tcagtacgctgtctcacgaccggtgctcgatttagatcgtctgtgttgggtttggggacccaaaaaaccacacccctccttgggagaatcccctagatcacagctcctcaccatggactggacctggagcatccttttcttggtggcggcagcaacaggtgcccactcccaggttcacctggtgcagtctggagctgaggtgaagaagccgtggggcctcgagtgaaggtctcctgacaaggcttctggttacattcgttaggagtatgacaatcaccgtgggtcgcgacgacggccctaggacgagggtcttaggaggtggagtgggatggactcgaggtcgtacttaacgaagttacggtaaactaactaaaattagtacggaaaacgtaaggtaaacggtttcccgaagggggacctaaagggtacgttacccgaaacccgtaagtaccggaaaacccaaaaccgtaaaaccctaccgaaccgttaaccccgaaaccgggtaaccgaacccgaaacccgtaacccggtaacccttaaaccggtaaaggttacggggaaccggtaccggtaacgggtaaaccgggtaccgtacccgttaagggaaccgtaacgttccggttaacgggaaccccgggtaaccggtaacccggggttacccggttttaagggtttaaacgtttttaacgggttttcgggttaacgggggttaaccgggggggggttaaagggggggggggtttaacgttttcggggggttaaccgggggtttacgggtaaccccgggtttaaaccccgggttaacccggtaaccgggttacccggttaaccgggttaaaccccggttaaaaccccgggtttaaaccgggtttaccccgggggtttaaccccccgggtaaccccccgggggttaaaccccggggggg

SEQ ID NO: 82113 - DNA, 591 bp, Homo sapiens
  misc_feature: GYAE6OF01C57PR.36.34.D01.1.454.CMB.1.raw
tcagtacgctgtctcacgaccggtgctcgatttagatcgtctgtgttgggtttggggacccaaaaaccacacccctccttgggagaatcccctagatcacagctcctcaccatggactggacctgagcatccttttcttggtggcggcagcaacaggtgcccactcccaggttcacctggtgcagtctggagctgaggtgaagaagcctggggcctcagtgaaggtctcctgcaaggcttctggttacattctttaggaggtatgcaatcacctgggtgcgacaggcccctggacaagggcttgagtggatgggatggatcagcgcttacaatggtaaacacaaaattatagaaacaagaagttccgaaggggtcaagagtcaccatcgaaccaacaaacacaactacccaacgaacgacaacacgacctaacaatggagctaggacggagcctagagatcgtgaccgacgacggccgttagtagttagttgtggtacgggtagggggggtagttgggtgggtcggacgtacgtacgacgtacgtacgtaccgttaaccgaacgttcggtccggtacccggtacccggggg

SEQ ID NO: 82114 - DNA, 673 bp, Homo sapiens
  misc_feature: GYAE6OF01EES0A.36.34.D01.1.454.CMB.1.raw
tcagtacgctgtctcacgaccggtgctcgatttagatcgtctgtgttgggtttggggacccaaaaaccacacccctccttgggagaatcccctagatcacagctcctcaccatggactggacctggagcatccttttcttggtggcggcagcaacaggtgcccactcccaggttcacctggtgcagtctggagctgaggtgaagaagcctggggcctcagtgaaggtctcctgcaaggcttctggttacatcgtttaggaggtatgcaatcaccgtggtgcgacacggcccctggacaagggcttggagtggagtggggagtggatcgagcgtcttaacaagtacgggtaaacaactaaattagtagaaacgaagtaacgttccgaagggcaaggagtacaccagtcgaaccaacaaacacactaccacgagacacacgcctaacagtaggacgacgtgaggacgaccgtagagatcgtacggaaccgaccgaccgggtaccggttagtttaattaaggtttcgggtacggggtacggggggtaagggggggggggtttattgggggttacggggttacgggtccgtaaccggtaccggacggtccgtacggtacccggtaaacccgtaaaccggtttcgggttacccggtacccccggggttacccgggggg

SEQ ID NO: 82115 - DNA, 712 bp, Homo sapiens
  misc_feature: GYAE6OF01DEFDE.36.34.D01.1.454.CMB.1.raw
tcagtacgctgtctcacgaccggtgctcgatttagatcgtctgtgttgggtttggggacccaaaaaccacacccctccttgggagaatcccctagatcacagctcctcaccatggactggacctggagcatccttttcttggtggcggcagcaacaggtgcccactcccaggttcacctggtgcagtctggagctgaggtgaagaagcctggggcctcagtgaaggtctcctgacaggcttcgtggtactattcgtttagggaggtatgacaatccgaccgtggtgcgtacgacggccctggacgaagggcttgaggtggagtgggatggatcgagcgtacttaacgaagtacggtaaacaactaaaagtttatacgaaacgtaaggtaaacgttccgaagggacaggacgtacaaccatacgaaccaacaaactacactccaacgacgacacgactcctaatacggtaggacgtactagggaacgacgtccgtagaagtatacgtacgaacccggaccggaacgggtccggttacgttaagtttacgttcgggttacgggaccgggggtaagggggggttagttcggggtacggggttggtacccggtaacgttacccgggtacggtccggttaaccggtaaccggtttaaaccccgggtaaagtttcccgggggttaaccccgggtacccccggggttaacccggggggg

SEQ ID NO: 82116 - DNA, 655 bp, Homo sapiens
  misc_feature: GYAE6OF01BG9IS.36.34.D01.1.454.CMB.1.raw
  modified_base (362)..(362): a, c, t, g, unknown or other
  misc_feature (362)..(362): n is a, c, g, or t
  modified_base (367)..(367): a, c, t, g, unknown or other
  misc_feature (367)..(367): n is a, c, g, or t
tcagtacgctgtctcacgaccggtgctcgatttagatcgtctgtgttgggtttggggacccaaaaaccacacccctccttgggagaatcccctagatcacagctcctcaccatggactggacctggagcatccttttcttggtggcggcagcaacaggtgcccactcccaggttcacctggtgcagtctggagctgaggtgaagagcctggggcctcagtgaaggtctcctgcaaggcttcgtggttacattcgtttaggagtatgcaatcaccgtgggtgacgacacggccctaggacgaagggtcttggagtggagtgggatggatcgagcgtacttacgaagtagtaacaactaaatanagaanagaacgttcgaggcagagtcacagtacgaaccaaacaacacactaccgacgacgacaacacgacctaacagacggacgcgtaggaacggacgccgtaggacgtacgtacgtacgaaccggtaccgaccgggtacgtttagttaagtttaggttacgggtacggggtacgggggtagggggggttattaggggttagggtaccggacgaaccggttaccgaggtccgtaccggtaaccgtaacccggtaaccggttccggttaacccgggtacccgggtaacccggggg

SEQ ID NO: 82117 - DNA, 720 bp, Homo sapiens
  misc_feature: GYAE6OF01CZBWA.36.34.D01.1.454.CMB.1.raw
  modified_base (171)..(171): a, c, t, g, unknown or other
  misc_feature (171)..(171): n is a, c, g, or t
  modified_base (182)..(182): a, c, t, g, unknown or other
  misc_feature (182)..(182): n is a, c, g, or t
  modified_base (188)..(188): a, c, t, g, unknown or other
  misc_feature (188)..(188): n is a, c, g, or t
  modified_base (195)..(195): a, c, t, g, unknown or other
  misc_feature (195)..(195): n is a, c, g, or t
  modified_base (243)..(243): a, c, t, g, unknown or other
  misc_feature (243)..(243): n is a, c, g, or t
  modified_base (259)..(259): a, c, t, g, unknown or other
  misc_feature (259)..(259): n is a, c, g, or t
  modified_base (340)..(340): a, c, t, g, unknown or other
  misc_feature (340)..(340): n is a, c, g, or t
tcagtacgctgtctcacgaccggtgctcgatttagatcgtctgtgttgggtttgggggagctacaacaggcaggcaggggcagcaagatggtgttgcagacccaggtcttcatttctctgttgctctggatctcgtggtgccgtggcggggacatcgtgatcgaccagtcnccagcctccgnggctgngtctcgngggcaggcggccacatacaactgacacggccagccagtatagttttanacagtacctaccaaanaagtaaactaactacttaactacggtaacagacaaagaaaccaggacaacgcctaaccgtaaactgacctactatttacgnggaacacgtacccggtaaccgggaaccgttccggggtacccctaggaacccgttacgttaacgacgggtacggaccggtacggggtacccggggttcgtaggggaaaccgtaaggtttacttaccgaaccgttcctacctaaaccaagtaccaagaccgtaagcctagaacgacggtacgagtaagtagtacggtagtacgttaagtttacgtacgtagtacgagtaataagttaattaagttaacggttacttacccgtacgttaacgtaccgggtttaaccgggaacggggtaaacgggaaaccggtaaacgggttacggaaacgtaacaaaccggtaaaaaccggtaacggttggtaacccgtgtacccgtaacccg

SEQ ID NO: 82118 - DNA, 707 bp, Homo sapiens
  misc_feature: GYAE6OF01B12IA.36.34.D01.1.454.CMB.1.raw
tcagtacgctgtctcacgaccggtgctcgatttagatcgtctgtgttgggtttggggacccaaaaaccacacccctccttgggagaatcccctagatcacagctcctcaccatggactggacctggagcatccttttcttggtggcggcagcaacaggtgcccactcccaggttcacctggtgcagtctggagctgaggtgaagaagcctggggcctcagtgaaggtctcctgcaaggcttctggttacatctttagggaggtatgcaatcaccgtgggtgcgacacggccctggacgagggcttgagtggagtggatgggatcgaggcgtacttaacaagttaggtaaacaactaaaattatagaaacctaaggtaaacgttccgaagggacaaggtacgtacaccaatcgaacccaaacaaaccacaactacccgaacgacgaccaacacggaccctaacgagtagggacgtcgtaggaacgggacgacccgtaggaggtaacttcgtaacgaacccggaacgtaacccggggtccgttaagggttaacttttaggttcgggtacggggtacggggggttaaggggggggttactttaggggttcggggtcggtaccgtaaccggtacccgtagggtccgttacgggtacccgtaaaccccggttaaacggttccgggttaccccggaccccgggttaccggggg

SEQ ID NO: 82119 - DNA, 630 bp, Homo sapiens
  misc_feature: GYAE6OF01D5WX7.36.34.D01.1.454.CMB.1.raw
  modified_base (440)..(440): a, c, t, g, unknown or other
  misc_feature (440)..(440): n is a, c, g, or t
tcagtacgctgtctcacgaccggtgctcgatttagatcgtctgtgttgggtttggggacccaaaaaccacacccctccttgggagaatcccctagatcacagctcctcaccatggactggacctggagcatccttttcttggtggcggcagcaacaggtgcccactcccaggttcacctggtgcagtctggagctgaggtgaagaagccgtggggcctcagtgaaggtctcctgcaaggcttctggttacatctttaggagtatgcaatcaccgtgggtgcgacaggcccctggacaagggcttgagtggagtgggatggatcgagcgtacttaacaagtcggtaaacactaaatttagtagaaacaaggtaagttaccgagggacaaggtagtccaacatacgaccaaacaacacactaccacgagacacacgacctanagtagagcgtagaggagaccgtgacgatcgtacgaacgaccgtacgggtaccgttagttaagttagttgggtacggtacgggggtagggggggttagttcgggttagggtcgggacgtaccggtaccggagtacgtacgtaccgttaaccggtaaaccgttcgggttacccgtccccgggtaaccggggg

SEQ ID NO: 82120 - DNA, 702 bp, Homo sapiens
  misc_feature: GYAE6OF01BK0NV.36.34.D01.1.454.CMB.1.raw
tcagtacgctgtctcacgaccggtgctcgatttagatcgtctgtgttgggtttgggacccaaaaaccacacccctccttgggagaatcccctagatcacagctcctcaccatggactggacctggagcatccttttcttggtggcggcagcaacaggtgcccactcccaggttcacctggtgcagtctggagcgtgaggtagaagaagccgtggggcctcgagtagaaggtctccgtgacgaaggtcttcgtggttactattcgtttaggaggttatgactaatccgtaccgttggggtcgaccgacgaccggccccgtagggaacgaagggtcgttggagtggagtgggatggactcgagtcgtacgttaacgaagtaggtaaacaataaattagagaacgagtaacgtacgaggactagacgtaccaacgtagtacgaaacccaaacgaaacacctaacgtaacccgaacgacgacaacgacgacctaacgagtacggacgacgtacggacggacgaccgtagaacgtatacggacgaaccggaaccggtaccggtaccgttagtttaacgttagttcgggtagggtacggggttaggggggttagttggggtcggtacgggtacgtaccggtaacgtacgacgttacgtaccggtaacccggttaacggtccggttcccgggtacccgggtacccgggg

SEQ ID NO: 82121 - DNA, 274 bp, Homo sapiens
  misc_feature: GYAE6OF01DJMDW.36.34.D01.1.454.CMB.1.raw
  modified_base (268)..(274): a, c, t, g, unknown or other
  misc_feature (268)..(274): n is a, c, g, or t
tcagtacgctgtctcacgaccggtgctcgatttagatcgtctgtggttggggggggtattgtggtggcactaccagctgctaccgaaactggttcgacccctggggccagggaaccctggtcaccgtctcctcagcctccaccaagggcccatcggtcttcccctggcaccctcctccaagagcacctctgggggcacagcggccctgggctgcctggtcaaggactacttccagacagctactgagcgggctggcaaggcgcatagnnnnnnn

SEQ ID NO: 82122 - DNA, 731 bp, Homo sapiens
  misc_feature: GYAE6OF01DYL7P.36.34.D01.1.454.CMB.1.raw
  modified_base (186)..(186): a, c, t, g, unknown or other
  misc_feature (186)..(186): n is a, c, g, or t
  modified_base (490)..(490): a, c, t, g, unknown or other
  misc_feature (490)..(490): n is a, c, g, or t
tcagtacgctgtctcacgaccggtgctcgatttagatcgtctgtgttgggtttggggaacccaaaaaccacacccctccttgggagaatcccctagatcacagctcctcaccatggactggacctggagctattccttttctggtgggcggcagcaacaggtgcccactcccaggttcacctggtncagtctggagctggaggtgaagacgccgtggggcctacgagtgaaggtcctcctgacgaaggtccttcgtacggttacagttacgtttagggagttatcgtacaaacttccgaaccggttggggtaccgaccggaccgtacgggcccccgttagggaaccgaaggggtcgttagggtaaggtggaggtgggtaatggactacggacggacggtactttaacgaagttacggtaaacctaataaaacgttagtaacgaaacgtacggtaacgttacggagggtacaaacggtacgtacaacgtanaccgaaaccaaacgaaccataccgtaccaacgacaccacgtacgacctacgacgtaggacgagcggagactcgagacgtacgtgaccgacgtacgtaccgggtccgttaagttagttacggttgggtacggggtacgggttaggggggtacttgggtacgggtggtacccaacggtccgacgtaccgttacgtaaccgttaaccgtaccgggttacccggtcccgtacccgggtaccgggg

SEQ ID NO: 82123 - DNA, 742 bp, Homo sapiens
  misc_feature: GYAE6OF01DL8NF.36.34.D01.1.454.CMB.1.raw
tcagtacgctgtctcacgaccggtgctcgatttagatcgtctgtgttgggtttggggacccaaaaaccacacccctccttgggagaatcccctagatcacagctcctcaccatggactggacctggagcatccttttcttggtgggcggcagcaacaggtgcccactcccaggttcacctggtgcagtctggagctggaggtgaagaacgtccgtggggcctcaggtagaacggtctaccgtgacaggcttctggttacagttcgtttaggagtatgactaatcgaccgtgggtcgcgacgacggcccctaggacgaagggtcttaggacggtggagtggagtggatcgagtcgtacttaacaagttacggaaacaactaaatgtacgtaaacgagtaacgtccgaaggtacaggtacgtacacgtactacgaaccaaacgaacacaactaccgacgaacgtacaaccgaacgaccttaacgacgtacgggtacggaccgtagggaaccggtaccggtaccggttgaaacgtaggtacgtaaccgggacctaaccgggtccggtaccggttagttacgtttaacggttcgggtaaggggtacggggggtttaggggggtacgttaggggttaccgggtcgggtaaccgtaccgtacccggtacgggtaccgtacccgggttaccgaaacccggttaaaccggttcccggggttaaaccgggtcccccgggttaacccggggg

SEQ ID NO: 82124 - DNA, 772 bp, Homo sapiens
  misc_feature: GYAE6OF01BGCF8.36.34.D01.1.454.CMB.1.raw
  modified_base (347)..(347): a, c, t, g, unknown or other
  misc_feature (347)..(347): n is a, c, g, or t
tcagtacgctgtctcacgaccggtgctcgatttagatcgtctgtgttgggtttgggacccaaaaaccacacccctccttgggagaatcccctagatcacagctcctcaccatggactggacctggagcattccttttcttggtgggcggcagcaacaggtcgcccactcccaggttcacctggtgcagtctggagctgaggtgaagacgtccgtgggcctgagtgaaggtctccgtgcgaaggtcttcgtggttactagttacgtttaggagttatgactaagtcaccggttgggtacgcgacgacggcccgtaggaccgtaagggtcttggaagtggagttagggntaggatcgacggtctacttaacgaggttacgtaaacaataaatttacgaacggtaacgaacggtaaacggttaccggaacgggtacgaaacggtacgtacccgaaaccgtaacgttaaccggaaccctaaaaccgaaacctaaccgtaacccgtaaccgaaccggaccgaaccgtaacccgaacgacctaacgaacggttaggaaccgtcggtaaggacggtacgtaccgtagtagaacgtcggtaacgaccggaccgtaccgggttaccggttagttagttacggttagggacgggttacgggggtaagggggttaccgttggtaggggtaccggttacggacccgtacgggtcgtaccggtacggtaccgtaacccggttaacgggttccggtaaccccgggttacccggggtaaccccgggg

SEQ ID NO: 82125 - DNA, 649 bp, Homo sapiens
  misc_feature: GYAE6OF01A34M8.36.34.D01.1.454.CMB.1.raw
  modified_base (345)..(345): a, c, t, g, unknown or other
  misc_feature (345)..(345): n is a, c, g, or t
  modified_base (390)..(390): a, c, t, g, unknown or other
  misc_feature (390)..(390): n is a, c, g, or t
tcagtacgctgtctcacgaccggtgctcgatttagatcgtctgtgttgggtttgggggagctacaacaggcaggcaggggcagcaagatggtgttgcagacccaggtcttcatttctctgttgctctggatctctggtgcctggcggggacatcgtgatcgacccagtctccagacctccctggctgtgtctcgtgggcgaggacgggcccacatcaactgcgaggtccagccagtagttagttttatacacgcctaccaaactaaataacgtaactactttaacgttcggtaccagacaagaaaccaggaccacgacctacctaaactcgcctactatttacgnggcctacgtccgtaacccgggacgtcccggggtcctaggaccgtnttacgaggtcggacgacggtcgggtcgtacgggaactaggtactttaccaccgtctaccaacctataccgacgccgacgcccgtcggacgtacggacgtaaggaagtacggttgtccggtacttaagtttaccttagtagtactaacgtactaagttaattattacgttactccgtacttcgttaccggttcgggaccgggtaggtacccgtaaggggtcgaacgtacgtaaccgaaacgtacgtggtcgcgtcgaccg

SEQ ID NO: 82126 - DNA, 702 bp, Homo sapiens
  misc_feature: GYAE6OF01E4NU4.36.34.D01.1.454.CMB.1.raw
tcagtacgctgtctcacgaccggtgctcgatttagatcgtctgtgttgggtttggggacccaaaaaccacacccctccttgggagaatcccctagatcacagctcctcaccatggactggacctggagcattccttttcttgggtggcggcagcaacaggtgcccactcccaggttcacctggtgcagtctggagctggaggtagaaggaacgccgtggggcctcgaggtggaaggtctcctgcaggtcttcgtgttacagttcgtttagggagtatgacaatccgacgtgggtcgacgacgaccggccccgtggaacgagggtctttaggacggtgggagtggggatggactacgagccgtattaacaagttacggtaaacactaaagtcgtaagaagtaaggtacgtacccgaggggacaggacgtacgaccagtaccgaaccaaacaaaccactaaccgtacccgagaacgaccaacgaccgtacctaacggagttacggacgtacggtacggaggtaccgtacgtagtaacgtcgtacggacggaaccgtaccgggacggtccgtttagtaaggtttcgttgggaggggtacggggttagggggttagtgggttggggtcgaaccgtacggtacccgaggtccgtacggtaacccttacgggtaaccgttcgggtccccggaacccgggtaccggggg

SEQ ID NO: 82127 - DNA, 651 bp, Homo sapiens
  misc_feature: GYAE6OF01BACR5.36.34.D01.1.454.CMB.1.raw
  modified_base (283)..(283): a, c, t, g, unknown or other
  misc_feature (283)..(283): n is a, c, g, or t
  modified_base (286)..(286): a, c, t, g, unknown or other
  misc_feature (286)..(286): n is a, c, g, or t
  modified_base (288)..(288): a, c, t, g, unknown or other
  misc_feature (288)..(288): n is a, c, g, or t
  modified_base (304)..(304): a, c, t, g, unknown or other
  misc_feature (304)..(304): n is a, c, g, or t
  modified_base (315)..(315): a, c, t, g, unknown or other
  misc_feature (315)..(315): n is a, c, g, or t
tcagtacgctgtctcacgaccggtgctcgatttagatcgtctgtgtttggggggggttagttgtggtggcactaccgagctgctaccgaaactggttcgacccctgggccagggaaccctggtcaacccgtctcctcagcctccaccaacggcccatcggtcttccccctggccaccctccgtccaagacgcacctctggggcacagcggccctggctgccctggtcaaggctacttccgagacagtcctactgacgcgggctaggccaaggcgacagtaggncancngtgcagaccataacgngacgcgctccncgtctctcaattcgtaaggacggcaacctacgccgtaaagggaccgcgtccgacgctaccggacgtcgtacgtacgagtacggacgtacggtacggtacggtacgacgtacgtacgtacgtacgtacgtaccgacctaccgtaccgacgtacgtacgtaccgtacgtaccgtacgtacgttacgtacgtacgtacgtacgtacgtacgtacgtacgtacgtacgtacgtacggtacgtacgtaccgtaccgtaccgtacggtacgtaccggtacggtaacggtacgtacgacgtacgtacgacgtacgtacgtacgtacgtacgactcgtcgtacg

SEQ ID NO: 82128 - DNA, 627 bp, Homo sapiens
  misc_feature: GYAE6OF01DEI3L.36.34.D01.1.454.CMB.1.raw
tcagtacgctgtctcacgaccggtgctcgatttagatcgtctgtgttgggtttggggacccaaaaaccacacccctccttgggagaatcccctagatcacagctcctcaccatggactggacctggagcatccttttcttggtggcggcagcaacaggtgcccactcccaggttcacctggtgcagtctggagctgaggtgaagaagccgtggggcctcagtgaaggtctcctgcaaggcttctggttacattcttaggaggtatgacatcaccgtggtgcgacgacggccctggacgaaggcttggagtggagtgggatggatcgagcacttacaatggtaaacaacgtaattagagaacgagtaagtccgaggacagagtacacatacggaacaacaacacgactaccgacgaacgacaacacgacctaacgagtacggagtaccgtaggacggacgaccgtaggacgtactcgacgacggtaccgaaccgggtcgttacgttagtttacgtggtacgggacggggtaggggggtagtttgggacggtacggtaccgtacgtacgaccggtctaccggtacctaacccggtaacgttacccgggtccgtaccccgggtaccgggg

SEQ ID NO: 82129 - DNA, 288 bp, Homo sapiens
  misc_feature: GYAE6OF01BWJBI.36.34.D01.1.454.CMB.1.raw
  modified_base (272)..(288): a, c, t, g, unknown or other
  misc_feature (272)..(288): n is a, c, g, or t
tcagtacgctgtctcacgaccggtgctcgatttagatcgtctgtggttgggggggtattgtggtggcactaccagctgctaccgaaactggttcgacccctggggccagggaacccgggtcaccgtctcctcagcctccaccaagggcccatcggtcttccccctggcaccctcctcaagagcacctcgtgggggcacaggccggccctgggctgcctggtcaaggactacttccagacagcgtactgagcgggctggacaaggcgcatagnnnnnnnnnnnnnnnnn

SEQ ID NO: 82130 - DNA, 270 bp, Homo sapiens
  misc_feature: GYAE6OF01C93FM.36.34.D01.1.454.CMB.1.raw
  modified_base (267)..(270): a, c, t, g, unknown or other
  misc_feature (267)..(270): n is a, c, g, or t
tcagtacgctgtctcacgaccggtgctcgatttagatcgtctgtgttgggggggtattgtggtggcactaccagctgctaccgaaactggttcgacccctggggccagggaaccctggtcaccgtctcctcagcctccaccaagggccatcggtcttcccctggcaccctcctccaagagcacctcgtgggggcacagcggccctgggctgcctggtcaaggactacttccagacagcgtactgagcgggctggcaaggcgcatagnnnn

SEQ ID NO: 82131 - DNA, 806 bp, Homo sapiens
  misc_feature: GYAE6OF01E2OGH.36.34.D01.1.454.CMB.1.raw
tcagtacgctgtctcacgaccggtgctcgatttagatcgtctgtgttgggtttggggacccaaaaaccaacacccctccttgggagaatcccctagatcacagctcctcaccatggactggacctggagcatccttttcttggtggcggcagcaacaggtgcccactcccaggttcacctggtgcagtctggagctgaggtgaagaagccgtggggcctcagtgaaggtctcctgcaagcttctggttacatctttaggaggtatgacaatcaccgtgggtgccgacgacggcccctggaaccgtaagggctttaggaggttgggatagggggtatgggtaactcgacggacgtactttaaacgaaagttacggtaaaaccgtaactaaaaatttaagtaacggaaacaaacggtaaacggtttaccccggaagggaccaaaggtaacgttaccgaacccgaagttaaccggaaacccctaaaccaaaaccgaccctaacgtacccaaaccggtaacgaccaaaccgactaacccctaacgaaggtacgggacgtacggtaggaacgggacgcccgttagacgaacttcgtaacggtaacccggaaccgtaccggggtacccgtttaagttaacgtttacggtttacggtaacggggtccgggggggttaagggggggggttacttttaggggttcgggggtacggttacccggtaaaccgtaccggtacggtccgttaacggtaacccgttaacccggtaaaccggtttcggggttaccccggaacccccgggttaccggggggg

SEQ ID NO: 82132 - DNA, 700 bp, Homo sapiens
  misc_feature: GYAE6OF01D445W.36.34.D01.1.454.CMB.1.raw
  modified_base (218)..(218): a, c, t, g, unknown or other
  misc_feature (218)..(218): n is a, c, g, or t
  modified_base (260)..(260): a, c, t, g, unknown or other
  misc_feature (260)..(260): n is a, c, g, or t
  modified_base (264)..(264): a, c, t, g, unknown or other
  misc_feature (264)..(264): n is a, c, g, or t
tcagtacgctgtctcacgaccggtgctcgatttagatcgtctgtgttgggtttggggacccaaaaaccacacccctccttgggagaatcccctagatcacagctcctcaccatggactggacctggagcatccttttctggtggcggcagcagcaggtgcccactcccaggttcacctggtgcagtctggagctgaggtgaagaagccgtggggcctnagtgaacggtctcctgcaaggtcttcgtgtacatcgttaggngtangacaatcaccgtggtcgcgacacggcccctaggaccgaaggtctggaggtggagtgggatggatcgaggtacgtacttaacgaattacggaaacaactaaacttagtaacgaactaaggaacgttacccgaagggtacaaggtacgtaccaaccgactacgaaacctaaacaacgaacacgtaacccaacggacgacaacgaacgactaacagtacgggagtaccgtaggaacggacgtaccgtaggtaaggtctaccggtacggaccggaaccgtaccgggttacggttacgttaagtttacggttaggggttacgggagggggttaggggggggttaacgtttggggtgggttacgggaccgtaaccggtaacccgaggtaccgtacggtaccgttaacccggaacggttacgggtccccgggtaaacccgggg

SEQ ID NO: 82133 - DNA, 750 bp, Homo sapiens
  misc_feature: GYAE6OF01BZCQ7.36.34.D01.1.454.CMB.1.raw
  modified_base (256)..(256): a, c, t, g, unknown or other
  misc_feature (256)..(256): n is a, c, g, or t
  modified_base (277)..(277): a, c, t, g, unknown or other
  misc_feature (277)..(277): n is a, c, g, or t
tcagtacgctgtctcacgaccggtgctcgatttagatcgtctgtgttgggtttgggacccaaaaccacaccctccttgggagaatccctagatcacagctcctcaccatggactggacctggagccatccttttcttggtggcggcagcaacaggtgcccactcccaggttcacctggtgcagtctggagctgaggtgaagagcctggggcctcagtgaaggtctcctgcaaggcttctggttacattctttaggngtatgacaatcaccgtgggtncgacacggccctggacagggtcttggagtggagtgggatggatcgaggcgtactttacaagttaggtaaacactaaattagtagaaacaagtaacgtccgaagggcaagagtcacatacgaccaacaacacactaccgaacgacgacctaacacgaccctacgagtacggacgtacgtacgggaaggacgtaccgtaggaacgtacgttaccgacggtaacccggtaaccggaacccggggttacccggtttaagtttaacggttttaacggtttcggggttacggggtaccgggggggttaagggggggggtttaacggtttcgggggtttacggggttcggggtaaccggtaacccggttaacccggtaaccgggttcccggttaccgggttaaccccggttaaacccgggtaaaacccgggttttcccgggtttaccccggggtaaccccccggggttaccccggggggg

SEQ ID NO: 82134 - DNA, 642 bp, Homo sapiens
  misc_feature: GYAE6OF01E35RS.36.34.D01.1.454.CMB.1.raw
tcagtacgctgtctcacgaccggtgctcgatttagatcgtctgtgttgggtttggggacccaaaaaccacacccctccttgggagaatcccctagatcacagctcctcaccatggactggacctggagcatccttttcttggtggcggcagcaacaggtgcccactcccaggttcacctggtgcagtctggagctgaggtgaagaagcctggggcctcagtgaaggtctcctgcaaggcttctggttacatctttaggaggtatgcaatcacctgggtgcgacacggcccctggacgaagggcttggagtggatgggatggatcgagcgtacttaacaagtaggtaaacaactaaaattatagaaacgaagaacgttaccgaggggtacaaggacgtcaaccatacgaacccaacaaacaccaactacccaacgacgacacacgacctacagtggacgcgtaggaaggacgaccgtaggagtacgtacgtacgaccggaccgtacgggtaccgttagttaacgtttagttggtcgggtacggggtagggggggttagttgggtgggtcggtacgtacgtaccgacggtcgtacgtaccgtaaccggaaaccgttcgggttcccggtaccccggtaccggggg

SEQ ID NO: 82135 - DNA, 661 bp, Homo sapiens
  misc_feature: GYAE6OF01EB488.36.34.D01.1.454.CMB.1.raw
tcagtacgctgtctcacgaccggtgctcgatttagatcgtctgtgttgggtttggggacccaaaaaccacacccctccttgggagaatcccctagatcacagctcctcaccatggactggacctggagcatccttttcttggtggcggcagcaacaggtgcccactcccaggttcacctggtgcagtctggagctggaggtgaagaagccgtggggcctcgagtgaaggtctccgtgacgaaggtcttcgtggttacattctttaggagtatgctaatcgaccgtggtgcgacgacggccccgtggacgaaggtcttaggaggtggagtgggagtggatacgagcgtcttaacgaagtagtaacaacaaattagtagaacgagtaacgtccgagggacaagacgtcaacatacgaaccctaaacaacaacactaccaacgacacaacgactacgtaacagtaggacgtcgtaggaggacgaccgtagaacgtagtcgtaacggaaccgtacggtaccgggtaccgtttagttagttacggtggtacgggtacgggggtagggggtttattgggtcgggtggtaccgtaacggtcccgtaggtcccgtaggtacccgtaaacccggttaacggtaccggttcccggtacccgggtaccgggg

SEQ ID NO: 82136 - DNA, 672 bp, Homo sapiens
  misc_feature: GYAE6OF01BXS6Z.36.34.D01.1.454.CMB.1.raw
  modified_base (218)..(218): a, c, t, g, unknown or other
  misc_feature (218)..(218): n is a, c, g, or t
  modified_base (268)..(268): a, c, t, g, unknown or other
  misc_feature (268)..(268): n is a, c, g, or t
  modified_base (284)..(284): a, c, t, g, unknown or other
  misc_feature (284)..(284): n is a, c, g, or t
  modified_base (422)..(422): a, c, t, g, unknown or other
  misc_feature (422)..(422): n is a, c, g, or t
tcagtacgctgtctcacgaccggtgctcgatttagatcgtctgtgttgggtttggggacccaaaaccacacccctccttgggagaatcccctagatcacagctcctcaccatggactggacctggagcatccttttcttggtggcggcagcaacaggtgcccacttcccaggttcacctggtgcagtctggagctgaggtgaagagccgtggggcctnagtgaaggtctcctgcaaggcttcgtggttacattcgtttaggaggtacngcaatcaccgtgggtnacgacacggcccctggacaagggtcttaggacggttgagtgggactggatcgaagcgtacttaacgagttaggtaaacaacgtaaaatttacgagaaactaggtaaacgttccgaagggctaaggacgttacaaccgntacgaaccaacgaaacacactaccgaacgacgacacaacgacctaacaacgtaggaagctaggagacgtccgagagactacgtacgaaccggacaccgggtccggttagttaacttagttagggtcggtacggggtagggggggttacgttgggttaggtcggacgtaccggttaaccgacgtacgtacggtacccgttaacggtaaaccggtttccgggttacccgggtaccccgggttaacccggggg

SEQ ID NO: 82137 - DNA, 310 bp, Homo sapiens
  misc_feature: GYAE6OF01BRUDO.36.34.D01.1.454.CMB.1.raw
  modified_base (150)..(150): a, c, t, g, unknown or other
  misc_feature (150)..(150): n is a, c, g, or t
  modified_base (193)..(193): a, c, t, g, unknown or other
  misc_feature (193)..(193): n is a, c, g, or t
  modified_base (283)..(310): a, c, t, g, unknown or other
  misc_feature (283)..(310): n is a, c, g, or t
tcagtacgctgtctcacgaccggtgctcgatttagatcgtctgtggttggggtttgggtgccgaagttgcgtggaggtcacggtcaccacgctgctggagggagtagacgtcctggaggactgtaggacagcccatcggtccttcccccnggccgccctgcctccaagggactccaccgtcgaagagcaacgngccggccctgggctcgcctggtacaaggtacttactccgagaccagcgtaactggaggcggggtctacggacgaaacggcgataagtagnnnnnnnnnnnnnnnnnnnnnnnnnnnn

SEQ ID NO: 82138 - DNA, 689 bp, Homo sapiens
  misc_feature: GYAE6OF01DE9FV.36.34.D01.1.454.CMB.1.raw
  modified_base (527)..(527): a, c, t, g, unknown or other
  misc_feature (527)..(527): n is a, c, g, or t
tcagtacgctgtctcacgaccggtgctcgatttagatcgtctgtgttgggtttggggacccaaaaaccacacccctccttgggagaatcccctagatcacagctcctcaccatggactggacctggagcatccttttcttggtggcggcagcaacaggtgcccactcccaggttcacctggtgcagtctggagctgaggtgaagaagccgtggggcctcgagtgaaggtctcctgcgaaggcttcgtggttacattcgtttagggagtatgactaatcgaccgtggggtcgccgaacgaccggtccccgtggaacgaacggggtctttagggacggtgggtagtggggtagtgggactaccgagccgtactttaacgaagttacggtaaaacaactaaaatttaagacgtaaacgtaaggtaacgttccgaagggcaagacgtacacctatccgaacaacaacacactaccgacgacgcaacgacacctaacagtagacgacgtagggagtacgccgtagaagtacncgtacgaccggacgacgggtcgttagttagtttagttcggcgggtgggggttaggggggtagttgggttcgggtacggtcgtaacgtaccggacgtaccggtacggtaccccgttaaacggaaccggtttccgggtacccggtaccccggggtaacccgggg

SEQ ID NO: 82139 - DNA, 273 bp, Homo sapiens
  misc_feature: GYAE6OF01EEY51.36.34.D01.1.454.CMB.1.raw
  modified_base (267)..(273): a, c, t, g, unknown or other
  misc_feature (267)..(273): n is a, c, g, or t
tcagtacgctgtctcacgaccggtgctcgatttagatcgtctgtgttgggggggtattgtggtggcactaccagctgctaccgaaactggttcgacccctggggccagggaacccgggtcaccgtctcctcagcctccaccaagggcccatcggtcttccccctggcaccctcctccaagagcacctctggggcacagcggccctgggctgcctggtcaaggactactccagacagcgtactgaggcgggctggcaaggcgcatagnnnnnnn

SEQ ID NO: 82140 - DNA, 833 bp, Homo sapiens
  misc_feature: GYAE6OF01AZCYE.36.34.D01.1.454.CMB.1.raw
tcagtacgctgtctcacgaccggtgctcgatttagatcgtctgtgttgggtttggggacccaaaaaccacacccctccttgggagaatcccctagatcacagctcctcaccatggactggacctggagcatccttttcttggtggcggcagcaacaggtgcccactcccaggttcacctggtgcagtctggagctgaggtgaagaagcctgggcctcgagtgaaggtctcctgcaaggtcttcgtggttacattcgtttaggaggtatgctaatcaccgttgggtcgacgacgacggccccgtaggacgaagggtcttaggagtggtagtgggatggatcgagcgtacttagaagtacggtaacaacgtaattagtacgaaacgaacgggtaacgttacccggaagggtacaacggtacgtacccgtaccgtagtaccggaacccaaacctaaacgaacctacctacccgaacggaccgaacccaacgtaaccctaccgttaacgacggtacggtaacggacgtacgggaaaggtccgtaaccggtaggtaacgacgttaccggtaacgggacccgtaaccggtaaccggggtctttaagggttttaacgtttacgggtttacggggtaccggggggtaacggggggtttaggggggggtttaacggtttagggggttacgggggtacccgggttaccgggaaccccgttaaaccgggttacgggtacccgtttacccggggtaaacccgtttaaacccccggggttaaacccgggttttaccccgggggtttacccccggggttaaccccccggggttaaccccgggggggg

SEQ ID NO: 82141 - DNA, 972 bp, Homo sapiens
  misc_feature: GYAE6OF01C44EQ.36.34.D01.1.454.CMB.1.raw
tcagtacgctgtctcacgaccggtgctcgatttagatcgtctgtgttgggtttggggaacccaaaaaccacacccctccttgggagaatcccctagatcacagctcctcaccatggactggacctggagcattccttttcttggtggcggcagcaacaggtcgacccacctcccgaaggttccaccgtgggtgcagtcgtggagcgtaggaggtgaaggaacgccgtcggggcctacgagtgaacggtcctccgtagcgtaaacggtccgtttacgtacggtttactacgtttacggttttaaggggaaggttagtacgaccgtaacgtccgttaaccggtggggtaccggaccggaaccggtacccgggtaccccggtagggaaccggaaggggttcgttagggtaagggtagggtaggtgggaaagtggggtaactcgacggtacgtaacgtttagaaacggttaacggtaaacaaacgttaaaagttaagtacgtaaacggaaggttaaacggttaccggaacggtaaccgaaaggtaccttaacccgaaaccgttaaccgaaacgaaaccctaaaaaccgaaacccgtaaccgtaaccgtaacccggaaccgaaccgaaccgaaacccgaaccgttaaccgaaaccgtaagggtaccggtaaacgggtccggaacgggtaaccgggtaacggtacccggtaacgtaacggtaccgttaccggaaccggtaaccggtaacccggtaaccgggttaaccggttagtttaaaccgtttaacgggttcgggggtaacgggggttaacgggggggttacggggggtttacgggtttaggggttacccgggtaaccgggtacccgtaacccgggttaccgttaaccggtccccggttaaccggtaaacccggttaacccgggttaacccggtttaacccggggttacccccggtacccgggggtaacccccggg

SEQ ID NO: 82142 - DNA, 788 bp, Homo sapiens
  misc_feature: GYAE6OF01A8KVB.36.34.D01.1.454.CMB.1.raw
  modified_base (249)..(249): a, c, t, g, unknown or other
  misc_feature (249)..(249): n is a, c, g, or t
tcagtacgctgtctcacgaccggtgctcgatttagatcgtctgtgttgggtttgggggagctacaacaggcaggcaggggcagcaagatggtgttgcagacccaggtcttcatttctctgttgctctggatctctggtgcctggcggggacatcgtgatcgacccagtctccagacctcccgtggctgtgtctcgtgggcgaggacggccaccatacaactgccaggtccagccgagtagtttgtttanacacgcctaccaaataaagtaacaacttacttaacgttcggaaccagacaacgaaaacccaggacctaccgtacccttaaccctaaacgtcgtaccttacgttaacgttttacggtacgggaccttaaccgtaccccgggtaaaccccggggtaacggttccccccggggttacctacggtaaccgtacgttacggaaggttcggaccgtacgggtccggggtaccgtaggggtaactaacggttctttacccacttccaccacctagtccacgccaccgtcctacggaccggacggtcaaggtaagtgttacggtacggttaaccgtttagtttttaacgtaccttacgggataacggtaacctaaagttttagttaacgtttaacgtttccttaccccggttcttaaccggtttacccgggtttacgggggaaccgggtaaaccgggtaacgggtaaagggggttacccgtaaacgtaaaccggttaaacccgtaaaaccggtcggttaacggccgggtaaccttcgggaaaccccc

SEQ ID NO: 82143 - DNA, 649 bp, Homo sapiens
  misc_feature: GYAE6OF01EITNQ.36.34.D01.1.454.CMB.1.raw
  modified_base (255)..(255): a, c, t, g, unknown or other
  misc_feature (255)..(255): n is a, c, g, or t
  modified_base (320)..(320): a, c, t, g, unknown or other
  misc_feature (320)..(320): n is a, c, g, or t
  modified_base (462)..(462): a, c, t, g, unknown or other
  misc_feature (462)..(462): n is a, c, g, or t
  modified_base (480)..(480): a, c, t, g, unknown or other
  misc_feature (480)..(480): n is a, c, g, or t
tcagtacgctgtctcacgaccggtgctcgatttagatcgtctgtgttgggtttggggacccaaaaaccacacccctccttgggagaatcccctagatcacagctcctcaccatggactggacctggagcatccttttcttggtggcggcagcaacaggtgcccactcccaggttcacctggtgcagtctggagctgaggtgaagaagccgtggggcctcgagtgaaggtctccgtgcaaggtcttcgtggttacnttacgtttaggaggtatgacaatcgaccgtggtgccgacgacggcccgtaggacgaggtcttagnggtggagtgggatgggactcgacgcgtacttaacgaagtacggtaaacactaaattagtacgaacgaagtaacgtcgagggacgacggataccgaactatacgaaccaaacaaccacatacccgagacgacacgacacctanagcggactgtaggacgcncgtagacgacgtcgacgacgacgaccgggtacgttattaacgttaggtcggtagggtacggggggtaggggttcgtagggttcgggtacggtacgtaaccggtcgacggtacgtacgggtaccgttaaaccggtaaccggtttcgggaccccggtccgggtaccggggg

SEQ ID NO: 82144 - DNA, 726 bp, Homo sapiens
  misc_feature: GYAE6OF01AKCVD.36.34.D01.1.454.CMB.1.raw
tcagtacgctgtctcacgaccggtgctcgatttagatcgtctgtgttgggtttggggacccaaaaaccacacccctccttgggagaatcccctagatcacagctcctcaccatggactggacctggagcatccttttcttggtggcggcagcaacaggtgcccactcccaggttcacctggtgcagtctggagctgaggtgaagaagccgtggggcctgagtgaaggtctcctgcaaggtcttcgtggttacagttcgtttaggagttatgacaatcacgtggtgcgacgacggccctaggacgagggcttggaggtggagtgggatgggattcgagcgtacttaacaagtaggtaaaaccaactaaaatttacgtaacgaaacgtaaggtaacgttaccggaagggaccaaggacgtaccaaccgaagtaaccgaacccaaacaaaccgacgactaacccgacgaacggacctaacgaacgtaccctaacgaacgtgggaacgtacggtacgggaacgggacgtacccgttaggaacgttacgtaccgtaacgggaaccgtacccggacgggttaccgttagttaacgtttacggtcggtaggggtacgggggtagggggtttacgttggggtacgggttcggtaccggtaacctaccggacggtccgtacggtacccgttaaccggtaacgttccggggtaacccgtccccgggtaaccggggg

SEQ ID NO: 82145 - DNA, 675 bp, Homo sapiens
  misc_feature: GYAE6OF01A2X2W.36.34.D01.1.454.CMB.1.raw
tcagtacgctgtctcacgaccggtgctcgatttagatcgtctgtgttgggtttggggacccaaaaccacacccctccttgggagaatcccctagatcacagctcctcaccatggactggacctggagcatccttttcttggtggcggcagcaacaggtgcccactcccaggttcacctggtgcagtctggagctgaggtgaaggaagccgtggggcctcgagtggaaggtctccgtgctaaggcttctggtacatcgttaggagtatgcaatcaccgtggtgcgacacggcccgtggaacgacgggtcttggaggtggagtggggtatggactcgaggtcgtctttaacaagtaggtaaacctaactaaaattacgtagaacgtaaggtaacggttacccgaagggcgtaagacgtacgacctagtaccgaacctaacaacaccacgtacccacgacgacaacacgactacgagtacggacgtactagggacgcgaccgtgaacgtgtacgtaggaacccgtacggaccgggttaccgtagtttaacgttacgttgggtcgggtacgggggtaggggggttacttaggggtcgggtcgggtactacccgttaggcgtaccgtcggtaacccgtaacccggtaacggttcggttacccgggtcccggtaccggggg

SEQ ID NO: 82146 - DNA, 337 bp, Homo sapiens
  misc_feature: GYAE6OF01EG3S0.36.34.D01.1.454.CMB.1.raw
  modified_base (281)..(281): a, c, t, g, unknown or other
  misc_feature (281)..(281): n is a, c, g, or t
  modified_base (292)..(292): a, c, t, g, unknown or other
  misc_feature (292)..(292): n is a, c, g, or t
  modified_base (300)..(337): a, c, t, g, unknown or other
  misc_feature (300)..(337): n is a, c, g, or t
tcagtacgctgtctcacgaccggtgctcgatttagatcgtctgtgttgggggggtattgtggtggcactaccagctgctaccgaaactggttcgaccctggggccagggaacccgggtcaccgtctcctcacgcctccaccaacgggcccatccggtccttcccccgtggccaccctcctaccaagagcacctcgtgggggcacgagccgggccctgggcctgtccgtggtcaaaggtacctacgtttccagaacgaggccttaacgtggacgcgggtacncggacaccggngacagtgnnnnnnnnnnnnnnnnnnnnnnnnnnnnnnnnnnnnnn

SEQ ID NO: 82147 - DNA, 688 bp, Homo sapiens
  misc_feature: GYAE6OF01EKXOS.36.34.D01.1.454.CMB.1.raw
  modified_base (638)..(638): a, c, t, g, unknown or other
  misc_feature (638)..(638): n is a, c, g, or t
tcagtacgctgtctcacgaccggtgctcgatttagatcgtctgtgttgggtttggggacccaaaaaccacacccctccttgggagaatcccctagatcacagctcctcaccatggactggacctggagcatccttttctggtggcggcagcaacaggtgcccactcccaggttcacctggtgcagtctggagctgaggtgaagaagccgtggggcctcgagtggaacggtctccgtgacgaaggtcctttcgtaggtttacagttcgtttaggacggtatcggactaaagtccgaccgttgggtacgcgaaccgacgggccccgtaggaccgaagggtccttaggagtggacgtgggtagtggactcgaggtccgtacttaacgaagtacgggtaaacaacgtaaaagttagtaacgaacgaaggtaacgttccgaagggcaaggtacgtcgaaccgtatacggaaccctaaacgaaccacgactaccgacgtacacaacgacgacctaacgaggtacggacgtcgtaggacggcgtccgtagagactacgagtaaccgacgtaccgcgtttagttaccttaggtggtacggacgggggtaagggggttattgggttacgggcgtacgaccggtacgnggtcctacggacccgttaaccgaggttcccgtccggcccggggtaccggg

SEQ ID NO: 82148 - DNA, 661 bp, Homo sapiens
  misc_feature: GYAE6OF01EYMX3.36.34.D01.1.454.CMB.1.raw
  modified_base (284)..(284): a, c, t, g, unknown or other
  misc_feature (284)..(284): n is a, c, g, or t
  modified_base (289)..(289): a, c, t, g, unknown or other
  misc_feature (289)..(289): n is a, c, g, or t
  modified_base (295)..(295): a, c, t, g, unknown or other
  misc_feature (295)..(295): n is a, c, g, or t
  modified_base (363)..(363): a, c, t, g, unknown or other
  misc_feature (363)..(363): n is a, c, g, or t
  modified_base (471)..(471): a, c, t, g, unknown or other
  misc_feature (471)..(471): n is a, c, g, or t
tcagtacgctgtctcacgaccggtgctcgatttagatcgtctgtgttgggtttggggacccaaaaaccacacccctccttgggagaatcccctagatcacagctcctcaccatggactggacctggagcatccttttcttggtggcggcagcaacaggtgcccactcccaggttcacctggtgcagtctggagctgaggtgaagaagccgtggggcctcgagtgaaggtctccgtgcgaaggtcttctaggttacatctttaggaggtatgcaatcacgtggtncgacnggcccnggacgaaggcttgagtggagtgggatggactcaggcgtacttaacaagttaggaaactaactaaattntagaacgaagtaacgttaccgagggacaaggaagtacaaaccaacgtaaaccaacaaaacgacaactaccaacgacaccaacgacgaccctaagagtaggaacgtacncgggtaacggacgtacgtaggaagtactacgtaggaaccgtaccgaccgggtaccgttagtagtttagttacggtaggggtaaggggtacggggggttattgggtcgggtacggactacggtacgcgacgtacgaaccgttaaccggtaacgttaccgggtacccggtacccggtcggggtaaccccggg

SEQ ID NO: 82149 - DNA, 720 bp, Homo sapiens
  misc_feature: GYAE6OF01CMKZP.36.34.D01.1.454.CMB.1.raw
  modified_base (364)..(364): a, c, t, g, unknown or other
  misc_feature (364)..(364): n is a, c, g, or t
tcagtacgctgtctcacgaccggtgctcgatttagatcgtctgtgttgggtttggggacccaaaaaccacacccctccttgggagaatcccctagatcacagctcctcaccatggactggacctggagcattccttttcttggtggcggcagcaacaggtgcccactcccaggttcacctggtgcagtctggagctgaggtgaagagccgtggggcctcgagtgaaggtctcctgcaaggtcttgtggttacattcgttaggagtatgcaatcacgtgggtgcgacgacggcccaggacgaggcttggagtggtagtgggatggatcgagcgtacttaacgaagtacggtaacaactaaattanaggaaacaggtaacgttacgaagggacaagacgtacacgagtacgaaccaacaacacactaccgaacgacgacaacgtacgacctaacgaagtacggaacgtacggtaacggacgggacgtaccgtagaacgtacgtacgtaacggaaccggtaccggtaaccgggtccggttaacggtttaagtttacgggttacgggttaggggtaaccgggggttagggggggtttaggttacggggttaggggttacggttaaccggaaccgttaccggtacgggtaccgttacggtaacccggttaaccggtaaaccgggtttacgggttaccccgggtaaccccggggttaaccgggggg

SEQ ID NO: 82150 - DNA, 801 bp, Homo sapiens
  misc_feature: GYAE6OF01CXEIC.36.34.D01.1.454.CMB.1.raw
  modified_base (558)..(558): a, c, t, g, unknown or other
  misc_feature (558)..(558): n is a, c, g, or t
tcagtacgctgtctcacgaccggtgctcgatttagatcgtctgtgttgggtttggggacccaaaaaccacacccctccttgggagaatcccctagatcacagctcctcaccatggactggacctggagctattccttttcttggtggcggcagcaaacgaggtcgcccacctcccaggttccaccgtgggtgcagtcgtgggagcgtgagggtagaaaggacgccgtggggccctagagtaggaacggtcctccgtgacgaaggtcctttgttaggttactagtttccgttaagggaggttatgactaacgtccgtaccggtggggtacgaccggaccgaaccggtcccccgtagggaaccgtaacgggtccgtttaggagggtggtaggtcgggagtcggacgtacgagccgtacttaacgtaagtacggtaaactaaactaagttaacgaagaacgaagttaacgtaccgaggatacgtacgtaccacgtaagaccgaaccaaacaacacgtaacgtaccgagtaccgaacacgactacagtagtcggagtacggnggaaggcctaacggtagaaccgtacgtaccggtaaccggaaccgtaccgggtccggttacgttaagtttggtttacggttacggggcggggttaacggggggtagggggtttaccgtttgggaccggggttaaccggtaccgtaacccggttacggtacccgtacgggacccgttaaacccgggttaacccgttaaccgggttttaccccggggaccccgggttaccccggggtaccccgggg

SEQ ID NO: 82151 - DNA, 744 bp, Homo sapiens
  misc_feature: GYAE6OF01AQKRM.36.34.D01.1.454.CMB.1.raw
  modified_base (156)..(156): a, c, t, g, unknown or other
  misc_feature (156)..(156): n is a, c, g, or t
tcagtacgctgtctcacgaccggtgctcgatttagatcgtctgtgttgggtttggggacccaaaaaccacacccctccttgggagaatcccctagatcacagctcctcaccatggactggacctggagcatccttttcttggtggcggcagcaacnggtgcccactcccaggttcacctggtgcagtctggagctgaggtgaagagccgtgggcctgagtgaaggtctctgcaggtcttcgtggttacattcgtttaggagtatgcaatccgaccgtgggtgcgacgacggccccgtaggacgaagggtcttaggaggtggagtgggagtggatcgaggtccgtactttaacgaagttaggtaaacctaaactaaagttagtaaggaaaccgtaaggtaaccggttaccggaagggcgaacggtacgtacccgaacccgtacgtaccggaaaccctaaacaaaccgactaaccgtaacccgaacgaaccgaccaaccgacgtacccgtaacgagtacggacgtacgtaggaccggtacgtccgtaggaacgtacgtcgaaccgaccggaccggtaaccgggtacggttaagttaacgtttacggttacgggtacggggtagggggttacggggggttagttaggggtgggtacggtaccgtaaccggtaccgtaggtacccgttacggtaccggttaaccggtaaaccggttccgggttaacccgggtcccggggtaccggggg

SEQ ID NO: 82152 - DNA, 780 bp, Homo sapiens
  misc_feature: GYAE6OF01A3109.36.34.D01.1.454.CMB.1.raw
  modified_base (368)..(368): a, c, t, g, unknown or other
  misc_feature (368)..(368): n is a, c, g, or t
  modified_base (678)..(678): a, c, t, g, unknown or other
  misc_feature (678)..(678): n is a, c, g, or t
tcagtacgctgtctcacgaccggtgctcgatttagatcgtctgtgttgggtttggggacccaaaaaccacaccctccttgggagaatccctagatcacagctcctcaccatggactggacctggagcattccttttcttggtgggcggcagcaacaggtcgcccacctcccgaggtcgcgagcgtggtgcagtcgtggggcgtggaggtagaaggaacggtccggtcggggtcctcgaggtagtaagggttccctccgtgacgaacgtacttcggtaggactactacccgttacgaccggctaactatagtcgcctaggtgggtcgcgaacgcggccgtaggaacggaggtcgttaggaggttacggnggtacgggtagtacgggtaactacccgaacccgtaaggtaggtacggtacggaacctaaacgtaaacgtacggtacgtaacgtaacggtaacgttaagggtttaccggaggggtacggtacgggtaactaccgtaacggtacggtaccggacggggtaacctacggttaccgaagtacgacgacgtaacgtaaccttaaccggtagtaaggcgggtaacggtcggaacggacgggaccggtacgggcttaaacgggagtaaccgttacggtacgaaccggaccggtacgggtacttacgtacgttacggngggacgtacggtagggtaaccgggtgttagttacggtagtttcgggttaacgggttacggtttacctttacgtagtcccgggtaacgggttcgggaaccggg

SEQ ID NO: 82153 - DNA, 804 bp, Homo sapiens
  misc_feature: GYAE6OF01CK6LH.36.34.D01.1.454.CMB.1.raw
tcagtacgctgtctcacgaccggtgctcgatttagatcgtctgtgttgggtttgggacccaaaaaccacacccctccttgggagaatcccctagatcacagctcctcaccatggactggacctggagcattccttttcttggtggcggcagacaacgaggtcgcccactcccaggttccaccgtggtgctagtctgggagcgtaggaggtagaaggacgtccgtggggcctcgaggtgaacggtctccgtgacgtaaggtcctttacgtcggttactacgttcggtttaggaggttatacgacgtaacgtaccgtaccggtggggtacgaccggacgtaccggccccgtagggacggaagggttccgtaggtaggtaggtaggtacgggtatggtatcggacgtcgtacgttaacgtaacgttaggtaacgaaacgtaaatttacggaaagaaacgtaggtaaaccggttacggaacgggacgtaacgtacgtaaccgaaccgtagaccggaaacccaaacgaaacgtaaccgtaccgtaacccgaacggaacgtaacccgaaaccgtacccgtaccgttaacgtaacgtacgggaacgtacgggttacggaacggaacgtaccggtaagtacgtacgtacgtaacggacccgtaaccgtacgggtaccgttagtttaacgttaggtacggtacgggtacggggttagggggttagttagggtacgggtacgtacggaccgtccggaacgtcgacgtaccgttaacggtacccggtcgggttccccgtcccgggtaacccgggg

SEQ ID NO: 82154 - DNA, 884 bp, Homo sapiens
  misc_feature: GYAE6OF01BX42T.36.34.D01.1.454.CMB.1.raw
  modified_base (777)..(777): a, c, t, g, unknown or other
  misc_feature (777)..(777): n is a, c, g, or t
tcagtacgctgtctcacgaccggtgctcgatttagatcgtctgtgttgggtttgggggagctacaacaggcaggcaggggcagcaagatggtgttgcagacccaggtcttcatttctctgttgctctggatcttcgtgggtcgccgtggcggggacagtcgtgagtcgaccctagtcctccagtcctcccgtggcttgtcgtcgtcgtgggcgaggacgggccactacgtaccaacgtcgacgtacggtcccacggaccgtaaggttagtttagttttaacaccgtacgtacccttaaaccgaaacgtaaaacgttaaaaccggtaaaaccctttaaaccgttttaaaccggtttaccgggtaaaaccccgaaggtaaaccccgaaaaacccgggtaaaaaccccgaaccggggtaaacccctaacccgggttaaccccctttaaaccccggtaaaaaccggttcccggtaaccctttaacccgttttaacggttttaacccgggtaccggggttaacctaaaccccggttttaacccccgggtaaaaccccccggggttaaccgggtttacccccccggggtttaccgtaacccggtaaccggttacgtttaccgggaacggtccgggaccggtacggggttacggggtacccggtaacgggtaacctaggtttacctttacccgtactacccgtaccaccgtactaccgacgtcgaccgtccgtaggacgtaacggtcgtagaacgtgtcggtacggtaatttacgtttaccgtntcgacgtataacttattagttactaccgttacgtctacgtcgttaccggtagggacggacggtacggaggtacgtagaacgtacgaacgtcgtagcgcgtacgtacg

SEQ ID NO: 82155 - DNA, 770 bp, Homo sapiens
  misc_feature: GYAE6OF01AXUQS.36.34.D01.1.454.CMB.1.raw
tcagtacgctgtctcacgaccggtgctcgatttagatcgtctgtgttgggtttggggacccaaaaaccacacccctccttgggagaatcccctagatcacagctcctcaccatggactggacctggagcatcctttctggtggcggcagcaacaggtgcccactcccaggttcacctggtgcagtctggagctgaggtgaagaagcctggggcctcgagtgaaggtctccgtgcaaggtcttctggttacattcgtttaaggaggtatgacgaactcgacgtgggtcgcgacgacggccccgtaggaccgaagggtcttggaggtggagtgggtatggatcgagcgtacttaacaagtagtaacaactaaattataagaacaggtaagtccgagggacagagtccgacacgtacgaaccaaactaaaccaactactaccgacgaacgacgaaccaggtacctaacgaggtaacggagtacgtacgggaacggtacgtacccgtaggaacgttacgtaccgtacggtaaaccggaaccgaacccggggttacgttaacggtttaacgtttaggttacggggttaccggggtacggggggttaaaggggggggtttaagtttacggggttagggggttaccgggtaaccggtaacccggttaaacccgtaacgggtttaccggttaaccgggtaaaccccgttaaacccggttaaaacccgggttcccggggttttaacccccgggaaccccccggggtttaaccggggggg

SEQ ID NO: 82156 - DNA, 662 bp, Homo sapiens
  misc_feature: GYAE6OF01ESQ9S.36.34.D01.1.454.CMB.1.raw
  modified_base (477)..(477): a, c, t, g, unknown or other
  misc_feature (477)..(477): n is a, c, g, or t
tcagtacgctgtctcacgaccggtgctcgatttagatcgtctgtgttgggtttggggacccaaaaaccacacccctccttgggagaatcccctagatcacagctcctcaccatggactggacctggagcatccttttcttggtggcggcagcaacaggtgcccactcccaggttcacctggtgcagtctggagctggaggtgaagaagccgtgggcctcagtgaaggtctctgacaggtcttcgtgtacatcgttaggagtatgataatcacgtggtgcgacgacggccctaggacgaagggtcttaggagtggagtgggagtggatcgacgcgtactacgtaagtaggtaaccaaacgtaaattagaagaaacgaagtaaacggtcgaagggacgaaggtactaccgaacaacgtacgaaacccaacaaaccgacaactaccgaacgacacgaacacgacctaagaggtagagcgngtacgcgtacgtagacgtactacgtcggaaccgtacgacgggttccgtaagtttacttaggttgggtcggaaggggggttcgggggttaagttggggttcggtacggtacgtaacccggttacgaacgtcgacgttaaccgaaccggttaaccggttcgggtacccgtaacccggggtacccggg

SEQ ID NO: 82157 - DNA, 954 bp, Homo sapiens
  misc_feature: GYAE6OF01BDDP1.36.34.D01.1.454.CMB.1.raw
tcagtacgctgtctcacgaccggtgctcgatttagatcgtctgtgttgggtttggggacccaaaaaccacacccctccttgggagaatcccctagatcacagctcctcaccagtggactggacctggagcattccttttcgttggtgggcggcagcaacgaggtcgccccactcccgaggtttccaccgttgggtcgcgagtcgtgggacgtcgtggaggtagaacgaagccggtggggcctacgaggtacggtaaggttcctccgtacgacgtaacggttcctttacggttacggtttaactacgtttacggtttaagggtacggttagtcgaactaacgtcccgtaaccggttgggtccgaccggtaccggaccggtacccggtaggaacggtacgggttccgtggggtacggtaggtagggtcggaggttaggacgtacgacggttaccgttacttaaacggtaacgttaacggttaaaactaaacgtaaagttaggtaaacgtaaccgtaaaggtaaccggtaccggtaaggaccgaaacggttacgtaaccgtaaaccgtaacggtaacccaaaaccgtaaaacccgaaacctacgtaacccgtaccgtaaaccggaacctaccgtaaacgaaccgttaacccgaacggtacggtacgggaccggttacgggaaacgggtaccggtaacccgttacggacgttaacggtaccgttaacggtaaccgggaacccggttaacccggtacggtttaccgggtttacgttaacggtttacggtacgggggttaacgggtacgggggggtttaggggttaaccggtttgggggtacggttacccgggtacgttacccggtacgggtaccgtaccgggttaaccgtaaacccggggttaacttaaaacccgggttcccggggttaccccccgggtaacccgggggttaacccggg

SEQ ID NO: 82158 - DNA, 721 bp, Homo sapiens
  misc_feature: GYAE6OF01DDJ2M.36.34.D01.1.454.CMB.1.raw
  modified_base (153)..(153): a, c, t, g, unknown or other
  misc_feature (153)..(153): n is a, c, g, or t
  modified_base (271)..(271): a, c, t, g, unknown or other
  misc_feature (271)..(271): n is a, c, g, or t
  modified_base (276)..(276): a, c, t, g, unknown or other
  misc_feature (276)..(276): n is a, c, g, or t
  modified_base (475)..(475): a, c, t, g, unknown or other
  misc_feature (475)..(475): n is a, c, g, or t
  modified_base (530)..(530): a, c, t, g, unknown or other
  misc_feature (530)..(530): n is a, c, g, or t
tcagtacgctgtctcacgaccggtgctcgatttagatcgtctgtgttgggtttggggacccaaaaccacacccctccttgggagaatcccctagatcacagctcctcaccatggactggacctggagcatcctttcttggtggcgcagcaacnggtgcccactcccaggttcacctggtgcagtctggagcgtggaggtgaaggagccgtggggcctcgagtgaaggtcctcctgaccgaaggtcttcgtggttaccagttcgttaagggngttangtacaatccgaccgtgggtcgaccgacgaccggtcccctagggaaccgtaagggtctttggaagggtcggagttacggggagtgggatccgaggccgttacgtagaagttacggtaaacaacgtaaattagtacgaacgtaaggtaacgtccggaaggcgtaagtaccgtacaccgtagtacgtaaccaaactaaaccncgaactaccgacgacgacacaacgtactaacagtacggctacgtaggaccggtanccgtagaacgtacgttacggaaccggaccgtacggtacccggttcgttacggttactttagggtcggtacgggtacgggggtaggggggttattacggggtacggggtcgaaccggtacgtaccggacggtcgtaccgtaaccgggtaaccgtacgggttaccccggtacggtacccccgggtaacggggg

SEQ ID NO: 82159 - DNA, 817 bp, Homo sapiens
  misc_feature: GYAE6OF01C4NUE.36.34.D01.1.454.CMB.1.raw
  modified_base (538)..(538): a, c, t, g, unknown or other
  misc_feature (538)..(538): n is a, c, g, or t
tcagtacgctgtctcacgaccggtgctcgatttagatcgtctgtggttgggttggggacccaaaaaccacacccctccttgggagaactccctagatcacagctcctcaccatggactggacctggagctattcctttcgtggtggcgcagcaacaggtcgcccactcccgaaggttcaccgtggtgcacgtcgtggacgcgtaggaggtagaaggacgccgtggggacctacgagtcgaacggttctccgtgacgtaacgtcttacgtacggttaactagttacggtttaggaggtacgtaggtacaacgttcgtaccgtagggtcgaccgacggaccggtcccgtaggaacgtaacggtgtttaggaacggtcggtaaggtaggtacgttagggaacttcggaacgtaccgggttactttaacggaaacttaccgggtaaaactaacggttaaaattggtaaaccgaaacgtaagggttaacggtttaccgaaggggaccttaagaccgtacgaaacacggtaacaaccctaaaanaaacccgtacgtaacccggtaacacggaaccgactaaccggtaccgtaacttaacccggaaggtacggacgtaaccgtaggaaaccggtgtaacccggtattaacggacgttaaccgttagaacccgggtacggtaaccggttcgttaacgttaaggtttcggtaggtaccgggtaagggggttaagggtcggttaggtacccgggtgtaaccgcgtaaccgacgttccggaacgtaccggtaaaccgtccggttaccggtcccgacggggtaacccgg

SEQ ID NO: 82160 - DNA, 814 bp, Homo sapiens
  misc_feature: GYAE6OF01A052D.36.34.D01.1.454.CMB.1.raw
  modified_base (163)..(163): a, c, t, g, unknown or other
  misc_feature (163)..(163): n is a, c, g, or t
  modified_base (189)..(189): a, c, t, g, unknown or other
  misc_feature (189)..(189): n is a, c, g, or t
  modified_base (723)..(723): a, c, t, g, unknown or other
  misc_feature (723)..(723): n is a, c, g, or t
tcagtacgctgtctcacgaccggtgctcgatttagatcgtctgtgttgggtttggggacccaaaaaccaccacccctccttgggagaatcccctagatcacagctcctcaccatggactggacctggagcattccttttctgggtggcggcagcaacgaggtncccactcccaggttcaccgtggtgcngtctggagtcgtaggagggtagaaaggacgtccggtcggggcctaccgaggtggaaagggttcctccgttaggacaaacgggttcctttacgttacgggtttaaccagttttaccgttttaagggaggttaagtggaactaacgttacgtaacccggttgggtaccggcggtaaccggaccggtccccgtagggaaaccgaacgggttctagggaggtcgggtaaggtgggtagtaggacgtacgacgtaccgtacgttaacgaaacgttaaggtaaaacctaacgttaaaatttacgaacggaaacgaaacgggttaaagttaccggacggggaataacggtacgtacaaaccgtacgaaaccggaaccaaaccgtaaaccaccttaacgaacccgtacggaaccgacaaacgtaacgaactaacggaagtaccgagtaacgtaagggacgacgtcgagtagaacctgacgaacgacggacgttacgtagtttacgttagtggcggggtaggggttacggggtaggtttaggnggggtcccgtagaccgtaccggacgtaccggtacgtaacccgggtaaaccgttaacggtttccgggacccgggttacccgggtacccgggg

SEQ ID NO: 82161 - DNA, 300 bp, Homo sapiens
  misc_feature: GYAE6OF01A52BI.36.34.D01.1.454.CMB.1.raw
  modified_base (272)..(300): a, c, t, g, unknown or other
  misc_feature (272)..(300): n is a, c, g, or t
tcagtacgctgtctcacgaccggtgctcgatttagatcgtctgtgttgggggagggtattgtggtggcactaccagctgctaccgaaactggttcgacccctggggccagggaaccctggtcactgtctcctcagcctccaccaagggcccatcggtccttccccctggccaccctcctccaagagcacctcgtgggggcacagcggccctgggctgcctggtcaaggactacttccagacagcgtactgagcgggctggcaggcgcatagnnnnnnnnnnnnnnnnnnnnnnnnnnnnn

SEQ ID NO: 82162 - DNA, 709 bp, Homo sapiens
  misc_feature: GYAE6OF01BAB0H.36.34.D01.1.454.CMB.1.raw
  modified_base (197)..(197): a, c, t, g, unknown or other
  misc_feature (197)..(197): n is a, c, g, or t
  modified_base (227)..(227): a, c, t, g, unknown or other
  misc_feature (227)..(227): n is a, c, g, or t
  modified_base (237)..(237): a, c, t, g, unknown or other
  misc_feature (237)..(237): n is a, c, g, or t
  modified_base (243)..(243): a, c, t, g, unknown or other
  misc_feature (243)..(243): n is a, c, g, or t
tcagtacgctgtctcacgaccggtgctcgatttagatcgtctgtgttgggtttggggacccaaaaaccacacccctccttgggagaatcccctagatcacagctcctcaccatggactggacctggagcatccttttcttggtggcggcagcaacaggtgcccactcccaggttcacctggtgcagtctggagctgnggtgaagagcctgggctcagtgaggtctcngcaggcttcngttacntcttaggagtatgacaatcaccgtgggtcgcgacacggtccccgtggaacaagggcctttggacggtggtacgtggggatgggtactcgagcgtacttaacaagtacggtaaacaacgtaaacttatagaacgtaagaacgttaccgaggacagtaacgtacaaccgatacggaaccaacaaccacactaccaacgacacaccacgactacgaggtacggtacgacgtacggacggacgtacccggtagaacggtcgtaacggaccggtaaaccggacccgaaccgggtacccggttagttaaacgttacggttacgggtaacggggtccggggggttaaggggggggttacgttacgggggttcgggttacggaccggttaacggaccgtaccggtaccgttaacgtaccggttaacccggttaaaggttcccgggttaccccggtacccggggttaacccgggg

SEQ ID NO: 82163 - DNA, 836 bp, Homo sapiens
  misc_feature: GYAE6OF01CU7ZG.36.34.D01.1.454.CMB.1.raw
  modified_base (281)..(281): a, c, t, g, unknown or other
  misc_feature (281)..(281): n is a, c, g, or t
  modified_base (419)..(419): a, c, t, g, unknown or other
  misc_feature (419)..(419): n is a, c, g, or t
tcagtacgctgtctcacgaccggtgctcgatttagatcgtctgtgttgggtttggggacccaaaaaccacacccctccttgggagaatcccctagatcacagctcctcaccatggactggacctggagcattccttttcgttggtggcggcagcaacaggtgcccactcccaggttcacctggtgcagtctggagctggaggtagaagaacgccgtgggcctcgagtgaaggtctcctgacgaaggtcttcgtaggttacagtttcgtttagggaggttangactaagtctaccgtgggtcgacgaccgacggtccccgtggaacgaggtctggaggtggagtgggatggatcgagcgtacttaacgaagttcgaaactaactaaattagtacgaaacgtagtaacggtaccgaggganacgacgtacaccgtaactaacgaacccaaacgaaaccaccaaccgtaccgaacgaaccgaccgaaccgtaacgtaccctaaagacgtagggacgtacggtagggaacggtccgaccgttaaggaacgtttacctacggtaaccggaacccggtaacccggtaccggggtttccggttaagtttaaggtttttacgggttaggggtaccgggggttaacggggggggtttaaagggggggtttcctttaagggggttccggggtttaacgggtaacccggtttaaacccggttaaccccgggtagggttaacccccggttacccgggttaaaaccccggttaaacccggggttaaacccggggttttcccggggttaaacccccccgggtacccccgggggtttaaccccgggggggg

SEQ ID NO: 82164 - DNA, 193 bp, Homo sapiens
  misc_feature: GYAE6OF01B31U8.36.34.D01.1.454.CMB.1.raw
  modified_base (173)..(173): a, c, t, g, unknown or other
  misc_feature (173)..(173): n is a, c, g, or t
  modified_base (177)..(177): a, c, t, g, unknown or other
  misc_feature (177)..(177): n is a, c, g, or t
  modified_base (185)..(193): a, c, t, g, unknown or other
  misc_feature (185)..(193): n is a, c, g, or t
tcagtacgctgtctcacgaccggtgctcgatttagatcgtctgtgttgggtttgggggagctacaacaggcaggcgaggggcagcaagatggtgttgcagacccaggtcttcatttctctgttcgctctggatctcgtggtcgccgtggacgggactagtcgtgatcgacccngtcnccgactannnnnnnnn

SEQ ID NO: 82165 - DNA, 771 bp, Homo sapiens
  misc_feature: GYAE6OF01CZ91O.36.34.D01.1.454.CMB.1.raw
tcagtacgctgtctcacgaccggtgctcgatttagatcgtctgtgttgggtttgggtgcgggggctgggctgccctcataagggcctcccagacaggagtgcagtgggcctggaaggtaggaataggccagagaggcccagctgggcagggagagcaggtccagggtggcgtctgccctctggcgggcttggagtcggcgtgggggcgctccagtcctcgacgcccccacggggtccctgtcgtcgttgggtcggcccttgttccgttggttcggccttccccggtagggacgccgacggcccacgacggcccggggactaaacccgtggactaacggttagacgtcgtggtccgtgggacgccgtggtccgtaccggtggaccgccccgtggaccgagggacggccggacgggccccgggagtacaaccgtagtcccacctacccccgatacccgtaaacggtcgaccgggttcaccgggtagcccctttaggtccgtacggtacggtacgttacggaccgtaccggtaacggccggtaccggaccgggttccccttcccgtttcccgtccgtacggtaccggtcctcgggtcccgtccgtcccggtacggacccgtaccgtaccggtaggtaaacccgtaacccggttacccggtaacccgggtcggggttaaccgtcggtaacggggacggtaccggaccggtaccggtccgggaacccctcccggtaacccgtacccgtaggtaccgtacggtagtccgttacccgg

SEQ ID NO: 82166 - DNA, 747 bp, Homo sapiens
  misc_feature: GYAE6OF01BYJVV.36.34.D01.1.454.CMB.1.raw
  modified_base (280)..(280): a, c, t, g, unknown or other
  misc_feature (280)..(280): n is a, c, g, or t
tcagtacgctgtctcacgaccggtgctcgatttagatcgtctgtgttgggttgggacccaaaaccacacccctccttgggagaatcccctagatcacagcctccctcaccatggactggacctggagcattccttttcttgggtggcggcagcaacgaggtcgccccacctccccgaggttccaccgtggtgcagtctggagctaggaggtagaagaacgccgtgggcctcgagtgaaggtcctctgacaaggtcttcgtgtactagttcgttaggagtntgactaacgtacgaccggtgggtcgacgtacgacggcccgtaggacgaggtctagaggtggagtggacgtaggacacgacgcgtactacgtaagtacggtaaacaacgttaaattacgaacgtaaacgaaggttaaccgtacggaaggggtacctaaacggtacgtaccaacctagtaacccgaaaccaaaaccgtaacgtaccaaacccggttaccaaaccggaccgtaaccaaacgtcccgtaacctaaccgaagggttaccggaacgtaccggtaaggggtaacgtaccggtaccgttaacggactaacgtacggtaacgaacccggtacgggtaccgttacgttaagggtttaacttacggaggggtaaccgggtaggggggttaggggtttactaggggtcgtacggtacacggttacgcgtacgtacgtaccgtaccgtagtccggtacccgtcgaccggg

SEQ ID NO: 82167 - DNA, 775 bp, Homo sapiens
  misc_feature: GYAE6OF01A4OLN.36.34.D01.1.454.CMB.1.raw
  modified_base (470)..(470): a, c, t, g, unknown or other
  misc_feature (470)..(470): n is a, c, g, or t
  modified_base (479)..(479): a, c, t, g, unknown or other
  misc_feature (479)..(479): n is a, c, g, or t
  modified_base (505)..(505): a, c, t, g, unknown or other
  misc_feature (505)..(505): n is a, c, g, or t
tcagtacgctgtctcacgaccggtgctcgatttagatcgtctgtgttgggtttgggacccaaaaccacacccctccttgggagaatcccctagatcacagctcctcaccatggactggacctggagcattccttttcttggtggcggcagcaacgtaggtgcccactcccaggttcaccgttggtcgcagtcgtggagcgtggagggtagaagaacggccgtggggcctcgagtggtaaggtctcgtggaccaaggtcttcgtacgggttactagtttcgttaaggtacggtagtcgactaatcgtaccgtggcgacgacgtacgggaccccgtaggacgtaagggtcctagggacggtggagtagggacgtggtacgtgtaacgcggttactaagtaacggtacgtaacaacgtaattacgaatacgagtacgtcgaggcgatagacacgatacgaacaaacgactacnctacgacgngacaacgcacctaagaggtaccgganaaccgtaggacggtacgtaccgtaggaacttaccgaccgggttaacgaaccggtaccgggtaaccccggtttagggtaccgttttaagggttccgggttaacggggttcggggaagggggggtttaccggggtggtttaagggtcccgggtaaaccggttaccggttaacccgttaggggtaaaccggtcgttaaacccgggtacggtaaaaccccccggttttagggtaccccggggttacccccggaacccgggtttaacccgggggg

SEQ ID NO: 82168 - DNA, 941 bp, Homo sapiens
  misc_feature: GYAE6OF01B8HCO.36.34.D01.1.454.CMB.1.raw
  modified_base (308)..(308): a, c, t, g, unknown or other
  misc_feature (308)..(308): n is a, c, g, or t
tcagtacgctgtctcacgaccggtgctcgatttagatcgtctgtgttgggtttgggtgcgggggctgggctgccctcataagggcctcccagacaggagtgcaggtgggcctggaagggtagaataggccagaggacggcccagcgtgggcaggggagagcagtccgaggggtggcgtctgccctcgtggcgggtcttgggagtcgggcggtggggggcggcctccgactcctccgaccgcccccgacggggtccttcgtgtcgttgggtcggcccttcgtcgttggttccgcgttcccgtggggacncgtacggccacgaccgggtccggggacctaaccgtacggacctacgttaacggtacgtcggttcgtcgggtacggggtcgtccgggtcgggtccggtacccgggtcggggaccccgtccccgggtggaccgggtaacggggcgggacccggaccggggcccggggaacgaccgtaaacgtcccgttcccgtaacccctacccccggtaacttaacccgtaacccgttacggggaaccgtcggttaccggtaccggtcccggtttaccggttccggttaaccgttaaccgggtaccgggttaccggtaacccgggtaccccgggtacgggacccgggggtaccccgttacccggggtccccgtttaccccgttttcccggtttccgacccgggtaccgggtcccggttccgggcccgtcggtccccggttggacccggtccggacggtttaaccgggaacccgttacccgttacccgggaccggggttacccggggtcggttaccgggtaacgggggaccggtaacgggttccccggaacccgggttccccggaacccgggttacccccggtacccggtaacccgggttaccccgggtaacgggttacccgtttacggttcccgtaaccccggg

SEQ ID NO: 82169 - DNA, 791 bp, Homo sapiens
  misc_feature: GYAE6OF01C940Y.36.34.D01.1.454.CMB.1.raw
  modified_base (296)..(296): a, c, t, g, unknown or other
  misc_feature (296)..(296): n is a, c, g, or t
tcagtacgctgtctcacgaccggtgctcgatttagatcgtctgtgttgggtttggggacccaaaaaccacacccctccttgggagaatcccctagatcacagctcctcaccatggactggacctggagcatccttttctggtggcgcagcaacgaggtgccccactcccaggttcaccgtggtgcagtctggagctgaggtgaagagcctgggcctgagtgaaggtctcctgacaggtcttcgtaggttacagttctttagggagttacgtgactaatccgtaaccgtggggtacnccggaaccgaacggtccccttagggaacgaagggtccttaggagggtacggaagttgggggaatcgggtaactcgtaaggccgttacgttaacgaaacgttcgggtaaaactaaccgtaaagtttaagacgaaacgtaggtaaacggttccgtaaggggacgtaacgtacggtaccaaccgtacgtacggaaccaaacgtaaacctacgactacccgaacgacgtaccaacgtacgtaccgtaacgaacggttggaacgtcgtaacggtacggtacgtacccgtaggtaacgtacgtacgttaacggaaccgtaaccggtaaccgggtaccggttacgttaacgttttaaccggttaggtaccggggttacgggtaacggggggggttaccgtttaggggttaccgggtacgggtaccgtaaccgttaccgaacgtacgtacggtacccgttaaacggtaccggttaccggtcccggtacccggtacccgggggg

SEQ ID NO: 82170 - DNA, 985 bp, Homo sapiens
  misc_feature: GYAE6OF01BVAJY.36.34.D01.1.454.CMB.1.raw
tcagtacgctgtctcacgaccggtgctcgatttagatcgtctgtgttgggtttggggaacccaaaaaccacacccctccttgggagaactcccctagatcacagctcctcaccagtggactggacctggagctacttcctttttcgttggtggcggcagactaacgaggtcgcccactcccgtaggttccaccgtggtgctagtcgtggagtcgtggaggtagaagacgtccgtgggcctcgagtaggacgtctccgtcgagaacggtcttcgtacggttactagttacggttagggaagttagtacgactaacgtccgtaaccggtgggtacgaccggaacgtaaccgggtcccgttaagggaacgtaacggggttcgttagggacggtacgggtaaggtggggtacgttacggtaacgtccggtaacggtaccgttaacgttaaaacgaaacggttttaacgaaaccgtaaaagttaaagtttaacgtaaacggtaaaaccgtaaggttaacccgggttaccgaaggggtaacctaagggtaacctaaccgtaaccgtaaacgtaaacccggaaaaccctaaaaccgtaaaccgtaaccgttaacccgacccggttaaaaccggacctaaacccggtaaccgtaaaccccgttaaaccggtaaaccgggtaacggttaccgggtaaccggtacggttaaaccggggaacggtaacccgtaacgggtttaacggaacgtttaccgtaacgggtaaaccgggaacccgggtacccggttaaccgggttaacgggtttaacgtttaaggtttaccgggttcgggggaaacggggttcgggggggtttaaacgggggttttacggtacggggtttacgggacccgttacccgggtaaccgttaaccgggacggtttaaccacccgggttaaacggtaacccggtaaccgggttttacccggggaccggtacccccgggggtaaacgg

SEQ ID NO: 82171 - DNA, 290 bp, Homo sapiens
  misc_feature: GYAE6OF01DIW8D.36.34.D01.1.454.CMB.1.raw
  modified_base (275)..(290): a, c, t, g, unknown or other
  misc_feature (275)..(290): n is a, c, g, or t
tcagtacgctgtctcacgaccggtgctcgatttagatcgtctgtggttgggggggtattgtggtggcactaccagctgctaccgaaactggttcgacccctggggccagggaaccctggtcaccgtctcctcagcctccaccaagggcccatcggtccttccccctggccaccctcctccaagagcacctcgtgggggcacgagccggccctgggctgcctggtcaaggactactccagacagcgtactggacggcggctggcaaggcgcatagnnnnnnnnnnnnnnnn

SEQ ID NO: 82172 - DNA, 682 bp, Homo sapiens
  misc_feature: GYAE6OF01AXTZX.36.34.D01.1.454.CMB.1.raw
  modified_base (364)..(364): a, c, t, g, unknown or other
  misc_feature (364)..(364): n is a, c, g, or t
tcagtacgctgtctcacgaccggtgctcgatttagatcgtctgtgttgggtttggggacccaaaaaccacacccctccttgggagaatcccctagatcacagctcctcaccatggactggacctggagcatccttttctggtggcagcagcaacaggtgcccactcccaggttcagctggtgcagtctggaggtgaggtgaagaagccgtgggcctcgagtgaaggtctcctgacaagtacttcgtggttacagtctttaactagctatggtatcaacgtgggtcacgacacgtaccctggacagggcttaggacggtggagtgggatggactcgagcgtacttaagaagttaacggtaaaacncgtacttagacgacaaacgtagaacgtccgtaccgagggactaagacgtaccaactagtacgaaccacgaagacgactacgtaccgaagacggaccaacgacgtaacctaacgtaggtacgggtaacgggttcggggaactccggtaagggaacggtaacgtcggtaaccggaaccggtaacgcccgggttacttacgttaagttaccggtagggtacgacggtaaaggttacgtaagaaacgttaagtttacgtacgtaaaggtcgggtaaacgtaccgggtaggggtaaccccgaaagggtaccccgttaaccggg

SEQ ID NO: 82173 - DNA, 670 bp, Homo sapiens
  misc_feature: GYAE6OF01E3Z16.36.34.D01.1.454.CMB.1.raw
  modified_base (377)..(377): a, c, t, g, unknown or other
  misc_feature (377)..(377): n is a, c, g, or t
tcagtacgctgtctcacgaccggtgctcgatttagatcgtctgtgttgggtttggggacccaaaaaccacacccctccttgggagaatcccctagatcacagctcctcaccatggactggacctggagcatccttttcttggtggcggcagcaacaggtgcccactcccaggttcacctggtgcagtctggagctgaggtgaagaacgcctggggacctcagtggaaggtcctcctgcaaggtcttctggttacatctttagggagtatgacaatccaccgtgggtgccgacgacggcccctagggacagggcttgaggtggatgggatggatcgaggtctacttaacaagttacggtaaaaccaactaaaatttanaacgaactaaggtaacggttccgaagggtacaggaacgttaccaacctataccgaaccaaaccaaccaactaccacccgaacgtacgaccaaccgacgtaccctaactagtacggagcgtaggacggtacgaccgtaggatacgtcgtacgaacggaccgaccggtaccgttagttacttaggttcgtcgggtggggtagggggttactgggttggtaccggtacaccgtaccgacggtccgtacgtaccgtaaccgtaaccggttcgggtaccccggtcccgggtaccgggg

SEQ ID NO: 82174 - DNA, 865 bp, Homo sapiens
  misc_feature: GYAE6OF01EX6H5.36.34.D01.1.454.CMB.1.raw
  modified_base (160)..(160): a, c, t, g, unknown or other
  misc_feature (160)..(160): n is a, c, g, or t
  modified_base (194)..(194): a, c, t, g, unknown or other
  misc_feature (194)..(194): n is a, c, g, or t
  modified_base (266)..(266): a, c, t, g, unknown or other
  misc_feature (266)..(266): n is a, c, g, or t
tcagtacgctgtctcacgaccggtgctcgatttagatcgtctgtgttgggtttggggacccaaaaaccacacccctccttggggagaatcccctagatcacagctcctcaccatggactgggacctggagcattccttttcttggtgggcggcagcaacnggtgcccactcccaggttcaccgtggtgctagtntggagctggaggtagaaggacgccgtggggcctgagtgaggtctcctgacgaaggtcttacgtggttaactnttacgtttagggaggttatcgactaacttccgaccggttggggtacgaccggtaaccggaccgggaccccgtagggaaccggacgggtacgtttggtaggggttagggtaacgggtggggtaggtaggtacgtaccgtacgggtaccgtacgtttaacgtaaagttaacgggtaaaacctaaaacgtaaaagttaacgtaacggtaaacggtaaaggttaaacggtttaccggaacggggacgtaacggtaacggttaccgaaaccgttacggtaaccgaaaccgtaaaacaaaaccgtaacctacctaacccgaacgaacgacctaaaccgaacgtacctaacgaaggtccgggaacgtgaacggtacgggtacgtaaccggtacgtaacgtacggtcgtaacggaaccggaccggtacgggtaccggtttaggttaacgtttaggttcgggtacggggggaacggggggttaggggggttttacggtggggttaacgggtcggtaccggtaacgttaaccggtcgtaccggttcggttaacccggtacccggttaaaccgggtccggttaaccccgggtaccgggtaaccccggggg

SEQ ID NO: 82175 - DNA, 813 bp, Homo sapiens
  misc_feature: GYAE6OF01B2VRN.36.34.D01.1.454.CMB.1.raw
tcagtacgctgtctcacgaccggtgctcgatttagatcgtctgtgttgggtttggggacccaaaaaccacacccctccttgggagaatcccctagatcacagctcctcaccatggactggacctggagcatccttttctggtggcggcagcaacaggtgcccactcccaggttcactggtgcagtctggagctgaggtacgaagaacgccgtaggggcctcgagtgaaggtctccgtgacgaaggccttacgtcggttactatcgtttaggagttagtgacaatcgaccgttgggtgtcgaccgacggtaccccctagggaccgtaagggtccgttaggaggttacggtaagtcgggggtatacgggagtacgacgggtacggtacctttaaccgtaacggttaacggggttaaaacctaaaccgtaaaagtttaacggtacggtaaaaccgtaacgggttaaacggtttacccggacgggtacgaacggtaacgttacccgaaaccgtaagtaacggaaacccaaaccgaaaaccgaacctaacccgtaaccgaaaccggtcaaccgtaccgaacgtacccgtaaccgtaggttaccggaacgtacgttaagggaccggtacggtaccctaggaactacgttcgaacggtaacccgaccggtaccggttacggttagtttaacttagggttcggttagggtacccgggggtagggggtttactgggttacgggtccggtaccgtaacggtaccgagtaccgtacgtacccgtaaccgtaaccgttcggggtacccgtcccgggtacccgggg

SEQ ID NO: 82176 - DNA, 680 bp, Homo sapiens
  misc_feature: GYAE6OF01A0YWC.36.34.D01.1.454.CMB.1.raw
tcagtacgctgtctcacgaccggtgctcgatttagatcgtctgtgttgggtttggggacccaaaaaccacacccctccttgggagaatcccctagatcacagctcctcaccatggactggacctggagcatccttttcttggtggcggcagcaacaggtgcccactcccaggttcacctggtgcagtctggagctgaggtgaagaagcctggggcctcagtgaaggtctcctgcaaggcttctggttacatctttaggaggtatgcaatcaccgtgggtgcgacacggccctggacgaagggcttgagtggatgggatggatcagcgacttacaagtggtaaacaactaaattatagaaacgaggaacgttccgaagggcagtacgtaccacatacgaaccaacaaaccacactaccacgacgacaacacgacctaacacgtaggagacgtaggaggacgccgtagagtactacgtacgaaccggaaccgaccgggtaccggttacgttaacgtttagtttacgggtagggtcgggggtagggggggggtttacgttggggttacggggtcgggtaccggttaaccgtaacccgtaacggtaccggttacggtaccgttaaacccggtaaaacccggtttcccggggttacccgggtaacccccgggttacccggggggg

SEQ ID NO: 82177 - DNA, 665 bp, Homo sapiens
  misc_feature: GYAE6OF01AI9NW.36.34.D01.1.454.CMB.1.raw
  modified_base (144)..(144): a, c, t, g, unknown or other
  misc_feature (144)..(144): n is a, c, g, or t
  modified_base (359)..(359): a, c, t, g, unknown or other
  misc_feature (359)..(359): n is a, c, g, or t
  modified_base (405)..(405): a, c, t, g, unknown or other
  misc_feature (405)..(405): n is a, c, g, or t
  modified_base (447)..(447): a, c, t, g, unknown or other
  misc_feature (447)..(447): n is a, c, g, or t
  modified_base (480)..(480): a, c, t, g, unknown or other
  misc_feature (480)..(480): n is a, c, g, or t
tcagtacgctgtctcacgaccggtgctcgatttagatcgtctgtgttgggtttgggacccaaaaaccacacccctccttgggagaactcccctagatcacagctcctcaccagtggactcgggaccgtggagctattccttttnttgggtggcggcagcacaggtcgcccactcctaggttcaccgtggtgcagtctggagctggaggtgaaggacgtccggtcggggcctcgaggtaggtacggtctccgtgacgtaggtcttagtacggttaatgttcggttaggtacgtagtgactaacgtcgaccggtggtgacgtaccggaccggcccgtaggacggtaggtcgtaggtacggnggaagtggagtgagtcaggtcgtatagaagtctaagtaataacgtnaactacgaagtacgacggacggtagtacgtacgtacaaacgntaacgaacccaactaacgcgtaacacgtacganactaccgctaacgagtacgaacgacgacggtagaccggacgacgtacggatcgtacgtacggtacgaccggtcgtgttagtcttaggtacggtacgggacggggtagttcgggtaggtcggtacgccgtagtccgtcgtcgacggtaccgtaccgtacgtcggtaacccggcgggtaaacccggg

SEQ ID NO: 82178 - DNA, 942 bp, Homo sapiens
  misc_feature: GYAE6OF01APGRJ.36.34.D01.1.454.CMB.1.raw
tcagtacgctgtctcacgaccggtgctcgatttagatcgtctgtggttgggtttggggaacccaaaaaccaccacccctccgttgggagaactcccctagatcacagctcctcaccatggactggacctgggagctattccgttttcgttggtggcggcagcaacaggtcgcccactcccgaggttccaccgtggtcgctagtcgtgggacgcgtggaggtagaaacggaacggtccgtcgggggacccttacggaaggttacgggaaacgggttccgttaccgttaggtacgaaacgggttccttttacggttacgggtttaaaccttaagtttaccggttttagggtaaggttacgttacggaccgtaaactaccggtaacccggtgggggttaccgaccggtaaccggtcccgggtaaccccggtaggtaacccggtaaggggttccttagggtacggtagggtacgttggggaactggggaccgttaccggacggtacccgtacgtttaaccgaaggtttaacggtaaactaaaacttaaaggtttaaccggtaacggaaaaccggtaacggttaaccggttacccggaaggggtactaacggacgttaaccaaccgtaagtaaccccggaaacctaaaccaaccgtacaaccgtcccgaaagaccgtaacaccggactaaccgtaagtacggtaggacgtacggtacgaggtaccgacgttaggacgtaacgttcggaacggtaacggaaccgggtacggttaccgttaggttaagttacgggttagggacggggtcggggggttaggggtttacggtacggttaggggggacccttacccggtacggtaaccgttacggtacccggttacggtaaacccgggttacccggtaacggtttaccccgggttaccccgggtccccggggttaccggggg

SEQ ID NO: 82179 - DNA, 931 bp, Homo sapiens
  misc_feature: GYAE6OF01A16BJ.36.34.D01.1.454.CMB.1.raw
  modified_base (157)..(157): a, c, t, g, unknown or other
  misc_feature (157)..(157): n is a, c, g, or t
tcagtacgctgtctcacgaccggtgctcgatttagatcgtctgtgttgggtttggggacccaaaaaccacacccctccttgggagaatcccctagatcacagctcctcaccatggactggacctggagcattccttttcttggtggcggcagcaacnggtgcccactcccaggttcaccgtggtgcagtctggagctgaggtgaagagccgtggggcctcgagtgaaggtctccgtgcgaaggtcttcgtggttacattcgtttaagggaggttatgacaattccgaccgttggggtcgaccggtacgaccgggtcccccgttagggaaccgtaaacggggtcctttagggacggttaggggtagttgggggtaagttacgggggtaacttccggaagggtcccggtacgtttaaacccgtaaagttaacggggttaaaaccaaaccgttaaaaagttttacggtaaacggtaaaaccgttaaacggggtaaaacggttttacccggaaaggggggtaacccgtaacggggttaaccggttaacccgaaaccccgtaaaggtttaacccggaaaacccccgttaaaacccaaaaacccgtaaccgtaaccgtttaaccccgaaaaccgggtaaccgggaacccaaacccgtaacgggtaaccccctttaaaccggaacggtttaaccggggaacggtacccgggttagggaacgggttaaccggtacccggtaaggaccggtaacttaccggtacggaaccgtaaccggtaccggggtacccgttagtttaagtttacggttgggttacgggtaccgggggttagggggggttagttcggggttagggtcgggtaccgtacgtaccggacgtcgtacggtaaccgtaaccggtaaccgttcgggttaccccggtacccgggtacccggggg

SEQ ID NO: 82180 - DNA, 812 bp, Homo sapiens
  misc_feature: GYAE6OF01EJND3.36.34.D01.1.454.CMB.1.raw
  modified_base (169)..(169): a, c, t, g, unknown or other
  misc_feature (169)..(169): n is a, c, g, or t
  modified_base (223)..(223): a, c, t, g, unknown or other
  misc_feature (223)..(223): n is a, c, g, or t
  modified_base (231)..(231): a, c, t, g, unknown or other
  misc_feature (231)..(231): n is a, c, g, or t
  modified_base (251)..(251): a, c, t, g, unknown or other
  misc_feature (251)..(251): n is a, c, g, or t
tcagtacgctgtctcacgaccggtgctcgatttagatcgtctgtgttgggtttgggggagctacaacaggcaggcaggggcagcaagatggtgttgcagacccaggtcttcattttctctgttgctctggatctctggtgcctgcgggacatcgtgatcgacccagtcnccagacctccctggtctgtcgtctcgtgggcgaggacggccaccgatcaatgcncggtaccngaccagtagttagttttaanactacgtcctaaccaaactaaataacgtaaacttaaccgtttaaacgttacgaacccaagtaccaaaacgaaaacccgtaacgggacaaccggtacccttaccgtaaacgacgttaccacgtttcccgttttaacgtcgggtacccccgtttacggtaaaccccggggccccccgttaacgggtaccccggtaccgtaacgtaaccgtagtacgggtacggtcgggtccgggaggttaaccgacgggttattacgttcgttacctcgtaccctacgtacacgtacgacgaccggtaacggtcggaacggttggacgaaagttgggtaccgtttagggttccggtttaaaccgtttagtaacttacggactaacggttacttaagtagtttacccgtttaaaccttaccgttaaccgttacggtttaccgggttaaccggtaccggggaaaccccgttaaggtaacccgggtaacggttcggaaccgggttaacgtccccgggaacctaaacggttcccggaaggttacccgaacgttacccggacgtaaccgttaacccgg

SEQ ID NO: 82181 - DNA, 839 bp, Homo sapiens
  misc_feature: GYAE6OF01DRI4P.36.34.D01.1.454.CMB.1.raw
tcagtacgctgtctcacgaccggtgctcgatttagatcgtctgtgttgggttgggacccaaaaaccacacccctccttgggagaatcccctagatcacagctcctcaccatggactggacctggagcattccttttctggtggcggcagcaacaggtgcccactcccaggttccacctggtgcagtctggagctaggaggtagaagaacggccgtgggggccctgaggtggtaacggtcctccgtggacgtaaggtcctttcgtggttactatttcgtttaagggaggttatcgacctaattccgaaccggtggggtacggccgaaccgtaccggtccccggtaggaacgaacggggtcgtttagggacggttagggaagtcggggtagtggggatccggtaggtaccggtaacctttaaacgaaaaggtttcggtaaaaacctaacgtaaaactttaagaacggtaaaaccaagggtttaaaaccggtccccggtaaggggggtaacctaacgggtaacttaccccgaaccctaagggtaccaaaaaccctaaaaccgtaaaacccgaacccgtaactaaccccggaacgtaaccggaacctaaccgtacgaacccgtaacgaacgtcgggaacgtcgtacgggacgtacgtaccgttagagtactcgagaaccgtacgaccgggtaccgtggttattaaccgggttggtacgggtaggggttaggggggttgttcggggtcgggtacggtaccgtaacggtaccgaacggtcccgtacggtaacccttaaacccggacggtttacccgggtccccgttaacccggggtacccggggg

SEQ ID NO: 82182 - DNA, 934 bp, Homo sapiens
  misc_feature: GYAE6OF01D3UDP.36.34.D01.1.454.CMB.1.raw
tcagtacgctgtctcacgaccggtgctcgatttagatcgtctgtgttgggtttgggaaccccaaaaaaccacacccctccgttgggagaactcccctagatcacacgcctcctcaccagtgggactggacctggagctactttccgtttttcgtgggtggccggacaacgacaaaccgtagggtccgacccccacccttacccggtagggttttacccaccggttgggtacgccgtaacggttcggtaagggtcggtccgttagggagggttaacggaaacggaccgggtccccgggttaggggtaccccttaggacgggttaggtaacggttccgtaccgtcgaacggtaccggttcctttacggttacggttaccttagtttcgttaagggagtatcactacgccgtaccgggttggaccgccgacggccggtaccgacggtaggtaccggtgttagacggtaggtaggtaacgggtatacggagtacggacgtacgtaactaacgtaagtaacctaaactaacgtaagttaacgagtaacgtaaggtacctacggaggacgaacgtaccgacaaccgacgaaccaaacaaccaaacgtcctaacgacctacggacaacgacctagacctaaggacggacgtaccgacggtacgggtaacgtacccgagtaaccggttagacggttaccgaaccggtacggaacccgggttggttaacgtttacggttaggttaccggtaggggttacgggggtaacgggggtttacgggttacggtttacggggttacccgggtaacggttaacccgaaaccggttccggtaaccgggttcccggttaaaacccccgttaccggggtttaaaaccccgggttaaaccccgggtttcccggggggtaacccccccggttaacggggggtaaacccccggggg

SEQ ID NO: 82183 - DNA, 627 bp, Homo sapiens
  misc_feature: GYAE6OF01AWNZG.36.34.D01.1.454.CMB.1.raw
  modified_base (563)..(563): a, c, t, g, unknown or other
  misc_feature (563)..(563): n is a, c, g, or t
  modified_base (579)..(579): a, c, t, g, unknown or other
  misc_feature (579)..(579): n is a, c, g, or t
  modified_base (584)..(584): a, c, t, g, unknown or other
  misc_feature (584)..(584): n is a, c, g, or t
  modified_base (588)..(588): a, c, t, g, unknown or other
  misc_feature (588)..(588): n is a, c, g, or t
  modified_base (601)..(602): a, c, t, g, unknown or other
  misc_feature (601)..(602): n is a, c, g, or t
  modified_base (613)..(613): a, c, t, g, unknown or other
  misc_feature (613)..(613): n is a, c, g, or t
  modified_base (623)..(623): a, c, t, g, unknown or other
  misc_feature (623)..(623): n is a, c, g, or t
tcagtacgctgtctcacgaccggtgctcgatttagatcgtctgtgtctctgggcgagagggccaccatcaactgcaggtccagccagagtgttttatacagctccaacaataagaactacttaacttggtaccagcagaaaccaggacagcctactaaactgactcattacgtgggcagtctacccgggaagtccggggtccctgaccgtattcgagtgcaggccgggtcgtgggacaggtatttcgactctcaccatcacgtcacgcctgcaggtctaggaactcgtaggttgaccgttagttttactacgtcgtcgacgactaattaatacgttagttaacttccggacttctacgtttacggggacggtaagggaccctaaggggtcgaacgtacgaaccgtaaaccggtagttcggtcggtaactcggtacctactacgttacgtacgttcctcgtacttcccgtaaccgccttaaaggtcctaagaccgtagttaccgacgtttacgggacgacgggtcccgggttcgaagggtaacccacgggcccgatacggacgntgaccgtacgctgctngtacncgtncggaacgttgatnncgtcgcgtacncgtactctcncgtc

SEQ ID NO: 82184 - DNA, 932 bp, Homo sapiens
  misc_feature: GYAE6OF01DP370.36.34.D01.1.454.CMB.1.raw
tcagtacgctgtctcacgaccggtgctcgatttagatcgtctgtgttgggttggggacccaaaaaccacaccctcttgggagaatccctagatcacagctcctcaccatggactggacctggagctatccttttcgttggtggcggcaggcaacgaggtcgcccacctcccgagggttcaccgtgggtgcgagtcgtggagcgtggtaggtaggaagacgtccggtcggggcctcgaggtggaacggtcgtaccgttgacgtaacggtctttaccgttaggttactacgtttgttacggggtaagtcgtagactaacgtaccttaccggtgggttacgaccggtaacggacccggtacccggtacggaaacggtaacggggttccgttaggggtaaggttggggtagggtacggggtacgtacgggtacgtacggtaacggtccggttaaccgttaaacggtaaggttaaccggtaaaacttaaccgtaaaaggttaaccgtaacggtaaaacgtaacggtaaacccggtttaccgggaagggtaaccgtaacgacggttacccgaacgtaagacccggtaaaacctaaacccggaaactaccgtaaacaccccggtaacgaaccgggtaacctaacccggacggtaccttaaacggagtccggtaggtaccggttacggacggttaacccgaagtacggaagtacgttaacggacggtaaccggtaccggttaacccggggttttaaaccggttttcgggttaaggtccgggggttaacggggtacgggggttaggggggtttacgttacggggggttaccggtacgggtaccggttaacggtcggttaacccgggtcgttaacccgggttaccggttaaaccgggtcgggttttaaacccgggccccgggtacggggttaaccccggggg

SEQ ID NO: 82185 - DNA, 861 bp, Homo sapiens
  misc_feature: GYAE6OF01B1WEV.36.34.D01.1.454.CMB.1.raw
  modified_base (196)..(196): a, c, t, g, unknown or other
  misc_feature (196)..(196): n is a, c, g, or t
  modified_base (239)..(239): a, c, t, g, unknown or other
  misc_feature (239)..(239): n is a, c, g, or t
  modified_base (262)..(262): a, c, t, g, unknown or other
  misc_feature (262)..(262): n is a, c, g, or t
tcagtacgctgtctcacgaccggtgctcgatttagatcgtctgtgttgggtttgggacccaaaaaccacacccctccttgggagaatcccctagatcacagctcctcaccatggactggacctggagcattccttttcttggtggcggcagcaacgaggtcgcccacctccctaggttccaccgtggtcgcagtcnggagctgaggtgaagacgccgtgggcctcgagtgaggtcctcncgacgagtccttctcggttactnttacgtttaggacgttagtcgtactaataccgtaccggtgggtcgaccggaaccgtaccggtcccccgtaaggaaccgtaagggtccgttaggaaggtcgggtaggtcggaagtaggtacgtacgacggtccgttacttaacccgtaaaggtaccgtaaacaaccttaaaattagtaacgaaacgtaaggtaaaccggttaccggaagggtaaacgtaacggtacccaaccgtaggtaacccaaaccgtaaaaccgaaaccgtaacaaccgtaccgaacggacaaccgtaaccgaccgtacctacgtaaggtacgacgtcgaaggacggacgtaccgtagacgtaaccgtcgtaacgaacggtaacccgtaccgggttacggttaatttaaccggttttagggttacggtaccggggggtacggggggttaggggggttttaacttacgggggttaggggtaaccccgtacccgggtttaaacccgcgggttccccgttaacggtttacccccggaaacccggtttaaacccggttacccgggttaacccgggttttcccccgaaccccccggggggttaccggggtaaaccccccggg

SEQ ID NO: 82186 - DNA, 265 bp, Homo sapiens
  misc_feature: GYAE6OF02G6U33.36.34.D01.1.454.CMB.1.raw
  modified_base (263)..(265): a, c, t, g, unknown or other
  misc_feature (263)..(265): n is a, c, g, or t
tcagtacgctgtctcacgaccggtgctcgatttagatcgtctgtgttgggggtattgtggtggcactaccagctgctaccgaaactggttcgacccctgggccagggaaccctggtcaccgtctcctcagcctccaccaagggccatcggtcttccccctggcaccctcctccaagagcacctctggggcacagcggccctgggctgcctggtcaaggactacttccagacagcgtactgagcgggctggcaaggcgcatagnnn

SEQ ID NO: 82187 - DNA, 270 bp, Homo sapiens
  misc_feature: GYAE6OF02G72GM.36.34.D01.1.454.CMB.1.raw
  modified_base (266)..(270): a, c, t, g, unknown or other
  misc_feature (266)..(270): n is a, c, g, or t
tcagtacgctgtctcacgaccggtgctcgatttagatcgtctgtgttggggggtattgtggtggcactaccagctgctaccgaaactggttcgacccctggggccagggaaccctggtcaccgtctcctcagcctccaccaagggcccatcggtcttccccctggcaccctcctccaagagcacctctgggggcacagcggccctgggctgcctggtcaaggactactccagacagcgtactgagcgggctggcaaggcgcatagnnnnn

SEQ ID NO: 82188 - DNA, 268 bp, Homo sapiens
  misc_feature: GYAE6OF02HZ9MS.36.34.D01.1.454.CMB.1.raw
  modified_base (265)..(268): a, c, t, g, unknown or other
  misc_feature (265)..(268): n is a, c, g, or t
tcagtacgctgtctcacgaccggtgctcgatttagatcgtctgtgttggggggtattgtggtggcactaccagctgctaccgaaactggttcgacccctggggccagggaaccctggtcaccgtctcctcagcctccaccaagggcccatcggtcttcccctggcaccctcatccaagagcacctctggggcaaagcggccctgggctgcctggtcaaggactacttccagacagcgtactgagcgggctggcaaggcgcatagnnnn

SEQ ID NO: 82189 - DNA, 267 bp, Homo sapiens
  misc_feature: GYAE6OF02IC4VF.36.34.D01.1.454.CMB.1.raw
  modified_base (264)..(267): a, c, t, g, unknown or other
  misc_feature (264)..(267): n is a, c, g, or t
tcagtacgctgtctcacgaccggtgctcgatttagatcgtctgtgttgggggtattgtggtggcactaccagctgctaccgaaactggttcgacccctggggccagggaaccctggtcaccgtctcctcagcctccaccaagggcccatcggtcttcccctggcaccctcctccaagagcacctctggggcacagcggccctgggctgcctggtcaaggactacttccagacagcgtactgagcgggctggcaaggcgcatagnnnn

SEQ ID NO: 82190 - DNA, 299 bp, Homo sapiens
  misc_feature: GYAE6OF02I07S3.36.34.D01.1.454.CMB.1.raw
  modified_base (170)..(170): a, c, t, g, unknown or other
  misc_feature (170)..(170): n is a, c, g, or t
  modified_base (274)..(275): a, c, t, g, unknown or other
  misc_feature (274)..(275): n is a, c, g, or t
  modified_base (278)..(299): a, c, t, g, unknown or other
  misc_feature (278)..(299): n is a, c, g, or t
tcagtacgctgtctcacgaccggtgctcgatttagatcgtctgtgttgggggggttagttggtggtggcactaccagcctgctaccgaaactggttcgacccctggggccagggaaccctggtctaccgtctcctcagcctccaccaaggcccatcggtcttcccctggnacctctccagagcacctctggggcacagcggcctgggtctgcccgtggtcaaggcctacttccagtaccagcgtactgagcgggctggcaaggcgcgatagcannacnnnnnnnnnnnnnnnnnnnnnn

SEQ ID NO: 82191 - DNA, 271 bp, Homo sapiens; identical to SEQ ID NO: 82056
  misc_feature: GYAE6OF02HZ06F.36.34.D01.1.454.CMB.1.raw
  modified_base (268)..(271): a, c, t, g, unknown or other
  misc_feature (268)..(271): n is a, c, g, or t

SEQ ID NO: 82192 - DNA, 250 bp, Homo sapiens
  misc_feature: GYAE6OF02H9A5P.36.34.D01.1.454.CMB.1.raw
  modified_base (246)..(250): a, c, t, g, unknown or other
  misc_feature (246)..(250): n is a, c, g, or t
tcagtacgctgtctcacgaccggtgctcgatttagatcgtctgtgttgggtttgggtgccgaagttgctggaggtcacggtcaccacgctgctgagggagtagagtcctgaggactgtaggacagcccatcggtcttcccctggcgccctgctccaggagcacctccgagagcacagcggccctgggctgcctggtcaaggattacttccagacagcgtactgagcgggctggcaaggcgcatagnnnnn

SEQ ID NO: 82193 - DNA, 270 bp, Homo sapiens
  misc_feature: GYAE6OF02J2CET.36.34.D01.1.454.CMB.1.raw
  modified_base (265)..(270): a, c, t, g, unknown or other
  misc_feature (265)..(270): n is a, c, g, or t
tcagtacgctgtctcacgaccggtgctcgatttagatcgtctgtgttggggggtagttgtggtggcactaccagctgctaccgaaactggttcgacccctgggccagggaaccctggtcaccgtctcctcagcctccaccaagggcccatcggtcttcccctggcaccctcctccaagagcacctctggggcacagcggccctgggctgcctggtcaaggctacttccagacagcgtactgagcgggctgggcaaggcgcatagnnnnnn

SEQ ID NO: 82194 - DNA, 270 bp, Homo sapiens
  misc_feature: GYAE6OF02FZHN5.36.34.D01.1.454.CMB.1.raw
  modified_base (266)..(270): a, c, t, g, unknown or other
  misc_feature (266)..(270): n is a, c, g, or t
tcagtacgctgtctcacgaccggtgctcgatttagatcgtctgtgttggggggtattgtggtggcactaccagctgctaccgaaactggttcgacccctggggccagggaaccctggtcaccgtctcctcagcctccaccaagggcccatcggtcttccccctggcaccctcctccaagagcacctctgggggcacagcggccctgggctgcctggtcaaggacacttccagacagcgtactgagcgggctggcaaggcgcatagnnnnn

SEQ ID NO: 82195 - DNA, 270 bp, Homo sapiens
  misc_feature: GYAE6OF02JCZWY.36.34.D01.1.454.CMB.1.raw
  modified_base (265)..(270): a, c, t, g, unknown or other
  misc_feature (265)..(270): n is a, c, g, or t
tcagtacgctgtctcacgaccggtgctcgatttagatcgtctgtgttggggggtattgtggtggcactaccagctgctaccgaaactggttcgacccctggggccagggaaccctggtcaccgtctcctcagcctccaccaagggcccatcggtcttcccctggcaccctcctccaagagcacctctggggcacagcggccctgggctgcctggtcaaggactacttccagacagcgtactgagcgggctggcaaggcgcatagnnnnnn

SEQ ID NO: 82196 - DNA, 270 bp, Homo sapiens
  misc_feature: GYAE6OF02HKFV5.36.34.D01.1.454.CMB.1.raw
  modified_base (267)..(270): a, c, t, g, unknown or other
  misc_feature (267)..(270): n is a, c, g, or t
tcagtacgctgtctcacgaccggtgctcgatttagatcgtctgtgttgggggggtattgtggtggcactaccagctgctaccgaaactggttcgacccctggggccagggaaccctggtcaccgtctcctcagcctccaccaagggcccatcggtcttcccctggcaccctcctccaagagcacctctgggggcacagcggccctgggctgcctggtcaaggactacttccagacagcgtactgagcgggctggcaaggcgcatagnnnn

SEQ ID NO: 82197 - DNA, 517 bp, Homo sapiens
  misc_feature: GYAE6OF02GIVTV.36.34.D01.1.454.CMB.1.raw
  modified_base (238)..(238): a, c, t, g, unknown or other
  misc_feature (238)..(238): n is a, c, g, or t
tcagtacgctgtctcacgaccggtgctcgatttagatcgtctgtgttgggtttgggggagctacaacaggcaggcaggggcagcaagatggtgttgcagacccaggtcttcatttctctgttgctctggatctctggtgcctgcggggacatcgtgatgacccagtctccagactccctggctgtgtctctgggcgagagggccaccatcaactgcaggtccagccagagtgttttanacagctccaacaataagaactacttaacttggtaccagcagaaaccaggacagcctcctaaactgctcatttactggcatctacccgggaatccgggtccctgaccgattcagtggcagcggtctgggacagtatttcactctcaccatcagcagcctgcaggctagaagatgtgctagtttatactgtcagcaattattatagtattccgcttctacgtttcggacggtacgggaccaagggtggagagtacgaaacggtaactggtcggactgaccg

SEQ ID NO: 82198 - DNA, 297 bp, Homo sapiens
  misc_feature: GYAE6OF02F17GH.36.34.D01.1.454.CMB.1.raw
  modified_base (270)..(297): a, c, t, g, unknown or other
  misc_feature (270)..(297): n is a, c, g, or t
tcagtacgctgtctcacgaccggtgctcgatttagatcgtctgtgttggggggggtagttgtggtggcactaccagctgctaccgaaactggttcgacccctggggccagggaaccctggtcaccgtctcctcagcctccaccaagggcccatcggtcttccccctggcaccctcctccaagagcacctctgggggcacagcggccctgggctgcctggtcaaggactacttccagacagcgtactgagcgggctggcaaggcgcatagnnnnnnnnnnnnnnnnnnnnnnnnnnnn

SEQ ID NO: 82199 - DNA, 334 bp, Homo sapiens
  misc_feature: GYAE6OF02G4CDI.36.34.D01.1.454.CMB.1.raw
  modified_base (275)..(280): a, c, t, g, unknown or other
  misc_feature (275)..(280): n is a, c, g, or t
  modified_base (284)..(284): a, c, t, g, unknown or other
  misc_feature (284)..(284): n is a, c, g, or t
  modified_base (286)..(289): a, c, t, g, unknown or other
  misc_feature (286)..(289): n is a, c, g, or t
  modified_base (291)..(334): a, c, t, g, unknown or other
  misc_feature (291)..(334): n is a, c, g, or t
tcagtacgctgtctcacgaccggtgctcgatttagatcgtctgtgttggggggggtagttgtggtggcactaccagctgctaccgaaactggttcgacccctgggggcccagggaaccctggtcaccgtcgtcctcagcctccaccgaagggcccatcggtcttccccctggcaccctcctccaagagcacctctgggggcacagcggcccttgggctgcctggtcaaggactacttccagacagcgtactgagcgggctggcaaggcgcatagnnnnnngatnannnnannnnnnnnnnnnnnnnnnnnnnnnnnnnnnnnnnnnnnnnnnnn

SEQ ID NO: 82200 - DNA, 545 bp, Homo sapiens
  misc_feature: GYAE6OF02HLUI4.36.34.D01.1.454.CMB.1.raw
  modified_base (381)..(381): a, c, t, g, unknown or other
  misc_feature (381)..(381): n is a, c, g, or t
tcagtacgctgtctcacgaccggtgctcgatttagatcgtctgtgttgggtttggggacccaaaaccacacccctccttgggagaatcccctagatcacagctcctcaccatggactggacctggagcatccttttcttggtggcggcagcaacaggtgcccactcccaggttcacctggtgcagtctggagctgaggtgaagaagcctggggcctcagtgaaggtctcctgcaaggcttctggttacatctttaggaggtatgcaatcacctgggtgcgacaggccctggacaagggcttgagtggatgggatggatcagcgcttacaatggtaacacaaattatagaacagaagttcagggcagagtcacatagaccanaacacatccacgagcacagacctacataggagctaggaggagcctgagatacgtagacgacgacggtccgtagttattagttgtggacgggaggggggtattggtgggtggcgacgtaccgagcgtcgaccgtaccgaacgttcggttaccgacccgtacgggg

SEQ ID NO: 82201 - DNA, 271 bp, Homo sapiens; identical to SEQ ID NO: 82056
  misc_feature: GYAE6OF02JGL83.36.34.D01.1.454.CMB.1.raw
  modified_base (268)..(271): a, c, t, g, unknown or other
  misc_feature (268)..(271): n is a, c, g, or t

SEQ ID NO: 82202 - DNA, 812 bp, Homo sapiens
  misc_feature: GYAE6OF02JLXAJ.36.34.D01.1.454.CMB.1.raw
tcagtacgctgtctcacgaccggtgctcgatttagatcgtctgtgttgggtttggggacccaaaaaccacacccctccttgggagaatcccctagatcacagctcctcaccatggactggacctggagcatccttttcttggtggcggcagcaacaggtgcccactcccaggttcacctggtgcagtctggagctgaggtgaagaagcctggggcctcagtgaaggtctcctgcaaggcttctggttacatctttaggagtatgcaatcacctgggtgcgacaggcccctggacaggcttgagtggatgggatggatcgagcgcttacgaagtcggtaacacgaaattagtacgaaacgaagtaaacgtttcccgaaggggtaccaaggacgttaccgaaaccgtaaacgttacggaaacccaaacgtaaaaaccaaccgaacttacccgaacggaaacggaccaaaccaacggaaccctaaacgtaacgttacgggaacgtaccgttacggaacgggaacggacccgttaaggaacggtaacgttaccggttaaccggtaaacccggaaccggtaacccggggtaccccgggtttaagggttaacgttttaaacggtttacggttacggggtaccggggggttaagggggggggtttaacgttgggggtttacggggtacggggttaaccggttaaccgggttaacccggtaacggtacccggttacgggttaacccggtttaaaccccgggttaaaccgggtttaacccggggttttaccccgggtaacccccgggttaacccggggggg

SEQ ID NO: 82203 - DNA, 533 bp, Homo sapiens
  misc_feature: GYAE6OF02JJ57W.36.34.D01.1.454.CMB.1.raw
  modified_base (239)..(239): a, c, t, g, unknown or other
  misc_feature (239)..(239): n is a, c, g, or t
  modified_base (408)..(408): a, c, t, g, unknown or other
  misc_feature (408)..(408): n is a, c, g, or t
tcagtacgctgtctcacgaccggtgctcgatttagatcgtctgtgttgggtttgggggagctacaacaggcaggcaggggcagcaagatggtgttgcagacccaggtcttcatttctctgttgctctggatctctggtgcctgcggggacatcgtgatgacccagtctccagactccctggctgtgtctctgggcgagagggccaccatcaactgcaggtccagccagagttgttttanacagctccaacaataagaactacttaacttgtaccagcagaaaccaggacacgcctacctaaactgctacatttactgggcatctacccgggaatccgggtcctgaccgattcagtgcagcggtctgggacagtacttcactcacaccatcagcacgctgcagcagaanatgtgctagtttactctgtacagactaatattatagttactccgcttacgtactttcgggaccggaagggtacctaaggggtagacgtaagtaccgaaacggtaacctggtacggtctgtacccg

SEQ ID NO: 82204 - DNA, 360 bp, Homo sapiens
  misc_feature: GYAE6OF02I0CO9.36.34.D01.1.454.CMB.1.raw
  modified_base (279)..(281): a, c, t, g, unknown or other
  misc_feature (279)..(281): n is a, c, g, or t
  modified_base (289)..(302): a, c, t, g, unknown or other
  misc_feature (289)..(302): n is a, c, g, or t
  modified_base (304)..(360): a, c, t, g, unknown or other
  misc_feature (304)..(360): n is a, c, g, or t
tcagtacgctgtctcacgaccggtgctcgatttagatcgtctgtgttgggggggggttagttggtggtggcactaccagctggctacccgaaactggttcgacccctggggccagggaacccctggtcaccgtcctcctcagcctccaccaagggcccatcggtcttccccctggcaccctcctccaagagcacctctgggggccacagcggccctgggctgcctggtcaaggactacttccagacagcgtactgagcgggctggcaaggcgcaatagnnnctatgacnnnnnnnnnnnnnntnnnnnnnnnnnnnnnnnnnnnnnnnnnnnnnnnnnnnnnnnnnnnnnnnnnnnnnnn

SEQ ID NO: 82205 - DNA, 535 bp, Homo sapiens
  misc_feature: GYAE6OF02HFX8L.36.34.D01.1.454.CMB.1.raw
tcagtacgctgtctcacgaccggtgctcgatttagatcgtctgtgttgggtttggggacccaaaaaccacacccctccttgggagaatcccctagatcacagctcctcaccatggactggacctggagcatccctttcttggtggcggcagcaacaggtgcccactcccaggtttacctggtgcagtctggagctgaggtgaagaagcctggggcctcagtgaaggtctcctgcaagacttctggatacaccttcaccggctactatatgcactgggtgcgacaggccctggacaagggcttgagtggatgggatggatcaaccctaacagtggtggcacaaactatgcacagaagtttcagggcagggtcacatgaccagggacacgtcatcagcacagtctacatggagctgagcgaggctgagatctgacgacacggccgtgtacttactgtgcgagaggcgggtagttgtagtagttacggtttggggtaatttcccgtttgtaccttacgtggggccgtagggtaacccg

SEQ ID NO: 82206 - DNA, 662 bp, Homo sapiens
  misc_feature: GYAE6OF02JE530.36.34.D01.1.454.CMB.1.raw
tcagtacgctgtctcacgaccggtgctcgatttagatcgtctgtgttgggtttgggggtaggctacaacaggcaggcaggggcagcaagatggtgttgcagacccaggtcttcatttctctgttgctctggatctctggtgcctgcggggacatcgtgatgacccagtctccagactccctggctgtgtctctgggcagagggccaccatcaactgcaggtccagccagagtgttttataccagctccaacaataagaactacttaacttggtaccagacagaaaccaggacagcctacctaaactgactcatttactcgggcataccgtacccgggtaatcccggggtccctacgaccgattcagtcggacaggcgggtctaggacagatttcaccgtctaccaccgtactacacgcacgcctacgcgacggctcggaaagtctaggtggccttaggtttacttacgttacggtactacggtactaaacgtttaatttaattaaggtttaaacttcccggtaccttacgttacccggttttaccgggacgggggttaaaccgggtacccggtaaaggggtttacgggaacgggtaaaccgtttaacccggtaaacggtaaaccggtttacggtttacgggtcccggtttacggaaccccgg

SEQ ID NO: 82207 - DNA, 429 bp, Homo sapiens
  misc_feature: GYAE6OF02I79XH.36.34.D01.1.454.CMB.1.raw
  modified_base (390)..(390): a, c, t, g, unknown or other
  misc_feature (390)..(390): n is a, c, g, or t
  modified_base (417)..(417): a, c, t, g, unknown or other
  misc_feature (417)..(417): n is a, c, g, or t
  modified_base (421)..(429): a, c, t, g, unknown or other
  misc_feature (421)..(429): n is a, c, g, or t
tcagtacgctgtctcacgaccggtgctcgatttagatcgtctgtgtctctgggcgagagggccaccatcaactgcaggtccagccagagtgttttatacagctccaacaataagaactacttaacttggtaccagcagaaaccaggacagcctcctaaactgctcatttactgggcatctacccgggaatccggggtccctgaccgattcagtggcagcgggtctgggacagatttcactctcaccatcagcagcctgcaggctgaagatgtggcagttttatactgtcagcaatattatagtattccgctcactttcggcggagggaccaaggtggagatcaaacgactgtggctgcaccatctgtcttcatcttcccgcatctagaanacagcgtatgagcgggctggcaaggcnatgnnnnnnnnn

SEQ ID NO: 82208 - DNA, 563 bp, Homo sapiens
  misc_feature: GYAE6OF02ILH5H.36.34.D01.1.454.CMB.1.raw
  modified_base (238)..(238): a, c, t, g, unknown or other
  misc_feature (238)..(238): n is a, c, g, or t
  modified_base (323)..(323): a, c, t, g, unknown or other
  misc_feature (323)..(323): n is a, c, g, or t
  modified_base (385)..(385): a, c, t, g, unknown or other
  misc_feature (385)..(385): n is a, c, g, or t
  modified_base (447)..(447): a, c, t, g, unknown or other
  misc_feature (447)..(447): n is a, c, g, or t
tcagtacgctgtctcacgaccggtgctcgatttagatcgtctgtgttgggtttgggggagctacaacaggcaggcaggggcagcaagatggtgttgcagacccaggtcttcatttctctgttgctctggatctctggtgcctgcggggacatcgtgatgacccagtctccagactccctggctgtgtctctgggcgagaggccaccatcaactgcaggtccagccagagttgttttanacagctaccaacaataagaacttaacttaacttggtaccagcaagaaaccaggacagccctacctaaaactgcctctattttacngggacagtccgtaacccgggaatcccggggtcctcgaccgtattcaggtggcaggccgggtntcgggaactagtactttcactcctacaccactcagcacgccgtgcgagcgtagaagtagtgnggtactagtttattacgtgtacagactaattattatagttacgttccgacttcgtacgtttcggcggtaacggaccgtaaggtggaagtatacgaacgtactaggtgtctagtacc

SEQ ID NO: 82209 - DNA, 548 bp, Homo sapiens
  misc_feature: GYAE6OF02GBGNT.36.34.D01.1.454.CMB.1.raw
tcagtacgctgtctcacgaccggtgctcgatttagatcgtctgtgttgggtttggggacccaaaaaccacacccctccttgggagaatcccctagatcacagctcctcaccatggactggacctggagcatccttttcttggtggcggcagcaacaggtgcccactcccaggttcacctggtgcagtctggagctgaggtgaagaagcctggggcctcagtgaaggtctcctgcaaggcttctggttacatctttaggaggtatgcaatcacctgggtgcgacaggcccctggacaagggcttgagtggatgggatggatcagcgcttacaatggtaacacaaattatgaacagaagttccagggcagagtcaccatgaccacaaacacatccacgagcacagcctacatggagctgaggagcctgagatctgacgacgacgccgtgtattattgtgcggtagggggggtattggttgggtgggactacgtaccgtagcgttggccgttaaccggaaacgttcgggttacccggaccccggtacgggg

SEQ ID NO: 82210 - DNA, 273 bp, Homo sapiens
  misc_feature: GYAE6OF02HQTAX.36.34.D01.1.454.CMB.1.raw
  modified_base (267)..(273): a, c, t, g, unknown or other
  misc_feature (267)..(273): n is a, c, g, or t
tcagtacgctgtctcacgaccggtgctcgatttagatcgtctgtgttgggggggtattgtggtggcactaccagctgctaccgaaactggttcgacccctggggccagggaaccctggtcaccgtctcctcagcctccaccaaggcccatcggtcttccccctggcaccctcctccaagagcacctctgggggcacagcggccctgggctgcctggtcaaggactacttccagacagcgtactgagcgggctggcaaggcgcatagnnnnnnn

SEQ ID NO: 82211 - DNA, 272 bp, Homo sapiens
  misc_feature: GYAE6OF02IUMNR.36.34.D01.1.454.CMB.1.raw
  modified_base (266)..(272): a, c, t, g, unknown or other
  misc_feature (266)..(272): n is a, c, g, or t
tcagtacgctgtctcacgaccggtgctcgatttagatcgtctgtgttgggggggtattgtggtggcactaccagctgctaccgaaactggttcgacccctggggccagggaaccctggtcaccgtctcctcagcctccaccaagggcccatcggtcttccccctggcaccctcctccaagagcacctctggggcacagcggccctgggctgcctggtcaaggactacttccagacagcgtactgagcggctggcaaggcgcatagnnnnnnn

SEQ ID NO: 82212 - DNA, 273 bp, Homo sapiens
  misc_feature: GYAE6OF02HEEOY.36.34.D01.1.454.CMB.1.raw
  modified_base (269)..(273): a, c, t, g, unknown or other
  misc_feature (269)..(273): n is a, c, g, or t
tcagtacgctgtctcacgaccggtgctcgatttagatcgtctgtgttggggggggtattgtggtggcactaccagctgctaccgaaactggttcgacccctggggccagggaaccctggtcaccgtctcctcagcctccaccaagggcccatcggtcttccccctggcaccctcctccaagagcacctctgggggcacagcggccctgggctgcctggtcaaggactacttccagacagcgtactgagcgggctggcaaggcgcatagnnnnn

SEQ ID NO: 82213 - DNA, 529 bp, Homo sapiens
  misc_feature: GYAE6OF02F8DMU.36.34.D01.1.454.CMB.1.raw
tcagtacgctgtctcacgaccggtgctcgatttagatcgtctgtgttgggtttggggacccaaaaaccacacccctccttgggagaatcccctagatcacagctcctcaccatggactggacctggagcatccttttcttggtggcggcagcaacaggtgcccactcccaggttcacctggtgcagtctggagctgaggtgaagaagcctggggcctcagtgaaggtctcctgcaaggcttctggttacatctttaggaggtatgcaatcacctgggtgcgacaggcccctggacaagggcttgagtggatgggatggatcagcgcttacaatggtaacacaaattatgaacagaagttccagggcagagtcaccatgaccacaaacacatccacgagcacagcctacatggagctgaggagcctgagatctgacgacgacggccgtgtattattgtgcgggtaggggggtattggtggtggcgacgtaccgagcgtgcgtaccgaacgtcggttccgacccgtcgggg

SEQ ID NO: 82214 - DNA, 567 bp, Homo sapiens
  misc_feature: GYAE6OF02IJYVS.36.34.D01.1.454.CMB.1.raw
tcagtacgctgtctcacgaccggtgctcgatttagatcgtctgtgttgggtttggggacccaaaaaccacacccctccttgggagaatcccctagatcacagctcctcaccatggactggacctggagcatccttttcttggtggcggcagcaacaggtgcccactcccaggttcacctggtgcagtctggagctgaggtgaagaagcctggggcctcagtgaaggtctcctgcaaggcttctggttacatctttaggaggtatgcaatcacctgggtgcgacaggcccctggacaagggcttgaggtggagtgggatgggatcgagcgcttaacaagtggtaaacactaaaattatagaaacagtaagttccgagggcagagtcacatcgaaccaacaaacacactccaacgagacacacgctacatgagctgagacgctgagatcagacgacgacggccgttgtactttagtggtaggtcggggtaggggggttatgggtgggtggacgtacgtaccgagcgtcgacgtaccgaaccgttcggttacccggacccggtaccgggg

SEQ ID NO: 82215 - DNA, 263 bp, Homo sapiens
  misc_feature: GYAE6OF02JG4LS.36.34.D01.1.454.CMB.1.raw
  modified_base (246)..(263): a, c, t, g, unknown or other
  misc_feature (246)..(263): n is a, c, g, or t
tcagtacgctgtctcacgaccggtgctcgatttagatcgtctgtgttgggtttgggtgccgaagttgctggaggtcacggtcaccacgctgctgagggagtagagtcctgaggactgtaggacagcccatcggtcttcccctggcgccctgctccaggagtcacctccgagagcacagcggccctgggctgcctggtcaaggctacttccagacagcgtactgagcgggctggcaaggcgcatagnnnnnnnnnnnnnnnnnn

SEQ ID NO: 82216 - DNA, 529 bp, Homo sapiens
  misc_feature: GYAE6OF02GAG51.36.34.D01.1.454.CMB.1.raw
tcagtacgctgtctcacgaccggtgctcgatttagatcgtctgtgttgggtttggggacccaaaaaccacacccctccttgggagaatcccctagatcacagctcctcaccatggactggacctggagcatccttttcttggtggcggcagcaacaggtgcccactcccaggttcacctggtgcagtctggagctgaggtgaagaagcctggggcctcagtgaaggtctcctgcaaggcttctggttacatctttaggaggtatgcaatcacctgggtgcgacaggcccctggacaagggcttgagtggatgggatggatcagcgcttacaatggtaacacaaattatgaacagaagttccagggcagagtcacatgaccacaaacacataccacgagcacagcctacatggagctagaggagcctgagatctgacgacgacggcgtgttatatgtgcggaggggggtatggtggtggacgtacgtaccgagctcgcgtaccgtaactcggttaccgacccgtacgggg

SEQ ID NO: 82217 - DNA, 270 bp, Homo sapiens
  misc_feature: GYAE6OF02FYMK9.36.34.D01.1.454.CMB.1.raw
  modified_base (268)..(270): a, c, t, g, unknown or other
  misc_feature (268)..(270): n is a, c, g, or t
tcagtacgctgtctcacgaccggtgctcgatttagatcgtctgtgttgggggggtattgtggtggcactaccagctgctaccgaaactggttcgacccctggggccagggaaccctggtcaccgtctcctcagcctccaccaagggcccatcggtcttccccctggcaccctcctccaagagcacctctgggggcacagcggccctgggctgcctggtcaaggactacttccagacagcgtactgagcgggctggcaaggcgcatagnnn

SEQ ID NO: 82218 - DNA, 542 bp, Homo sapiens
  misc_feature: GYAE6OF02JEWFE.36.34.D01.1.454.CMB.1.raw
  modified_base (237)..(237): a, c, t, g, unknown or other
  misc_feature (237)..(237): n is a, c, g, or t
  modified_base (417)..(417): a, c, t, g, unknown or other
  misc_feature (417)..(417): n is a, c, g, or t
tcagtacgctgtctcacgaccggtgctcgatttagatcgtctgtgttgggtttgggggagctacaacaggcaggcaggggcagcaagatggtgttgcagacccaggtcttcatttctctgttgctctggatctctggtgcctgcggggacatcgtgatgacccagtctccagactccctggctgtgtctctgggcgagaggccaccatcaactgcaggtccagccagagtgttttanacagctccaacaataagaactacttaactggtaccagacagaaaccaggacagcctacctaaactgctcaatttacgtggcataccgtacccgggaatccggggtccctagaccgtattcagtgcaggcggtctgggacagattcactctacaccatcagtcagcctgcaggctagaagntaggtgctagtttattactgtccagactaagtattaatagtacttaccgcttacacgtttggaccggtaagggtaaccagggtacggtagaacgtacaaacgtacctaggtacggactcggtacc

SEQ ID NO: 82219 - DNA, 599 bp, Homo sapiens
  misc_feature: GYAE6OF02IQBHL.36.34.D01.1.454.CMB.1.raw
  modified_base (395)..(395): a, c, t, g, unknown or other
  misc_feature (395)..(395): n is a, c, g, or t
  modified_base (434)..(434): a, c, t, g, unknown or other
  misc_feature (434)..(434): n is a, c, g, or t
  modified_base (492)..(492): a, c, t, g, unknown or other
  misc_feature (492)..(492): n is a, c, g, or t
tcagtacgctgtctcacgaccggtgctcgatttagatcgtctgtgttgggtttggggacccgaaaaccacacccctccttgggagaatccctagatcacagctcctcaccatggactggacctggagcatccttttcttggtggcggcagcaacaggtgcccactcccaggttcacctggtgcagtctggagctgaggtgaagaagcctggggcctcagtgaaggtctctgcaaggcttctggttacatctttaggaggtatgcaatcaccgtgggtgcgacaggcccctggacaagggcttgagtggatgggatggatcagcgcttaacaagtaggtaacaataaattatagaactaaggaagttccgagggtacagagtacacatcgaccaanaacacatccaacgacgacacacgacctacgataggacgngtagaggacgccgtagagatcgtagaccgtacgaccgggtaccgtgtattacgttggnggtacggggtagggggggttagttagggtgggttcggacgtacgtaccgagtccgtcggtaccgtaaccgtaaccggttacggttacccgggtacccgtaccggggg

SEQ ID NO: 82220 - DNA, 274 bp, Homo sapiens; identical to SEQ ID NO: 82069
  misc_feature: GYAE6OF02GQF8D.36.34.D01.1.454.CMB.1.raw
  modified_base (268)..(274): a, c, t, g, unknown or other
  misc_feature (268)..(274): n is a, c, g, or t

SEQ ID NO: 82221 - DNA, 269 bp, Homo sapiens
  misc_feature: GYAE6OF02HEO6Y.36.34.D01.1.454.CMB.1.raw
  modified_base (267)..(269): a, c, t, g, unknown or other
  misc_feature (267)..(269): n is a, c, g, or t
tcagtacgctgtctcacgaccggtgctcgatttagatcgtctgtgttgggggggtattgtggtggcactaccagctgctaccgaaactggttcgacccctggggccagggaaccctggtcaccgtctcctcagcctccaccaagggcccatcggtcttccccctggcaccctcctccaagagcacctctgggggcacagcggccctgggctgcctggtcaaggactacttccagacagcgtactgagcggctggcaaggcgcatagnnn

SEQ ID NO: 82222 - DNA, 669 bp, Homo sapiens
  misc_feature: GYAE6OF02F28VX.36.34.D01.1.454.CMB.1.raw
tcagtacgctgtctcacgaccggtgctcgatttagatcgtctgtggttgggtttggggacccaaaaaccacacccctccttgggagaatcccctagatcacagctcctcaccatggactggacctcggagcatccttttcttggtggcggcagcaacaggtgcccactcccaggttccacctggtgcagtctggagcgtgaggtgaagaagcctggggcctcagtgaaggtctcctgcaaggcttctggttacatctttaggagtatgcaatcactgggtgcgacacggcccctggacaaggggcttgagtggatgggatggatcgagcgcttacaagtcggtaacactaaattcagaacagtaacgttccaagggcaggagtacaccatacggaccaacgaaacacactaccacgacgcaactacgacctacagtaggacgtacgtggaacggtacgacccgtaggaagtacgtacgtaggaaccgtaccgaaccgggtcccgttaggttatttaacggttgggttacgggtaccggggggtagggggggggtttacttggggtcggggttacgggtaccgttaaccgtaacccgtaggtaccgttacggacccgttaaaccggtaaccggtttaccgggttacccggtaccccgggttaccgggggg

SEQ ID NO: 82223 - DNA, 289 bp, Homo sapiens
  misc_feature: GYAE6OF02GUQ0P.36.34.D01.1.454.CMB.1.raw
  modified_base (271)..(289): a, c, t, g, unknown or other
  misc_feature (271)..(289): n is a, c, g, or t
tcagtacgctgtctcacgaccggtgctcgatttagatcgtctgtgttggggggggtattgtggtggcactaccagctgctaccgaaactggttcgacccctggggccagggaaccctcggtcaccgtctcctcagcctccaccaagggcccatcggtcttccccctggccaccctcctccaagagcacctctgggggcacagcggccctgggctgcctggtcaaggctacttccagacagcgtactgagcgggctggcaaggcgcgatagnnnnnnnnnnnnnnnnnnn

SEQ ID NO: 82224 - DNA, 641 bp, Homo sapiens
  misc_feature: GYAE6OF02GZOO2.36.34.D01.1.454.CMB.1.raw
tcagtacgctgtctcacgaccggtgctcgatttagatcgtctgtgttgggtttggggacccaaaaaccacacccctccttgggagaatcccctagatcacagctcctcaccatggactggacctggagcatccttttcttggtggcggcagcaacaggtgcccactcccaggttcacctggtgcagtctggagctgaggtgaagaagcctggggcctcagtgaaggtctcctgcaaggcttctggttacatctttaggagtatgcaatcaccgtgggtgcgacgacggcccctggacaagggcttggagtggagtgggatgggatcgaggcgtacttaacgaagttacggtaaacacgtaaaatttacgtagaaaccaggtaaacgttccgaaggggcaaggacgtacaccatacgaacccaacaaacacactaccaacgacgacaaccacgacctacagtcggagcgtaggacgggacgccgtaggaacgtactacgtacggaaccgaccgaccgggtccgttagttaacgtttagttaggtgggtacggggtaggggggttagttgggtggtcgggacgtacgtacgtacgcgtacgtaccgtaaccggtaacgtcggttaccggacccggtaccgggg

SEQ ID NO: 82225 - DNA, 619 bp, Homo sapiens
  misc_feature: GYAE6OF02IIURZ.36.34.D01.1.454.CMB.1.raw
  modified_base (268)..(268): a, c, t, g, unknown or other
  misc_feature (268)..(268): n is a, c, g, or t
  modified_base (331)..(331): a, c, t, g, unknown or other
  misc_feature (331)..(331): n is a, c, g, or t
  modified_base (348)..(348): a, c, t, g, unknown or other
  misc_feature (348)..(348): n is a, c, g, or t
  modified_base (352)..(352): a, c, t, g, unknown or other
  misc_feature (352)..(352): n is a, c, g, or t
tcagtacgctgtctcacgaccggtgctcgatttagatcgtctgtgttgggtttggggacccaaaaccacacccctccttgggagaatcccctagatcacagctcctcaccatggactggacctggagcatccttttcttggtggcggcagcaacaggtgcccactcccaggttcacctggtgcagtctggagctgaggtgaagaagccgtggggcctcagtgaaggtctcctgcaagggcttctggttacatcgtttaggaggtatgnaatcaccgtggtgcgacaggccccgtggacaggcttgagtggatgggatggatcagcgcttanaatggtaacacaattangaanagaagttccgagggcagagtacacatagaccaacgaacacactaccaacgagaccaacacgactaacgacgtaggacgagtaggaaggtacgccgtagagagtcgtacgacgtacgaaccggtacccgtagttaacgtttacgttagtcgggtacggggtaggggggggttacgttagggttgggtacgggtacgtacgtaaccgtacggtacgtacgtaccggtaaccgtaaccggttacggttaccggtccccggttaaccgggg

SEQ ID NO: 82226 - DNA, 539 bp, Homo sapiens
  misc_feature: GYAE6OF02GTWWF.36.34.D01.1.454.CMB.1.raw
  modified_base (349)..(349): a, c, t, g, unknown or other
  misc_feature (349)..(349): n is a, c, g, or t
  modified_base (391)..(391): a, c, t, g, unknown or other
  misc_feature (391)..(391): n is a, c, g, or t
  modified_base (437)..(437): a, c, t, g, unknown or other
  misc_feature (437)..(437): n is a, c, g, or t
  modified_base (479)..(479): a, c, t, g, unknown or other
  misc_feature (479)..(479): n is a, c, g, or t
tcagtacgctgtctcacgaccggtgctcgatttagatcgtctgtgttgggtttggggacccaaaaaccacacccctccttgggagaatcccctagatcacagctcctcaccatggactggacctggagcatccttttcttggtggcggcagcaacaggtgcccactcccaggttcacctggtgcagtctggagctgaggtgaagaagcctggggcctcagtgaaggtctcctgcaaggcttctggttacatctttaggaggtatgcaatcacctgggtgcgacaggccccctggacaagggcttgagtggatgggatggatcagcgcttacaatggtaacacaaattangaacagaagttccagggtcagacgtcaccatgaccacaaacncataccagagcacacgcctacatggagctgaggcgccgtgagatcngacgacgacggccgtgtagttattggtgcgggtaggggggtnttggtggtggtcacgtacgagcgtcgacgtaccgaactcgggttaccgacccgtacgggg

SEQ ID NO: 82227 - DNA, 651 bp, Homo sapiens
  misc_feature: GYAE6OF02FW7HA.36.34.D01.1.454.CMB.1.raw
tcagtacgctgtctcacgaccggtgctcgatttagatcgtctgtgttgggtttggggacccaaaaaccacacccctccttgggagaatcccctagatcacagctcctcaccatggactggacctggagcatccttttcttggtggcggcagcaacaggtgcccactcccaggttcacctggtgcagtctggagctgaggtgaagaagcctggggcctcagtgaaggtctcctgcaaggcttctggttactcctttcttacgtatggcatcagctgggtgcgacacggcccctggacaagggctcgagtggagtggggtagactcgaggtcctaaacgaagtggttaacaacaaactagtgacgacggtaagttgacgaggacaggaacgtgaacctagtcgaacctacgacgaccacgtaccgaacggagacaacgagaccgtaacagtaggaacctggaacgggacgccgtaggaaccggaccctaggaaccgtaccggaaccggacctaagttaacttacgtttaacgttggtacgaccggtaaagtaaaccgtaaccgggtattacccgtaaggtttcggttagttaagttttaacggttttggggaatttacggtagtaggttactttccgttttagagttaaccgg

SEQ ID NO: 82228 - DNA, 526 bp, Homo sapiens
  misc_feature: GYAE6OF02FU0Z1.36.34.D01.1.454.CMB.1.raw
  modified_base (415)..(415): a, c, t, g, unknown or other
  misc_feature (415)..(415): n is a, c, g, or t
tcagtacgctgtctcacgaccggtgctcgatttagatcgtctgtgttgggtttgggggagctacaacaggcaggcaggggcagcaagatggtgttgcagacccaggtcttcatttctctgttgctctggatctctggtgcctgcggggacatcgtgatgacccagtctccagactccctggctgtgtctctgggcgagagggccaccatcaactgcaggtccagccagagtgttttatacagctccaacaataagaactacttaacttggtaccagcagaaaccaggacagcctacctaaactgcctcatttactgggcatccgtaacccggatccgggtccctgaccgattcagtggcagcgggtctgggacagtatttcactctcaccatcagcagcctgcaggctaggaagntgtgctagtttatactgtcagctaatattatagttattccgcttctacgtttcggcggtaagggacccgaaggtggaacgagtacgaaacgtacgtggtcggactgtaccg

SEQ ID NO: 82229 - DNA, 272 bp, Homo sapiens
  misc_feature: GYAE6OF02F3WH0.36.34.D01.1.454.CMB.1.raw
  modified_base (269)..(272): a, c, t, g, unknown or other
  misc_feature (269)..(272): n is a, c, g, or t
tcagtacgctgtctcacgaccggtgctcgatttagatcgtctgtgttggggggggtattgtggtggcactaccagctgctaccgaaactggttcgacccctggggccagggaaccctggtcaccgtctcctcagcctccaccaagggcccatcggtcttccccctggcaccctcctccaagagcacctctgggggcacagcggccctgggctgcctggtcaaggactacttccagacagcgtactgagcgggctggcaaggcgcatagnnnn

SEQ ID NO: 82230 - DNA, 634 bp, Homo sapiens
  misc_feature: GYAE6OF02GNA1J.36.34.D01.1.454.CMB.1.raw
tcagtacgctgtctcacgaccggtgctcgatttagatcgtctgtgttgggtttggggacccaaaaaccacacccctccttgggagaatcccctagatcacagctcctcaccatggactggacctggagcatccttttcttggtggcggcagcaacaggtgcccactcccaggttcacctggtgcagtctggagctgaggtgaagaagcctggggcctcagtgaaggtctcctgcaagacttctggttacagctttactagctatggtatcaactgggtgcgacagcccctggacagggcttgagtggatgggatggaatcgagcgcttacgaatacggtaaaacacgactagtgaccaacaggaacgcctacccgagggaccaggacgtcaaccctagtcgaacccacagaacgaccactaccaacgacgacaacgacgacctacgaagttggagggtttgggacgtccgtgacgtagtcgtacggaaccgacgaccgggtacccgttacttaacgtttaccgtggttacgacggtacgtacggtaacgaaggtaaagttagtttaagtaaacggttaggtaacgttaacggtccggggtaaccgtaacggggtaaccccgagggtaaccccgg

SEQ ID NO: 82231 - DNA, 630 bp, Homo sapiens
  misc_feature: GYAE6OF02GLVVN.36.34.D01.1.454.CMB.1.raw
  modified_base (239)..(239): a, c, t, g, unknown or other
  misc_feature (239)..(239): n is a, c, g, or t
tcagtacgctgtctcacgaccggtgctcgatttagatcgtctgtgttgggtttgggggagctacaacaggcaggcaggggcagcaagatggtgttgcagacccaggtcttcatttctctgttgctctggatctctggtgcctgcggggacatcgtgatgacccagtctccagactccctggctgtgtctcgtgggcgagaggccaccatcaactgcaggtccagccagagttgttttanacagctaccaaacaataagaacttaacttaacttggtaccagacagaaaccaggacacgacctacctaaactgactactatttacgtgggcataccgtacccggggaagtcccggggtaccctagacccgtattcgaggtcggcgaggtcgggtctagggacaggtactttccactcctcaacctatacacgcacgcctggacacggtctaggaagtacgttggtacggtacttagtttttaacttacgtgtacagtacttaaagttaatttagttaacgttactttacccgtcttaccgttacgtttcgggacgggtaacgggtaaccgtaggggtacggacgtaacgtaacggtaaacggtaaccgttaggtacggtacgtacgaaccc

SEQ ID NO: 82232 - DNA, 662 bp, Homo sapiens
  misc_feature: GYAE6OF02I9NKU.36.34.D01.1.454.CMB.1.raw
  modified_base (283)..(283): a, c, t, g, unknown or other
  misc_feature (283)..(283): n is a, c, g, or t
tcagtacgctgtctcacgaccggtgctcgatttagatcgtctgtgttgggtttggggacccaaaaaccacacccctccttgggagaatcccctagatcacagctcctcaccatggactggacctggagcatccttttcttggtggcggcagcaacaggtgcccactcccaggttcacctggtgcagtctggagctgaggtgaagaagccgtggggcctcagtgaaggtctcctgcaaggcttctggttacatctttaggagtatgcaatcactgggtgcgacncggcccctggacaagggcttgagtggatgggatggatcagcgtcttacaagtggtaacactaaattatagaacagtaacgttccgagggcagacgtacaccatacgaaccacaaacacactacccaacgaacgaccacacgtacctaacgacgtacgggacgacgtacggaaggacgaccgtaggaacgacgttacgtacggaaccgaaccgaccggtacccggttagttaacgtttaggttacggtcgggtaccgggggtaggggggggtttacttggggttacgggttcgggaccgttaccgtaaccggacggtccgtacggtacccgtaacccggtaacggttccgggttacccggtaccccggttacccgggggg

SEQ ID NO: 82233 - DNA, 273 bp, Homo sapiens
  misc_feature: GYAE6OF02G55U7.36.34.D01.1.454.CMB.1.raw
  modified_base (271)..(273): a, c, t, g, unknown or other
  misc_feature (271)..(273): n is a, c, g, or t
tcagtacgctgtctcacgaccggtgctcgatttagatcgtctgtgttgggggggggtattgtggtggcactaccagctgctaccgaaactggttcgacccctggggccagggaaccctggtcaccgtctcctcagcctccaccaagggcccatcggtcttccccctggcgcccctgctccaggagcacctccgagagcacagcggccctgggctgcctggtcaaggactacttccagacagcgtactgagcgggctggcaaggcgcatagnnn

SEQ ID NO: 82234 - DNA, 545 bp, Homo sapiens
  misc_feature: GYAE6OF02IGI46.36.34.D01.1.454.CMB.1.raw
tcagtacgctgtctcacgaccggtgctcgatttagatcgtctgtgttgggtttggggacccaaaaaccacacccctccttgggagaatcccctagatcacagctcctcaccatggactggacctggagcatccttttcttggtggcggcagcaacaggtgcccactcccaggttcacctggtgcagtctggagctgaggtgaagaagcctggggcctcagtgaaggtctcctgcaaggcttctggttacatctttaggagtatgcaatcacctgggtgcgacaggcccctggacaagggcttgagtggatgggatggatcagcgcttacaatggtaacacaaattatagaacagaagttcgaggcagagtacaccatgaccacaaacacactaccacgacgcaacagacctacatgggagctggaggagccgtgagatctagacgacgacggcgtagtattagtgtgcgggaggggggttagttggtggtggacgacgtccgagcgtcgacgtaccgaacgtcggttaccggacccgtaccgggg

SEQ ID NO: 82235 - DNA, 572 bp, Homo sapiens
  misc_feature: GYAE6OF02GMSYT.36.34.D01.1.454.CMB.1.raw
  modified_base (284)..(284): a, c, t, g, unknown or other
  misc_feature (284)..(284): n is a, c, g, or t
  modified_base (420)..(420): a, c, t, g, unknown or other
  misc_feature (420)..(420): n is a, c, g, or t
tcagtacgctgtctcacgaccggtgctcgatttagatcgtctgtgttgggtttggggacccaaaaaccacacccctccttgggagaatcccctagatcacagctcctcaccatggactggacctggagcatccttttcttggtggcggcagcaacaggtgcccactcccaggttcacctggtgcagtctggagctgaggtgaagaagcctggggcctcagtgaaggtctcctgcaaggcttctggttacatctttaggaggtatgcaatcacctgggtgcgacnggcccctggacagggcttgagtggatgggatggatcgaggcgcttacaatggtaacacaaattatagaacagaagttccagggcagagtacaccatcgaccaacaacacactaccacgacgacacacgacctacanggagacgtgaggagcctagagatctgacgacgacggccgtagttacttagttggtcggcgggtagggggggttattgggtgggtggtcctacgtaccgacgtcgtcggtccgtaaccgtaacgttcgggttaccggtaccccggtaccgggg

SEQ ID NO: 82236 - DNA, 277 bp, Homo sapiens
  misc_feature: GYAE6OF02IQLNW.36.34.D01.1.454.CMB.1.raw
  modified_base (270)..(277): a, c, t, g, unknown or other
  misc_feature (270)..(277): n is a, c, g, or t
tcagtacgctgtctcacgaccggtgctcgatttagatcgtctgtgttgggggggggtattgtggtggcactaccagctgctaccgaaactggttcgacccctggggccagggaaccctggtcaccgtctcctcagcctccaccaagggcccatcggtcttccccctggcaccctcctccaagagcacctctgggggcacagcggccctgggctgcctggtcaaggactacttccagacagcgtactgagcgggctggcaaggcgcatagnnnnnnnn

SEQ ID NO: 82237 - DNA, 647 bp, Homo sapiens
  misc_feature: GYAE6OF02HD7TZ.36.34.D01.1.454.CMB.1.raw
  modified_base (357)..(357): a, c, t, g, unknown or other
  misc_feature (357)..(357): n is a, c, g, or t
tcagtacgctgtctcacgaccggtgctcgatttagatcgtctgtgttgggtttggggacccaaaaaccacacccctccttgggagaatcccctagatcacagctcctcaccatggactggacctggagcatccttttcttggtggcggcagcaacaggtgcccactcccaggttcacctggtgcagtctggagctgagttgaagaagccgtggggcctcagtgaaggtctcctgcaaggcttctggttacattcgtttaggaggtatgcaatcaccgtggtgcgacacggcccctggacgaaggcttagagtggatgggatggatcgagcgacttacaagtggtaacactaaattanagaacgaagtaagtccgaggacagacgtacacatacgaaccaacaaacacactaccgacgacgacaacacgacctaacgagtacggacgtcgtaggacggacgtccgtagacgtactcgtacggaaccgtaccgaccggtccggttagttacgtttagttaggtcgggtacgggggtaggggggttagttcgggttacgggtacggtacgtaacggtaccgtacggtacgtacggtaccgttaacccggtaaccggttccggttacccggtaccccggttaacccggggg

SEQ ID NO: 82238 - DNA, 768 bp, Homo sapiens
  misc_feature: GYAE6OF02F1LSZ.36.34.D01.1.454.CMB.1.raw
  modified_base (199)..(199): a, c, t, g, unknown or other
  misc_feature (199)..(199): n is a, c, g, or t
tcagtacgctgtctcacgaccggtgctcgatttagatcgtctgtgttggggtttagggggacccgaaaaaccacacccctccttgggagaatccccgtagatcacagctcctcaccatggactggaccctggagcatccttttctggtggcggcagcaacaggtcgcccactcccaggttcacctggtgcagtctgganctgacggtgaagagccgtggggcctcagtgaaggtcctcctgccaaggtcttcgtaggttacatacgtttaagggaggttatgtctaagtccaacctgggtagccgacgacggcccctggacaagggtcttggagtggagtgggatgggatcgagccgacttaacaagtcggtaaaccataaaagttacgtagaaacctaggtaaacgttccgaagggacagtaacgtaccgaacctagtacggaacccaacgaaaacactaactacccaacggacgacaacgacgaccgtaacgagtagggacgcgttaggagggacgtaccgtaggtaacgtaacgtacgttaacggaaccggaaccgtaacccggggtaccgtttacgttaacgtttaagtttacgggttacggggtacggggggttaagggggggggtttaccttagggggtacggggttacgggtaccggttaacccggtaacccggtacggttaccggtacggtaacccggttaaaccccgggtaaaccggttcccgggtttacccccgggtacccccggtttacccgggggg

SEQ ID NO: 82239 - DNA, 665 bp, Homo sapiens
  misc_feature: GYAE6OF02JTAMD.36.34.D01.1.454.CMB.1.raw
  modified_base (577)..(577): a, c, t, g, unknown or other
  misc_feature (577)..(577): n is a, c, g, or t
tcagtacgctgtctcacgaccggtgctcgatttagatcgtctgtgttgggtttggggacccaaaaaccacacccctccttgggagaatcccctagatcacagctcctcaccatggactggacctggagcatccttttcttggtggcggcagcaacaggtgcccactcccaggttcacctggtgcagtctggagctgaggtgaagagcctggggcctcagtgaaggtctcctgcaaggcttctggttacagtcttaggaggtatgcaatcacctgggtgccgacgacggtcccctggacgaaggggtcttggaggtgggactgggatggactcgaggccgcttaacaagttaggtaaacaactaaagttagtaacgaacgaaggtaacggttaccgaaggggactaagtaacggtacaaccgtaagtacgaacctaaaccgaaactacaactacccaacgaacgtaccgaacacgtacctaacgataggagacgtagaacggtacgaccgtgaacgtacgtcgtaggaccgtacgacgggtcgtagttaagtttatcggtggtacgggtaggggggtnttagggtcgggtggtacgtacgtaccgtacggtacgtaccgtacgttaaccgtaaccggttacggttcccggtacccggtacccgggg

SEQ ID NO: 82240 - DNA, 720 bp, Homo sapiens
  misc_feature: GYAE6OF02GCAQL.36.34.D01.1.454.CMB.1.raw
  modified_base (285)..(285): a, c, t, g, unknown or other
  misc_feature (285)..(285): n is a, c, g, or t
tcagtacgctgtctcacgaccggtgctcgatttagatcgtctgtgttgggtttggggacccaaaaaccacacccctccttgggagaatcccctagatcacagctcctcaccatggactggacctggagcatccttttcttggtggcggcagcaacaggtgcccactcccaggttcacctggtgcagtctggagctgaggtgaagaagcctggggcctcagtgaaggtctcctgcaaggcttctggttacattctttaggaggtatgcaatcacgtgggtgcgacncggcccctggacaagggcttggaggtggagtgggatgggatcgagcgcttaacaagttaggtaaacaactaaaatttacgtagaaacaaggtaaacggttaccgaggggcaaggacgtacaaccgatacgaacccaacaaaccacaactaccacgaacgacaaccacgacctacgagtacgggacgcgtaggacgggacgaccgtaggacgacgttacgtacggaaccggtaccgaccggggtaccgttaggttacgttttagtttcggttacggggtacggggggttaaggggggggtttagtttacggggttacggggttcggggtaaccggttaaccggttaacccgtaacggtaccgttacgggtaacccggttaacccggtaaaccggtttccggggtttaccccgggtacccccgggttacccgggggg

SEQ ID NO: 82241 - DNA, 731 bp, Homo sapiens
  misc_feature: GYAE6OF02JML9N.36.34.D01.1.454.CMB.1.raw
  modified_base (195)..(195): a, c, t, g, unknown or other
  misc_feature (195)..(195): n is a, c, g, or t
  modified_base (357)..(357): a, c, t, g, unknown or other
  misc_feature (357)..(357): n is a, c, g, or t
tcagtacgctgtctcacgaccggtgctcgatttagatcgtctgtgttgggtttggggacccaaaaaccacacccctccttgggagaatcccctagatcacagctcctcaccatggactggacctggagcatccttttcgttggtggcggcagcaacaggtgcccacctcccaggttcacctggtgcagtctggancgtgaggtgaagaagccgtggggcctcgagtggaacggtctccgtgccgaaggtccttcgtcggttactagttcgtttaggaggttatcgactaatccaccgtgggtcgacgaccgacggccccgtaggacgagggtcttggaggtggagtcgggagtgganacgacgtcgtacttaacgaagtacggtaaacaactaaagtttagagaaactaaggtaacgtaccgagggacaggacgtaccaaccagtaccgaaaccaacaaaccgacaaccgtacgaacgaacgacctaaccgaacgtaccaacgtacgtaggacgacggtacggaacggacgtacgagtagtaccgtcgtacggaaccgaacggtaccggtacgtttacgttaacgtttaaggttcgggtaacggggtacgggggttaacggggggtttagttggggttaccgggtaacgggtaaccgtaccgtaacggacgttcggtacgtaccgtaaccggttaaccggttcgggttaccccgggaacccggttccgggg

SEQ ID NO: 82242 - DNA, 557 bp, Homo sapiens
  misc_feature: GYAE6OF02JETBH.36.34.D01.1.454.CMB.1.raw
  modified_base (253)..(253): a, c, t, g, unknown or other
  misc_feature (253)..(253): n is a, c, g, or t
  modified_base (395)..(395): a, c, t, g, unknown or other
  misc_feature (395)..(395): n is a, c, g, or t
  modified_base (431)..(431): a, c, t, g, unknown or other
  misc_feature (431)..(431): n is a, c, g, or t
  modified_base (447)..(447): a, c, t, g, unknown or other
  misc_feature (447)..(447): n is a, c, g, or t
  modified_base (455)..(455): a, c, t, g, unknown or other
  misc_feature (455)..(455): n is a, c, g, or t
tcagtacgctgtctcacgaccggtgctcgatttagatcgtctgtgttgggtttgggggaagaggaagactgacggtcctgccacaggtggtgctgggcacggtgggcactcgacacaacatttgcgctcaactgtcttgttctccttgttgctattttagaaggtttccagtgtgaggtgcagttggtggagtcgtggggggaggcttgggtacaggccgtggggggtccctgagactctcctgtgcagcctntggtttcatctttagcaactacgccatgagctgggtccgccaggctccgagggaagggctggagtgggctcgaggtattacgtggtagtggtaatccgcatactacgcagactccggtgaccgggccgttcacgtctcaganacattcgaagaatacggtctatctaggaaatgaacngcctgagagcgagacnccggcctntattcagtgcgagagactcgaagacggaatactagactaggctagcttacaggtaacctacggtacggggccccaacgggaacccgttggtaccctacccgg

SEQ ID NO: 82243 - DNA, 645 bp, Homo sapiens
  misc_feature: GYAE6OF02GA162.36.34.D01.1.454.CMB.1.raw
tcagtacgctgtctcacgaccggtgctcgatttagatcgtctgtgttgggtttggggacccaaaaaccacacccctccttgggagaatcccctagatcacagctcctcaccatggactggacctggagcatccttttcttggtggcggcagcaacaggtgcccactcccaggttcacctggtgcagtctggagctgaggtgaagagcctggggcctcagtgaaggtctcctgcaaggtcttctggttacattctttagggaggtatgcaatcaccgtgggtgcgacgacggcccctggacaagggcttgaggtggatggggatggatcgagcgtacttacgaagttggtaaacactaaaattatagaaacagtaacgttccgaagggacaaggtacgtacaaccgtatacgaaccaacaaacactaactaccaacgagacacgacgacctacacgtggacgcgtaggaggacgccgtagagtactcgtaggacgaccgaccgggtacgttacgttagttagttggtcgggtacgggggtagggggggttagttggggtacgggttcggggaccgtacgtaccggagtccggtacgtaccgtaaccggtaaccgtttccgggttacccgtaccccgggtaccgggg

SEQ ID NO: 82244 - DNA, 662 bp, Homo sapiens
  misc_feature: GYAE6OF02FYCZV.36.34.D01.1.454.CMB.1.raw
tcagtacgctgtctcacgaccggtgctcgatttagatcgtctgtgttgggtttgggggacccaaaaaccacacccctccttgggagaatcccctagatcacagctcctcaccatggactggacctggagcatccttttcttggtggcggcagcaacaggtgcccactcccaggttcacctggtgcagtctggagctgaggtgaagaagcctggggcctcagtgaaggtctcctgcaaggcttctggttacattctttaggaggtatgcaatcacctgggtgcgacaggcccctggacaagggcttgagtggatgggatggatcgagcgcttacaatggttaacaacgtaaattatagaacaggtaattaccgagggcagagtacgaccatacgaaccaacaaactacactaccaacgacgcaaccacgaccttaccgaatagggacgacgttaggaaggtacgacccgtgaggtatccgtagaaccggaccgaaccggggtcccggttagttaacgtttagttcggttacgggtacggggttagggggggggtttatttacggggttggggttacgggaccgtaaccgtaccgtaacggtccgtacggtaccgttaacccggtaacggtttccgggttacccgaccccgggttacccggggg

SEQ ID NO: 82245 - DNA, 648 bp, Homo sapiens
  misc_feature: GYAE6OF02HSMXY.36.34.D01.1.454.CMB.1.raw
  modified_base (472)..(472): a, c, t, g, unknown or other
  misc_feature (472)..(472): n is a, c, g, or t
tcagtacgctgtctcacgaccggtgctcgatttagatcgtctgtgttgggtttggggggaagaggaagactgacggtcctgccacaggtggtgctgggcacggtgggcactcgacacaacatttgcgctcaactgtcttgttctccttgttgctattttagaaggtttccagtgtgaggtgcagttggtggagtcgtgggggagcttggtacagccgtgggggtccctgagactctcctgtgcagcctctggtttcattctttagcaactacgccatgagtcgtggtccgccaggctaccgaggggaagggctgggaggtgggtctcgtaggtacttacgtggtaggtaggtaactaccgcatacgtacgacacgactccggtaggccggggtccgttcaccgtctaccgagacgaacgtaacttacccgaaagtaataccggttactactcgtaagggaaattggaaaccngacctagagacggacccgaaggaccgaccggtcccttactacgttacgtcggtcgacggaagtagactcggaaggaaccgggtagtaagtcggacgaacggccacggtcttaccgtacgtacccgttacgggccggggacccctaccgggtaaccccgttggtaccccgtacccgg

SEQ ID NO: 82246 - DNA, 696 bp, Homo sapiens
  misc_feature: GYAE6OF02GWBVM.36.34.D01.1.454.CMB.1.raw
tcagtacgctgtctcacgaccggtgctcgatttagatcgtctgtgttgggtttggggacccaaaaaccacacccctccttgggagaatcccctagatcacagctcctcaccatggactggacctggagcatccttttcttggtggcggcagcaacaggtgcccactcccaggttcacctggtgcagtctggagctgaggtgaagaagcctggggcctcgagtgaaggtcctcctgcaaggcttctggttacattcgtttaggaggtatgctaatcaccgtgggtcgcgacacggcccctggacaagggcttggagtgggatgggatggatcgaggcgtacgttaacaagtacggtaacaactaaattagtacgaaacaagtaacggttaccgaaggggtcaaggtacgtacaacgtactacggaaccaacaaactacactacccaacgacgacaacgacgaccctaacgtacgtacgggacgaccgtaggaacggacgaccgtaggaagtactacgtacggaccgaaccggaccgggtaccgttacgtttatttacggttaggtagggtaccgggggtagggggggttagtttcggggtgggtacggtaccggtaaccgtaaccggacggttaccgtaccggtaccggtaaaccgttaaccggttccgggttacccggtacccgggtacccggggg

SEQ ID NO: 82247 - DNA, 681 bp, Homo sapiens
  misc_feature: GYAE6OF02IRSZG.36.34.D01.1.454.CMB.1.raw
tcagtacgctgtctcacgaccggtgctcgatttagatcgtctgtgttgggtttggggacccaaaaaccacacccctccttgggagaatcccctagatcacagctcctcaccatggactggacctggagcatccttttcttggtggcggcagcaacaggtgcccactcccaggttcacctggtgcagtctggagctgaggtgaagaagccgtggggcctcgagtgaaggtctccgtgcaaggtcttcgtggtacattcgtttaggaggtatgactaagtcaccgtgggtgcgacgacggccccgtaggaacgaagggcttaggagttggagtgggatggatacgaggtcgtacttaacgaagtacggtaaacacgtaaaattagtaacgaactaacggtaacgttccggaagggacaaggtacgtacaacaagttacgaacccaacaaacgacaacgtaccgaacgaacgacgaacacgactaacgtaggacggacgtacgaggacgtacgccgagagactcgtacggacgacgtacggtacgttacgttattacggtaggtacgggtacggggtacggggggttagtttcgggtgggtaccggtcggtacgtaaccggtacgtcgtacggtacccggtaaccggtaaccggtcgggttacccggacccgggttaaccgggg

SEQ ID NO: 82248 - DNA, 530 bp, Homo sapiens
  misc_feature: GYAE6OF02FODGE.36.34.D01.1.454.CMB.1.raw
  modified_base (348)..(348): a, c, t, g, unknown or other
  misc_feature (348)..(348): n is a, c, g, or t
  modified_base (474)..(474): a, c, t, g, unknown or other
  misc_feature (474)..(474): n is a, c, g, or t
tcagtacgctgtctcacgaccggtgctcgatttagatcgtctgtgttgggtttggggacccaaaaaccacacccctccttgggagaatcccctagatcacagctcctcaccatggactggacctggagcatccttttcttggtggcggcagcaacaggtgcccactcccaggttcacctggtgcagtctggagctgaggtgaagaagcctggggcctcagtgaaggtctcctgcaaggcttctggttacatctttaggagtatgcaatcacctgggtgcgacaggcccctggacaagggcttgagtggatgggatggatcgagcgcttacaatggtaacacaaattanagaacagaagttccagggcagagcacatcgaccaacaaacacatccacgagacacagcctacatggagctgaggagccgtgagatctgacgacgacggccgtgtattattgtggcggaggggggtntggtggtggcgactaccgagcgtcgcgtaccgaacgtcggttccgacccgtcgggg

SEQ ID NO: 82249 - DNA, 736 bp, Homo sapiens
  misc_feature: GYAE6OF02I7NC3.36.34.D01.1.454.CMB.1.raw
  modified_base (262)..(262): a, c, t, g, unknown or other
  misc_feature (262)..(262): n is a, c, g, or t
  modified_base (272)..(272): a, c, t, g, unknown or other
  misc_feature (272)..(272): n is a, c, g, or t
  modified_base (641)..(641): a, c, t, g, unknown or other
  misc_feature (641)..(641): n is a, c, g, or t
tcagtacgctgtctcacgaccggtgctcgatttagatcgtctgtgttgggtttggggacccaaaaaccacacccctccttgggagaatcccctagatcacagctcctcaccatggactggacctggagcatccttttcttggtggcggcagcaacaggtcgccactcccaggttcacctggtgcagtctggagctgaggtgaagaagccgtggggcctgagtgagtctctgcagctctgtacatcttaggaggtatgacaancacgtgggtnaccgactacgccccgtaggaccgaaggtccgttagaggtacggtagtaggggtatcgggatcaaggacggtcctttaaacgaatttaagggaacctaaagtaaactttagtaacggaaacaaggttaacggttcccggaagggacgtaaaggtacgtacctaaacgttacgacggaaacccaaactaaaccgaacgtaaccttaaccgaaccgtaacgaccaaccgtaaacggacccttaaaggaagttacgggaacgttacgaacggtaacggaacgtccggtagaacggtaacgttactacggaacggttaccgaaacgggtccttaaggttacgtttaagtggttagggacggggtaggggggttnttacggggtggtaccggactaaccggtaccggacgtcggttacgtaccgtaaacggtaacggtttacccgggttacccggacccgggtaccgggg

SEQ ID NO: 82250 - DNA, 735 bp, Homo sapiens
  misc_feature: GYAE6OF02JK612.36.34.D01.1.454.CMB.1.raw
tcagtacgctgtctcacgaccggtgctcgatttagatcgtctgtgttgggtttggggacccaaaaaccacacccctccttgggagaatccctagatcacagctcctcaccatggactggacctggagcatccttttcttggtggcggcagcaacaggtgcccactcccaggttcacctggtgcagtctggagctgaggtgaaggaagcctggggcctcagtgaaggtctcctgcaaggctctggttacatctttaggagtatgcaatcacctgggtgcgacacgggcccctaggacaagggcttgagtggagtgggatggatcgagcgcttacaagtacggtaacactaaattagagaacaagtaagttccgaggcaggactcacgatacgaccaacgaaacacactaccacgacgtacaacacgacctaacgagtacggacgtacgtacggtaacgggacgtcgtacggtaacgtacgtacggtacggtaaccgaacccggtaacccggggtaaccggttaccgtttaacgttttaaacggttttcgggttaacgggggtaacgggggttaacggggggggggtttacgggtttacgggtttcgggggttaacgggttaaccggttaacccggttaaccggttaacgggtaccggttaccgggtaacccggtttaacccgggtaaaccggttttacccggggttacccgggtaccccgggttaaccccgggggg

SEQ ID NO: 82251 - DNA, 535 bp, Homo sapiens
  misc_feature: GYAE6OF02G1JOJ.36.34.D01.1.454.CMB.1.raw
  modified_base (326)..(326): a, c, t, g, unknown or other
  misc_feature (326)..(326): n is a, c, g, or t
  modified_base (369)..(369): a, c, t, g, unknown or other
  misc_feature (369)..(369): n is a, c, g, or t
tcagtacgctgtctcacgaccggtgctcgatttagatcgtctgtgttgggtttggggacccaaaaaccacacccctccttgggagaatcccctagatcacagctcctcaccatggactggacctggagcatccttttcttggtggcggcagcaacaggtgcccactcccaggttcacctggtgcagtctggagctgaggtgaagaagcctggggcctcagtgaaggtctcctgcaaggcttctggttacatctttaggaggtatgcaatcacctgggtgcgacaggcccctggacaagggcttgagtggatgggatggatcagcgnttacaatggtaacacaaattatgaacagaagttccagggcagngtcaccatgaccacaaacacatccacgagcacagcctacatggagctgaggagccgtgagatctgacgacgacggccgtgtattagttgtgtcgggagggggggttacttggttgggtggcgactaccgagcgtgctaccggaacgtcggttccgacccgtcgggg

SEQ ID NO: 82252 - DNA, 589 bp, Homo sapiens
  misc_feature: GYAE6OF02JY6YV.36.34.D01.1.454.CMB.1.raw
  modified_base (258)..(258): a, c, t, g, unknown or other
  misc_feature (258)..(258): n is a, c, g, or t
  modified_base (340)..(340): a, c, t, g, unknown or other
  misc_feature (340)..(340): n is a, c, g, or t
  modified_base (356)..(356): a, c, t, g, unknown or other
  misc_feature (356)..(356): n is a, c, g, or t
  modified_base (362)..(362): a, c, t, g, unknown or other
  misc_feature (362)..(362): n is a, c, g, or t
  modified_base (380)..(380): a, c, t, g, unknown or other
  misc_feature (380)..(380): n is a, c, g, or t
  modified_base (404)..(404): a, c, t, g, unknown or other
  misc_feature (404)..(404): n is a, c, g, or t
  modified_base (433)..(433): a, c, t, g, unknown or other
  misc_feature (433)..(433): n is a, c, g, or t
  modified_base (492)..(492): a, c, t, g, unknown or other
  misc_feature (492)..(492): n is a, c, g, or t
  modified_base (515)..(515): a, c, t, g, unknown or other
  misc_feature (515)..(515): n is a, c, g, or t
tcagtacgctgtctcacgaccggtgctcgatttagatcgtctgtgttgggtttggggacccgaaaaccaccacccctccttcgggagaatcccctagatcacagctcctcaccatggactggacctggagcatccttttcttggtggcggcagcaacaggtgcccactcccaggttcacctggtgcagtctggagctgaggtgaagagcctggggctcagtgaaggtctcctgcaaggcttctggtacatctttaggngtatgctatcacctgggtgtacgacacggtccccgagaaccgaggggtcttggaggtggaagtggaagttcggatcgagcgnttacgaatgtaacaanaattangaacagtagtaccgaggnagaatcgacatacgaccaacgaanacagtacacgagcaactacgactacgaanggtagcgttagacggtagaccctgagacgtatagaccgacgtacgcgtacgtaagtttntcggtaggacgggtagggggttntaggtacgggtgacgtacgtcgtaacgtgtacgacgtaccgtaacggtaccgttaccgggaccccgtaaccggg

SEQ ID NO: 82253 - DNA, 729 bp, Homo sapiens
  misc_feature: GYAE6OF02I1S9R.36.34.D01.1.454.CMB.1.raw
  modified_base (249)..(249): a, c, t, g, unknown or other
  misc_feature (249)..(249): n is a, c, g, or t
  modified_base (614)..(614): a, c, t, g, unknown or other
  misc_feature (614)..(614): n is a, c, g, or t
tcagtacgctgtctcacgaccggtgctcgatttagatcgtctgtgttgggtttggggacccaaaaccacacccctccttgggagaatcccctagatcacagctcctcaccatggactggacctggagcatccttttcttggtggcggcagcaacaggtgcccactcccaggttcacctggtgcagtctggagctgaggtgaagagccgtgggcctgagtgaggtctcgtgcaaggtcttcgtggttacnttcgtttaggagtatgcaatcacgtggtgcgacgacggccctggaacaagggtcttaggagtggagtgggatggatcgagcgtacttaacgagtaggtaaaccaacgtaaattagtacgaaacgtaacggtaaacgttcccgaagggggacaacggacgttacgaaccctagttaaccggaaacccaaacaaaaccgtacctaacgacccgtaacggaacgaccgaaccacggtaccctaacgtacggtacggacgacgttagggaacggacgtcccgtaagacgtacgttcgaacgaccggaaccgaccgggtaccgttacgttagtttaacggttggtacgggtcggggtaacgggggggttnttaacggggttcgggttaacgggtaccgtaccggttaccgtaacggtacggttacggtaaccggttaacccggttaaccggttaccgggttacccggacccgggttaaccggggg

SEQ ID NO: 82254 - DNA, 757 bp, Homo sapiens
  misc_feature: GYAE6OF02H1F3D.36.34.D01.1.454.CMB.1.raw
tcagtacgctgtctcacgaccggtgctcgatttagatcgtctgtgttgggtttggggacccaaaaaccacacccctccttgggagaatcccctagatcacagctcctcaccatggactggacctggagcattccttttcttggtggcggcagcaacaggtgcccactcccaggttcacctggtgcagtcgtggagctggaggtgaagaagccgtggggcctcgagtgaaggtctccgtgcgaaggtcttcgtaggttaacagttacgttttagggaaggtatggactaacgtcctaaccgttgggtagtaccggacgaacgggcccccgttagggaaccgtaaaggggtccttaggtacggtgggaaggttggggacgtaggtaacgtcgaaggtcgtactttaacgaagttacgggtaaacaactaaagttactaagaaacgtaggtaaactcggagggtacaaggtaagtaccaacgtaagtaccgaaaccgaaacaaaaccgtaccaagtaaccccgaagaacggaccaaccggaacgcccgttaaagaggttacgggaatcggaagggacggaaccgtactaggtaactacgttcgtaaacggaccgaaacggcccggtacgttagttaactttaggtcggtaacgggtcggggggtaaggggttacttggggtacgggtcgttaaccgaaccgttaacgacgtcgtacgtaccggtaaacgacggtttacggttacccggacccggtacggg

SEQ ID NO: 82255 - DNA, 920 bp, Homo sapiens
  misc_feature: GYAE6OF02IUFOY.36.34.D01.1.454.CMB.1.raw
tcagtacgctgtctcacgaccggtgctcgatttagatcgtctgtgttgggtttggggacccaaaaaccacacccctccttgggagaatcccctagatcacagctcctcaccatggactggacctggagctattccttttcgttggtgggcggcagcaacgaggtcgcccactcccaggttccaccgtggtgctacgtcgtaggagtcgtaggaggtagaaacggaacggtccggtcggggcccttagaggtaggtaaacgggttcctcgtcggaccgtaagggtcctttcgttacgggttaacacgttttacgtttaaggggtagttagttgactaactacgtaccggttgggtcggacgacgaccggccccgtaggaacggaaggtcgttaggaggtggaggtgggagtggtactacgacggtccgtaactttaacgaacggttaaccgggtaaactaaaacgtaaaagtttaacgtaaacggtaaaaccgtaaacgggtttaaccggtttaccggaaagggtaaccgtaaacgggttaaccggtaaccccaaacccgtttaaacgtaacccggaaaaccccgaaaaaactaaaacccgaaccgttaaaccgtaccccggaaaaccgggtaaccaaccgggtaaaaaccctcccgggtttaaacccaaacggttaacggaacgggtaacggtttaacccggtaaggggaaacggtaacccggtacccgtttaaggaagttaacccggtaacgtacgggaaaccccggtaacgtaacccggggttaccttaggtttaaccttagggttacggaccggggtagggggtaacgggggttattacgggtggtacgaccggtactaacgtcgtaccgtacgtaccgtaaccgtaacggttccgttaccggacccggtaaccggg

SEQ ID NO: 82256 - DNA, 658 bp, Homo sapiens
  misc_feature: GYAE6OF02HIP7X.36.34.D01.1.454.CMB.1.raw
  modified_base (350)..(350): a, c, t, g, unknown or other
  misc_feature (350)..(350): n is a, c, g, or t
tcagtacgctgtctcacgaccggtgctcgatttagatcgtctgtgttgggtttggggacccaaaaaccacacccctccttgggagaatcccctagatcacagctcctcaccatggactggacctggagcatccttttcttggtggcggcagcaacaggtgcccactcccaggttcacctggtgcagtctggagctgaggtgaagagcctggggcctcagtgaaggtctcctgcaaggcttctggttacatctttaggaggtatgcaatcacctgggtgcgacaggcccctggacaagggcttgagtggatgggatggatcgagcgcttacgaagtggtaacacaaattanagaacagaagttccgaggcagagtcacatgaaccaacaaacacactaccaacgacgaccacacgacctaacagtaggacgacgtaggaagggacgaccgtagaacgtacgtacgtacggaaccggaaccgtaccgggtaccggttagttaacgttttagttagggtacgggtacgggggtagggggggggttagtttggggttcggggttacgggtacgtaaccgttaaccggtacggtaccgttacggtaccgtaaacccggtaaccggtttaccgggtttacccggtaccccgggttaaccggggg

SEQ ID NO: 82257 - DNA, 277 bp, Homo sapiens
  misc_feature: GYAE6OF02JU44W.36.34.D01.1.454.CMB.1.raw
  modified_base (269)..(277): a, c, t, g, unknown or other
  misc_feature (269)..(277): n is a, c, g, or t
tcagtacgctgtctcacgaccggtgctcgatttagatcgtctgtgttgggggggggtattgtggtggcactaccagctgctaccgaaactggttcgacccctggggccagggaaccctggtcaccgtctcctcagcctccaccaagggcccatcggtcttcccctggcaccctcctccaagagcacctctgggggcacagcggccctgggctgcctggtcaaggactacttccagacagcgtactgagcgggctggcaaggcgcatagnnnnnnnnn

SEQ ID NO: 82258 - DNA, 842 bp, Homo sapiens
  misc_feature: GYAE6OF02H8JQ7.36.34.D01.1.454.CMB.1.raw
  modified_base (243)..(243): a, c, t, g, unknown or other
  misc_feature (243)..(243): n is a, c, g, or t
tcagtacgctgtctcacgaccggtgctcgatttagatcgtctgtgttgggtttgggggagctacaacaggcaggcagggcagcaagatggtgttgcagacccaggtcttcatttctctgttgctctggatctctggtgcctgcggggacatcgtgatcgaccagtctccagactccctggctgtgtctcgtgggcgagacgggccacatcaactgctaggtccagccaggtagttagttttanacagctaccgaaactaataagaacttaacttaacttggtaacagcaagaaaccaggacctacgtaccttacctaaaactcgaccttctaacgttttacctaggggactacgttacccggtaaaccccgggggtaaacgttccccggggggttacccttacggaaaccccggttacgttttaccggaacggtttacgggaccgtaaacggggtcccggggtttacgttaacgggggaaaccttaaacgggttacttttcccggtaaaccctttccggtttaacccgtaaaccccttaaacgttaccgaaacggtaccctaaacggtcccgtacggacccgtacgggtaccgtaaggaaacgtacgttcgggtacgggtactttaagggttttaacgtttacgttacggttaaccgtaggtaaccgttaaagtttaacgtttaaacgtttaacgttaaccgttttacccggtaactttacccggtttaacccggttttacggggaacccggggttaacgggaaacccggttaaggggttaacggaacgtaacgttaaccggtaaaaccggtacgttacgggtacggtaccgtagtaacccg

SEQ ID NO: 82259 - DNA, 304 bp, Homo sapiens
  misc_feature: GYAE6OF02FWX4Q.36.34.D01.1.454.CMB.1.raw
  modified_base (285)..(285): a, c, t, g, unknown or other
  misc_feature (285)..(285): n is a, c, g, or t
  modified_base (287)..(304): a, c, t, g, unknown or other
  misc_feature (287)..(304): n is a, c, g, or t
tcagtacgctgtctcacgaccggtgctcgattttagatcgtctgtgttggggggggggtacttagtggtggcactaccaagctggctaccgaaactcggttccgacccctggggcccagggaacccgtcggtcaccggtctccctcagccctccaccaaggcccatcggtcttccccctggcgaccctctccaagagcacctcgtggggcacagcggccctgggctgcctggtcaaggctacttccagacagccgtactgaggccgggctggcaaggcgcatagnannnnnnnnnnnnnnnnnn

SEQ ID NO: 82260 - DNA, 621 bp, Homo sapiens
  misc_feature: GYAE6OF02H8VOM.36.34.D01.1.454.CMB.1.raw
  modified_base (298)..(298): a, c, t, g, unknown or other
  misc_feature (298)..(298): n is a, c, g, or t
  modified_base (338)..(338): a, c, t, g, unknown or other
  misc_feature (338)..(338): n is a, c, g, or t
  modified_base (370)..(370): a, c, t, g, unknown or other
  misc_feature (370)..(370): n is a, c, g, or t
  modified_base (485)..(485): a, c, t, g, unknown or other
  misc_feature (485)..(485): n is a, c, g, or t
  modified_base (493)..(493): a, c, t, g, unknown or other
  misc_feature (493)..(493): n is a, c, g, or t
  modified_base (503)..(503): a, c, t, g, unknown or other
  misc_feature (503)..(503): n is a, c, g, or t
  modified_base (532)..(532): a, c, t, g, unknown or other
  misc_feature (532)..(532): n is a, c, g, or t
tcagtacgctgtctcacgaccggtgctcgatttagatcgtctgtgttgggtttggggggaagaggaagactgacggtcctgccacaggtggtgctgggcacggtgggcactcgacacaacatttgcgctcaactgtcttgttctccttgttgctattttagaaggtttcagtgtgaggtgcagttggtggagtcgtggggggaggtcttggtacaggccgtggggggtccctgacgactctcctgtgcacgcctcgttggtttcattctttagcaactacgcatgagcgtcgggtccncgaggctaccggaaggggaagggccgtgggaggttggtcngtaggttattacgtggtagtagtaactaccgnactacgacgcacgtactcggtggaccgggtccgtcaccgtctacagacacaacttaccgaagtacgttcggtctatcgaaggaatagaacgacgctagacgcggaccgaggaccncggccttntaattaccgnggtgacgagagtacacggaggtaacggtntaacgcgcgaggcctacgccttcgtaaccgaaccgttcgggaacccgggacccgtaacccgggtaccgttccgggtacccctaccccgg

SEQ ID NO: 82261 - DNA, 623 bp, Homo sapiens
  misc_feature: GYAE6OF02I1CQB.36.34.D01.1.454.CMB.1.raw
  modified_base (484)..(484): a, c, t, g, unknown or other
  misc_feature (484)..(484): n is a, c, g, or t
tcagtacgctgtctcacgaccggtgctcgatttagatcgtctgtgttgggtttggggacccaaaaaccacacccctccttgggagaatcccctagatcacagctcctcaccatggactggacctggagcattccttttcttggtggcggcagcaacaggtgcccactcccaggttcacctggtgcagtctggagctgaggtgaagaagcctggggcctcagtgaaggtctcctgcaaggcttctggttacatcttaggagtatgcaatcactgggtgacgaaggcccctggacgaagggcttggagtgggagtgggatggatcgagcgtacttacaagtggtaacactaaattatagaaacgtaggaaacgttccgaaggggcaggtacgtaccaaccatacgaaccaaacaaacaacactaccgaacgacgacacgacgtacctaacgagtgggaacgcgtaggaggacggaccgtagaacgntaccgtcggaacgaccgaccggccgttagttacgtttattgggtaggcggggtagggggggtattgggtggtcgggtcgacgtacgagtcgtgtacgtaccgtaaccgtcggttaccggaccccggtgggtaacccggg

SEQ ID NO: 82262 - DNA, 604 bp, Homo sapiens
  misc_feature: GYAE6OF02I10C8.36.34.D01.1.454.CMB.1.raw
tcagtacgctgtctcacgaccggtgctcgatttagatcgtctgtgttgggtttggggacccaaaaaccacacccctccttgggagaatcccctagatcacagctcctcaccatggactggacctggagcatccttttcttggtggcggcagcaacaggtgcccactcccaggttccacctggtgcagtctggagctgaggtgaagaacgcctggggcctcagtgaaggtctcctgcaaggcttctggttacatctttaggaggtatgcaatcacctgggtgcgacaggcccctggacaagggcttgagtggatgggatggatcagcgtacttacaagtggtaaccaactaaattataggaaaccaaggtaaacgttcccgaaggggtccaaaggtagtaccaaccgaagtacgaaacccaacgaaaacacgactacccaacgacgacacacgacctacagtacgagacgtagacggtatcctagagatcgacgacgacgacggccgtgttattagtgtggcgggtaggggggtattggtggtggcgacgtacgacggtctacggtacgtaaccgaacgttacggttaccggacccgtaccgggg

SEQ ID NO: 82263 - DNA, 648 bp, Homo sapiens
  misc_feature: GYAE6OF02JXNXR.36.34.D01.1.454.CMB.1.raw
  modified_base (315)..(315): a, c, t, g, unknown or other
  misc_feature (315)..(315): n is a, c, g, or t
  modified_base (320)..(320): a, c, t, g, unknown or other
  misc_feature (320)..(320): n is a, c, g, or t
  modified_base (406)..(406): a, c, t, g, unknown or other
  misc_feature (406)..(406): n is a, c, g, or t
  modified_base (445)..(445): a, c, t, g, unknown or other
  misc_feature (445)..(445): n is a, c, g, or t
  modified_base (451)..(451): a, c, t, g, unknown or other
  misc_feature (451)..(451): n is a, c, g, or t
tcagtacgctgtctcacgaccggtgctcgatttagatcgtctgtgttgggtttggggacccaaaaccacacccctccttgggagaatcccctagatcacagctcctcaccatggactggacctggagcatccttttcttggtggcggcagcaacaggtgcccactcccaggttcacctggtgcagtctggagctgaggtgagaagccgtggggcctcaggtgaacggtctccgtgcaaggcttctggttacattctttaggaggtatgcaatcgacctgggtgcgacaggcccctggacaagggcttgagtgganggganggatcgagcgtctaacaatcggtaaacactaaacttagtagaaacgaagtaacgttccagggcagacgtcacaatacgaacccaanaaacacactaccaacgacgacaacgtacgacctacgaangggtancgtaggacggacgccgtacgatacgttcgacgacggaaccgtaccggtaccggtaggtttaactttacggtttacgtcggggtacggggtagggggggttacgtttgggttcgggtagggtaccgtaaccgtacgacggtagtacggtaaccgtaccggtaaccgttcggttacccggtaaccccggttcccggggg

SEQ ID NO: 82264 - DNA, 784 bp, Homo sapiens
  misc_feature: GYAE6OF02HP8T0.36.34.D01.1.454.CMB.1.raw
tcagtacgctgtctcacgaccggtgctcgatttagatcgtctgtgttgggtttggggacccaaaaaccacacccctccttgggagaatcccctagatcacagctcctcaccatggactggacctggagcatccttttcttggtggcggcagcaacaggtgccccactcccaggttcacctggtgcagtctggagctgagttgaagaagccgtgggcctcagtgaaggtctcctgcaaggcttctggttacattcgtttaggagtatgacaagtcaccgtgggtgcgacacggccccgtggacgaagggtcttaggagtggagtgggagtggactcgagcgtacttacaagttaggtaaacaacgtaaaatttagtacgaaataacggtaacggtttaccgaaggggacctaaggaacgttacctaaccgaataaccggaacccaaaccaaaacgtaccaacgtaccccgaaacggacgaacccgaacgtaaccgtaccctaacgaacgtacgggtacaccggttagggaacggacgtcccgtaaggtaacgaacgttacgtacggaaacgtaccggtacccgggtacccggtttaagtttaacttttacgggttttacggacggggtaacccggggggttaaggggggggtttacttttagggggtacggggttacgggtacccgtaaccggttaaccgtaaccggtcgttaccgtaaccggttaaacccggttaaaccggtttcccggggtttaacccccggaccccggtttaacccgggggg

SEQ ID NO: 82265 - DNA, 613 bp, Homo sapiens
  misc_feature: GYAE6OF02GZ4FO.36.34.D01.1.454.CMB.1.raw
tcagtacgctgtctcacgaccggtgctcgatttagatcgtctgtgttgggtttggggacccaaaaaccacactcctccttgggagaatcccctagatcacagctcctcaccatggactggacctggagcatccttttcttggtggcggcagcaacaggtgcccactcccaggttcacctggtgcagtctggagctgaggtgaagaagcctggggcctcagtgaaggtctcctgcaaggcttctggttacatctttaggaggtatgcaatcacctgggtgcgacacggcccctggacaagggcttgagtggagtgggatggatcgagcgcttacaagtggtaaacactaaattagtagaacagtaacgttccgagggcagagtcacatcgaaccaacaacacactaccacgacgacacacgacctacacgtggagcgtagaggacgccgtgagactacgtacgacgaccgaccgggtccgttagttacgtttacgttcggtacggggaccggggtagggggggttagttcgggttgggtacggtaccgtaccgtaccgacggtccgtacggaccgttaacccggtaacggttccgggtacccggtacccccggg

SEQ ID NO: 82266 - DNA, 936 bp, Homo sapiens
  misc_feature: GYAE6OF02HJV1W.36.34.D01.1.454.CMB.1.raw
  modified_base (221)..(221): a, c, t, g, unknown or other
  misc_feature (221)..(221): n is a, c, g, or t
tcagtacgctgtctcacgaccggtgctcgatttagatcgtctgtgttgggtttgggggagctacaacaggcaggcaggggcagcaagatggtgttgcagacccaggtcttcatttctctgttgctctggatctctggtgcctgcggggacatcgtgatcgacccagtcctccagacctccctggctgtgtctcgtgggcgaggacggccaccatacaactncgacggtccacgaccaagtagttagttttactaacgacgtcctaaccaaacaaactaaaacgtaacttaaactttaaacgttacggttaaccccaagtaccaacggaaaaccctaacggaaccacgtcccttaacccgtaaaaccttcgaccttactaacgttttaacgtacgggtacctaacgttaccccggtaaccccggggtaacggttaccccgggggttacccctaaccggtaaccccggttaactttacccggtaaacgggtttaccgggaccggtaacggggtacccgggggttaacggttaccgggggaaaccctaagggtttaacccttttacccggtaacctttacccgtaacccaacccgttaacgttaccggaaacccggacgtaaccgggtaccccttgggtaacccggtaacggttaccggtaaacggttaaacggtacgttacgggtaacgggttaaaccctttaaggtttttaaacccgtttaacggttacggtaaccttaaccgggtaacctaaaaattttacgttttaaaacgttaacggttaacctttcccggtaaccttaaccgttacccgggttttaccggaacgggggtaaccggttaaaaccggtaacgggggtaacggtaaaccggtaaaccttaccggtaaaaaaccggttaaccggttacggggtacgttaccggtactaaaccccggg

SEQ ID NO: 82267 - DNA, 681 bp, Homo sapiens
  misc_feature: GYAE6OF02FV3MT.36.34.D01.1.454.CMB.1.raw
tcagtacgctgtctcacgaccggtgctcgatttagatcgtctgtgttgggtttggggacccaaaaaccacacccctccttgggagaatcccctagatcacagctcctcaccatggactggacctggagcatccttttcttggtggcggcagcaacaggtgcccactcccaggttcacctggtgcagtctggagctgaggtgaagaagcctggggcctcagtgaaggtctcctgcaaggcttctggttacatctttaggagtatgcaatcaccgtgggtgcgacacggcccctggacaagggcttgaggtggatgggatggatcgaagcgtacttacgaatggtaaactaactaaaatttagtaggaaacctaggtaaacggttcccgaagggggtcaaggtacgtacaaccagttacggaaccaaacaaaccactaactacccgaacgacgacaaccgaacgacctaacgacgtacggacgcgttacggaaggacgaccgtaggacgacttacgtacggaaccggaccgtaccgggtaccggttagttaacgtttacgttacggtacgggacggggtagggggggttattgggtacgggtcgggtaccgtaccgtacgtacgtacgtaccggacgttaacccggtaacgttcggggttacccggtacccggtacccggggg

SEQ ID NO: 82268 - DNA, 843 bp, Homo sapiens
  misc_feature: GYAE6OF02HIHL1.36.34.D01.1.454.CMB.1.raw
tcagtacgctgtctcacgaccggtgctcgatttagatcgtctgtgttgggtttggggacccaaaaaccacacccctccttgggagaatcccctagatcacagctcctcaccatggactggacctggagcatccttttcttggtggcggcagcaacaggtgcccactcccaggttcacctggtgcagtctggagctgaggtgaagaagccgtggggcctcagtgaaggtctcctgcaaggcttctggttacatcttaggagtatgcaatcaccgtgggtgcgacacggccctggacaagggcttgagtggatgggatggatcgaggcgtacttaacgaagttacggtaaacaacgtaaaatttagtacggaaacctaaggtaaacgtttacccggaagggggtaccaaacgggaacggttaaccgaaacccgtaacgttaaccggaaacccaaaacctaaaaaccgaacctaaaccgttaaccccgaaaccggtaaacgtaacccgaaaaccgaaccggtaacccttaaacgaacggttacggggaacgtaccggttaaggaacggggtaaccgacccgttaagggaacgtaccgttacgttacggaaaccggaaccggtacccggttaccggttaggtttaaactttaaggtttacgggtacggggtaccggggggttaacgggggggggtttactttacggggttacggggtttaccgggaaccgttaacccgggttaaacccgtaaccgggttcgttaaccgggtaacccggttaaaccccggttaaaacccggtttccggggtttaacccccgggtacccccgggtttaacccggggggg

SEQ ID NO: 82269 - DNA, 778 bp, Homo sapiens
  misc_feature: GYAE6OF02GXA7D.36.34.D01.1.454.CMB.1.raw
tcagtacgctgtctcacgaccggtgctcgatttagatcgtctgtgttgggtttggggacccaaaaaccacacccctccttgggagaatcccctagatcacagctcctcaccatggactggacctggagcatccttttcttggtggcggcagcaacaggtgcccactcccaggttcacctggtgcagtctggagctgaggtgaagagccgtggggcctcagtgaaggtctcctgacaaggcttcgtggttacattcgtttaggaggtatgacaatcaccgtgggtcgcgacacggcccctggacaagggcttaggagtggagtggggatggatcgagcgtacttaacgagttacggtaacaacgtaaaattagtacgaaacgtaacgtaaacgttccgaagggtcgaaggacgtaccaaccgagtacgaaccctaacgaaacaccaactaccgaacggaacgtaccaacgaccgtacctaacgaggtacggagtaccgtaggaacggacggtaccgtaggaacggtacgtaccggtaaccggaacccggaaccgtacccggggttacccggttaggtttaacgttttacgggtttacgggtacggggtaacgggggggttagggggggggtttacgtttaggggttacggggtttacgggtaccggttaacccggttaacccgggtaacggtaccggttaaccgggtacccgttaaacccgggtaaaccgggtttacccggggtttaccccgggtacccccgggggttaacccgggggg

SEQ ID NO: 82270 - DNA, 720 bp, Homo sapiens
  misc_feature: GYAE6OF02JS7DY.36.34.D01.1.454.CMB.1.raw
  modified_base (193)..(193): a, c, t, g, unknown or other
  misc_feature (193)..(193): n is a, c, g, or t
  modified_base (217)..(217): a, c, t, g, unknown or other
  misc_feature (217)..(217): n is a, c, g, or t
  modified_base (263)..(263): a, c, t, g, unknown or other
  misc_feature (263)..(263): n is a, c, g, or t
  modified_base (318)..(318): a, c, t, g, unknown or other
  misc_feature (318)..(318): n is a, c, g, or t
tcagtacgctgtctcacgaccggtgctcgatttagatcgtctgtgttgggtttgggggacccaaaaccacacccctccttgggagaatcccctagatcacagctcctcaccatggactggacctggagcatccttttcttggtggcggcagcaacaggtgcccactcccaggttcacctggtgcagtctgganctgaggtgagagcctggggcctcngttgaaggtctcctgcaaggtcttcgtggtactatcttaggaggtntgcaatcaccgtggtcgcgaacgcggtccccgtggacgagggtcttcgaggtggngtgggagttgggatcgaacggtccgtacgttaccgaagtacggtaacgaacctaaattagtagtaactaagtaacgttccgaagggacaggtacgtacacgtacgtacgaaaccgaactaaacctacgtaacctacccgaacgagacccgacgtaccgaccgtaaccgtaggtacggaaacgtcgttacggaacgggacgtaccgtaggtacgaagttccgtacgaaccggaaacgttccgggtacccggttaatttaacgggttttaacgtcgggtttaacggggaccgggggttaggggggttaccttggggttacggtcgggtacgttacggtaaccgtacggtcgttacggtacgacccggttaacggtaccggttaccggtaccccggtacccgggg

SEQ ID NO: 82271 - DNA, 284 bp, Homo sapiens
  misc_feature: GYAE6OF02H16Q4.36.34.D01.1.454.CMB.1.raw
  modified_base (269)..(284): a, c, t, g, unknown or other
  misc_feature (269)..(284): n is a, c, g, or t
tcagtacgctgtctcacgaccggtgctcgatttagatcgtctgtgttggggggggtattgtggtggcactaccagctgctaccgaaactggttcgacccctggggccagggaaccctggtcaccgtctcctcagcctccaccaagggcccatcggtcttccccctggcaccctcctccaagagcacctcgtggggcacagcggccctgggctgcctggtcaaggactacttccagacagcgtactgagcggctggcaaggcgcagtagnnnnnnnnnnnnnnnn

SEQ ID NO: 82272 - DNA, 654 bp, Homo sapiens
  misc_feature: GYAE6OF02IGCJF.36.34.D01.1.454.CMB.1.raw
  modified_base (262)..(262): a, c, t, g, unknown or other
  misc_feature (262)..(262): n is a, c, g, or t
tcagtacgctgtctcacgaccggtgctcgatttagatcgtctgtgttgggtttggggacccaaaaaccacacccctccttgggagaatcccctagatcacagctcctcaccatggactggacctggagcattccttttcttggtgggcggcagcaacaggtgcccactcccaggttcacctggtgcagtctggagctggagtgaagaagccgtgggcctcagtgaagtctctgcaggtcttctgtacatcttaggagtatgnaatcactggtgcgacacggcccctggacgaagggcttgagtggatgggatggatcagcgtacttaacgaagttacggtaaacaactaaaattaactagaaacgtaagtaacggtacgaagggcgtaagacgtaccaaccatacggaacctaaacgaaaccgtaacgaactacccgaaacgtacgacaaccgtacgtaccgtaacgagtcgggaacgtcgtacggagtacgaccgtagagtacgtacgaacggacgtacgaaccgggtccgttagttaattacgttacggtgggtacggggtaggggggtattcgggtaggtcgaccgtaccgtaccgtagaccgtacgtacgttaccggaaaccggtcggttacccgtacccggtaccgggg

SEQ ID NO: 82273 - DNA, 669 bp, Homo sapiens
  misc_feature: GYAE6OF02IOPEA.36.34.D01.1.454.CMB.1.raw
tcagtacgctgtctcacgaccggtgctcgatttagatcgtctgtgttgggtttggggacccaaaaaccacacccctccttgggagaatcccctagatcacagctcctcaccatggactggacctggagcatccttttcttggtggcggcagcaacaggtgcccactcccaggttcacctggtgcagtctggagctgaggtgaagaagcctggggcctcagtgaaggtctcctgcaaggtcttctggttacatcgtttaggaggtatgctaatcacctgggtgacgacacggcccctggacaagggcttgagtggagtgggatgggatcgagcgcttacgatggtaacaactaatatagaacagaacgttccagggcagagtcaacgatacgaaccaacaaacacatacccgaacgacgcaacagtacctacacgtagggacgacgttaggaacgggacgtcccgtaggagtactaccggtcgaaccgggaccgaaacggggtcccgttaagtttagttaagttacgggtacggtacggggggttaagggggggttagtttacgggtcggggttcgggtaccgtacccgtaaccggtagggtacccgtacggttaacccgtaacccggtaaaccggttaccgggttcccggaaccccgggttcccggggg

SEQ ID NO: 82274 - DNA, 703 bp, Homo sapiens
  misc_feature: GYAE6OF02G2T9E.36.34.D01.1.454.CMB.1.raw
  modified_base (350)..(350): a, c, t, g, unknown or other
  misc_feature (350)..(350): n is a, c, g, or t
tcagtacgctgtctcacgaccggtgctcgatttagatcgtctgtgttgggtttggggacccaaaaaccacacccctccttgggagaatcccctagatcacagctcctcaccatggactggacctggagcatccttttcttggtggcagcagcaacaggtgcccactcccaggttcaattggtgcagtctggagctgaactgaagaagccgtgggacttagtaacgtctccgtgacgaaggtcttcgtaggttaccttcctttcttacgtatggcatcagtcgtgggtgcgacgacggccccgtaggacgaagggctcgaggtggaggtgggggtgagtcgaggacctaanaagtagttaacaactaaactagtcgacgacggaagttgacgaggacaagtatacgaacatacgaaccaacgacgaccgacgtaccgacgacgacaacgacggtacgtacaagtacggaacgtaggaggacgccgtacggaacgtaccgacgtaaccggaacgaccggacctaattacgtttaacttacggttcgtacggtacgtaaacggtaaacggtaaccgggtacgttacggttacgttagggtttaacgttaaaggtttttaaggggtttttagggggtaacgttttagggtaacgtttacggtttaaccgttttacccggtttttagtaccggtttagttaccggggg

SEQ ID NO: 82275 - DNA, 809 bp, Homo sapiens
  misc_feature: GYAE6OF02IS6U9.36.34.D01.1.454.CMB.1.raw
  modified_base (150)..(150): a, c, t, g, unknown or other
  misc_feature (150)..(150): n is a, c, g, or t
  modified_base (176)..(176): a, c, t, g, unknown or other
  misc_feature (176)..(176): n is a, c, g, or t
  modified_base (275)..(275): a, c, t, g, unknown or other
  misc_feature (275)..(275): n is a, c, g, or t
tcagtacgctgtctcacgaccggtgctcgatttagatcgtctgtgttgggtttgggtgcggggctaggctgccctcataagggcctcccagacaggagtgcagtggcctggaaggtaggaataggccagagaggcccagctgggcagggngagcagtccagggtggctctgccctntgcggcttggagtcggctgggggcgctccatcctcacgcccccacgggccctctcgtcttggtcggccttcgtccgtggttcgccttcccgtggggacncgaggccacgaggccgggacaaccccgtaggcctaacttaggtacgtcggttcggtcggtaggggacgtccgtcggggtccgttcccggtagggaccgtcccccgggtagccgaaggggacgggaccggtaccggggacccccgggtagacccgaacgtactaccgaacccgttccccccaagttaccgaaaccgtggacggtccgtaggtaaccgtcccgttacgttccggtaacccgttaaacgggtaccgtacggtaccgttacccgggaagtaccgggcccgggaacccgggttcccctttccccggtttaccttcccggtacgggacccggtcccgggtcgggtcccctaccggtccccgttgggacccctacggtcccgtaacggaacccgtaaacccgtcccccggtaacccgggttcggggtaccctttcgggaccggggtacgggtaccgaccggttacccgtacccggaccgggtaccctacccgttccgtacccggtaggtaccgtaccgttaccgtacccgg

SEQ ID NO: 82276 - DNA, 709 bp, Homo sapiens
  misc_feature: GYAE6OF02HD70N.36.34.D01.1.454.CMB.1.raw
  modified_base (295)..(295): a, c, t, g, unknown or other
  misc_feature (295)..(295): n is a, c, g, or t
  modified_base (372)..(372): a, c, t, g, unknown or other
  misc_feature (372)..(372): n is a, c, g, or t
tcagtacgctgtctcacgaccggtgctcgatttagatcgtctgtgttggggtttgggggacccaaaaaccacacccctccttgggagaactcccctagatcacagctcctcaccatggactggacctggagcatcccttttcttggtggcggcagcaacaggtgcccactcccaggttcacctggtgcagtctggagctgaggtgaagaagccgtgggggcctcaggtgaaggtctcctgcaaggcttctggttacattcgttaggaggtatgacaatcaccgtgggtcgcgacncggcccctggaacaagggcttgaggtggagtgggatcggatcaagcgacttaacaagtggtaaacactaaattcganaaacagtaacggttccagggtacagacgtaccaacgtatccgaaaccaacaaactaccaataccgacgacgacaacgacgaccgtacagtaggtacggcttacgggaacggtacgaccggtagaacgtattcggtacggaaccgtacggtaaccggcccgttagtttaacgttaacggttcggtaacggggtacggggttaacggggggggttagtttaggggtacgggtacgggtacccgaaccggttaaccggaacggttccgtacggtaacccgttaaacccggtaacccggtttaccggggttaaccccggtacccccgggttaacccggggg

SEQ ID NO: 82277 - DNA, 662 bp, Homo sapiens
  misc_feature: GYAE6OF02JFS0I.36.34.D01.1.454.CMB.1.raw
tcagtacgctgtctcacgaccggtgctcgatttagatcgtctgtgttgggtttggggacccaaaaaccacacccctccttgggagaatcccctagatcacagctcctcaccatggactggacctggagcatccttttcttggtggcggcagcaacaggtgcccactcccaggttcacctggtgcagtctggagctgaggtgaagaagcctggggcctcagtgaaggtctcctgcaaggcttctggttacatctttaggaggtatgcaatcacctgggtgcgacaggcccctggacaagggcttgaggtggagtgggatggatcgagcgacttacaagtggtaaacacaaattatagaaacaggtaacgttccgaagggcaaggagtacaacctatacgaacccaacaaacaccaactacccaacgagaccaaccaacgaccctaacagtacggacgtacgttagggaacggacgacccgtagaacgagtaccgtaggaacccgaaccgaccggggtaccggttaggtttaactttaggtttcggtacgggtacgggggtaaggggggggtttacgtttgggtacgggttcggaccgtaaccgtaccgacggtcgtacgtacgtaaccggtaacgtcgggttacccggacccggtaccggggg

SEQ ID NO: 82278 - DNA, 677 bp, Homo sapiens
  misc_feature: GYAE6OF02GTBOJ.36.34.D01.1.454.CMB.1.raw
tcagtacgctgtctcacgaccggtgctcgatttagatcgtctgtgttgggtttggggacccaaaaaccacacccctccttgggagaatcccctagatcacagctcctcaccatggactggacctggagcatccttttcttggtggcggcagcaacaggtgcccactcccaggttcacctggtgcagtctggagctgaggtgaagaagcctggggcctcagtgaggtctcctgcaggcttctgtacatcttaggaggtatgcaatcaccgtgggtgcgacgacggccccgtggacgtaagggcttggaggtggagtgggatggatcgaagtcgtacttaacaagttaggtaaaccaacgttaaatacgtagaaacgaagtaacgttccgaggggtacaaggtacggtaccaaccgtagtacgaaccctaaccaaaacaaccgtacctaaccacgtaacacccgaacgacgaccttaaacagtacgggacgtacgtacgggaaggtacggtccgtagaacggtactaccgtaggaccgtaccgaccggttcgttagttaatttacgtgggtacggacgggggttagggggttacttgggtgggtacgacggtaacgtaccggagtaccgtcgtaccgtaaccgtaaccggtccggttacccggtacccgggtaccgggg

SEQ ID NO: 82279 - DNA, 684 bp, Homo sapiens
  misc_feature: GYAE6OF02GVY0D.36.34.D01.1.454.CMB.1.raw
  modified_base (489)..(489): a, c, t, g, unknown or other
  misc_feature (489)..(489): n is a, c, g, or t
tcagtacgctgtctcacgaccggtgctcgatttagatcgtctgtgttgggtttggggacccaaaaaccacacccctccttgggagaatcccctagatcacagctcctcaccatggactggacctggagcatccttttcttggtggcggcagcaacaggtgcccactcccaggttcacctggtgcagtctggagctgaggtgaagaagcctggggcctcagtgaaggtctcctgcaaggcttcgtggttacattcgtttaggaggtatgctaatcaacgttgggtgcgacagggccaacgaggaacgaagggtcttaggaggtggtagtggggagtggggtacgtaaccctttagtaggtggtgaacgacgagtattagtcgacactaaggaacgttaccgagggacaagtaactcaactagtacgtaaccaagaacacgtactaccaaagtaacaacgtagttacaagtacggaactagaactcgtacncgtacgcgtacgagacgtaccgggtacttaagttacgttacgtagtacgaacggacggtaaacgtacgttaacggtttagttttacggacggtttaggtaacgttaaacggttacgggttaacccgggttacccggtaccccgggttaggggaacccgtaacccggggttacccggttggttaccccgtacccgg

SEQ ID NO: 82280 - DNA, 703 bp, Homo sapiens
  misc_feature: GYAE6OF02JHP8G.36.34.D01.1.454.CMB.1.raw
  modified_base (193)..(193): a, c, t, g, unknown or other
  misc_feature (193)..(193): n is a, c, g, or t
  modified_base (206)..(206): a, c, t, g, unknown or other
  misc_feature (206)..(206): n is a, c, g, or t
tcagtacgctgtctcacgaccggtgctcgatttagatcgtctgtgttgggtttggggacccaaaaccaacacccctccttgggagaatcccctagatcacagctcctcaccatggactggacctggagcatccttttcttggtggcggcagcaacaggtgcccactcccaggttcacctggtgcagtctgganctgaggtgaaganccgtgggcctcgagtgaaggtctccgtgcaaggcttcgtggtacatctttaggagtatgacaatcaccgtggtgcacacggcccctggaaccaagggcttagaggtggatagggatggactcgaggcgtacttacaagttcggtaaacactaaaagttctacgaacaggtaaggtccgaaggggctaacggacgtaccctaaacgaagtacgaaaccgaacctaaaacgtaccaaacgtaccgaaaccggtaacgtacccgaaacgtacggtaaccctaacgtactacgggaacaaccggttaggacggtaacggcgttaacgaagtaacgtacgtacggaaccgtaaccgtaccgggaccgtagggttaaaccttggtttaacggtcggggtacggggttacggggggttattgggttacgggtggtacccttacgtacccgtagtctacggccgttaaaccgtaacggttaccggttacccggaccgtaccgggg

SEQ ID NO: 82281 - DNA, 657 bp, Homo sapiens
  misc_feature: GYAE6OF02I9GUR.36.34.D01.1.454.CMB.1.raw
  modified_base (141)..(141): a, c, t, g, unknown or other
  misc_feature (141)..(141): n is a, c, g, or t
  modified_base (158)..(158): a, c, t, g, unknown or other
  misc_feature (158)..(158): n is a, c, g, or t
  modified_base (407)..(407): a, c, t, g, unknown or other
  misc_feature (407)..(407): n is a, c, g, or t
  modified_base (464)..(464): a, c, t, g, unknown or other
  misc_feature (464)..(464): n is a, c, g, or t
  modified_base (489)..(489): a, c, t, g, unknown or other
  misc_feature (489)..(489): n is a, c, g, or t
  modified_base (572)..(572): a, c, t, g, unknown or other
  misc_feature (572)..(572): n is a, c, g, or t
tcagtacgctgtctcacgaccggtgctcgatttagatcgtctgtgttgggtttggggacccaaaaaccacacccctccttgggagaatcccctagatcacagctcctcaccatggactggacctggagcattccctttttntggtggcggcagcaacnggtgcccactcccaggttcacctggtgcagtctggagctgaggtgaagagccgtgggcctcagtgaaggtctctgcagctcgtgttacatcttaggagtactgctaatcaccgtgggtacgacgaccgacgggccccttagggaacgaacgggtctttaggaggttaggagttcggggatgggaactcgaaggccgtaacttaacgaagtcggtaacactaaattcagaacagtactcgaaggctaagngtacaacgatacgaactaacaactacgactaccgacgagacctacgactacccgtanagtacggacgacgttaggacggacnccgtagagtcgtactacggaaccgtacggacgtccggttagttaacgttcggttacggacggtacggggggttaagggggttnttcgggtacggtcggaccgttaaccgtacgtaccggtcggtacgttaaccgtacggtaaccgttcggtacccggacccggtcggg

SEQ ID NO: 82282 - DNA, 888 bp, Homo sapiens
  misc_feature: GYAE6OF02FFNB1.36.34.D01.1.454.CMB.1.raw
  modified_base (192)..(192): a, c, t, g, unknown or other
  misc_feature (192)..(192): n is a, c, g, or t
tcagtacgctgtctcacgaccggtgctcgatttagatcgtctgtgttgggtttggggacccaaaaaccacacccctccttgggagaatcccctagatcacagctcctcaccatggactggacctggagcatccttttctggtgcggcagcaacaggtcgcccactcccaggttcacctggtgcagtctgganctgaggtgaagagccgtgggccctcagtgaaggtccctccgtgaccaaggtcttcgtggtttaaccagttccgtttaagggagttacgtggacctaactccgaacccgttcggggtacgaccggtaaccgaccgggtaccccccgtagggtaaccgtaacgggggtcctttagggtaacggttcggggtaagttacgggggtaattcgggtaacctaccggtaacggtacccggtacccgttttaaaaccgtaaaaggttaaccggggtttaaaacccaaaccgtttaaaaagttttacggtaaccggtaaaaaccgtacggttaaacgggttttaccccggaagggggtttaacccgaaacggggtaaccgttaaccccgaaacccgttacgttaacccgggtaaaacccctaaaacccgaaaacccgtaaccgttaacccgttaacccgaaacccgggtaaccgaccccgtaaacccgaccgtaacccgtaaccgtaacggtacgggacgtaccggttaggaacggtacgtaccgtagacgtacgtacgtcgaacgaccgacggtccgttagttacgtgttacggcggtacggggtagggggttactgggtcggtacggacctaccgtaacgtaccgtaccgtacgtaccgtaacccgttaaccggtcggttaccccgtacccggtacccgggg

SEQ ID NO: 82283 - DNA, 699 bp, Homo sapiens
  misc_feature: GYAE6OF02JPOZZ.36.34.D01.1.454.CMB.1.raw
  modified_base (361)..(361): a, c, t, g, unknown or other
  misc_feature (361)..(361): n is a, c, g, or t
  modified_base (512)..(512): a, c, t, g, unknown or other
  misc_feature (512)..(512): n is a, c, g, or t
tcagtacgctgtctcacgaccggtgctcgatttagatcgtctgtgttgggtttgggggagctacaacaggcaggcaggggcagcaagatggtgttgcagacccaggtcttcatttctctgttgctctggatctctggtgcctggcggggacatcgtgatcgacccagtctccagcctcccgtggctgtcgtctcgtgggcgaggacggcccaccatacaactgacgacggtccacgccaggtagttgttttaacacagtcctaccaaactaataaacgaaccttaacttaaacttcggtaaccagtacaaacgaaaccgaggaacacgtaccctaacctaactcgacctactagtttacgnggactacgtaccggtaacccgggaacgttccccggggtacctacggtaaccgtacgtttacgaacggttcgggaccgtacgggtccgggtacgtacggggtaaactaggttactttccgaccgttacctaccgtaactacgtacgacgacncgtctacgacggtacgtacgtagaacgtagttcgggtactacgtttaagtttacctacggttctaacgtactaagtaaatttacgttagttacgttacttccgtattaccgtacgggttaccggacgggtaacggaacgtagggtaacgacgtaacgtacgtaacggtactgggtctagtccgaacc

SEQ ID NO: 82284 - DNA, 674 bp, Homo sapiens
  misc_feature: GYAE6OF02IYJEL.36.34.D01.1.454.CMB.1.raw
  modified_base (448)..(448): a, c, t, g, unknown or other
  misc_feature (448)..(448): n is a, c, g, or t
  modified_base (484)..(484): a, c, t, g, unknown or other
  misc_feature (484)..(484): n is a, c, g, or t
  modified_base (533)..(533): a, c, t, g, unknown or other
  misc_feature (533)..(533): n is a, c, g, or t
tcagtacgctgtctcacgaccggtgctcgatttagatcgtctgtgttgggtttggggacccaaaaaccacacccctccttgggagaatcccctagatcacagctcctcaccatggactggacctggagcattccttttcttggtggcggcaggcaacaggtcgcccacctcccaggttcacctggtgcagtctggagctgaggtgaaggaacgccgtggggcctcgaggtagaacggtccttccgtgcgtaaaggtcttcgtcggttaaccattcgttagggaggtatgacaatcgaccgtgggtcacgacgaccggccccgtggaaccgtacgggtcttaggaggtaggacgtggggagtaggatcgtaagccgtacttaacagtacggtaacactaaattacgtagaaacgagtaacgttcgaagggacgtacgacgtacgactanacgaaccaacaacactatacccgaacgaacgccaanacgacctacgagtacggatcggtaggacggacgtcgtagagtcgtaacngaaccgtacggcgtacgttcgttaacgtttgtacgggttacggagggggttagggggttactgggtcgggtcgtaccgtaacgtcgaccgtcgtacggaacccgtaaccggtacggttaccggtaccggacccggtcgggg

SEQ ID NO: 82285 - DNA, 742 bp, Homo sapiens
  misc_feature: GYAE6OF02IEXTX.36.34.D01.1.454.CMB.1.raw
tcagtacgctgtctcacgaccggtgctcgatttagatcgtctgtgttgggtttggggacccaaaaaccacacccctccttgggagaatcccctagatcacagctcctcaccatggactggacctggagcattccttttcttggtggcggcagcaacaggtcgcccactcccaggttcaccgtggtgcagtctggagctggaggtgaagagccgtgggcctcgagtgaaggtctcctgcaggtctttcgtggttacattcgtttagggagtatcgactaatccgaccgtgggtcgcgtacacggcccctaggacgagggtcttggagtggagtgggatggatcgagcgtacttaacaagttacggtaaacaacgttaaattcgtaacgtaaacgaggttaaacgttccggaagggactaacggacttcgaaactacgtaccggaaaccaaacaaaccgtacctactacccgaacggaaccaccaacgtaccgtacctaacgagttacgggacgtacgttacgggacgtacgtaccgaggaacgtacgttcgtaacggaaccggtaccgtaccgggtcgttagttaacgtttcggttacgggtacggggttacggggggtagggggggtttacttgggggtttacgggtacgggtaccgttaaccgtaccggacggtccgtaccgtaaccggtaacccggttaacggtttaccggttaccccggtacccgggttaacccggggg

SEQ ID NO: 82286 - DNA, 861 bp, Homo sapiens
  misc_feature: GYAE6OF02I7ZA4.36.34.D01.1.454.CMB.1.raw
  modified_base (130)..(130): a, c, t, g, unknown or other
  misc_feature (130)..(130): n is a, c, g, or t
  modified_base (142)..(142): a, c, t, g, unknown or other
  misc_feature (142)..(142): n is a, c, g, or t
  modified_base (153)..(153): a, c, t, g, unknown or other
  misc_feature (153)..(153): n is a, c, g, or t
  modified_base (169)..(169): a, c, t, g, unknown or other
  misc_feature (169)..(169): n is a, c, g, or t
tcagtacgctgtctcacgaccggtgctcgatttagatcgtctgtgttggggtttggggacccaaaaaccacacccctccttgggagaatcccctagatcacagctcctcaccatggactggacctggacncacttccttttntgggtggcggngacgcgaacgaggtcncccacctccgaggttccaccgtggtgctagttcgtggacgtctggagggtagaaaggaacgtccggtcggggccctacgtaggtacggaaacggtcctaccgtgacaaacgggttccttacggtacggttaactacgtttaggtttaagggaagttatcgtactaaacttccgtaccggttgggtacgacgtaaccgaccggtccccgtaggaacccggaaagggtccgtttaggaggttaggtaggtaggggtaagtgggtaactacgaacggtccgtaccgttaactaaagggttacggtaaaacctaaacggttaaattaacgtaacgaaaacggtaacggttaaacggttccggaaagggtacgaaacggtacgtaacgaaccgtaagtaccgaaaacccaacttaaaacgactaacccgtaccgaaaccggaacggaaacctaacggaaccgtacctaaacggacgttaggggaaactcgttaagggaccgtacgcgttacggactacgttacgaggaacccgacggaccggttagtacttaacgttttagtacggtaggggtaggggggaccggggtttagttcgggaacggtccggaacgttaaccggacgtaacgtcggtaccggttaacgtaaaccccgggttaagtttccccggggtacccgggttaccccgggtaccgggg

SEQ ID NO: 82287 - DNA, 678 bp, Homo sapiens
  misc_feature: GYAE6OF02GDDPY.36.34.D01.1.454.CMB.1.raw
  modified_base (471)..(471): a, c, t, g, unknown or other
  misc_feature (471)..(471): n is a, c, g, or t
tcagtacgctgtctcacgaccggtgctcgatttagatcgtctgtgttgggtttggggacccaaaaaaccacacccctccttgggagaatcccctagatcacagctcctcaccatggactggacctggagcatccttttcttggtggcggcagcaacaggtgcccactcccaggttcacctggtgcagtctggagctgaggtgaagaagccgtgggggcctcgaggtgaagggtctcctgcaaggtcttctggttactattcgtttaggagtatgcaatcacgtgggtgcgacacggcccctaggacgaagggtcttggagtggagtgggagtggatcgagtcgacttacgaagttacggtaacaactaaagttatacgaaacaagtaagttccgaagggtcaaggacgtcaaccagtacgaaccaaacaaacacactaccacgacgaccacacgaccttaacaggtcgganccgtagaacggtcgacgtagactactcgtacgaaccggtacgaccgggtaccggtttagtaacgttttcgttagggtacgggtacggggggttagggggggttattcggggttacgggtcggtaccgttaacggtaccgtaggtcctacggtacccggtaaaccggttaaccggtccggggttaccccgtaccccgggtaccggggg

SEQ ID NO: 82288 - DNA, 600 bp, Homo sapiens
  misc_feature: GYAE6OF02JFT6Q.36.34.D01.1.454.CMB.1.raw
  modified_base (321)..(321): a, c, t, g, unknown or other
  misc_feature (321)..(321): n is a, c, g, or t
  modified_base (352)..(352): a, c, t, g, unknown or other
  misc_feature (352)..(352): n is a, c, g, or t
  modified_base (361)..(361): a, c, t, g, unknown or other
  misc_feature (361)..(361): n is a, c, g, or t
tcagtacgctgtctcacgaccggtgctcgatttagatcgtctgtgttgggtttgggggaagaggaagactgacggtcctgccacaggtggtgctgggcacggtgggcactcgacacaacatttgcgctcaactgtcttgttctccttgttgctatttttagaaggtttccagtgtgaggtgcagttggtggagtctgggggaggcttggtacagcctggggggtccctgagactctcctgtgcagcctctggtttcatctttagcaactacgccatgagcgtgggtccgccaggctaccgagggagggctggagtgggtcncgaggtattacgtggtagtacggtaatccgnatactacgnagactccgtgacggccgttcacgtctcgagagactatcgaagtatacggtactagtctggaaatgaacagcctagagtacgcccggaagtccgacggtcccttcgtaactttacgtgtacgcggtaagacgattaccggagaaacgggagttacgaggtaccaaggtctaccggacttcgacgttaacctacgggtccgggaaccccgaaccggttaaccccgtggtacccctacccgg

SEQ ID NO: 82289 - DNA, 822 bp, Homo sapiens
  misc_feature: GYAE6OF02GNNSY.36.34.D01.1.454.CMB.1.raw
  modified_base (586)..(586): a, c, t, g, unknown or other
  misc_feature (586)..(586): n is a, c, g, or t
tcagtacgctgtctcacgaccggtgctcgatttagatcgtctgtgttgggtttgggacccaaaaaccacacccctccttgggagaatcccctagatcacagctcctcaccatggactggacctgagcatccttttctggtggcggcagcaacaggtcgcccactcccaggttcacctggtgcagtctggagctgaggtgaagaacgccgtggggcctcgagtggaaggtcctccgtgacgaaggtccttcgtaggttaacctagttcgtttagggaggttagtgacaatccgtaccgttggggtgaccggaaccgaccgggtcccccgtaggaaccggtaacggggtccgttggaggttgggaacggttgggaagtgggacgtaccgaggacgttacgttaacgaagttaacggtaaaccgtaaacttaaaagttacgtaacgaaacgtaacgtaacggttacccggaagggaccgaagtaccgttaccaaccgtaacgtaaccgaacccaaacctaaaaccacctacgtaacccgaacgtaaacgccgaaaccacggttaccctaacgaagttcggaacgtcggnggtaacgggacgtaccgtgaaacgttcgtaaccggcgaaaccggtaacccgtcgggtaccgtttaagtttaagtttcggggttacggacggggttcgggggggtaggggttttacgttagggggttcggggtaccgtaccggtaaccggtacccgtaacgggtcctaacggtaaccccgttaacgggtaacccgggttttaccggggtacccccgggttcccgggaaccccggggg

SEQ ID NO: 82290 - DNA, 686 bp, Homo sapiens
  misc_feature: GYAE6OF02G22XH.36.34.D01.1.454.CMB.1.raw
  modified_base (286)..(286): a, c, t, g, unknown or other
  misc_feature (286)..(286): n is a, c, g, or t
tcagtacgctgtctcacgaccggtgctcgatttagatcgtctgtgttgggtttggggacccaaaaaccacacccctccttgggagaatcccctagatcacagctcctcaccatggactggacctggagcatccttttcttggtggcggcagcaacaggtgcccactcccaggttcacctggtgcagtctggagctgaggtgaagaagccgtggggcctcgagtgaaggtctcctgcaaggcttctggttacattcttaggaggtatgcaatcacctgggtgcgacncggcccctggacaagggcttggagtggacgtggggatggatcgagccgacttacgaagttggtaaacaactaaaattagtagaaacaggtaaacgttccgaaggggcaaggtacgtaccaaccgatccgaaacctaacgaaaccacgactacccgacgaagacccgaacacgaccgtaacagtaggacgactacggacggcgtacgtagacgtacgttcgacgtaccggaaccgtaccgggtacgtacgttagtttagtacggtagggtaccgggggttagggggggttactttgggggtcgggtcgggttaaccgtacggtaccggtagtccgttcgggtacccgttaacccggtaacgggtttaccggttacccgggtaccccgggttaacccggggg

SEQ ID NO: 82291 - DNA, 643 bp, Homo sapiens
  misc_feature: GYAE6OF02JLXX6.36.34.D01.1.454.CMB.1.raw
  modified_base (259)..(259): a, c, t, g, unknown or other
  misc_feature (259)..(259): n is a, c, g, or t
  modified_base (263)..(263): a, c, t, g, unknown or other
  misc_feature (263)..(263): n is a, c, g, or t
tcagtacgctgtctcacgaccggtgctcgatttagatcgtctgtgttgggtttgggggacccaaaaccacacccctccttgggagaatcccctagatcacagctcctcaccatggactggacctggagcatccttttcttggtggcggcagcaacaggtgcccactcccaggttcacctgtgcagtctggagctgaggtgaagagcctggggcctcagtgaaggtctccgtgcgaagcttctggttacattcgttaggngtangacaattcaccgtggtgcacgacggcccctggaaccaggcttagaggtcggagtgggagtggactcgaggcgtcttaacgagtaggtaaacactaaattagacgaacgaaggtaacgtccggaaggtcaggagttccactagtcacaaccaacgacagtacccaacgagaccgacagaccgtaactacgagtacgagtcggtaggacgccgtagacgaacgtcgtaccgacgtacggaccggtcgttagttatttacggtggtcgggacgggttagggggtactttagggtcgggttaacgtacggtaccctacggtccgtaccgttaccggacggttaaccccgtaagggttcccggttaccgtacccgggtaccgggg

SEQ ID NO: 82292 - DNA, 680 bp, Homo sapiens
  misc_feature: GYAE6OF02JSD59.36.34.D01.1.454.CMB.1.raw
  modified_base (267)..(267): a, c, t, g, unknown or other
  misc_feature (267)..(267): n is a, c, g, or t
  modified_base (270)..(270): a, c, t, g, unknown or other
  misc_feature (270)..(270): n is a, c, g, or t
  modified_base (288)..(288): a, c, t, g, unknown or other
  misc_feature (288)..(288): n is a, c, g, or t
  modified_base (378)..(378): a, c, t, g, unknown or other
  misc_feature (378)..(378): n is a, c, g, or t
  modified_base (420)..(420): a, c, t, g, unknown or other
  misc_feature (420)..(420): n is a, c, g, or t
  modified_base (456)..(456): a, c, t, g, unknown or other
  misc_feature (456)..(456): n is a, c, g, or t
  modified_base (486)..(486): a, c, t, g, unknown or other
  misc_feature (486)..(486): n is a, c, g, or t
tcagtacgctgtctcacgaccggtgctcgatttagatcgtctgtgttgggtttggggacccaaaaccacaccctccttgggagaatccctagatcacagctcctcaccatggactggacctggagcattcctttttctttggttgggccgggcagcaacaggtgcccacctcccaggttcacctggtgcagtctggagctgaggtgagaagccgtgggcctcagtgaaggtctcctgcaaggcttctggtacattctttagggagtntgnaatcactgggtgcgtacncggcccctggacgaagggtccttaggaggttggagtaggggatgggtatcgaggtcgctttaacgaagtggtaaaccactaaacgtttanaggtaaacagtaaacgtttcgagggacgaagcgtacaaccgngttacggaaccaacgaaactcaactcccgaagtacncaacgacaccgtaacgcgtaagggaccgtntacggaggacgtacctaggtaagtaccttcggtacgtaacccggacggtaccgggttaacgaccgttttagtaacctttgggaccggtgggggttagggggtagttttgggtacggtcggtcggtaacttacccggagtccgtaacggttcaaaccgggttaccgtacggtttaccggcccggttaacccgggg

SEQ ID NO: 82293 - DNA, 747 bp, Homo sapiens
  misc_feature: GYAE6OF02IRU3M.36.34.D01.1.454.CMB.1.raw
tcagtacgctgtctcacgaccggtgctcgatttagatcgtctgtgttgggtttggggacccaaaaaccacacccctccttgggagaatcccctagatcacagctcctcaccatggactggacctggagcatccttttctggtggcggcagcaacaggtgcccactcccgaggttcacctggtgcagtcgtggagctgaggtagaagagccgtggggcctcgaggtgaggtctcctgcgaaggtcttcgtggttacagttacgttaggagtatgacaatcctaccgtgggtcgaccgacgaccggtcccccgtaggaacgaagggtcgttggagggtaggtacggttaggggacgtagggtacgtacggacggtccgtaccgttaacgaagttacgggtaaactaacgtaaaagttagtaacgtaaacgtaacggtaacgttaccggaagggctaaggacgttaccaaccgtgtaaccgaacccgaaacccaaaactacaaccgtacccgaaaccgtacgacccgaacgacccgtaacccgtaacgtaagtacggacgggtacctaagggtaacggacggtactacggagacgtcgtacgacggacccgtaacggtccgttagttagtttaggcggttacggggaggggtaaggggggtttagttgggtacgggttggacctaacggtaccgtagtcgtacgttaccggtaaccggtacggtccggttacccggaccggtacccgggg

SEQ ID NO: 82294 - DNA, 704 bp, Homo sapiens
  misc_feature: GYAE6OF02FJ77F.36.34.D01.1.454.CMB.1.raw
  modified_base (279)..(279): a, c, t, g, unknown or other
  misc_feature (279)..(279): n is a, c, g, or t
tcagtacgctgtctcacgaccggtgctcgatttagatcgtctgtgttgggtttggggacccaaaaaccacacccctccttgggagaatcccctagatcacagctcctcaccatggactggacctggagcatccttttcttggtggcggcagcaacaggtgcccactcccaggttcacctggtgcagtctggagctgaggtgaagagcctgggcctcagtgaaggtctcctgcaaggcttctggttacattctttaggaggtatgcaatcaccgtgggtncgacgaggccccgtggacaagggcttgaggtggagtgggtatggtaatcgaggccgtacttaacaagtacgggtaaacaactaaaagtttagagtaaaccgtaaggtaacgttaccggagggactaaggacgtaccgaaccgattacggaaacccaacaaaccactaactaccaacgacgacaacgacgacctaacgtagtcggagtcgtaggacggagccgtagacgtacgttcgtaggtaaccgaccgtaccgggtacgtttagtttagtttaagttacgggtgggtaccgggggtaaggggggggtttacgttcggggttaggggttacgggaccgttaaccggtacccgtaggtaccgttcggtaaccggttaacccggtaacggttcccgggtttacccggacccgggttaacccggggg

SEQ ID NO: 82295 - DNA, 718 bp, Homo sapiens
  misc_feature: GYAE6OF02G7RAK.36.34.D01.1.454.CMB.1.raw
tcagtacgctgtctcacgaccggtgctcgatttagatcgtctgtgttgggtttggggacccaaaaaccacacccctccttgggagaatcccctagatcacagctcctcaccatggactggacctggagcatccttttcttggtggcggcagaaacaggtgcccactcccaggttcacctggtgcagtctggagctgaggtgaagaagcctgaggcctcagtgaaggtctcctgcaaggcttctggttacatctttaggagtatgcatcacgtgggtgcgacgacggccccgtggaacgaagggcttggacggtggagtgggagtgggatcgaggcgtacttaacaagtacggtaacaacgtaaattatagaaacaacggtaacgttaccggagggacgtaagacgtacaacctagtacgaacccaaaccaaacactacacccgaacgacgaccaaccacgtacctaacgtacgtacgggacgtacgtacggacgggacgtaccgtaaggaacgtacgtaccggtacggaaccgaacccgggtccgggtaccgttaaggtttaacgtttaggttacgggttacgggtacggggggttagggggggtttacgtttggggttacgggtacgggtaccgtaaccggtaaccgtacgtacggttaccgtaccgttaaccggtaaccggttacccgggttacccggtacccgggtacccggggg

SEQ ID NO: 82296 - DNA, 658 bp, Homo sapiens
  misc_feature: GYAE6OF02FRCI1.36.34.D01.1.454.CMB.1.raw
  modified_base (357)..(357): a, c, t, g, unknown or other
  misc_feature (357)..(357): n is a, c, g, or t
tcagtacgctgtctcacgaccggtgctcgatttagatcgtctgtgttgggtttgggggacccaaaaaccacacccctccttgggagaatcccctagatcacagctcctcaccatggactggacctggagcatccttttcttggtggcggcagcaacaggtgcccactcccaggttcacctggtgcagtctggagctgaggtgaagaagcctggggcctcagtgaaggtctcctgcaaggcttctggttacattctttaggaggtatgcaatcacgtgggtgcgacgacggcccctggacaagggctggagtggagtgggatggatcgagcgcttaacaatggtaacactaaagttanagaacagaagttccgagggacagtagtacgaacagtagaccaacaaacacactaccacgacgacaacgagaccctaacacgtacggagacgtgaaggacgtaccgtagaagtactcgtacggacggaccgaccgggtacgttacgttaagtttacgtttggtagggtcgggggtaagggggggtttagtttagggtggggttacgggacccgttaaccggtaacccgtacggtaccgtacggttaccgttaaacccgggtaacggttaccgggtttacccggaccccgggttacccggggg

SEQ ID NO: 82297 - DNA, 776 bp, Homo sapiens
  misc_feature: GYAE6OF02FF582.36.34.D01.1.454.CMB.1.raw
  modified_base (193)..(193): a, c, t, g, unknown or other
  misc_feature (193)..(193): n is a, c, g, or t
tcagtacgctgtctcacgaccggtgctcgatttagatcgtctgtgttggggtttggggacccaaaaaccacacccctccttgggagaatcccctagatcacagctcctcaccatggactggacctggagcatccttttcttggtggcggcagcaacaggtgccactcccaggttcacctggtgcagtctgganctgaggtgaagagcctggggcctcagtgaaggtcctcctgcaaggcttctggttacattctttaggaggttatggacatcaccgttgggtgcgacacggcccctaggacagggcttggagtggatgggactggatcgagccgacttaacaacgttggtaacaacgtaaatttacagaaaccgtaaggtaaacgtttccgaaggggacaacggtacgtaccgaacccgtaagttaccggaaacccaaacaaaaccgacctaacgtacccgaacgtaacggacctaaaccgtacggaaccctaacgtaactacggaacggtacgttacgggaacgggtacgacccgtacgggtaactacgttacggttacggaaccgtaacccggtaaccgggttccggttagtttaaacgttagtttacgggttacgggtaccggggggtaaaggggggggtttacttacgggggttagggttacgggtaccggtacccggttaacccggaggttaccgttacggtaccccggtttaaaccccgggtaagttttacccggggttacccggttacccccggggtaacccgggggg

SEQ ID NO: 82298 - DNA, 594 bp, Homo sapiens
  misc_feature: GYAE6OF02GDBDM.36.34.D01.1.454.CMB.1.raw
  modified_base (351)..(351): a, c, t, g, unknown or other
  misc_feature (351)..(351): n is a, c, g, or t
tcagtacgctgtctcacgaccggtgctcgatttagatcgtctgtgttgggtttggggacccaaaaaccacacccctccttgggagaatcccctagatcacagctcctcaccatggactggacctggagcatccttttcttggtggcggcagcaacaggtgcccactcccaggttcacctggtgcagtctggagctgaggtgaagaagcctggggcctcgagtgaaggtctcctgcaaggcttctggttacatctttaggagtatgcaatcactgggtgcgacaggcccctggacaaggtctgagtggatggatggatcagccgcttaacaagtcggtaacactaaagttanagaaccaggaagttccgaagggcaggagtacaccatacgaaccaacaaacacactccacgagacacacgcctacagtacggagcgtaggaggacgccgtagaacgtatcgtagaaccggacgaccgggtccgttagttagttagtggtaggcgggggtagggggtattggtgggtcggacgtaccgtaccgagtcgtacgaccgttaaaccgaacgttcggttacccgacccggttaccgggg

SEQ ID NO: 82299 - DNA, 822 bp, Homo sapiens
  misc_feature: GYAE6OF02FZXR9.36.34.D01.1.454.CMB.1.raw
  modified_base (156)..(156): a, c, t, g, unknown or other
  misc_feature (156)..(156): n is a, c, g, or t
tcagtacgctgtctcacgaccggtgctcgatttagatcgtctgtgttgggtttggggacccaaaaaccacacccctccttgggagaatcccctagatcacagctcctcaccatggactggacctggagcatccttttcttggtggcggcagcaacnggtgcccactcccaggttcacctggtgcagtctggagctgaggtgaaggaacgccgtggggcctcaggtgaaggtcctccgtgcgaaggcttctggttacagttcgtttaagggaggtatgcatacaccgtgggcgacgacgacggccccgtggaacgaacgggtcgtggagtggtagtgggagtggagtcgagacgtcttaacgaagttacggtaaactaacgtaaaagttaacgtacgtaaacgtacgtaacgttaccggaacggggctaaacggtacgtaccgaaccgtaacttacggaaaccccgtaaacgaaaaacccgtacgtaaccgttaacccgaaaccggtaaaccgacccgtaaaccggaacgttaccccgtaaacggtaacggttaccggggtaacgtcggtaacgggtaacgtaacgggtacccgttaagggacgttaacggttaccgttaacgggaacccggttaaccggtacccgggtaccggtttacgtttaacggtttacggtttcgggtaagggggtaccggggggttagggggggttacgttggggttacgggtcgggtaacgtaccggtaaccggtacgtaccggtacggtaccggttaaccggtaaccggttaccgggttacccgggtaccccgggttaaccgggg

SEQ ID NO: 82300 - DNA, 749 bp, Homo sapiens
  misc_feature: GYAE6OF02JOP5V.36.34.D01.1.454.CMB.1.raw
  modified_base (198)..(198): a, c, t, g, unknown or other
  misc_feature (198)..(198): n is a, c, g, or t
  modified_base (254)..(254): a, c, t, g, unknown or other
  misc_feature (254)..(254): n is a, c, g, or t
  modified_base (581)..(581): a, c, t, g, unknown or other
  misc_feature (581)..(581): n is a, c, g, or t
  modified_base (637)..(637): a, c, t, g, unknown or other
  misc_feature (637)..(637): n is a, c, g, or t
tcagtacgctgtctcacgaccggtgctcgatttagatcgtctgtgttgggtttgggggagctacaacaggcaggcaggggcagcaagatggtgttgcagacccaggtcttcatttctctgttgctctggatctctggtgccgtggcggggacagttcgtgatcgaccctagtcctcacgctcccgtggctgtgtctgngggacgaggacggccacatcaactggcacggtccacgccgagtacgttagttttanaaccagtcctaccaaactaaattaaacgaaaccttaacctttaaaccgttacggttaaccaacgacgtaaacgaaacccgaaggtaaccacgtaccttaccctaaaccgttcgaccctacttaagtttaaccggtacggacctaacgttacccggtaaacccgggtaaccggttcccggggtaccctacggaacccggttgtaaccgtacggtacggtacgtacgggtcggttacggtacgggaacgttacgtaacgtttaccgaaccgtttccacgtaaccgtacgtacacgtaccgactccgtcgacgtacgtacgagttaaagngtacgtagtcgttattactcgtcggtactaagtaacgtaatttagttaaaccgttnttaccgtaccgttacggtactttacccgggtacggtaaccgggtacggtaaccgtaggggtaacgaaccgttatacgggtaactaacgggttcggtagtcgttaccgtaccg

SEQ ID NO: 82301 - DNA, 727 bp, Homo sapiens
  misc_feature: GYAE6OF02H6A8B.36.34.D01.1.454.CMB.1.raw
  modified_base (258)..(258): a, c, t, g, unknown or other
  misc_feature (258)..(258): n is a, c, g, or t
tcagtacgctgtctcacgaccggtgctcgatttagatcgtctgtgttgggtttggggacccaaaaaccacacccctccttgggagaatcccctagatcacagctcctcaccatggactggacctggagcatccttttcttggtggcggcagcaacaggtgcccactcccaggttcacctggtgcagtctggagctggaggtgaagaacgccgtggggcctcagtgaaggtgtcctgcaagcttcgaggatacaccttnactagtttatgaaatcaacgtgggtgacgacgaggccacgaggacgaagggtcgttaggagtggtagtggggagttagggtacgtaacccgtttaagtacggtaggtcgaacgaacgaagtagtttaagtcggacaacgtaggtaaacgttccggaagggacaacggtaactaccgaaacctagtacgaaccgaaacgaaaccgtacgtacccgtaacctaaactaaaaccgaaaccgttaaacgtttaacgaacgttaacggaaacgttacgaaaccgtaacgtttacgtaggaccgtacgtaaccggaacggaaccggaccgggtaaccgttattaacttagtcgtagacgaagacgaacgtaacgttagttttcggtacgtggtaaggtaacgttaacggtaacgggttaccggtacccggtacgggtacccggaacgggtaacccgttcggtacccgttacccgg

SEQ ID NO: 82302 - DNA, 935 bp, Homo sapiens
  misc_feature: GYAE6OF02IZYAB.36.34.D01.1.454.CMB.1.raw
tcagtacgctgtctcacgaccggtgctcgatttagatcgtctgtgttgggtttggggacccaaaaaccacacccctccttgggagaatcccctagatcacagctcctcaccatggactggacctggagcattccttttcttggtggcggcagcaacaggtgcccactcccaggtttcaccgtggtgcagtcgtggagctgaggtgaagacgccgtgggcctcgagtgtaaggtctccgtgcaggtcttcgtggttacattcgttaggaggtatgactagtctaccgtgggtcgccgacgaccggtccccgtagggaacgtaacgggtcgttaggtaacgggtcgggaacggtaggggtacggtcggggtaacgttaccggaacgtccggttaaccgtttaaacgtaaacggttaaacggttaaaacccgtaaacttaaaaacgttttaaaccggtaacgtaaaaaccgtaaacggttaaacggtttaccccggaaaggggtacccgtaaacggtacggtaaccccaaccgttaacgaaccggtaaaccccgaaaaccgaaaaccgtaccaaccgtaaccccggtaaaccgaaccgacccaaacgtaccgaccgtaaactacggtacggacgtacggaaggaccgggtacgtaccggtagtaccggtaagtacgtaacggtaacccgaccgggtaaccggttaccgttaacggtttttacgttaagggttttacgggtacgggggttacgggggggttaacgggggggtttacggtttaccgggtttacggggtacgggttaaccccggtaaccggttaccccgtaacgggttaacccgggtttaccccgggttaaacccgttaaaacccggggttaaccggggttttacccccgggtttacccccggggtaacccccgggttaacccgggggggg

SEQ ID NO: 82303 - DNA, 809 bp, Homo sapiens
  misc_feature: GYAE6OF02JZUVY.36.34.D01.1.454.CMB.1.raw
tcagtacgctgtctcacgaccggtgctcgatttagatcgtctgtgttgggtttggggacccaaaaccacacccctccttgggagaatcccctagatcacagctcctcaccatggactggacctggagcattccttttcttgggtggcggcagcaacgaggtcgcccacctcccaggttcacccgtggtgcagttctggagctggagggtagaaggacgccgtcggggcctcgaggtgaacgggtcctcctggcgaaggtcttccgtaggttacattacgtttagggagttactcggactaactcaccggttggggcgtcgacgaccgggtccccgtagggacgtaacgggtctttaggacgggtaggtagtaggggtattagggtactacggacggtccggttacttaaacgaaaggttacgtaacgaaacttaaacgtttaagacgtaacgtaacggtttaacggttaccggaggtacgaacggtacgtaccacctaaggtaccgaacccgtaaacgtaaccaacgtacgtacccaacgggtaccgacctaaccgaacgtaccgtaacgtacggtacggtacgtacgtaagggaggtaaccggtcgtaacgacgtacgttacgtacggtaacggaccggtaccggttcgttaacgtttacgttacggttacgggtacgggttaccggggggtaggggttacgttacggggtcgggttcggtaccgtaaccggtaaccgtacgtaccggtttacgaaccggtttaaccggtaaccggtttccgggtacccggtacccgggtaaccgggg

SEQ ID NO: 82304 - DNA, 861 bp, Homo sapiens
  misc_feature: GYAE6OF02G5CBY.36.34.D01.1.454.CMB.1.raw
  modified_base (197)..(197): a, c, t, g, unknown or other
  misc_feature (197)..(197): n is a, c, g, or t
  modified_base (287)..(287): a, c, t, g, unknown or other
  misc_feature (287)..(287): n is a, c, g, or t
  modified_base (307)..(307): a, c, t, g, unknown or other
  misc_feature (307)..(307): n is a, c, g, or t
tcagtacgctgtctcacgaccggtgctcgatttagatcgtctgtgttgggtttggggacccaaaaccacacccctccttgggagaatcccctagatcacagctcctcaccatggactggacctggagctatccttttcgttggtggcggcagcaacaggtcgcccactcccaggttcaccgtggtgcagtcgtggancgtagaggtgaagacgccgtggggcctcgacgtggacggtctcctgacgaaggtcttcgtggttactattcgtttaggtaggtattacgntaaccgtacgtaccgtgggngtaccgaccgaaccggccccgtaggacgaacgggttcgtttagagggttcggaagtggggtacctaggtacgtcgacggtcgtaccttaacgtaacggttacggtaaactaacctaaaagttacgacgtaaaccgaggtttaaccgtaccggtaagggtaacgaagggtacctacgtaacccgtaggtaaccgaaccgtaaccaaaaacgtcgaaacccgtaccgtaacgaaccgactaaccgtaaccgtaccgtacgtaacgtagggtaacacggtaacggtaaacggacggtaccgttagaacgtaccgtaacgaccgggtacgtaacccgggaccgttacccggttaagtttaccgtttaagggttacgggttaccggggaccggggtttacgggggggttagtttacggggtttaaccggggttccgggttaaacccgttacggtaacccgttacggggttaacccgttaccggggttacccggttaaaacccggttacccggggtttaaccgggttacccccgggtaacccgggttaccccccgggggg

SEQ ID NO: 82305 - DNA, 1010 bp, Homo sapiens
  misc_feature: GYAE6OF02H8AGW.36.34.D01.1.454.CMB.1.raw
  modified_base (194)..(194): a, c, t, g, unknown or other
  misc_feature (194)..(194): n is a, c, g, or t
tcagtacgctgtctcacgaccggtgctcgatttagatcgtctgtgttggggtttggggacccaaaaaccacacccctccttgggagaatcccctagatcacagctcctcaccatggactggacctggagcatccttttcttggtggcggcagcaacaggtgcccactcccaggttcacctggtgcagtctggancgtgaggtgaagaagccgtggggcctcagtgaacggtctcctgcaaggtcttcgtaggttacagttcgtttaagggaggttagtcgactaattccgtaaccgttcggggtgaccggtaaccgtaaccggggtcccccgtagggtaccggaaaggggttcctttgggaaggtagggaggttagggggtaatgggagtaccgacggtcgtacgttaaacgaagttacgggtaaccaaacgttaaaagttacgtaagtaaaccgaaggttaaacgttaccggaacgggtacgtaacggaacgttacccgaacctaagttaccggaaaccccaaaccgtaaaaccgtacctaaacgttaccccgtaaacggaaaccggtaccgaaacccgttacgggtaaacccttaaccgtaacggtttacggggaacccgttaggttaccgggtaaacgggaccgggttaaccccggtaaggggttaaaccgttaaccggttaccggtttaaaccgggaaaccccgggggtaaaccggttaccccgggtttaacccgggtttaaggtttttaaacccgttttacgggtttaccggggggtagggttaaccccgggggggggggttaagggggggtttttacgttttacggggggttaccggggtttccggggttaacccctaaacccggggtttaaacccgggtaaccgggtcccggtttaaccgggttaacccgggtttaaaacccccgggttttaaaaaccgggttttcccccgggggttaaaaccccccgggggggtttccccccggttaaaaccccgggggggg

SEQ ID NO: 82306 - DNA, 778 bp, Homo sapiens
  misc_feature: GYAE6OF02HS2VQ.36.34.D01.1.454.CMB.1.raw
  modified_base (470)..(470): a, c, t, g, unknown or other
  misc_feature (470)..(470): n is a, c, g, or t
tcagtacgctgtctcacgaccggtgctcgatttagatcgtctgtgttgggtttggggacccaaaaaccacacccctccttgggagaatcccctagatcacagctcctcaccatggactggacctggagcatccttttcttggtggcggcagcaacaggtgcccactcccaggttcacctggtgcagtctggagctggaggtgaagaagcctggggcctcgagtgaaggtctcctgcaaggcttctggttacattcgtttaggagtatgacatcacgtggtgcgacgcggccctaggacgaagggtcttggagtggagtgggagtggatcgagcgtactaacgaagtacggtaaactactaaaattagtacgaaacgtagtaaacgttaccggagggacagtacgtaccaactagacgaccaaactaaacacaactacccgaacgaacgcccaaacgacgtacccgtaaanacggtacggaactacgtacgggtaacgggacgtacccgtagggaacgtacgttaccggtaaccggaaccgtaaacccggtaccgggttaccgttaaggttttaaacgtttaagggtttacgggtaacggggttacgggggggttaaggggggggttttatttacgggggtacggggttacgggtaacccgttaaccggtaacccggtaacgggtaccctttacggggtaaaccccgtttaaacccggggttaaaccggttttacccggggtttaacccccgggtaccccgggggtttaacccgggggg

SEQ ID NO: 82307 - DNA, 611 bp, Homo sapiens
  misc_feature: GYAE6OF02H1TPT.36.34.D01.1.454.CMB.1.raw
  modified_base (252)..(252): a, c, t, g, unknown or other
  misc_feature (252)..(252): n is a, c, g, or t
  modified_base (260)..(260): a, c, t, g, unknown or other
  misc_feature (260)..(260): n is a, c, g, or t
  modified_base (490)..(490): a, c, t, g, unknown or other
  misc_feature (490)..(490): n is a, c, g, or t
  modified_base (575)..(575): a, c, t, g, unknown or other
  misc_feature (575)..(575): n is a, c, g, or t
  modified_base (577)..(577): a, c, t, g, unknown or other
  misc_feature (577)..(577): n is a, c, g, or t
  modified_base (579)..(579): a, c, t, g, unknown or other
  misc_feature (579)..(579): n is a, c, g, or t
  modified_base (581)..(581): a, c, t, g, unknown or other
  misc_feature (581)..(581): n is a, c, g, or t
  modified_base (583)..(584): a, c, t, g, unknown or other
  misc_feature (583)..(584): n is a, c, g, or t
  modified_base (586)..(587): a, c, t, g, unknown or other
  misc_feature (586)..(587): n is a, c, g, or t
  modified_base (589)..(590): a, c, t, g, unknown or other
  misc_feature (589)..(590): n is a, c, g, or t
  modified_base (592)..(596): a, c, t, g, unknown or other
  misc_feature (592)..(596): n is a, c, g, or t
  modified_base (598)..(611): a, c, t, g, unknown or other
  misc_feature (598)..(611): n is a, c, g, or t
tcagtacgctgtctcacgaccggtgctcgatttagatcgtctgtgtctctgggcgagagggccaccatcaactgcaggtccagccagagtgttttatacagctccaacaataaagaactacttaacttggtaccagcagaaaccaggacagccctacctaaactgctcatttactgggcatccgtacccggggaatcccgggggtccctagaccgattcgagtggcaggcgggtctgggacagattcactcncacatcancagcctgcaggcagaacgtagtgtggactagtttacttcgtagtcacgataattaagttaagtattactccgtacgtcttacgttacggggacggtaacggaacgaaggggtcgaagtactaccgaaaacggtcgtacggtacgcttacggacctacccgtaagtttccggttacttccgttaccgtaacccgtttcccgttaccccggtaccttactccgggtttaaanaaccgggtaactaaccgggtcgttaaccccggtagggacgggttcccggggcgttaacggcggaaacggtccgaattacggaagngngngngnngnngnngnnnnngnnnnnnnnnnnnnn

SEQ ID NO: 82308 - DNA, 791 bp, Homo sapiens
  misc_feature: GYAE6OF02FJUNQ.36.34.D01.1.454.CMB.1.raw
  modified_base (185)..(185): a, c, t, g, unknown or other
  misc_feature (185)..(185): n is a, c, g, or t
tcagtacgctgtctcacgaccggtgctcgatttagatcgtctgtgttgggtttgggggacccaaaaaaccacacccctccttgggagaatcccctagatcacagctcctcaccatggactggacctggagcatccttttcttggtggcagcagcaacaggtgcccactcccaggttcagctggtncagtctggaggtgaggtgaagagccgtggggcctcgagtgaaggtctccgtgacaaggtaccttcgtaggttacaggtccttttaacgtagtcttaagttgggttaactcgtaaacgttgggggtcgaccggtaaccgaaccggtaccccccgttaggggaaaccgtaaagggggtccttttagggacggttaggggtaacggttagggggtaacttggggaattccggaaggtccggtaactttaacgaaagttaacggtaaaaaccacgtaactaagtacgacctaacgaaggaaacgtccgtaccggagggtacaacgtacggtaccaaccgagtaccggaaccgtaacgaaggaacgaactacgtaccgaacggacgacccgaacgaaccgaccgtaacgtacggttagggtacgggttcggggaacgtccgtaaggacgtacgtacgtacggtaaccggaaccggtacccgggtaccgtttaaccgttaaacgtttacggtcgttacgggtaccgtaaggtaacgtaacgtaagtaacgttagttagtaagtacggtaacggtaccggtacggggaccggtaaccggaacccggttaccgg

SEQ ID NO: 82309 - DNA, 721 bp, Homo sapiens
  misc_feature: GYAE6OF02GA66J.36.34.D01.1.454.CMB.1.raw
tcagtacgctgtctcacgaccggtgctcgatttagatcgtctgtgttgggtttggggacccaaaaaccacacccctccttgggagaatcccctagatcacagctcctcaccatggactggacctggagcatccttttcttggtggcggcagcaacaggtgcccactcccaggttcacctggtgcagtctggagctgaggtgaagagcctgggcctcagtgaaggtctcctgcaaggtcttctggttacatctttaggagtatgcaatcaccgtggtcgcgacgacggcccctgggacaagggcttggacgtggagtgggatggatcgaggcgtacttaacgaagtacggtaaacacgtaaaatttagaacggtaaacacggtaaagttaccgaaggggtacgaagtaacggtaccaaccctaaagtaccggaacccaaaccaaactaacaacctaccgaacggaacgaccgaaccaaccggtccctaacgagtacgggaacgtcggtaaggaacggtacgacgtaagtacgacgttacgtacgaaccgaccggaccgggtccgttagttaacgtttagttcgggtcgggtacgggggttaggggggggttatttaggggtacgggttcgggaccttaccggttaaccgacggtaccgttacggtaccgttaaacccggtaaccggtttcgggttaccccggtacccggttaacccgggggg

SEQ ID NO: 82310 - DNA, 638 bp, Homo sapiens
  misc_feature: GYAE6OF02HGC6H.36.34.D01.1.454.CMB.1.raw
  modified_base (267)..(267): a, c, t, g, unknown or other
  misc_feature (267)..(267): n is a, c, g, or t
  modified_base (282)..(282): a, c, t, g, unknown or other
  misc_feature (282)..(282): n is a, c, g, or t
  modified_base (423)..(423): a, c, t, g, unknown or other
  misc_feature (423)..(423): n is a, c, g, or t
  modified_base (530)..(530): a, c, t, g, unknown or other
  misc_feature (530)..(530): n is a, c, g, or t
tcagtacgctgtctcacgaccggtgctcgatttagatcgtctgtgttgggtttggggacccaaaaaccacacccctccttgggagaatcccctagatcacagctcctcaccatggactggacctggagcatccttttcttggtggcggcagcaacaggtgcccactcccaggttcacctggtgcagtctggagctgaggtgaagaagccgtggggcctcagtgaaggtctcctgcgaaggcttcgtggttacatctttaggaggtangcaatcacgtgggtncgacacggcccctggacaagggtcttggagtggagtcgggatggatcaggctacttacgaatggtaaacaacgtaaattactaggaacaagtaacgttccgaagggcaagacgtccaacgtatcgtaacccgaactaaacncaacgtacccaaggaacgcaacgacgacctaacgagtaggacgtctacggaggacgccgtagagtactcgtacggaacgacgacggtcgttacgtattacggttagnggtacgggggtaggggggttacttgggtgggtacggacctaccgttacgacgtacgtacggaccgttaaccgtaaacggtccgggtttacccgaccccggtaacgggg

SEQ ID NO: 82311 - DNA, 795 bp, Homo sapiens
  misc_feature: GYAE6OF02H77LS.36.34.D01.1.454.CMB.1.raw
  modified_base (565)..(565): a, c, t, g, unknown or other
  misc_feature (565)..(565): n is a, c, g, or t
tcagtacgctgtctcacgaccggtgctcgatttagatcgtctgtgttgggtttgggggagctacaacaggcaggcaggggcagcaagatggtgttgcagacccaggtcttcatttctctgttgctctggatctctggtcgccgtggcggggacagtcgtgatcgacccagtcctccagacctccctggctgtcgtctcgtgggacgaggacggaccaaccgatactaacgtcgacgtacggtaccacgacctaggttacgtttagttttactacgacggtcctaaccaaaactaaaacgtaaacgtaaacctttaaccgtttaaacgttacggtaaccgaacgaacgaaaccggaaaaaccgaggtaacccgaacgtacccttaaccgtaaactcggtactacttaacgttttacgacgggtacctacgttacccggtaacccggggtacggtacccgggttcccgtacgtaccgtaacgttcgaggtacgacggtcggacggtcggtacgtacgacgttacttaccgtacttaccgactaccgactcgacacgacggtctacgngggtaaccgtacggtagttaacgggtcgtacggtcgggtttaacttacggtttttacttaccggttaagttacgaacggttaactaattttaatttacgttaaacgttccgttacctttacgtacccggtttacggtacgggggtaccggtaaacgggtacggtaaggggttaaccgaacgtaaccgtaagttaaacccggtaggttacggcggtttaaccgactaccgg

SEQ ID NO: 82312 - DNA, 728 bp, Homo sapiens
  misc_feature: GYAE6OF02IL4C4.36.34.D01.1.454.CMB.1.raw
  modified_base (260)..(260): a, c, t, g, unknown or other
  misc_feature (260)..(260): n is a, c, g, or t
  modified_base (361)..(361): a, c, t, g, unknown or other
  misc_feature (361)..(361): n is a, c, g, or t
tcagtacgctgtctcacgaccggtgctcgatttagatcgtctgtgttgggtttggggacccaaaaaccacacccctccttgggagaatcccctagatcacagctcctcaccatggactggacctggagcatccttttcttggtggcggcagcaacaggtgcccactcccaggttcacctggtgcagtctggagctgaggtgaagaagcctggggcctcagtgaaggtctcctgcaaggcttctggttacatcgtttaggnggtatgcaatcaccgtgggtgtgacacggcccctggacaagggcttggagtggagtgggatgggatcgagcgtcttaacaagttggtaacactaaaattanagaaacagtaagttccgaagggcagagtacacatacgaaccaacaaaccgacaactaccgaacgacgaccaacgacgaccctaacgtagtgggaacgcgttaggaaggtaccgtccgtaggaacgacgttacgtacggaaccggtaacccgtaaccgggtcccggttaagttaacgttttaaggtttcgggtacgggtaccgggggggttaaggggggggtttacgtttaggggttacggggttacgggtaacccggttaacccggtaacccggtaacggtcccggttacgggtaaccccggttaaacccgggttaaacccggtttaccggggtttaccccgggaaccccccgggttacccgggggg

SEQ ID NO: 82313 - DNA, 784 bp, Homo sapiens
  misc_feature: GYAE6OF02IXAJC.36.34.D01.1.454.CMB.1.raw
  modified_base (292)..(292): a, c, t, g, unknown or other
  misc_feature (292)..(292): n is a, c, g, or t
tcagtacgctgtctcacgaccggtgctcgatttagatcgtctgtgttgggtttggggacccaaaaaccacacccctccttgggagaatcccctagatcacagctcctcaccatggactggacctggagcattccttttcttggtggcggcagcaaacaggtcgcccactcccgaggttcaccgtggtcgcagtctggcgcgtgaggtagaagaacgccgtggggccctcgagtgaacggtcctcctgacgtaaggtctttcgtcggtttactacttccgtttaaggagttangactaacgtcaccggtggtgaccggacgaccgccccgtagggaacgacgggtcttggaggtgggagttgggacgttaggacgtcgtagtccgtacttaaacgaacgttacggttaaaccaaacttaaaatttagaacgtaaaccgaaacggttaacggttacggacgggtacgaaggttcgaaccaacctagtaaccgaaacccgaaaccaaacctaccgtaaccaccgaaacgtcgaaacccacctaacgtaccctaagacgtacgggtcgaaccggttgggaaaccggtcgtaccgtaacgggaagtacccgtacggtacgaaccgacccgttaaccggggtccgtttacgtttaaacgtttcgggttaggggtcgggacggggggttaacgggggtttatttgggtaccggacggtacgtaacgtaccgtccgtaagtacggtacctaacccggtacggtttaccggtccccggacccggtaccggggg

SEQ ID NO: 82314 - DNA, 799 bp, Homo sapiens
  misc_feature: GYAE6OF02F6S0V.36.34.D01.1.454.CMB.1.raw
tcagtacgctgtctcacgaccggtgctcgatttagatcgtctgtgttgggtttggggacccaaaaaccacacccctccttgggagaatcccctagatcacagctcctcaccatggactggacctggagcattccttttcttggtggcggcagcaacaggtgcccactcccaggttcacctggtgcagtctggagctgaggtgaagaagccgtggggcctcagtgaaggtctcctgcaggtcttctggttacattctttaggagtatgcaatcaccgtgggtgcgacgcggcccgtggacgaagggtcttggaggtgggagtggggatggagtcgacggccgtcgttaaacaagtacggtaaacaactaaaagtttataacggaaacgtaaggtaacgttaccgaagggtaccgaaggtacgtaccaacctaaacgtaccgaaacccaaactaaaaccacgaaccgttaacccgaacggtaaccgaaccgtaaccaccgtaaccctaaacgtaacggtacgggacgtacggttaacgggaacgggtacggtccgtagggaaccggtaagttaccggtacggaacccggaccggtacccggggttacggtttaggtttaacgttttacggtttagggtacggggttacgggggggtaacgggggggtttacggtttgggttaccgggggttaacggtaccggtaacccgttaaccggtacgttacccgggtacgtaacccggttaacccggaaccggttttacggggttaccccgggtaaccccgggttaccccggggggg

SEQ ID NO: 82315 - DNA, 731 bp, Homo sapiens
  misc_feature: GYAE6OF02FWEDF.36.34.D01.1.454.CMB.1.raw
  modified_base (326)..(326): a, c, t, g, unknown or other
  misc_feature (326)..(326): n is a, c, g, or t
tcagtacgctgtctcacgaccggtgctcgatttagatcgtctgtgttgggtttggggacccaaaaaccacacccctccttgggagaatcccctagatcacagctcctcaccatggactggacctggagcatccttttcttggtggcggcagcaacaggtgcccactcccaggttcacctggtgctagtctggagctgaggtgaagagccgtgggcctcagtgaaggtctctgcaagtcttctggttacattcgttaggagtatcgtacaactcgaccgtggtgaccgacgacggtccccgtggacgtaacgggtcttaggagtggnggtggagtggactcgtacgcgtacttaacacgttacgtaactaactaattacgagaacgtaggtaaacgtcgaacgggtacgaggtactaccgtaaccgtacgtaacgaacctaaaccgaaacacgactaaccgacgaacgtacaacgtacgacctacgtcgaggtacgagttacgggacgtacgtacgtagtaacgtacgtcgtacggtaccgaaccgtacgggtacccggtttagttacgttaggttacgggttcggggtaccgggggtagggggtttcgttaggggttaggggtccgggtaaccggttaccggtaaccgacggttacccggtacgggttaacccggttaaacccggttacgggttaccccggtttacccggtaccccggggttaacccgggg

SEQ ID NO: 82316 - DNA, 816 bp, Homo sapiens
  misc_feature: GYAE6OF02JOVGU.36.34.D01.1.454.CMB.1.raw
  modified_base (216)..(216): a, c, t, g, unknown or other
  misc_feature (216)..(216): n is a, c, g, or t
  modified_base (254)..(254): a, c, t, g, unknown or other
  misc_feature (254)..(254): n is a, c, g, or t
tcagtacgctgtctcacgaccggtgctcgatttagatcgtctgtgttgggtttggggacccaaaaccacacccctccttgggagaatccctagatcacagctcctcaccatggactggacctggagcatccttttcttggtggcggcagcaacaggtgcccactcccaggttcaccgtggtgcagtctggagctgaggtgaagagccgtgggcctnagtgaggtctctgcaggcttcgtgtacattcgttaggngtatgacaatcctaccgtgggtgaccgacgacggccccgttaggaacgtagggtcttaggaggttcggagtgggactgggtatacgacgtcgtaccttaaggaacggttacggtaaaccaacttaaagttacgtacgaaaaccggtaacggttaacgttacccgggaaggggtcctaaagggtacggttaccaaacccgtattacccgggaaacctaacccgaaacaaccgtaactaccgaaccggaacgaaccaccgtaacgtacccgtaagtaacgtaggtaacgtaccggtagggaggtaaccgtaccgtagaacgtccgtaacgttacggaaccgtacggtaacccggggtcgttacggttttaagtttacggttaacgggtacggggtaccgggggttaagggggggttttacgttgggggttaacggggttcggttaacccggttaacggttaacccggacgggttacgtttacccgggtaacccggtttaaccccggtaaaacgggttttaccccgggttacccccgggtaccccggggtttaaccccggggggg

SEQ ID NO: 82317 - DNA, 314 bp, Homo sapiens
  misc_feature: GYAE6OF02JGTQB.36.34.D01.1.454.CMB.1.raw
  modified_base (279)..(279): a, c, t, g, unknown or other
  misc_feature (279)..(279): n is a, c, g, or t
  modified_base (286)..(314): a, c, t, g, unknown or other
  misc_feature (286)..(314): n is a, c, g, or t
tcagtacgctgtctcacgaccggtgctcgatttagatcgtctgtggttgggggggggtattgtggtggcactaccagctgctaccgaaactggttcgacccctggggccagggaaccctggtcaccgtctcctcagcctccaccaagggcccatcggtccttccccctggccaccctcctccaagagccacctcgtgggggcacagcggcccgtgggctgccgtggtcaaggactacttccagacagcgtactgacggcgggcgtcggacgaacgggcncgatagnnnnnnnnnnnnnnnnnnnnnnnnnnnnn

SEQ ID NO: 82318 - DNA, 734 bp, Homo sapiens
  misc_feature: GYAE6OF02HQ21N.36.34.D01.1.454.CMB.1.raw
  modified_base (246)..(246): a, c, t, g, unknown or other
  misc_feature (246)..(246): n is a, c, g, or t
tcagtacgctgtctcacgaccggtgctcgatttagatcgtctgtgttgggtttgggggagctacaacaggcaggcaggggcagcaagatggtgttgcagacccaggtcttcattttctctgttgctctggatctctggtgcctggcggggacatcgtgatcgaccagtctccagactccctggctgtgtctcgtgggcgaggacgggccacatcaactgcgacggtccagccaggtgttgttttanacgagctaccaaacaataaacgaacttaacttaacttacggtaccagacaagaaaccaggactaccgacctacctaacgtcgtctactaacgtttacgtgggactacgtaccgtaaccccgggtaacggttccccggggtaccctaccggaaccgtactttacgacggtcgggtaccgacggggttccgggtacgtaccggggaacgtaacggttacctttaccaccgtccttaccaaccctacgtaccgaacgccgacgtccgtacgcgtaacggtcgaaggtaacgtagttcgggttacgtacttacgtttttaacgtcgttacgtaccggtaacgtaacgttaaagttaagttacgttaaaccgtttagttcccgttattcccggtacgtttccggggacggtaaccgggtaaaccggtaacgggtaggtaaccgaagttaaccgaaacgggttagttacgggtacggtaccgtacggtaacccg

SEQ ID NO: 82319 - DNA, 709 bp, Homo sapiens
  misc_feature: GYAE6OF02FWEDM.36.34.D01.1.454.CMB.1.raw
  modified_base (161)..(161): a, c, t, g, unknown or other
  misc_feature (161)..(161): n is a, c, g, or t
tcagtacgctgtctcacgaccggtgctcgatttagatcgtctgtgttgggtttggggacccaaaaaccacacccctccttgggagaatcccctagatcacagctcctcaccatggactggacctggagcatccttttcttggtggcagcagcaacagggtnacccactcccaggttcagctggtgcagtctggagtgaggtgaagaagccgtagggctacgagtagaacggtctcgtgacaagtacttcgttagtacagtacctttaacgtagtcttagtaggtactcgaacggtggtcgacgacaccggaccccgtaggacgtaggtacgttaggaggtggagtgggagtcggatcgacgtcgtacttacgaaggtaacggtaaacacgtaactatacggacaacgtaggaacgtcgaccgagggacacggacgtaccaaccgtacgtacaccgtaacgagaaaccgacacgtaccaacgacgacctacgacctaccgtacgaggtacggtacggggtcgtacgtacgtagggactagtaccgtacggaacccgaccggtacgtaccgttacgttaaacgtttcggaccggttaggaccgaacgggttaacgtaacgtaaggttacgtttaaacgtttaaggtaacggttaacggtaaggttaacccgggacccggggtaaccgggtaacccggtaccggtacccggg

SEQ ID NO: 82320 - DNA, 797 bp, Homo sapiens
  misc_feature: GYAE6OF02F7XX8.36.34.D01.1.454.CMB.1.raw
tcagtacgctgtctcacgaccggtgctcgatttagatcgtctgtgttgggtttggggacccaaaaaccacacccctccttgggagaatcccctagatcgacagctcctcaccatggactggacctggagcatccttttcttggtggcggcagcaacaggtgcccactcccaggttcacctggtgcagtctggagctggaggtgaagagccgtgggcctcagtgaaggtcctcctgacgaagtcttcgtggttacattcgtttaggagtatgcaagtccaccgtgggtcgcgacgaccggtcccctgggaaccgaaggggtccttaggacgggtgggtaggttcgggaagttcgggacttacggaggtccggtactttaaacgtaaagttacgggttaaaaccaaacgttaaaaactttacgtaacgaaaaccggtaacgggttaaaccggttacccggaagggggacctaacgggtaaccgtacccgaaacccgttaacggtaaccggtaaacccaaaaccgaaaaccgtaacccgtaaaccgtaccccgaaaccggtaaccgaaccgtaaacccgaacgtacccgtaaaccgtaggttaaccggggacgtacggttaacggacgggagtcccgtagacgtactacgtacgaaccgcgaccggttccgtagttaagttacgttcgggtacgggacgggggttaaggggggttcttggggttaggtcggtacctaccgtacgacgtcgtacggacgttaaccggtaacggttcggttacccggtcccggtaaccgggg

SEQ ID NO: 82321 - DNA, 963 bp, Homo sapiens
  misc_feature: GYAE6OF02I95PD.36.34.D01.1.454.CMB.1.raw
tcagtacgctgtctcacgaccggtgctcgatttagatcgtctgtgttgggtttggggacccaaaaccacacccctccttgggagaatcccctagatcacagatcctcaccatggactggacctggagcatccttttcttggtggcggcagcaacgaggtgcccactcccgaggttcaccgtggtgcagtcgtggagcgtgaggtgaagaacgtccgtggggcctcgagtgaaggtctccgtgcaaggtcttacgtggttaaccattcgttaaggaggtatgactaatcgtaccgtagggttgaccggtacgaccggtccccgtaggaaccggaagggtcggtttacggagggttacgggtaggttacggggagttacgggaacgttccggaagggtaccgttaccgtttaaaacggaaggtttaaccggggtaaaaccctaaaacgtaaaagttttaacgttaaccggaaaccgttaacgggttaaaccgtttacccggggaacgggtaccgtaaacggtaaccgttaacccgaacccttaaaggttaaccgaaaccccgaaaacgtttaaaacccggaaccgtaaaccgttaaccccgggaaaggaacccggaaacccgaaacccgtaacgggtaacccctaagttaaacggtacggggaaaccgttccggtaaggggaaacggtaaccggtccgtaagggtaaacgtacgttaaccggtacgtaaacccggtacggtaccggtttaccggttaacggttttaaccgttaagggttaccggggttaggggtaaccggggggggtttacgggggggtacgtttttccgggggtaagggtttaccgggaacccggtttaaacggtacccgtaagggtccccggtttaaacgggttccccgttaaacgggtttaacccggtttacccggggtttaccccgggtaccccccgggttaaacgggggg

SEQ ID NO: 82322 - DNA, 663 bp, Homo sapiens
  misc_feature: GYAE6OF02FL6E9.36.34.D01.1.454.CMB.1.raw
  modified_base (156)..(156): a, c, t, g, unknown or other
  misc_feature (156)..(156): n is a, c, g, or t
  modified_base (265)..(265): a, c, t, g, unknown or other
  misc_feature (265)..(265): n is a, c, g, or t
  modified_base (286)..(286): a, c, t, g, unknown or other
  misc_feature (286)..(286): n is a, c, g, or t
tcagtacgctgtctcacgaccggtgctcgatttagatcgtctgtgttgggtttggggacccaaaaaccacacccctccttgggagaatcccctagatcacagctcctcaccatggactggacctggagcatccttttcttggtggcggcagcaacnggtgcccactcccaggttcacctggtgcagtctggagctgaggtgaagagccgtggggcctcagtgaaggtctcctgcaaggcttgtggttacatcgtttaggaggtangacatcacgtgggtgcgacgnggccccgtggacgaagggtcttaggaggtggagtgggatggtatcgacgcgtacgttacgtaagtaggtaaacaactaaattagtagaaacgtagtacgtaccgagggacagactcactatacgaacctaacaacactacgacccaagacgacacgactaccgtactacggtaggagtacgtcgggaacggcgtacccgtagacgacgtcgacggaccgaacggtccgggtacgttagttaagtttacgttggtacggggtacggggtaggggggttacgttgggtcgggtaccggtacgtaaccggtaccgtacgtacgtacggtaaccgtaaccggtaacggttcccgggttacccggtcccgggttacccgggg

SEQ ID NO: 82323 - DNA, 681 bp, Homo sapiens
  misc_feature: GYAE6OF02HJ5QK.36.34.D01.1.454.CMB.1.raw
  modified_base (183)..(183): a, c, t, g, unknown or other
  misc_feature (183)..(183): n is a, c, g, or t
  modified_base (283)..(283): a, c, t, g, unknown or other
  misc_feature (283)..(283): n is a, c, g, or t
  modified_base (432)..(432): a, c, t, g, unknown or other
  misc_feature (432)..(432): n is a, c, g, or t
tcagtacgctgtctcacgaccggtgctcgatttagatcgtctgtgttgggtttggggacccaaaaaccacacccctccttgggagaatcccctagatcacagctcctcaccatggactggacctggagcatccttttcttggtggcggcagcaacaggtgcccactcccaggttcacctggtncagtctggagctgaggtgaagagcctggggcctcgagtgaaggtctctgcaagtcttctggttacattcgtttaggaggtatgctaatcaccgtgggtcncgacacggcccctaggacgaagggcttggaggtcggagtgggtatcggatccgagcgtacttagaagtcggtaaacaacgtaaattagtacgaacaaggtaacgttccgagggcaggtacgtaccacctagtaccgaaccaactaaacncactaccacgacaccgacacgtctaacagtaggagcgtaggtaggcgtacgtaggactacgtcgacggtaaccgaccgtacgggtccgtttaggttaacgtttacggtttacggtaggggtacgggggttagggggggttacgtttaggggttcggggtacggtccggtaaccgtaaccggtcgtaccggttcggtaaccggtaaccgtaacgggtttcccggttacccggacccggggttaaccgggg

SEQ ID NO: 82324 - DNA, 821 bp, Homo sapiens
  misc_feature: GYAE6OF02FQWLK.36.34.D01.1.454.CMB.1.raw
  modified_base (299)..(299): a, c, t, g, unknown or other
  misc_feature (299)..(299): n is a, c, g, or t
tcagtacgctgtctcacgaccggtgctcgatttagatcgtctgtgttgggtttggggacccaaaaaaccacacccctccttgggagaatcccctagatcacagctcctccaccatggactggacctggagcatccttttcttggtggcggcagcaacaggtgcccactcccaggttcacctggtgcagtctggagctgaggtgaagaacgccgtggggcctcgagtggaacggtctccgtgcaaggtcttcgtggttacagttctttaagggaggtatcgtactaatcaccgttggggnccggtaacaccgggccccttagggacgaaacggggtcttaggagggtaggagtacggggtgtacggagtacgaggtccgtaccttaaacgtaacggttaacgggtaaacaacttaaaagtttacgaaccgtaaaaggtaacggtaaacgttaccggtaaggggactaaaggtcgtaccaaccgtagtaaccggaaacccaaaccgtaaaaccaccgaactttacccgaaagtaccgaaccaacgacgtaaccttaacgaggttacgggacgtacggttacgggaaggtacgtacggtacgtaggtaacgttcgtacgaacggtaccgtaacccgggtgggtttacgttttaacggttaactttacggggacgggtacgggggggggtttaagggggtttaggttcggggttcgggttaacgggccgttaaaccggtaccgtaacccggtagttacgtaaaccccgggttacgttaaaccgggtttccccgggttacccggtaacccccggttaccggggggg

SEQ ID NO: 82325 - DNA, 359 bp, Homo sapiens
  misc_feature: GYAE6OF02HVMXI.36.34.D01.1.454.CMB.1.raw
  modified_base (163)..(163): a, c, t, g, unknown or other
  misc_feature (163)..(163): n is a, c, g, or t
  modified_base (277)..(277): a, c, t, g, unknown or other
  misc_feature (277)..(277): n is a, c, g, or t
  modified_base (281)..(281): a, c, t, g, unknown or other
  misc_feature (281)..(281): n is a, c, g, or t
  modified_base (285)..(285): a, c, t, g, unknown or other
  misc_feature (285)..(285): n is a, c, g, or t
  modified_base (287)..(287): a, c, t, g, unknown or other
  misc_feature (287)..(287): n is a, c, g, or t
  modified_base (290)..(290): a, c, t, g, unknown or other
  misc_feature (290)..(290): n is a, c, g, or t
  modified_base (294)..(359): a, c, t, g, unknown or other
  misc_feature (294)..(359): n is a, c, g, or t
tcagtacgctgtctcacgaccggtgctcgatttagatcgtctgtgttgggtttgggtgccgaagttgctggaggtcacggtcaccacgctgctgagggagtagagtcctgaggactgtaggacagcccatcggtccttccccctggccgccctgctccagganccacccgtccgagacgcacaggccggccctggggacctggcctggtccaaggtacctactccagacaggtctactggacggccgggtctggaccgaacgggccacgtagtaggnagtnagtnancgngacnnnnnnnnnnnnnnnnnnnnnnnnnnnnnnnnnnnnnnnnnnnnnnnnnnnnnnnnnnnnnnnnnn

SEQ ID NO: 82326 - DNA, 750 bp, Homo sapiens
  misc_feature: GYAE6OF02GLD79.36.34.D01.1.454.CMB.1.raw
  modified_base (250)..(250): a, c, t, g, unknown or other
  misc_feature (250)..(250): n is a, c, g, or t
  modified_base (263)..(263): a, c, t, g, unknown or other
  misc_feature (263)..(263): n is a, c, g, or t
  modified_base (690)..(690): a, c, t, g, unknown or other
  misc_feature (690)..(690): n is a, c, g, or t
tcagtacgctgtctcacgaccggtgctcgatttagatcgtctgtgttgggtttggggacccaaaaaccacacccctccttgggagaatcccctagatcacagctcctcaccatggactggacctggagcattccttttcttggtggcggcagcaacaggtgccccactcccaggttcacctggtgcagtctggagctgaggtgaagaacgcctgggcctcagtgaagtctcctgacaggcttctggtacnttcgttaggagtntgctaagtccacgtgggtcgacgacgcggtccccgtaggacgtaaggggtccttaggacgtagggacgtgggagtaggatccgagtccgtacctttaacgaacgttacggaaaccaacgttaaaacttagtaaccgaaacgtaagtaaacgttcccgaaggggacctaaggtacgtacctaacccgaagttacccgaaacctaaaaccgaaacccaactactaccgtaaccggaacgacctaaccgaaccgtacctaacgaacggttacggtagcgtaacggacggtacgccgtaagacgtacgtccgtagtaaccgtaacccggacggttaccggttagttacgtttaacgttcggagggtacggggggttaaccgggggttggttacgggtacgggtcggtaccggtaaccgtaaccggtaccgnggttaccgaccggttaaaccgtaccggttaccgggttacccggtaccccgggtaccgggg

SEQ ID NO: 82327 - DNA, 303 bp, Homo sapiens
  misc_feature: GYAE6OF02JTFHV.36.34.D01.1.454.CMB.1.raw
  modified_base (278)..(303): a, c, t, g, unknown or other
  misc_feature (278)..(303): n is a, c, g, or t
tcagtacgctgtctcacgaccggtgctcgatttagatcgtctgtgttgggggggggtagttgtggtggcactgccagctgctaccgaaactggttcgacccctggggccagggaaccctggtcaccgtctcctcagcctccaccaagggccatcggtcttccccctggcaccctcctccaagagcacctcgtggggcacagcggccctgggctgcctggtcaacggactacttccaggacagcgtactgacggcggctcggcaaggcgacgtataggnnnnnnnnnnnnnnnnnnnnnnnnnn

SEQ ID NO: 82328 - DNA, 848 bp, Homo sapiens
  misc_feature: GYAE6OF02GD8K7.36.34.D01.1.454.CMB.1.raw
  modified_base (783)..(783): a, c, t, g, unknown or other
  misc_feature (783)..(783): n is a, c, g, or t
  modified_base (816)..(816): a, c, t, g, unknown or other
  misc_feature (816)..(816): n is a, c, g, or t
  modified_base (828)..(828): a, c, t, g, unknown or other
  misc_feature (828)..(828): n is a, c, g, or t
tcagtacgctgtctcacgaccggtgctcgatttagatcgtctgtgtctctgggcgagagggccaccatcaactgcaggtccagccagagttgttttatacagctacaacaataagaactacttaacttgtaccagcaagaaccaggacagccttacctaaactgactactaatttacgtgggactagtaccgtaacccgggtaagtacccggggtccctaggaccgtacttacgaggtggacgacggtcgggtacgtgggaacctagtactttcacgtacctacaaccgatcgaacgtctaacgcctagaccacgtccgtaggtaaacgtagttaggtttacgaacttaaaccgttttagtttaaacgttaacgggttaaacccgtaaaaaaggtttaacgtaaaacccgttaacgggttaccccggtaaccccccgttaggttaacccccgtttaaaccggtttccccggggggtaaaccggggttaaaccggggttaacccgggtaaaagggttacgggggtaaaacctaacggtaaacggtaaaaaaccccggtacggttcggtaacggggttacctacggaccccgtaaacgttaacgtaccgtttaacgtttacccggttccttaaaccgtttccccgtaccccttacgttaacttaccggtaacggaaacgtaaccgtacggtacgtttacgacggtacgggtacgtcggaaccggtacgtaaccggtcgtaaacgtaagttacggaccgtagacgccgtaagtccgtaagtgaccngtacacgagttaacgcgtagtacgtcgtagacntacgtccggtanacgtactgtacgtcggcagg

SEQ ID NO: 82329 - DNA, 894 bp, Homo sapiens
  misc_feature: GYAE6OF02JSQL7.36.34.D01.1.454.CMB.1.raw
tcagtacgctgtctcacgaccggtgctcgatttagatcgtctgtgttgggtttggggacccaaaaccacacccctccttgggagaatcccctagatcacagctcctcaccatggactggacctggagccattccttttcttggtggccggcagcaacaggtgcccactccaggttcaccgtggtgcagtcgtggagctagaggtagaagacggccgtgggcctcgaggtcggtaaggtcctccgtcggacgtaacggtcctttcgttacggttaactacgtttccgttttaaggggacggtttaatcgactaactccgtaacgtcggggccggtacgaccgtaaccggccccgtagggtaaccggagggttcgttaggacgggttaggacgtaggggtacgttacgggtactaccggacggtaccttacgtttaaccgaaacggtttaagggtaaaaccctaaaactttaaaacggttaacggtaaaccggaacggttaaaagggttaccgggttacccggtaaacggggacgtaaacggttaaccggttacccgaaaacccgttcgtaaaccgggaaaccccttaaaacaaacccgtacgtaaaccgaacccgtaacccgaacgtaacccgaaccgtaaccggacttaacccggagtaacggacggtacgaggaacggacgtcgtaaggacgtaaccgttcgtacgaacccggtaccgacggttccggttaagttacgttaggttaccggaaggggttacgggggtaggggtttaacgggtcgggtaacgggtaccgtaccggtaacggttaacgaaccgggtttactaccggtttaaccggaacccgtttaaccgggtttcggtaccccggggtttacgggtaccccggggg

SEQ ID NO: 82330 - DNA, 682 bp, Homo sapiens
  misc_feature: GYAE6OF02JWL1V.36.34.D01.1.454.CMB.1.raw
  modified_base (156)..(156): a, c, t, g, unknown or other
  misc_feature (156)..(156): n is a, c, g, or t
  modified_base (189)..(189): a, c, t, g, unknown or other
  misc_feature (189)..(189): n is a, c, g, or t
  modified_base (234)..(234): a, c, t, g, unknown or other
  misc_feature (234)..(234): n is a, c, g, or t
  modified_base (277)..(277): a, c, t, g, unknown or other
  misc_feature (277)..(277): n is a, c, g, or t
  modified_base (421)..(421): a, c, t, g, unknown or other
  misc_feature (421)..(421): n is a, c, g, or t
  modified_base (564)..(564): a, c, t, g, unknown or other
  misc_feature (564)..(564): n is a, c, g, or t
  modified_base (587)..(587): a, c, t, g, unknown or other
  misc_feature (587)..(587): n is a, c, g, or t
tcagtacgctgtctcacgaccggtgctcgatttagatcgtctgtgttgggtttggggacccaaaaaccacacccctccttgggagaatcccctagatcacagctcctcaccatggactggacctggagcatccttttcttggtggcggcagcaacnggtgcccactcccaggttcacctggtgcagtcnggagctggaggtgaagaagccgtggggcctgagtggaacggttcncctgaccaggtcttcgtggttacattcgtttagggagtatcgnaatcacgtgggcgcgacgacggcccctaggaccgagggcttggagtggagtgggatggatcgagtcgtacttaacgaagtaggtaaaccaactaaagttacgagaaacctaggtaaacgttccgaggtacagtacgacacgtanacgaaccaacaacgactacgaccacgaagaccaacgtacgaccctttaacgagttacgggagccgtagggacggtacgtacggtagagtacgtacgaacggaccgtaaccgtaccggtgttaaccgtttaatcgggtttacgnggggaccggggttaagggggttntagggtttccggaggggttaccaacgttaccggtagtaccgttacggtaccgtaaccggtaacggttccgggttacccgacccgggtaaccgggg

SEQ ID NO: 82331 - DNA, 790 bp, Homo sapiens
  misc_feature: GYAE6OF02IQGX0.36.34.D01.1.454.CMB.1.raw
tcagtacgctgtctcacgaccggtgctcgatttagatcgtctgtgttgggtttggggacccaaaaaccacacccctccttgggagaaccccctagatcacagctcctcaccatggactggacctggagcattccttttcttggtggcggcagcaacaggtcgcccactcccaggttcacctggtgctagtctggagctgaggtagaagagccgtgggcctgagtgagtctcgtgacaggtcttcgtaggttacagttcgttaaggaggtatcgactactccgacgttggggtcgaccgtacgaaccggtcccccgtaggaaccgaacggggttccttaggtacgggtagggtaacgggttggggtacttcgggaacttacggaacggtcccgttaagtttaaaccggaaacgtttacgggtaaaacctaaacgtttaaagtttaacgaacggtaaaaccgtaacgggttaaacggtttacccgggaacggggttacaaacggttacccgtaactaaccgtaagttacccggaaaccctaaaaccgaaaaccctacctaaccgttacccggaaacgctaacccgacgtaaccgtcctaacggagtacgggacaggtacgaacggacgtcgacgtagcctacggtagaccgtacgaccggtcgttagttaacgttgttaggacgggttacggggtaggggttatgggttaggtcgacgttaccgacggcttaaccggtagtaccgtaaccggttaccggttaccggcccggttacccgggtaggtaccccgg

SEQ ID NO: 82332 - DNA, 737 bp, Homo sapiens
  misc_feature: GYAE6OF02IIXBM.36.34.D01.1.454.CMB.1.raw
  modified_base (354)..(354): a, c, t, g, unknown or other
  misc_feature (354)..(354): n is a, c, g, or t
tcagtacgctgtctcacgaccggtgctcgatttagatcgtctgtgttgggtttgggggagctacaacaggcaggcaggggcagcaagatggtgttgcagacccaggtcttcatttctctgttgctctggatctctggtgcctggcggggacagtcgtgatcgacccagtctccagacctcctggctgtgtctcgtgggcgagacgggccacatcactgcgaggtccacgccaggtagttgttttacacacgtcctaccaaactaaagtaacgaaaccttaacttaaacttcggtaaccagacaagaaacccaggaccacgacctacctaaactcgtacctactaagttttacgngggactacgttaccgtaaccccggggtagttaccccggggtcccttacggaacccgtacgttcgtaggttcggaccgtacgggtcggggttaccgtaggggacgtaacggtacgttttaccgaccgttacctaccaccctactaccgaacggtaccaacggtcctacgtacgacggtaccgtaagaaagtacgttcgggttacgacgttacgttttaaacgttccgtagtacgacgtaactaactttagttaacttcgttacttccgacgttaccttaccggttccggtacggggaacgggttaacccgaaggggttacggaacgttaacgtaacccggtaaacggttaaccgtagggtacggttacccgtagtaaaccccgg

SEQ ID NO: 82333 - DNA, 943 bp, Homo sapiens
  misc_feature: GYAE6OF02FJTAQ.36.34.D01.1.454.CMB.1.raw
tcagtacgctgtctcacgaccggtgctcgatttagatcgtctgtgttgggtttggggacccaaaaaccacaccctccttgggagaactccctagactcacacgctcctcaccatggactggacctggagcatccttttctggtcggcggcagcaacacggtcgcccactcccgtaggttcaccgtggtagctagtctggacgctcgagggtagaacgtacgccgtcggggtcctcgtaaggtcgtaacggtccttccgtcgtaccgtaacgggtccttaccgtacggttactacgttccgttttaacggggacgttacgtcggtaacctaacgttcccgtaacccggttcggggttcgaccccggaaccggtaaccggggtcccccgttaaggggtaacccgaaccgggggttccttttaacggggaacggttcgggtaaccgtggggtacgttacgggtactaccggtacggtacccggttacccgtttaaacgaaacggttaccgggttaaaaaccctaacgttaaaacgtttacgtaacggtaaaccgtacggtaaacggtttccggaacggggtacgtaacgtaccggtacaacccgttacgacccgaaccaaaccgtaaccctacaccgtacccgaacggtaccgaaccgtaaccaccgtacccgtaacggtaacggtacgttaaccggccggtaacgtacggggaccttacccggttaagtactacgtaccggtaccgtaaaccgggcccgtaacgggtacgtttacggtttaacgtcggtttaagggtccggggttaacccggggggttaagggggttttccttacggggagggtttaacccggacgtaacccggtaaccgtcgggtaaccgtacggtaacccgttaaccggtaaccggtttccccgggttaacccgggtacccgggtaacccggg

SEQ ID NO: 82334 - DNA, 646 bp, Homo sapiens
  misc_feature: GYAE6OF02HRBJU.36.34.D01.1.454.CMB.1.raw
  modified_base (250)..(250): a, c, t, g, unknown or other
  misc_feature (250)..(250): n is a, c, g, or t
  modified_base (260)..(260): a, c, t, g, unknown or other
  misc_feature (260)..(260): n is a, c, g, or t
  modified_base (359)..(359): a, c, t, g, unknown or other
  misc_feature (359)..(359): n is a, c, g, or t
  modified_base (486)..(486): a, c, t, g, unknown or other
  misc_feature (486)..(486): n is a, c, g, or t
  modified_base (503)..(503): a, c, t, g, unknown or other
  misc_feature (503)..(503): n is a, c, g, or t
  modified_base (510)..(510): a, c, t, g, unknown or other
  misc_feature (510)..(510): n is a, c, g, or t
  modified_base (514)..(514): a, c, t, g, unknown or other
  misc_feature (514)..(514): n is a, c, g, or t
  modified_base (519)..(519): a, c, t, g, unknown or other
  misc_feature (519)..(519): n is a, c, g, or t
  modified_base (547)..(547): a, c, t, g, unknown or other
  misc_feature (547)..(547): n is a, c, g, or t
  modified_base (557)..(557): a, c, t, g, unknown or other
  misc_feature (557)..(557): n is a, c, g, or t
tcagtacgctgtctcacgaccggtgctcgatttagatcgtctgtgttgggttgggacccaaaaaccacacccctccttgggagaatcccctagatcacagctcctcaccatggactggacctggagcatccttttctggtggcggcagcaacaggtgcccactcccaggttcacctggtagcagtcgtggagcgtgaggtgaagacgccgtggggcctcgagtgaaggtctctgcgagtcttctggtacnttcgttaggngtatgctaatcgacgtgggtgcgtacgcggtccctagggaccgaagggtcgttggaggttggagttacgggagttgggactcggacggctaccgttaanaagttacggaactaactaaagttacgaagaactaacgtacggttaccgaaggacctagtacgtaccaactacgtacgaccgtaacaaacctcgtacgaccgtaacgacgcaccgtaacgtactaacngttacggacgtcgaggngactcgngagntccgngaccgactcgtcgttactagtttacggngtaacggggngggttacgggtattgggtcggtagtaccgcgtaacgcggttacgcgtaccgtaaccggtacggttacggtacccgaccgggtacccggg

SEQ ID NO: 82335 - DNA, 569 bp, Homo sapiens
  misc_feature: GYAE6OF02GKMVF.36.34.D01.1.454.CMB.1.raw
  modified_base (281)..(281): a, c, t, g, unknown or other
  misc_feature (281)..(281): n is a, c, g, or t
  modified_base (411)..(411): a, c, t, g, unknown or other
  misc_feature (411)..(411): n is a, c, g, or t
tcagtacgctgtctcacgaccggtgctcgatttagatcgtctgtgttgggtttggggaacccaaaaccacacccctccttgggagaactcccctagatcacagctcctcaccatggactggacctggagcattccttttcttggtggcagcagcaacaggtgcccactcccaggttcaattggtgcagtctggagctgaactgaagaagcctggggccttagtaaacgtctcctgcaaggcttctggttactcctttcttacgtatggcatcagctgggtncgacaggcccctggacagggctcgagtggagtggggtggatcaggcctacaatggttacacaaactaatgacacggaagttgactacgggaacagaactagaccatgaccacaagacacgccgacgacgnaaccagcgtacgatgggaactgacgggagcctagagacctgacgacgacggccagttatattactcgtagcgaggaataacccgggatccgtagttgttggtaacttaagttttcgggggattccggtacgtggtacttcgttttcgtagtattccgg

SEQ ID NO: 82336 - DNA, 655 bp, Homo sapiens
  misc_feature: GYAE6OF02JZKBG.36.34.D01.1.454.CMB.1.raw
  modified_base (162)..(162): a, c, t, g, unknown or other
  misc_feature (162)..(162): n is a, c, g, or t
  modified_base (195)..(195): a, c, t, g, unknown or other
  misc_feature (195)..(195): n is a, c, g, or t
  modified_base (412)..(412): a, c, t, g, unknown or other
  misc_feature (412)..(412): n is a, c, g, or t
  modified_base (472)..(472): a, c, t, g, unknown or other
  misc_feature (472)..(472): n is a, c, g, or t
  modified_base (485)..(485): a, c, t, g, unknown or other
  misc_feature (485)..(485): n is a, c, g, or t
  modified_base (497)..(497): a, c, t, g, unknown or other
  misc_feature (497)..(497): n is a, c, g, or t
  modified_base (512)..(512): a, c, t, g, unknown or other
  misc_feature (512)..(512): n is a, c, g, or t
tcagtacgctgtctcacgaccggtgctcgatttagatcgtctgtgttgggtttgggggacccgaaaaccacacccctccttgggacgaactccctagatcacagctcctctacgagtcggactggacctgagctattccgtttctggtggcgcacgcaacgngggtcgcctactcccaaggttcaccgttggtcnccgagttcgtggagtctggtaggtagaagacgtcccgtggggcctacggaggttagaacggttcctcccgtagacgaacggttctttagtcggttactacgttcgtttagggaatcgtacgactaactcgtaacgttgggccacgagacggtccctaggacgtaggtcttggagtcgagtacggagttgactacgcgtcgtattacgaagtcgtaanaacgtaacttgagaacgtagtcgtacgagacagtcacacgtactcgaaccatacacctcnctacgacacgaanaccgactacganagacgacgagcgacngtacaggactcgaggacgacgtcgtacgttacgtattacggtcgacgggttacgggttagggtcgttaggtacggttcgaccggttcgaccgttagccgttaacgtacggtaccggtacggttaccggtaccgcggttaccgg

SEQ ID NO: 82337 - DNA, 732 bp, Homo sapiens
  misc_feature: GYAE6OF02HWRDI.36.34.D01.1.454.CMB.1.raw
  modified_base (435)..(435): a, c, t, g, unknown or other
  misc_feature (435)..(435): n is a, c, g, or t
tcagtacgctgtctcacgaccggtgctcgatttagatcgtctgtgttgggtttgggtgcgggggctgggctgccctcataagggcctcccagacaggagtgcagtgggcctggaaggtaggaataggccagagaggcccagctgggcagggagagcagtccagggtggcgtctgccctctgcgggcttggagtcggcgtggggcgctccatcctcgacgcccccgacgggccttcgtcgtccgtttgggtcggcccttcgttcgttcggttcgccgtcccggtaggggacgccgacggcccaacgacggccgggaccctaaccccgtaggcctaacgtttacgtacggtcgttagtcggtggggtacgtcggtcgggccttccggtaggaccggtccccggtagccggaagggaccggccgacgggccccggaanccgaactagtccgaacctccccaactactaccgaaccgtgacgctaggacgtcgtgtcgtaccgtacgtacgtcgacgtccggagacggccgtacggtcccttcccgtttcgtcgtcgtacgcccgtacggtcccgtccgtcccgtcggccgtacgtccgtacgaaccgtaacccgtccccgtaccgggttcgggtaccgttcgggtacggggaacgggtaaccgtacgggtaacccgtaccgggaccggtacccctaccgttacccgtaccggtacggttaccggtacgttcccgg

SEQ ID NO: 82338 - DNA, 804 bp, Homo sapiens
  misc_feature: GYAE6OF02IWFOX.36.34.D01.1.454.CMB.1.raw
  modified_base (259)..(259): a, c, t, g, unknown or other
  misc_feature (259)..(259): n is a, c, g, or t
  modified_base (335)..(335): a, c, t, g, unknown or other
  misc_feature (335)..(335): n is a, c, g, or t
tcagtacgctgtctcacgaccggtgctcgatttagatcgtctgtgttgggtttggggacccaaaaaccacacccctccttgggagaactccctagatcacagctcctcaccatggactggacctggagcattccttttcttggtggcggcacgcaaacaggtgcccactcccaggttcacctggtgcagtctggagctgaggtcaagaacgccgtgggcctcgagtagaagtctacctgccaaggcttcgtaggttacncgttacgttaggaggtatgacaatccacgtcggtcgcgacacggcccctggacgaggacttgagtcggagtggagnggactcgaggtctaccgttaacgtaattaacggtaacgtaaactaaaagttacgtaacgtaaacgtaaacgggttaacgtaccggacgggtacgaaggtaaccggttaccaaccgtaacgttaccgaacccgaaaaccaaaacctaaccgaaccgttacccgaaaccgaccgtaaaccgaaaccgacccgtacgtaaccgaaggttaacgggacgtacggttaacgggaacggtaacgtaccggacgtaacgaacgtccgttaacgaaaccggtacccgacgggttaccgttaggttaaagtttcggttaggtacgggtacggggggttaacggggggtttacgttaccgggttaggggttcgggttaacccaacggttaacccgaaccggtacgtttaacggaaaccccgggttaaaccgttaaaccgggttaaccggggttaaccccggtacccgggttaaccgggg

SEQ ID NO: 82339 - DNA, 845 bp, Homo sapiens
  misc_feature: GYAE6OF02ILKAC.36.34.D01.1.454.CMB.1.raw
  modified_base (198)..(198): a, c, t, g, unknown or other
  misc_feature (198)..(198): n is a, c, g, or t
  modified_base (216)..(216): a, c, t, g, unknown or other
  misc_feature (216)..(216): n is a, c, g, or t
  modified_base (259)..(259): a, c, t, g, unknown or other
  misc_feature (259)..(259): n is a, c, g, or t
  modified_base (368)..(368): a, c, t, g, unknown or other
  misc_feature (368)..(368): n is a, c, g, or t
tcagtacgctgtctcacgaccggtgctcgatttagatcgtctgtgttgggtttggggacccaaaaaccacacccctcttgggagaatccctagatcacagctcctcacatggactggacctggagcatccttttctggtggtcggcagcaacaggtgtccactccgaggttcacctggtgcagtctgtagctgaggtnaagaacgcgttgggcctntacggtgaacgggtctcctgacgaacgctttcgtcggttaacnttaaccgttttaggaggtttacgttcgactacgttccgaaccggttgggttacgaccggacgtaaccgggtccccgttacggggaaccggtaacgggttcgttaacggngggtttacgggagtagggtataccgggtaacagtacggaccgttaccgttaacaacgttttaacgggtaacgtaaacccttaaaattacgttaaccggaacctaagggttaaccgttaccggtaagggtaacgacggtttacggtacctaaccctaactaccgggtaaaacctaaaacctaaaccggtacctaactaaccccgggtaacggtaaacgtaaccgtaaaccggtaccgttaaaccgtttaacgaacggtacgtaaccgggttacggtaagggtaccgggaaggttcccgtagtaaaccggtcttaacgtacggaaccgtaacgtaccgggtacgttacgttaagttacgtttacggtcggggtacgggttaccgggggttattacgggtttacgggtgtaaccgttacgtaaccggtgtacgttaggacccgtaaccggttacgtacggttacccgtacccgggtacgg

SEQ ID NO: 82340 - DNA, 847 bp, Homo sapiens
  misc_feature: GYAE6OF02HFYEZ.36.34.D01.1.454.CMB.1.raw
  modified_base (140)..(140): a, c, t, g, unknown or other
  misc_feature (140)..(140): n is a, c, g, or t
  modified_base (264)..(264): a, c, t, g, unknown or other
  misc_feature (264)..(264): n is a, c, g, or t
  modified_base (424)..(424): a, c, t, g, unknown or other
  misc_feature (424)..(424): n is a, c, g, or t
  modified_base (669)..(669): a, c, t, g, unknown or other
  misc_feature (669)..(669): n is a, c, g, or t
tcagtacgctgtctcacgaccggtgctcgatttagatcgtctgtgttgggtttggggacccaaaaccaccacccctccttgggagaatcccctagatcacagctccctcaccatggactggacctggagcattccttttnttggtgggcggcagcaactagggtgcccctaactcccgaggttctaccgtggtgtccagttcgtgggacgctaggaggtagaagaacgccggtggggccctagaggtaggaacgggtcctccgngacgaggctttacgtcgtactagttacgtttagggagttatggtataaaccgtcgtaccgttaggggtaccgtccggaaacgtccgggttaccccgtaggggaaacctaaggggtcccgttaaggttcggggacggttaacggtgggaacgtgggttacncgttaacggtcttaaaccgtttaacggtaagttaaccgggtaaaccctaaaagttaaacgttaagttacgaaaacgtaacggttaaaccgttccgggaagggccgttagaaaccgggttacaaccggtaacggttaccgaaacctaaaacccgtaaacgaccgtaacgtccgaaacgacgtacgaacgtacgggtacccttaagaccgggtttaaggaacgccggttaacggaacgggttaaccnccggtaagtacgtcgtaacgtacgaaccgacggtaccggtacgttaacggtagttacggacggtacgggtacggggtaggggttagttacggggtttcggacgttacgtacggtaacgtacggtacgttaccgtaacggttaaccggtacggttacggttacccggtacccggtcggg

SEQ ID NO: 82341 - DNA, 703 bp, Homo sapiens
  misc_feature: GYAE6OF02GJ1OU.36.34.D01.1.454.CMB.1.raw
tcagtacgctgtctcacgaccggtgctcgatttagatcgtctgtgttgggtttggggacccaaaaaccacacccctccttgggagaatcccctagatcacagctcctcaccatggactggacctggagcatccttttctggtggcgcagcaacaggtcgcccactccccaggttccacctggtgcagtctggagctgaggtgaagacgccgtgggcctcagtgaaggtctcctgcgaaggcttcgtggttacagttcgttaggagtatgactactcgtacgtgggtcgaccgacgaccggtcccgtaggacgtacggtcgttaggaggtaggtaggtagggtagtggtactcgacggccgttaactaacgtaagtaacgtaaactaagttaaattacgaactaacgtaacggtaacggttaccggacggacgtaagtaccgtaacgaacgacgtaaccgaaccaacgaaacacctacctaccgacgacgacacgtaccgtacctacgtacgtaggacgcgtacggacggccgacgtagacgtacgtcggtacgaccgaccggtaccggtccgttagttacgttaggttcggagggtagggggttaggggttgttggtcgggtcggtaccgtaccgtacggacgtccggtacgtacccggttaaccggtaccggtttacccggtacccgggacccggtaccggg

SEQ ID NO: 82342 - DNA, 873 bp, Homo sapiens
  misc_feature: GYAE6OF02IJYJC.36.34.D01.1.454.CMB.1.raw
  modified_base (583)..(583): a, c, t, g, unknown or other
  misc_feature (583)..(583): n is a, c, g, or t
tcagtacgctgtctcacgaccggtgctcgatttagatcgtctgtgttgggtttgggggagctacaacaggcaggcaggggcagcaagatggtgttgcagacccaggtcttcatttctctgttgctcgtggtactcgtcgtggtcgccgtggcggggactagttcgtagtacgtacgaacccgtaagttcctaccgagtacccttcccgtgggtccttcggttacgttccgttcggtcggggtacgaacgggaccgggaccccaaacgtaacttcccgaaacgttcggacctaacgggttaccaacggaccgtaaggttaggttacgttttaacaacggtaacgtacctaaacctaaaactaaacgtaaaacgttaaaccgtttaaaccgttaaacgttaccggaaaccaacggaaaccgtaaaacccggtaaaaccggtaacggtaacccgtaaccgttaacccttaaaccgtaacgtcgttaccgttaacgttaacggtttacggacggtaacctacggttaacccggtaccgggtaccggttcccggtactacgtaaccgtagtacggacggtcgtacggngggttacggtacgtacggtaactacgttaccttaccgcgtacctacctactacacgaacgtactacgtaccgtcgtacgacggtacgtaagtagtacgtacggtacgttacgttaacgtttttaacgtacgttacgtacgtacgttaacgttaagttaacgttaacgttaacgttacgttaccgttaccgttaaccggttacggtacgggtacgggtaacggtaacggtaaggtaacggtaacgtaacgtaaccggtaacggtacggtacggtacgtacgtaccgtaccg

SEQ ID NO: 82343 - DNA, 773 bp, Homo sapiens
  misc_feature: GYAE6OF02FOEXF.36.34.D01.1.454.CMB.1.raw
  modified_base (731)..(731): a, c, t, g, unknown or other
  misc_feature (731)..(731): n is a, c, g, or t
tcagtacgctgtctcacgaccggtgctcgatttagatcgtctgtgttgggtttggggagctacaacaggcaggcaggggcagcaagagtggtgttgcagacccaggtcttcatttctcgtgttgctctaggatctctggtgccgtggcggggactagtcgtgagtcgacccagtcctaccgagacctccgtgctagtgtctcggtgggcgtaggacggccactataccaactgacgcgtccaggcctaggtagttttacgttactacgacgtacctaaccgaaaagtaaataaacgtaacctttaaccgttaaacttcggaaacacggactaaaccggaaaaccgtggaaacctaccgtaacctaccgttaaaacgtgtaaccttcgttaaacgtttcggaggtaccttaccgttaccggtacccggaacggttccccgggtctacgtaaccgtcgttcaaggtttcggacgacgggttccgggtggtaacgacgtaacgtttccgtttaccgaccgtacgtacccttacgaaccttccgaacgttccgaccgtaccgtcgtaacggtcgtacgtaaggtactcgttagggttaccgtgtttaaccgttttaggtaacgttccacgttaacgaattttaacgttaacgttacgttaaccgttcttaccgtaccgtttaccgttaccggttcggaccgggtaaggtaacccggtagggtaacgtaacggtanaaaccggtaccgttaaggtacggttccggacgtacgtacccg

SEQ ID NO: 82344 - DNA, 864 bp, Homo sapiens
  misc_feature: GYAE6OF02HF0XG.36.34.D01.1.454.CMB.1.raw
  modified_base (183)..(183): a, c, t, g, unknown or other
  misc_feature (183)..(183): n is a, c, g, or t
  modified_base (261)..(261): a, c, t, g, unknown or other
  misc_feature (261)..(261): n is a, c, g, or t
tcagtacgctgtctcacgaccggtgctcgatttagatcgtctgtgttgggtttggggacccaaaaaccacacccctccttgggagaatcccctagatcacagctcctcaccatggactggacctggagcatccttttcttggtggcggcagcaacaggtgcccactcccaggttcacctggtncagtctggagctggaggtgaagagcctgggcctcgagtgaggtctccgtgcaggtcttcgtggtacagtcgtttaggngtatgactaatccgacgtggggtcgacgacgacgggcccctagggaacgaagggtcttaggacggtggagtgggatggatcgagcgtacttaacagttaacggtaaacctaactaaattagacgaaacgtaaggtaaccgttaccgagggcgtaagacgtaccaaccgagtacgaaacccaacgaaacctacgacgttacccggaacgacggaaccccaacgtaccgtaccgtaacgtacgtacgggaacgtaccggtaagggtaccgggtaaccgtacccggtaggttaaaccggtacctttaacccgggttaaccggtaacccgggaacccgggtttcccggggtttaagtttttaaacggtttacgggtttttacggggtaaccgggggttagggggggggttaacccggggggggttttaagtttcggggggtttacggggttacggggttaaccccgtaaccgggtttaaacccggacgggttacccgtttacgggttaaccccgggttttaaccccggttaaaaccgggtttcccccggggttttaacccccgggttaccccggggggtaaccggggttaaaccccccccggggggg

SEQ ID NO: 82345 - DNA, 728 bp, Homo sapiens
  misc_feature: GYAE6OF02FZYEY.36.34.D01.1.454.CMB.1.raw
  modified_base (513)..(513): a, c, t, g, unknown or other
  misc_feature (513)..(513): n is a, c, g, or t
tcagtacgctgtctcacgaccggtgctcgatttagatcgtctgtgttgggtttggggacccaaaaaccacacccctccttgggagaatcccctagatcacagctcctcaccatggactggacctggagcatccttttcttggtggcggcagcaacaggtcgcccaactcccaggttccacctggtgcagtctggagctggaggtgaagaagccgtggggcctcgagtagaacggttcctctgcgagtcttcgtaggttactattacgtttagggagttatcgactaactctacggtgggtcgacgacgtaccgtccccgtaggaacggtacgggtcgttaggaggtggacgtgggagttcggatcgacggcgtaccttaagaagtacgtaactaataattagacgaaacgtaggttaaccgtaccggaaggtacgacgtacgtaccgaactacgtacgaaaccctaaacaacacgtactaccgaacaccgaacaccactaccgtacgagacgngaacgtgggaaccgtgccaggtataccgttcgacgaccggtaccgacggtcgttaagttacgttaagtcggttacggggtagggggttaggggttcttacgggttacgggtacgggttaacccttaccgggtaaaccttgggtacccgttaacgggtaccctaaccgggtttaacccgtccggggtttaacccgtacccggggtaaccccggggg

SEQ ID NO: 82346 - DNA, 918 bp, Homo sapiens
  misc_feature: GYAE6OF02GTMO6.36.34.D01.1.454.CMB.1.raw
tcagtacgctgtctcacgaccggtgctcgatttagatcgtctgtgttgggtttggggacccaaaaccacacccctccttgggagaatcccctagatcacagctcctcaccatggactggacctggagcatccttttcgtggtggccggcagcaacaggtgcccaccgtcccaggttccaccgtggtgcacgttctgggacgtcgtggaggtaggaaacggaacggcccgttgggggaccctcgacggttggaacgggttcctacccgtgggacctaacgggtccctttaccgttagggttaacctacgtttaccgttttaggggaacggtttacgtcggtaacctaacgttcccgtaccggttcgggggttacggccgggtaaccgtacccggggtaccccccggttagggaaccggttaaacgggggtcctttagggtacgggttacgggtagggttacgggtaaggttcggggaacgttccggtacggccgttaccgtttaacggaacggttacggtaaaacccgaacgttaaaatttacggtaacggaaacgtaacggttaacgggttaccggaacggggtaactaacgggtaccgtaacccgtaaccgtacgtaaccggtaaacccaaaaccgtaaacccttaccgaaccttaacccgaaccggtaacgaacccgtaaccgaccggtaacctaaccgtaggtacgggacgtacgtacgggtacgacggtaccgtacgggattacctcggtaccgaccggaaccgtccgggtacgttacgttagttacgttcggacgggtaccggggttagggggttacttggggtacggttcggtaccgtacggtacccgtacgttcggtacgtaccgttaaccggtaccggttaccggttacccggtacccgggtacccgggg

SEQ ID NO: 82347 - DNA, 748 bp, Homo sapiens
  misc_feature: GYAE6OF01AP42H.3.2.A02.1.454.CMB.1.raw
  modified_base (205)..(205): a, c, t, g, unknown or other
  misc_feature (205)..(205): n is a, c, g, or t
  modified_base (302)..(302): a, c, t, g, unknown or other
  misc_feature (302)..(302): n is a, c, g, or t
tcagagacgcactccacgaccggtgctcgatttagactcatctacgaggggaaagggggaggaactgctcagttaggacccagacggaaccatggaagcccagcgcagcttctcctcctcctgctactctggctccctagataccactggagtaagtagttctgatgcagtctccaggcaccctgtctgtgtctccgaagggaanggccacgctacctcctgtacgggccagtcaggagtgtcagacagttattaggctggtaccaacagaaaccgtggaccacggctcccgaggctccgtntacttccagttcggcacaagtcctaaacggcgggtcccgaagtcgggactacgttccgacgtcccgtaaggtttcaaggttcgggacgtacggtaggtaacgttacggtggggaaaccgtacggttaacctttccgacgttcccgtaacccaaccgtaacgttaccgaaacggtaccgtaactaccgttactacggtaacgttacgtttaggtaaacgtttaaccgtttttacggactttaaggttttactttaccgttcgttacgtaacgttacgttaaccggttttaacgaccgggtttaccggttcgttacgggttaaacggttttcgggaccggtaaacggggaccctaaagggttcggtaaccgggtaacgtacccgttaacgtaaaccgtacggttaccggtcggtacgttaccgaacgtaccctacgtaccgttaccgg

SEQ ID NO: 82348 - DNA, 919 bp, Homo sapiens
  misc_feature: GYAE6OF01EPLCO.3.2.A02.1.454.CMB.1.raw
  modified_base (100)..(100): a, c, t, g, unknown or other
  misc_feature (100)..(100): n is a, c, g, or t
  modified_base (176)..(176): a, c, t, g, unknown or other
  misc_feature (176)..(176): n is a, c, g, or t
  modified_base (287)..(287): a, c, t, g, unknown or other
  misc_feature (287)..(287): n is a, c, g, or t
tcagagacgcactccacgaccggtgctcgatttagactcatctacgagggaaaggggggaggaactgctcagttaggacccagacggaaccatgggaacnccccagcgcagcttctcctcctcctgctactctggctccagataccatgggagagtagttctgatgcctagttccnccgaggccaccgttgtccgtgtacgtctccggaaagggggaagccgccacgcctactccgtaggtacgggccaagtcgagactgacagacttatattggctaggtaccaanacgtaacctcggactacggcctaccgaggtcctccttactacgttcgaacgttcggtacgacctaacgtaccgtaaccggaccggggtactagacgggtctaccggttcccagtacccgtaagggtcgtacggcggtacgtagggtagggtaacgttacgggtacggaaaccggtacttacggtaccttacccggttaccctaaccaacgtacgttacccgaacggtacctaaacgttccggtaacgtacggttaacgttacggtaacgttaaacgttttcggtttaacgttacgttttcgtttttaacgttccgtttaaggttaacccggttagttaaacccgttttaaacggggtttaaccccgttacccgggtttaacggggtttacccgggtttttaaacggggggtttaaccccgggttttaccgggggtaaaaacccccgggggtttaggggtaaaacccccgggtaccggggttttaacccggggtaaacgggggttaaacccggttaacccgggtttaaaaccccgttaaaaagggtaaaccgggttttcccggggaaccgggttttaaccaccccgggttaaccccgggttaacttacccggtttaacccgggtttaaccccg

SEQ ID NO: 82349 - DNA, 679 bp, Homo sapiens
  misc_feature: GYAE6OF02FMSPO.3.2.A02.1.454.CMB.1.raw
  modified_base (170)..(170): a, c, t, g, unknown or other
  misc_feature (170)..(170): n is a, c, g, or t
tcagagacgcactccacgaccggtgctcgatttagactcatctactagggtaagggggaggaactgctcagttaggacccagacggaaccatggaagccccagcgcagcttctcctcctcctgctactctggctcccagatacactgtagaagtagttcgtgatgcagtntccacggtcacccctgtctgttcgtcggtccagggaagcgccctacgcctcgtcctggtacggccagtcgagacgttaggtaccgaagtacgacttaagtttagcctaggtaccaacgaggaaaccctggcccagggcctccccgaggcctccctcattcctagtcggtcttacaggtcctaagtgggacctactggcctagtttcccagccgtacggtacgagggttcggcggaacgtttcggtatacgtgggaccaacgtacttccaactacctcgaccaattccagaccaaactttcgtacgtacgttagttcctaggtaacgttagtttcgacttacgtttactttacgtacgtacgtacgttaccgtaacgttttaccgaccgttagggtacccttagggttaacgtttacggtaccgtaacggggtaacctaggtaccgtaggtacgaccgtaccgaaacgtacgttcggtcgtacctacgtacctacccgtactcgttaccg

SEQ ID NO: 82350 - DNA, 618 bp, Homo sapiens
  misc_feature: GYAE6OF02G1GC2.3.2.A02.1.454.CMB.1.raw
  modified_base (216)..(216): a, c, t, g, unknown or other
  misc_feature (216)..(216): n is a, c, g, or t
tcagagacgcactccacgaccggtgctcgatttagactcatctacaggggaaacgggggaaggaactcgctcgagttaaggaccccagacggaaccatggaagccccagcgcagcttctcctcctcctgctacttctgggctcccagataccactgggagaacgtagttcctggatgcaggtctccaggcaccctgtctgtgtctccaggggaaanggccacgctctcctgtacgggccagtcagtagtgtcagtacattaatttggctggtaccaacgagaaacctggccacggctacccagggcctccgtcagttcagtggtgcatctaacgagggtccatggcacttccagtccaggttcagtggcaggtggatagtgggacagacttcactctacaccatcacgacaatctacgcacgtctagagtagtttgtacttagtttagtttcttacgtcgtacgtacgtaacgtttaaccgtaccgttacggtaccgttaggttaacggttttcggaccgtaggggtaaccgtacggtacggtacgggtacgttaccgtaccgtaaacggtaaccgttggttacggtcgttccgtaccgtaccgtacgtcgttaccgg

SEQ ID NO: 82351 - DNA, 527 bp, Homo sapiens
  misc_feature: GYAE6OF01D6S3F.36.53.E09.1.454.CMB.1.raw
  modified_base (508)..(508): a, c, t, g, unknown or other
  misc_feature (508)..(508): n is a, c, g, or t
tcagtacgctgtctcacgaccggtgctcgatttagagagagtgtgttgggtttgggggaggaactgctcagttaggacccagagggaaccatggaagccccagctcagcttctcttcctcctgctactctggctcccagataccaccggggaagttgtgttgacacagtctccagccaccctgactttgtctccgggggaaagagccaccctctcctgcagggccagtcggagtgttttcagctacttaatgtggtaccaacagaaacctggccaggctcccaggctcctcatctatgatacatccaacagggccactggcgtcccagacaggttcagtggcaggtgggtctggggacagacttcactctcaccatcagcagcctggacgcctgaagtattctgctagtttatactgtcagcagtcgttacagttcggcctccgcttcacgtttcggcgggtagggtccaagggtggagagtacaaacgactgtggctggcacatctntcttcattcctcccgctac

SEQ ID NO: 82352 - DNA, 552 bp, Homo sapiens
  misc_feature: GYAE6OF01BHB2U.36.53.E09.1.454.CMB.1.raw
  modified_base (309)..(309): a, c, t, g, unknown or other
  misc_feature (309)..(309): n is a, c, g, or t
  modified_base (389)..(389): a, c, t, g, unknown or other
  misc_feature (389)..(389): n is a, c, g, or t
tcagtacgctgtctcacgaccggtgctcgatttagagagagtgtgttgggtttgggggaggaactgctcagttaggacccagagggaaccatggaagccccagctcagcttctcttcctcctgctactctggctcccagataccaccggggaagttgtgttgacacagtctccagccaccctgactttgtctccgggggaaagagccaccctctcctgcagggccagtcggagtgttttcagctacttaatgtggtaccaacagaaacctggccaggctcccaggctcctcatctatgatacatccaanagggccacgtggccgtcccagacaggttcagtggcagtgggtctgggacagacttcactctcaccatcagcagcctggancctgaagattctgctagtttattactgtcagctagcgttacagttggcctcgctcacgtttcggcgggtaggtccaagggttggagtactacgaaaacggtacttggtaggcttggcaccctagttccgtacgttcttactaatttcccttccccgtcctacg

SEQ ID NO: 82353 - DNA, 585 bp, Homo sapiens
  misc_feature: GYAE6OF01B9AO0.36.53.E09.1.454.CMB.1.raw
  modified_base (399)..(399): a, c, t, g, unknown or other
  misc_feature (399)..(399): n is a, c, g, or t
tcagtacgctgtctcacgaccggtgctcgatttagagagagtgtgttgggtttgggggaggaactgctcagttaggacccagagggaaccatggaagccccagctcagcttctcttcctcctgctactctggctcccagataccaccggggaagttgtgttgacacagtctccagccaccctgactttgtctccgggggaaagagccaccctctcctgcagggccagtcggagtgttttcagctacttaatgtggtaccaacagaaacctggccaggctcccaggctcctcatctatgatacatccaacacgggccactggccgtcccagacaggttcaggtggcaggtgggtctgggacagacttcactctcaccatcagcagctgcagagtgaagtnttcgctaagtttattattgtcagtctaagtaataattaactcggtcccttccggtactacgtttcgggacggtacgggtaccgtaagggtggaagtacgtacgaaaacggtaactggtaggtccgtagaccgacctagttccgttcgttcccgttactacttcccgttccccgtcctacgttaccg

SEQ ID NO: 82354 - DNA, 585 bp, Homo sapiens
  misc_feature: GYAE6OF01CAX2B.36.53.E09.1.454.CMB.1.raw
tcagtacgctgtctcacgaccggtgctcgatttagagagagtgtgttgggtttgggggaggcttggtaaagccggggggtccctgagactctcctgtgcagcctctggattcgtctttgatgattatgccatgagttgggtccgccaggctccagggaaggggctggaatgggtctcggccatcagtgtcagtggtagaaaagacattctacgcagactccgtgaagggccgttcaccatctccagagacaatcccaacagtatactgtatctagacatgaacagcctgacagccgaggacacggccgtatattattgtgcgaaagggaccaatcctcatcactccctatactttgaattactggggccagggacgccctggtccacccgttctccctcacgccctcccaccgaacgggcccacgtccggttccttccccctggccgccctgcctccacggacgccaccctccgagacgccacgacgccggcccgtcgggcctcggcccgtggtccgaaagggtaccttaccttccgacggtaccacggtccgttacgtcggacggccgggcgtgggcgaacggg

SEQ ID NO: 82355 - DNA, 546 bp, Homo sapiens
  misc_feature: GYAE6OF01CEF3M.36.53.E09.1.454.CMB.1.raw
  modified_base (204)..(204): a, c, t, g, unknown or other
  misc_feature (204)..(204): n is a, c, g, or t
tcagtacgctgtctcacgaccggtgctcgatttagagagagtgtgttgggtttgggggaggaactgctcagttaggacccagagggaaccatggaagccccagctcagcttctcttcctcctgctactctggctcccagataccaccggggaagttgtgttgacacagtctccagccaccctgtctttgtctccaggggaaagngccaccctctcctgcagggccagtcagagtgtagcagctacttagcctggtaccaacagaaacctggaccaggctcccaggcctcctcatctatgatacatcctacgagggccactggcactcccagccaggttcagtggcaggtgggtctggggacagacttcactctcaccatcagcacgcctagaacctgaagtattttgacttaagtttattactgtacagcaggcgaggacggtctttcgggcccttacggggaacctaaaggtcggaatatacgaaacgtaacgtgtggcgtgacctaccatctgttcttcactccttcccgactactcgtgaacg

SEQ ID NO: 82356 - DNA, 531 bp, Homo sapiens
  misc_feature: GYAE6OF01E1FP9.36.53.E09.1.454.CMB.1.raw
  modified_base (391)..(391): a, c, t, g, unknown or other
  misc_feature (391)..(391): n is a, c, g, or t
  modified_base (400)..(400): a, c, t, g, unknown or other
  misc_feature (400)..(400): n is a, c, g, or t
  modified_base (460)..(460): a, c, t, g, unknown or other
  misc_feature (460)..(460): n is a, c, g, or t
  modified_base (496)..(496): a, c, t, g, unknown or other
  misc_feature (496)..(496): n is a, c, g, or t
tcagtacgctgtctcacgaccggtgctcgatttagagagagtgtgttgggtttgggggaggaactgctcagttaggacccagagggaaccatggaagccccagctcagcttctcttcctcctgctactctggctcccagataccaccggggaagttgtgttgacacagtctccagccaccctgactttgtctccgggggaaagagccaccctctcctgcagggccagtcggagtgtttcagctacttaatgtggtaccaacagaaacctggccaggctcccaggctcctcatctatgatacatccaacagggccacgtggccgtcccagacaggttcaggtggcaggtgggtctggggacagacttcactctcaccatcagcagtctggancctgaagtnttctgtctagttttatactgtcagcagtcgttacaggttcgcctccgctctacgttcggnggtacgggtccaagggtgagatacgaaacgactggnggctgcaccattctgtcttcattccttcccgctac

SEQ ID NO: 82357 - DNA, 564 bp, Homo sapiens
  misc_feature: GYAE6OF01EJI1D.36.53.E09.1.454.CMB.1.raw
  modified_base (312)..(312): a, c, t, g, unknown or other
  misc_feature (312)..(312): n is a, c, g, or t
  modified_base (442)..(442): a, c, t, g, unknown or other
  misc_feature (442)..(442): n is a, c, g, or t
tcagtacgctgtctcacgaccggtgctcgatttagagagagtgtgttgggtttgggggaggaactgctcagttaggacccagagggaaccatggaagccccagctcagcttctcttcctcctgctactctggctcccagataccaccgggggaagttgtgttgacacagtctccagccaccctgactttgtctccgggggaaagagccaccctctcctgcagggccagtcggagtgttttcagctacttaatgtggtaccaacagaaacctggccaggctcccaggcctcctcatctatgatacatccaacnggggcccacgtcggccgtcccagaccaggttcaggtggcaggtgggtctgggacagacttcactctcaccatcagcagcctggacgcctagaagtattctgctagtttattactgtcagcagtcgttacngttcgcctccgctctacgtttcgggcgggtacgggtccgaagggtggaagactacgaaacgtacgtggtcggtctgacctacctattccgtcgttccttactactttcccttccccgctacg

SEQ ID NO: 82358 - DNA, 549 bp, Homo sapiens
  misc_feature: GYAE6OF01CUKX1.36.53.E09.1.454.CMB.1.raw
  modified_base (371)..(371): a, c, t, g, unknown or other
  misc_feature (371)..(371): n is a, c, g, or t
  modified_base (394)..(394): a, c, t, g, unknown or other
  misc_feature (394)..(394): n is a, c, g, or t
  modified_base (403)..(403): a, c, t, g, unknown or other
  misc_feature (403)..(403): n is a, c, g, or t
  modified_base (438)..(438): a, c, t, g, unknown or other
  misc_feature (438)..(438): n is a, c, g, or t
  modified_base (489)..(489): a, c, t, g, unknown or other
  misc_feature (489)..(489): n is a, c, g, or t
tcagtacgctgtctcacgaccggtgctcgatttagagagagtgtgttgggtttgggggaggaactgctcagttaggacccagagggaaccatggaagccccagctcagcttctcttcctcctgctactctggctccagataccaccggggaagttgtgttgacacagtctccagccaccctgactttgtctccgggggaaagagccaccctctcctgcagggccagtcggagtgttttcagctacttaatgtggtaccaacagaaacctggccaggctcccaggctcctcatctatgatacatacccaaacgacgggccacgtggccgtcccaggacaggttcagtggcaggtgggtctgggacagacttnactctcacatcagcagcctggancctagaagnttctgctagtttattactgtcagcagtcgttaacngtttcggccctccgtctctacgtttcgggacggtagggtccaaggtcgganagtaccaaacgaccgtggtcgtcgtgaccacctatcctgtcttacattcctcccgctacg

SEQ ID NO: 82359 - DNA, 521 bp, Homo sapiens
  misc_feature: GYAE6OF01B1W6J.36.53.E09.1.454.CMB.1.raw
  modified_base (387)..(387): a, c, t, g, unknown or other
  misc_feature (387)..(387): n is a, c, g, or t
  modified_base (395)..(395): a, c, t, g, unknown or other
  misc_feature (395)..(395): n is a, c, g, or t
  modified_base (496)..(496): a, c, t, g, unknown or other
  misc_feature (496)..(496): n is a, c, g, or t
tcagtacgctgtctcacgaccggtgctcgatttagagagagtgtgttgggtttgggggaggaactgctcagttaggacccagagggaaccatggaagccccagctcagcttctcttcctcctgctactctggctcccagataccaccggggaagttgtgttgacacagtctccagccaccctgactttgtctccgggggaaagagccaccctctcctgcagggccagtcggagtgttttcagctacttaatgtggtaccaacagaaacctggccaggctcccaggctcctcatctatgatacatccaacagggccactggcgtcccagacaggttcagtggcagtggtctgggacagacttcactctcaccatcagcagcctggacncctgaagnttctgctagtttattactgtcagcagtcgttacagttcggcctccgctcacgtttcggcggtagggtccaagggtggagatacgaaacgactgtagctgcncatctgtcttcatccttcccgctac

SEQ ID NO: 82360 - DNA, 509 bp, Homo sapiens
  misc_feature: GYAE6OF01EGA8A.36.53.E09.1.454.CMB.1.raw
  modified_base (386)..(386): a, c, t, g, unknown or other
  misc_feature (386)..(386): n is a, c, g, or t
  modified_base (398)..(398): a, c, t, g, unknown or other
  misc_feature (398)..(398): n is a, c, g, or t
  modified_base (447)..(447): a, c, t, g, unknown or other
  misc_feature (447)..(447): n is a, c, g, or t
tcagtacgctgtctcacgaccggtgctcgatttagagagagtgtgttgggtttggggaggaactgctcagttaggacccagagggaaccatggaagccccagctcagcttctcttcctcctgctactctggctcccagataccaccggggaagttgtgttgacacagtctccagccaccctgactttgtctccgggggaaagagccaccctctcctgcagggccagtcggagtgttttcagctacttaatgtggtaccaacagaaacctggccaggctcccaggctcctcatctatgatacatccaacagggccactggcgtcccagacaggttcagtggcagtgggtctgggacagacttcactctcaccatcagcagcctggancctgaagattcngcagtttatactgtcagcagcgttacagttggcctcgctcactttcggnggaggtccaagggtgagatcaaacgactgtggctgcaccatctgtcttcatcttcccgctac

SEQ ID NO: 82361 - DNA, 576 bp, Homo sapiens
  misc_feature: GYAE6OF01D4ZYV.36.53.E09.1.454.CMB.1.raw
  modified_base (358)..(358): a, c, t, g, unknown or other
  misc_feature (358)..(358): n is a, c, g, or t
  modified_base (457)..(457): a, c, t, g, unknown or other
  misc_feature (457)..(457): n is a, c, g, or t
tcagtacgctgtctcacgaccggtgctcgatttagagagagtgtgttgggtttgggggaggaactgctcagttaggacccagagggaaccatggaagccccagctcagcttctcttcctcctgctactctggctcccagataccaccggggaagttgtgttgacacagtctccagccaccctgactttgtcgtccgggggaaagagcccaccctctcctgcagggccagtcggagtgttttcagctacttaatgtggtaccaacagaaacctggccaggcctcccgaggcctcctcatctaatgatacatccaacgagggccacgtcggctcccagacaggttcagtggcagtgggtntagggacagtactcactctacaaccatcagcagcccgtgggacgtcctagaacgtatttcgtgtacgtagttttaattacgtgtacagcagtcgttacnggttcgcctccgcttcgtacgtttcggcggtacgggtaccaagggtggagaactacgaaacgtactaggtcggcgtagacacctagtccttcgtacttcactttcccttcccgcctacg

SEQ ID NO: 82362 - DNA, 546 bp, Homo sapiens
  misc_feature: GYAE6OF01EJIHF.36.53.E09.1.454.CMB.1.raw
  modified_base (440)..(440): a, c, t, g, unknown or other
  misc_feature (440)..(440): n is a, c, g, or t
tcagtacgctgtctcacgaccggtgctcgatttagagagagtgtgttgggtttgggggaggaactgctcagttaggacccagagggaaccatggaagccccagctcagcttctcttcctcctgctactctggctcccagataccaccggagaaattgtgttgacacagtctccagccaccctatctttgtctccaggggaagagccaccctctcctgcagggccagccagagtgttagtacaaaacttgcctggtatacaaacaaaagctaggccaggcctcccaggctcctcatctatgatgcttaccgaaacgggcccctggccactcccaacgaggttacagtcgccgagtcgggtctagggacagtactcactctcaccatcagcagcctaagacgtctagaacgtattttgacttactttaatacttgtacaacncgtactaccgaacgtggcgtacgttcgacgaaggaccaggtcgaggtacaacgatgtgctgccactcgtctgtcttcacttccttcccgcctactcagacgctacg

SEQ ID NO: 82363 - DNA, 522 bp, Homo sapiens
  misc_feature: GYAE6OF01BOA1O.36.53.E09.1.454.CMB.1.raw
  modified_base (203)..(203): a, c, t, g, unknown or other
  misc_feature (203)..(203): n is a, c, g, or t
  modified_base (260)..(260): a, c, t, g, unknown or other
  misc_feature (260)..(260): n is a, c, g, or t
  modified_base (306)..(306): a, c, t, g, unknown or other
  misc_feature (306)..(306): n is a, c, g, or t
  modified_base (495)..(495): a, c, t, g, unknown or other
  misc_feature (495)..(495): n is a, c, g, or t
  modified_base (504)..(504): a, c, t, g, unknown or other
  misc_feature (504)..(504): n is a, c, g, or t
tcagtacgctgtctcacgaccggtgctcgatttagagagagtgtgttgggtttgggggaggaactgctcagttaggacccagagggaaccatggaagccccagctcagcttctcttcctcctgctactctggctcccagataccaccggggaagttgtgttgacacagtctccagccaccctgactttgtctccgggggaaanagccaccctctcctgcagggccagtcggagtgtttcagctacttaatgtgtaccaanagaaacctggccaggctccaggctcctcatctatgatacatcctanagggccacgtggcatcccagccaggttcagtggcaggtgggtctgggacagacttcactctcaccatccagcagcctagacctgaagtatttgactagtttattactgtcagcagcgagacggtctttcggccgtagggaccaaaggtggatagtacaaacgtactgtggctgctacatcgtcgtctcncttcctccnctatctagaacatgtacg

SEQ ID NO: 82364 - DNA, 677 bp, Homo sapiens
  misc_feature: GYAE6OF01BBVSO.36.53.E09.1.454.CMB.1.raw
tcagtacgctgtctcacgaccggtgctcgatttagagagagtgtgttgggtttgggggaggaactgctcagttaggacccagagggaaccatggaagccccagctcagcttctcttcctcctgctactctggctcccagataccaccggggaagttgtgttgacacagtctccagccaccctatctttgtctccaggggaagagccaccctctcctgcagggccagccagagtgttagtacaaaacttagcctggtatacaaacaaaaagctggaccaggctcccaggctcctcatctatgatcgcttaccgaaaacgggcccctaggaccacgtcccaaccgtaggttcacgtcgccgaggtcgggtctggggacaggtaccttcgaacctctaccaccatcacgcacgacctaggactccgtagtaacgtattttcgaccttaattttaacgttaacctcgtaccaaactacgtaccgtaaacctaacgtaccgggaccggtaccggttaccggaacccggtaaacggggaacccgtaacgggtacggaacgggtaacgaaaccgtaacgtacggtacggacgttacggaccaaccgtacgttcgtcgttacttacctacgttaccgtttcccccgaccgttacttaccgtaggaacgtaccgtaaggtacccgg

SEQ ID NO: 82365 - DNA, 603 bp, Homo sapiens
  misc_feature: GYAE6OF01EQZQC.36.53.E09.1.454.CMB.1.raw
  modified_base (339)..(339): a, c, t, g, unknown or other
  misc_feature (339)..(339): n is a, c, g, or t
  modified_base (375)..(375): a, c, t, g, unknown or other
  misc_feature (375)..(375): n is a, c, g, or t
tcagtacgctgtctcacgaccggtgctcgatttagagagagtgtgttgggtttgggggaggcttggtaaagccggggggtccctgagactctcctgtgcagcctctggattcgtctttgatgattatgccatgagttgggtccgccaggctccagggaaggggctggaatgggtctcggccatcagtgtcagtggtgaaaagcattctacgcagactccgtgaagggccggttcacatctccagagacaatcccaaacagtatactgtatctagacatagaacagcctgacagccgaggaccacggcgtatattattgtgacgaaagggaccaatcctnatcactccctatactttgaatacgtgggccagggcncccgtggtcaccgtctcctcacgccctccaccgacggccctactccggttcccttcccccgtcggcccgtccctcgccgtccgacggacgccacccgtccgacgacgaccacgacggcccggcccgtggggcctcggtcccgtcgggtaccgaacgggtaccttaccgttaccgaacgtaccgacgtaccggttacgtcggacggccgggtcgtacgggcgtaacggg

SEQ ID NO: 82366 - DNA, 564 bp, Homo sapiens
  misc_feature: GYAE6OF01ENW0T.36.53.E09.1.454.CMB.1.raw
  modified_base (388)..(388): a, c, t, g, unknown or other
  misc_feature (388)..(388): n is a, c, g, or t
  modified_base (398)..(398): a, c, t, g, unknown or other
  misc_feature (398)..(398): n is a, c, g, or t
tcagtacgctgtctcacgaccggtgctcgatttagagagagtgtgttgggtttgggggaggaactgctcagttaggacccagagggaaccatggaagccccagctcagcttctcttcctcctgctactctggctcccagataccaccggggaagttgtgttgacacagtctccagccaccctgactttgtctccgggggaaagagccaccctctcctgcagggccagtcggagtgttttcagctacttaatgtggtaccaacagaaacctggccaggctcccgggctcctcatctatgatacatccaacagggccactggcctcccagacaggttcagtggcagtgggtctgggacaggacttcactctcacatcagcagcctggacncctagaagtnttctgctaagtttatactgtacagctaggtcgttacaggttcggcccttccggcttcgaccgttttccgggcgggtacgggtacccgaagggttggaacgagtacgaaaacgtacgtggtaggtcgtgaccactgtctgttcttcacttcccttcccgctagtccg

SEQ ID NO: 82367 - DNA, 615 bp, Homo sapiens
  misc_feature: GYAE6OF01AZIM8.36.53.E09.1.454.CMB.1.raw
  modified_base (398)..(398): a, c, t, g, unknown or other
  misc_feature (398)..(398): n is a, c, g, or t
tcagtacgctgtctcacgaccggtgctcgatttagagagagtgtgttgggtttgggggaggaactgctcagttaggacccagagggaaccatggaagccccagctcagcttctcttcctcctgctactctggctcccagataccaccggggaagttgtgttgacacagtctccagccaccctgactttgtctccgggggaaagagccaccctctcctgcagggccagtcggagtgttttcagctacttaatgtggtaccaacagaaacctggccaggctcccaggcctcctcatctatgatacatccaacgacgggccacgtcggccgtcccagaccaggttcaggtggcaggtgggtctggggacagacttcactctcacatcagcagcctgggacncctagaagtactttcgtgtacttagttttacttacgtagtcagtctaggtccgttacgtacggtttcggcccttccgtcttccgtaccggttttccggggacgggtacgggttccgaaaggggttggaacgtaacgtaaccgaaacggtaacgtgggtacggcttggacctaacctgttaccgttcgttaccttaccgacttcccttccccgctacg

SEQ ID NO: 82368 - DNA, 574 bp, Homo sapiens
  misc_feature: GYAE6OF01BT2WE.36.53.E09.1.454.CMB.1.raw
tcagtacgctgtctcacgaccggtgctcgatttagagagagtgtgttgggtttgggggaggcttggtaaagccggggggtccctgagactctcctgtgtagcctctggattcacctttaacaactactggatgtcctgggtccgccaggctccagggaaggggctggaatgggtggccaacatgaagccagatggaagtcagacatactatgtggactctgtgaagggccgattcaccatctccagagacagcgccaatcactcactgtatctgcaaatgaacagcctgagagccgaagacacggctgtttatactgtgcgagagagggctacgttttggagttgttatcgtccctttgactacgtggggccagggaccctggtctccgtctcctctgcttccaccaacgggcccactccgtccttcccccgtggcccgtccctcgccctccgacggacgccacccgtccgacgacgcccacgacggcccgccccgtgggcctcggcccgtcggtcaaacggtcttacctttacgacgacacgtcgtacgtgacggcgggctcgggcgaacggg

SEQ ID NO: 82369 - DNA, 551 bp, Homo sapiens
  misc_feature: GYAE6OF01B1TF9.36.53.E09.1.454.CMB.1.raw
  modified_base (436)..(436): a, c, t, g, unknown or other
  misc_feature (436)..(436): n is a, c, g, or t
tcagtacgctgtctcacgaccggtgctcgatttagagagagtgtgttgggtttgggggaggaactgctcagttaggacccagagggaaccatggaagccccagctcagcttctcttcctcctgctactctggctcccagataccaccggggaagttgtgttgacacagtctccagccaccctgactttgtctccgggggaaagagccaccctctcctgcagggccagtcggagtgttttcagctacttaatgtggtaccaacagaaacctggccaggctcccaggctcctcatctatgatacatccaacagggccacgtggcgtcccagacaggttcagtggcagtgggtctgggacagacttcactctcacatcagcagcctggacgccgtagaagtattctgtctagttttatactgtcagcagtcgtttacgngttacggccttaccggtctccgtacgtttccgggacgggtacgggtccgtaagggtcggagacgtacgaaactacgtggtggctgctaccatcgtctcttcattcctcccgctac

SEQ ID NO: 82370 - DNA, 540 bp, Homo sapiens
  misc_feature: GYAE6OF01D8RU3.36.53.E09.1.454.CMB.1.raw
  modified_base (289)..(289): a, c, t, g, unknown or other
  misc_feature (289)..(289): n is a, c, g, or t
  modified_base (386)..(386): a, c, t, g, unknown or other
  misc_feature (386)..(386): n is a, c, g, or t
  modified_base (399)..(399): a, c, t, g, unknown or other
  misc_feature (399)..(399): n is a, c, g, or t
  modified_base (428)..(428): a, c, t, g, unknown or other
  misc_feature (428)..(428): n is a, c, g, or t
  modified_base (535)..(535): a, c, t, g, unknown or other
  misc_feature (535)..(535): n is a, c, g, or t
tcagtacgctgtctcacgaccggtgctcgatttagagagagtgtgttgggtttgggggaggaactgctcagttaggacccagagggaaccatggaagccccagctcagcttctcttcctcctgctactctggctcccagataccaccggggaagttgtgttgacacagtctccagccaccctgactttgtctccgggggaaagagccacctctcctgcagggccagtcggagtgttttcagctacttaatgtggtaccaacagaaacctggccaggctccaggctcctnatctatgatacatccaacagggccacgtggcctcccagacaggttcagtgcaggtggtctgggacagacttcgactctcaccatcagcagctggacncctagaagattcngctagtttatactgtacagctagcgttangttcgcctcgactcgacgtttcggcggtaggtccaagggtggactagtacgaaacgtactggtacggctggacctaccattcctagttccttacatttccctcccgntaacg

SEQ ID NO: 82371 - DNA, 650 bp, Homo sapiens
  misc_feature: GYAE6OF01DWWUO.36.53.E09.1.454.CMB.1.raw
tcagtacgctgtctcacgaccggtgctcgatttagagagagtgtgttgggtttgggggaggaactgctcagttaggacccagagggaaccatggaagccccagctcagcttctcttcctcctgctactctggctcccagataccaccggggaagttgtgttgacacagtctccagccaccctgactttgtctccgggggaaagacgcccaccctctcctgcagggccagtcggagttgtttcagcttacttaatgtagtaccaacagaaacctggccaggcctcccaggcctcctcatctatgatacactccaacgacgggccacgtggccgtcccagacaggttcagtggcaggtggtcgtgggacagtcttacactctcacctatcagcacgtccgtaggacgtcctagaagtacttcgtgtacgtagttttactacgtgtacagtactagttagtaggtaactacgtacccgttacgggtaccgttaccgggaaccgaaacgggtaccgtaaagggtacggtaaaacgtacggaaaagggtacctagggtacggtaccgtacggtaccctaccgtacgttcgttccgttactttacccgtacctttacccgttcccccggacctacgttaccgtaggtaaaacccgg

SEQ ID NO: 82372 - DNA, 534 bp, Homo sapiens
  misc_feature: GYAE6OF01AXPWO.36.53.E09.1.454.CMB.1.raw
  modified_base (203)..(203): a, c, t, g, unknown or other
  misc_feature (203)..(203): n is a, c, g, or t
  modified_base (311)..(311): a, c, t, g, unknown or other
  misc_feature (311)..(311): n is a, c, g, or t
  modified_base (391)..(391): a, c, t, g, unknown or other
  misc_feature (391)..(391): n is a, c, g, or t
  modified_base (399)..(399): a, c, t, g, unknown or other
  misc_feature (399)..(399): n is a, c, g, or t
  modified_base (403)..(403): a, c, t, g, unknown or other
  misc_feature (403)..(403): n is a, c, g, or t
  modified_base (431)..(431): a, c, t, g, unknown or other
  misc_feature (431)..(431): n is a, c, g, or t
  modified_base (477)..(477): a, c, t, g, unknown or other
  misc_feature (477)..(477): n is a, c, g, or t
  modified_base (517)..(517): a, c, t, g, unknown or other
  misc_feature (517)..(517): n is a, c, g, or t
tcagtacgctgtctcacgaccggtgctcgatttagagagagtgtgttgggtttgggggaggaactgctcagttaggacccagagggaaccatggaagccccagctcagcttctcttcctcctgctactctggctcccagataccaccggggaagttgtgttgacacagtctccagccaccctgactttgtctccgggggaaanagccaccctctcctgcagggccagtcggagtgttttcagctacttaatgtggtaccaacagaaacctggccaggcctcccaggcctcctcatctatgatacatccaanaggccactggcgtcccagacaggttcagtggcaggtgggtctggggacagacttcactctcaccatcagcagcctgggancctgaagnttcngctagtttatactgtcagcagcgttacngttcggcctccgcttcgactttcgggcggtagggtccaagggtganactacaaacgtactggtgctgacaccatcttgttaccttnacttccttcccgctacg

SEQ ID NO: 82373 - DNA, 711 bp, Homo sapiens
  misc_feature: GYAE6OF01DHT25.36.53.E09.1.454.CMB.1.raw
  modified_base (316)..(316): a, c, t, g, unknown or other
  misc_feature (316)..(316): n is a, c, g, or t
  modified_base (428)..(428): a, c, t, g, unknown or other
  misc_feature (428)..(428): n is a, c, g, or t
tcagtacgctgtctcacgaccggtgctcgatttagagagagtgtgttgggtttgggggaggaactgctcagttaggacccagagggaaccatggaacgcccagctcagcttctcttcctcctgctactctggctccagataccgaccggggaagttgtgttgacacagtctccacgccaccctgtactttgtccgtaccgggggaaagacgccaccctctcctgcgacgggccagtcggagttgttttcagtcttacttaagtgtacggtaaccaacgaacgaaaccgtcggaccagggcctcccgaggcctcctnactctatgactactactaccaaacgacggcctacgtcggcccgtacccgaagtacgtaggttccgaaggtggacgtaggtcggtcgtagggactagtacttcgactcacacntcgacgcgacgtcgtaggacgtaccgtagtaacgtcgttaccgtaggtaccgtttaagtttttaaccttacgtaggttaccgaacgtcgtaacggttccgtttaacgtcgggttttccgcccgttcccgtacttccgttaaccgggtttccgggcgggttaacgggtaccgtaagggttacggaacgtaacgtaaccaaacggtacgtcgggtacggtacctagacccgtacctgttacccgttcgttccttaccgtaccgtttccctaaccccgcgttaacg

SEQ ID NO: 82374 - DNA, 647 bp, Homo sapiens
  misc_feature: GYAE6OF01C76E3.36.53.E09.1.454.CMB.1.raw
tcagtacgctgtctcacgaccggtgctcgatttagagagagtgtgttgggtttgggggaggaactgctcagttaggacccagagggaaccatggaagccccagctcagcttctcttcctcctgctactctggctccagataccaccggggaagttgtgttgacacagtctccagccaccctgtactttgtcgtccgggggaaagagccaccctctcctgcgagggccagtcggagttgttttcagtctacttaatgtaggtaccaacagaaacctggccaggctccaggcctctcatctatgatacataccaaacgacgggcccaacgtcggaccgtcccaaggacctacggtttacaggtggccgagggttcgggtacgtggggaacacggtacttcgactctacacatcagcagccgtaggactccgtagaagttacttcgtcgtacttaagttttacttacgtgtacacgtctacgtacgtttactaggttcgttcctaccgtcttacgtaccggttttccgggaccgggttaacgggtaccggtaagggttacgggaacgtaacgtaaccgaaacggtaccgtggtaccggcttagacctacctagttccgttcgttacttacactttcccttccgcttaccg

SEQ ID NO: 82375 - DNA, 590 bp, Homo sapiens
  misc_feature: GYAE6OF01BM7G8.36.53.E09.1.454.CMB.1.raw
tcagtacgctgtctcacgaccggtgctcgatttagagagagtgtgttgggtttgggggaggcttggtaaaggccgggggggtccctgagactctcctgtgcagcctctggattcgtctttgatgattatgccatgagttgggtccgccaggctccagggaaggggctggaatgggtggccaacatgaagccagatggaagtcagacatactatgtggactctgtgaagggccgattccaccatctccagagacagcgccaatcactcactgtatctgacaaatgaacagcctaggagagaccgaagacacggcttgtttaattacgtggtgcgagagagggctacgttttggagttggttatcgtcctttgactacgtggggccacgggtaacctggtcctccgtctcctctcgtctccaccgacggcccacgtcccgtccttcccccgtggtccgcccgtcgtccctccgacggaccgccacccgtccgacgacgccacgaccgcccgcccgtcgggcctcggcccgtcggtaccgaaggtccctaccgttcccgaacgtaccgacgaccgtacgtcggtacggcgggg

SEQ ID NO: 82376 - DNA, 732 bp, Homo sapiens
  misc_feature: GYAE6OF01CEVRV.36.53.E09.1.454.CMB.1.raw
tcagtacgctgtctcacgaccggtgctcgatttagagagagtgtgttgggtttgggggaggaactgctcagttaggacccagagggaaccatggaagccccagctcagcttctcttcctcctgctactctggctcccagataccaccggggaagttgtgttgacacagtctccagccaccctgtactttgtcgtaccgggggaaagacgccaccctctcctgcgagggccaggtcggagttgtttcagtactaacttaatgtacggtaaccaacacgaaacctcggaccacggcctacccgaggccttcctacacttctaatcgaataccactacccaaacgacgggccacgtcgggccctacccgagacgtacggttacgaggtcgggactagggtcggggtactacggggactaacggtacctttaccacttcctaccaacctataccgacgcaacggtccctgggaacctccgttaggtaaacgtactttcgtacgtacttaaggtttttaacttacgttagtaccgtacggactacggttacggtttacgtacgggtttccggacccttccggtcttaccgtacggttttacccgggggacgggttacgggttaccgaagggggttggaacgtaagttacccaaaacgggtacttggggcggtctacgacctacccgtatttcgtccggtttccttacgtaaccttcccgtttccccgaccgttaacg

SEQ ID NO: 82377 - DNA, 917 bp, Homo sapiens
  misc_feature: GYAE6OF01D8EHQ.36.53.E09.1.454.CMB.1.raw
  modified_base (204)..(204): a, c, t, g, unknown or other
  misc_feature (204)..(204): n is a, c, g, or t
  modified_base (264)..(264): a, c, t, g, unknown or other
  misc_feature (264)..(264): n is a, c, g, or t
tcagtacgctgtctcacgaccggtgctcgatttagagagagtgtgttgggtttgggggaggaactgctcagttaggacccagagggaaccatggaagccccagctcagcttctcttcctcctgctactctggctcccagataccaccggggaagttgtgttgacacagtatccagccaccctgactttgtctccgggggaaagngccaccctctcctgcagggccagtcggagttgttttcagcttacttaatgtggtaccaanagaacctggccaggcctcccaggcctcctcatctatgatacataccaacgacgggacccacgtcgggccgtaccccaaggaaccgtagggtttaccaagggttgggaccgtaaggggtttcggggttccgttacggggggaacctaacgggtaacctttccgaacccgtttccttacccaaacccgtacgttaccgaacgggcctaacggtccccgttaggggaaccgtccccgttaaggtaaacggtttaacgtttttttacgggaccgttaaacggttttaccctttaaacgttttaacccggtttacggtttacccgtaacgggttaacccgtttaagggtttaaacgtttaacggggtttaaaaccttaacccggttaacccccgtttaaccgggggtaaccccggttttaacccggggtaaccccgggtaaaaccgggggtaaaccccgttaaaagggggttaacgggtaaaaaccggttaaccggtaaaaacggggtaaaccggttaacgggttacgggtaccgttacggtaacccgtaacccgttaacgtttacccggtttaccggtttacccgttttaacccgtaaccgttttcccccgtttacccccgaccctttaaccgttaccggttaacggtaaaacccgg

SEQ ID NO: 82378 - DNA, 691 bp, Homo sapiens
  misc_feature: GYAE6OF01BAAQI.36.53.E09.1.454.CMB.1.raw
  modified_base (226)..(226): a, c, t, g, unknown or other
  misc_feature (226)..(226): n is a, c, g, or t
  modified_base (238)..(238): a, c, t, g, unknown or other
  misc_feature (238)..(238): n is a, c, g, or t
  modified_base (587)..(587): a, c, t, g, unknown or other
  misc_feature (587)..(587): n is a, c, g, or t
  modified_base (617)..(617): a, c, t, g, unknown or other
  misc_feature (617)..(617): n is a, c, g, or t
tcagtacgctgtctcacgaccggtgctcgatttagagagagtgtgttgggtttgggggaggaactgctcagttaggacccagagggaaccatggaagccccagctcagcttctcttcctcctgctactctggctcccagataccgaccgggtaagttgtgttgacactagtctccagccaccctgactttgtcgtaccgggggaaagagccaccctcgtcctgcgngggaaaaaaccnggtcggagttgttttcagtctacttaatgtggtaccaacagaaaccgtggccacggcctcccgaggcctcctcatctatgatacactaccaacgacgggccacgtcggccgtaccgagacgtacggtctaggtggactaggtgggtcgtagggactagtactttcacgtctaccacctatcacgcgacggccgtcgggacgtcctaaggaacgttctttacctaggtacctttaagttttaacttacgtggtaaccacgggtcttaacggttcccgttttaagcggtttacggccctaccgtcttacgtacggtttcggggacggtaacgggtacgtaagggtcggtanactaacggtaaacgacggttgggtaccggnttacgggacccttaacggtagtttcccgtaggttttcccttaacgtaccctttcccgttaccccggatttaacg

SEQ ID NO: 82379 - DNA, 768 bp, Homo sapiens
  misc_feature: GYAE6OF01A0D88.36.53.E09.1.454.CMB.1.raw
  modified_base (207)..(207): a, c, t, g, unknown or other
  misc_feature (207)..(207): n is a, c, g, or t
tcagtacgctgtctcacgaccggtgctcgatttagagagagtgtgttgggtttgggggaggaactgctcagttaggacccagagggaaccatggaagccccagctcagcttctcttcctcctgctactctggctccagataccgaccggggaagttgtgttgacacagtctccagccaccctgacttttgtccgtaccgggggaaancgcccaccctctcctgcagggccaggtcggagttgttttcagtctacttatgtcggtaccaacgagaaacctggccaggcctccgaggcctcctcatctatgaatacactcccaaacgcgggccacgtcggcccgtaccgaagacgtagggttacaggtcggctagggtcgggtcgtacggggactacggtacctttacgaccttcgtaccaacctacgttccgaacggcctaacggtccccgttaggggaacccgtaccggttaaggaaacggttacgttttaccgtacggttacgtttaaagtttttaacgtttaccgtacggttacctaacgtacgttaacggttaccgtttaacggtacggtttccggtaccccgttccgttaccggtttccgtttaacccggtttccgggggacgggttaaccggggttaccggtaaacggggttcggaacggttaccggttaaaccgtaaaaccggtacgtcgggtacggtcgtaccggaccgtacgtacgttccgttcgttaccttacgtacctttcccttcccggtcttacgg

SEQ ID NO: 82380 - DNA, 609 bp, Homo sapiens
  misc_feature: GYAE6OF01CGC8S.36.53.E09.1.454.CMB.1.raw
tcagtacgctgtctcacgaccggtgctcgatttagagagagtgtgttgggtttgggggaggaactgctcagttaggacccagagggaaccatggaagccccagctcagcttctcttcctcctgctactctggctcccagataccaccggggaagttgtgttgacacagtctccagccaccctgactttgtctccgggggaaagagccaccctctcctgcagggccagtcggagtgttttcagctacttaatgtggtaccaacagaaacctggccaggctccaggctcctcaatctatgatacatcccaagacgggccactggcgtcccagacaggttcagtggcagtgggtctgggacagacttcactctcaccatcagcagcctggacggcctagaagtacttcgtagcctaggttttaactacctgtaccagtcctaggtcctttaacgaggttttcgcccttccggacttccgtaacggttttccgggacggtaacgggttccctaaaggggttcgagacttacgaaaacggtacctggtacggcttagacctaacctagttcttcggttacctttacaacctttcccgttcccgtaccctaacgg

SEQ ID NO: 82381 - DNA, 813 bp, Homo sapiens
  misc_feature: GYAE6OF01BZ07T.36.53.E09.1.454.CMB.1.raw
  modified_base (203)..(203): a, c, t, g, unknown or other
  misc_feature (203)..(203): n is a, c, g, or t
tcagtacgctgtctcacgaccggtgctcgatttagagagagtgtgttgggtttgggggaggaactgctcagttaggacccagagggaaccatggaagccccagctcagcttctcttcctcctgctactctggctccagataccaccggggaagttgtgttgacacagtctccagccaccctgactttgtcgtccgggggaaanagccaccctctcctgcagggccagtcggagtgtttcagtctacttaatgtggtaccaacagaacctggccaggctcccaggcctcctcatctatgactacatacccaaacgacggggccctaacgtcgggcccgtaccccgaagtaccgtaagggtttccaagggttcgggaccgtaagggttcgggggttcgtacgggggaacctaagggtaaccttttcgaacccttcctacccaacctaacttcgaacggccaacggcccgtggggaacgtcccgtaggaacgtactttcgtcggtacgttaagtttttaactttacgttcggttaccgtacggtaccgtaacggttaccggtttaacgtacgggttttccggtaccccgttcccggttcgtttacccgttaccggtttttaccgggggacccggggttaacggggttaacccggtaaggggttacgggtaaggtaaccggttaaccgtaaaaaccgggttaaccgttacgggttacgggtccgttacggtacccggtaacccgttaacgttcccggtttacgtttaccccgttttacgttaacccttttccccgttaccccgttcccgttaacccg

SEQ ID NO: 82382 - DNA, 608 bp, Homo sapiens
  misc_feature: GYAE6OF01ECQWL.36.53.E09.1.454.CMB.1.raw
tcagtacgctgtctcacgaccggtgctcgatttagagagagtgtgttgggtttgggggaggaactgctcagttaggacccagagggaaccatggaagccccagctcagcttctcttcctcctgctactctggctcccagataccaccggggaagttgtgttgacacagtctccagccaccctgtactttgtcgtaccgggggaaagcgccaccctctcctgcagggccagtcggagtgtttcagtctacttaatgtagtaccaacagaaacctggccaggcctcccaggcctcctcatctatgatacactaccaacgcgggccacgtcggccgtcccagacgtaggttcaggtcggcgtagggttgggtcgtaggggactaggtaccttcgaccttcctaccaacctatacgacgccacggccgtagggacgtccgtaggaacgtcttcgtgtactttagtttactacgtgtacagtcgtacgtcgttacgtggttcgcccttcgctcgtacggttcggcgggtacggtaccgagggtggagtactacgaaacggtacgtggtcgcgttgacctacgtattcgtcttcttacacttcctcccgctacg

SEQ ID NO: 82383 - DNA, 569 bp, Homo sapiens
  misc_feature: GYAE6OF01B2N00.36.53.E09.1.454.CMB.1.raw
  modified_base (203)..(203): a, c, t, g, unknown or other
  misc_feature (203)..(203): n is a, c, g, or t
  modified_base (263)..(263): a, c, t, g, unknown or other
  misc_feature (263)..(263): n is a, c, g, or t
  modified_base (452)..(452): a, c, t, g, unknown or other
  misc_feature (452)..(452): n is a, c, g, or t
  modified_base (560)..(560): a, c, t, g, unknown or other
  misc_feature (560)..(560): n is a, c, g, or t
tcagtacgctgtctcacgaccggtgctcgatttagagagagtgtgttgggtttgggggaggaactgctcagttaggacccagagggaaccatggaagccccagctcagcttctcttcctcctgctactctggctcccagataccaccggggaagttgtgttgacacagtctccagccaccctgactttgtctccgggggaaanacgccaccctctcctgcagggccagtcggagtgttttcagctacttaatgtggtaccaanagaaacctggccaggctcccaggctcctcatctatgatacatccaaacgagggcccacgtcggccgtcccagacgaggttcaggtggacaggtgggtctggggacagacttcactctcacatcagcacgctggactcctagaagtacttcgtgtactaagttttacttacgtgtacagcagtcttacgngttcgcctcgtctctacgttcggcggtaggtaccgaagggtggagtacacgaaacgtacgtggtacggctagacctactacgttccgtacttcctacttacccttccncctgtaccg

SEQ ID NO: 82384 - DNA, 562 bp, Homo sapiens
  misc_feature: GYAE6OF01A1855.36.53.E09.1.454.CMB.1.raw
  modified_base (493)..(493): a, c, t, g, unknown or other
  misc_feature (493)..(493): n is a, c, g, or t
tcagtacgctgtctcacgaccggtgctcgatttagagagagtgtgttgggtttgggggaggcttggtaaagccggggggtccctgagactctcctgtgcagcctctggattcgtctttgatgattatgccatgagttgggtccgccaggctccagggaaggggctggaatgggtctcggccatcagtgtcagtggtagaaaagcattctacgcagactccgtgaagggccggttcaccatctccagagacaatcccaaacagtatactgtatctagacatgaacagcctgacagccgagacacggccgtatattattgtgacgaaagggaccaaatcctcatcatccctaactactttgaaattacgtggggccagggacgccctggtcaccgtcctcctcacgccctcccaaccgaacgggcccagttccggtccttcccccgtggcccgtcccctgcctccgacggcgccacccgtccgaagacgtcacgngccggcccgtgggctcgcctggcaaggcctacgtccagccacgcgtactggacgcgggctggcgacggg

SEQ ID NO: 82385 - DNA, 572 bp, Homo sapiens
  misc_feature: GYAE6OF01BPPJZ.36.53.E09.1.454.CMB.1.raw
  modified_base (376)..(376): a, c, t, g, unknown or other
  misc_feature (376)..(376): n is a, c, g, or t
tcagtacgctgtctcacgaccggtgctcgatttagagagagtgtgttgggtttgggggaggcttggtaaagccggggggtccctgagactctcctgtgcagcctctggattcgtctttgatgattatgccatgagttgggtccgccaggctccgagggaagggctggaatgggtctcggccatcagtgtcagtggtgaaaagcattctacgcagactccgtgaagggccgttcaccatctccagagacaatcccaacagtatactgtatctagacatagaacagcctgacagccgaggacacggccgtatattattgtgacgaaaggacaatcctcatcactccctactactttagaatacgtgggaccagggacncccgtggtccaccgtctcctcacgcctcccacgacggccactccggtcccttccccgtcgccgccctcgcctccgaggcgcaccgtcgacgagccacgacgcccggcccgtcgggccgtcgcccgtggtaccgaaggtaccttaccgtccacggacgacggtaccgtacgtcggacggcgggctcgggacgtacgg

SEQ ID NO: 82386 - DNA, 658 bp, Homo sapiens
  misc_feature: GYAE6OF01CX6B3.36.53.E09.1.454.CMB.1.raw
  modified_base (202)..(202): a, c, t, g, unknown or other
  misc_feature (202)..(202): n is a, c, g, or t
  modified_base (291)..(291): a, c, t, g, unknown or other
  misc_feature (291)..(291): n is a, c, g, or t
  modified_base (312)..(312): a, c, t, g, unknown or other
  misc_feature (312)..(312): n is a, c, g, or t
  modified_base (354)..(354): a, c, t, g, unknown or other
  misc_feature (354)..(354): n is a, c, g, or t
  modified_base (381)..(381): a, c, t, g, unknown or other
  misc_feature (381)..(381): n is a, c, g, or t
tcagtacgctgtctcacgaccggtgctcgatttagagagagtgtgttgggtttgggggaggaactgctcagttaggacccagagggaaccatggaagccccagctcagcttctcttcctcctgctactctggctccagataccgaccgggaagttgtgttgacacagtatccagccacctgactttgtctaccgggggaaanagccacctctcctgcagggccagtcggagttgttttcagtcttacttaatgtaggtaccaacagaaactggccaggctccaggctcctnatctatgatacataccaacgnggccacgtggcctcccagactggttcagtggcaggtgggtcngggacagtcttcactctcaccatcagnacgcctaggacgctagaagtattccgtgacttagttttatacgtgtacaacgtctaagtcgttaacgtacggtttcggcccttccgtcgttccgtaacggttttcccgggggacgggttaacgggtacccggtaaaggggttcgggtaacgtaacgttaaccggtaaaaaccggtcgttacgggtcggtcccgttagggaccctaaacccgttagtttcccggtttacggtttcccctttactaccccgttttccccgtaccccgttccgttaaacg

SEQ ID NO: 82387 - DNA, 593 bp, Homo sapiens
  misc_feature: GYAE6OF01D00VS.36.53.E09.1.454.CMB.1.raw
  modified_base (262)..(262): a, c, t, g, unknown or other
  misc_feature (262)..(262): n is a, c, g, or t
  modified_base (390)..(390): a, c, t, g, unknown or other
  misc_feature (390)..(390): n is a, c, g, or t
tcagtacgctgtctcacgaccggtgctcgatttagagagagtgtgttgggtttgggggaggaactgctcagttaggacccagagggaaccatggaagccccagctcagcttctcttcctcctgctactctggctcccagataccgaccggggaagttgtgttgacacagtctccagccaccctgactttgtcgtccgggggaaagagccaccctctcctgcagggccagtcggagtgtttcagctacttaatgtgtaccaanagaacctggccaggctccaggctcctcatctatgatacatccaacgcgggccacgtggccgtccagacaggttcagtggcaggtgggtctgggacagtacttcactctcaacatcagcagcctggacncctagaagtattcgtgacttagttttatacgtgtcagtctagtcgttactcggttcgcccttccgctaccgtacggttttccggggacgggtacggggttaccgaaggggtgggaacgtacgtaaccgaaaacggtacgttggtacggtcttagcctactacgttcttacgttccttacgtactttcccttccccgtactacg

SEQ ID NO: 82388 - DNA, 707 bp, Homo sapiens
  misc_feature: GYAE6OF01DEOFW.36.53.E09.1.454.CMB.1.raw
tcagtacgctgtctcacgaccggtgctcgatttagagagagtgtgttgggtttgggggaggaactgctcagttaggacccagagggaaccatggaagccccagctcagcttctcttcctcctgctactctggctccagataccgaccggggaagttgtgttgacacagtctccagccacctgactttgtcgtaccgggggaaagcgccaccctctcctgcgagggccaggtcggagttcgttttcagtcttacttaagtggtaggtaaccaacaacgaaacctcggaccaggcctacccgaggtcctcctctactctatagaacttacaactacccgaacgacgggccctagtcggaccgtaccgaagaccgtaggttccgagggtcggacgtagggtcgggttacgtgggaacctagttaccttcgacttcctaccaaccgtatccagtccaacggtcccttaggggacaccgtagaacgttacttacgtgtacgtttaacgttttagttacgtcgttacgacgtcgtaacggttacgttacgtacggttcggtccctccgtcttaccgttacggtttcgggccgggttacgggtacggtacgggtacggacgtaacgtaaccgtaaacggtcgtacggtacgtacgtacgactaccgtacgttcgttacgttaccttacgtaccctttcccgttcccgcctacgg

SEQ ID NO: 82389 - DNA, 858 bp, Homo sapiens
  misc_feature: GYAE6OF01EC6HF.36.53.E09.1.454.CMB.1.raw
tcagtacgctgtctcacgaccggtgctcgatttagagagagtgtgttgggtttgggggaggaactgctcagttaggacccagagggaaccatggaagccccagctcagcttctcttcctcctgctactctggctcccagataccgaccggggtaagttgtgttgacacagtctccagcccaccctgtactttgtccgtaccgggggaaagcgcccaccctctcctgcgagggccagtcggtagttgtttcagtctaacttaatgtacggtaaccaacgaacgaaacccgtggaccaacgggtccctacccgaggtccttcctactacttctaatacgtaactacactacccaaacggacggggaccctaacggtccgggaccgtaccccgaaggtaccgtacgggtttaccaagggttcggacgtaagggttcgggggtaccgtacgggggaacctacggttaccttaccgaaccttccgtaacccaaccgtactaccgacggccaacggtcccgttagggaccgttacccgtaaggaacgttacgtttcgtacggtaactttaaggtttttaacttaccggttacgtaccgtacggtaccgtaacggttaccggtttaacgtaccgggtttaccggtccccgttccgtaccgtttaccggttaacccgggttttaccgggggaccggggtttaaccgggttaccggtaaaggggtcgggtaaacgttaaccggttaaaccggtaaaaaccgggttacggttacggggtacggtaccgttacgggaaccccttaaccgtacgtttccgtacgtttacccttacccgttaaccttccccggtttccccgacttaaccgg

SEQ ID NO: 82390 - DNA, 527 bp, Homo sapiens
  misc_feature: GYAE6OF01BHR4O.36.53.E09.1.454.CMB.1.raw
tcagtacgctgtctcacgaccggtgctcgatttagagagagtgtgttgggtttgggggaggaactgctcagttaggacccagagggaaccatggaagccccagctcagcttctcttcctcctgctactctggctcccagataccaccggggaagttgtgttgacacagtctccagccaccctgactttgtctccgggggaaagagccaccctctcctgcagggccagtcggagtgtttcagctacttaatgtggtaccaacagaaaacctggccaggctcccaggctcctcatctatgatacatccaacagggccatggcgtcccagacaggttcagtggcaggtggtctgggacagacttcactctcaccatcagcagcctggagcctgagatctgctagttatactgtcagcagcgttaacagttggacctcgctcactttcggcgagggtccaaggtgagatacaaaacgaactggtacggctaggcacccaagttctagttccttacaatcccttcccgctac

SEQ ID NO: 82391 - DNA, 784 bp, Homo sapiens
  misc_feature: GYAE6OF01EA2YK.36.53.E09.1.454.CMB.1.raw
  modified_base (743)..(743): a, c, t, g, unknown or other
  misc_feature (743)..(743): n is a, c, g, or t
tcagtacgctgtctcacgaccggtgctcgatttagagagagtgtgttgggtttgggggaggaactgctcagttaggacccagagggaaccatggaagccccagctcagcttctcttcctcctgctactctggctcccagataccgaccgggggaagttgtgttgacacgagtctccacgcccaccctgtactttgtccgtaccgggggaaagacgcccacctctcctggcgagggccaggtcggtagttgttttacagtcttaacttaagtcgtacggtaaccaaacgaacggtaaaccgtcggaccgaaggccctacccgacggtccctccgttacacgttcttaatacgtaactacaacctaacccgaaaccggacgggtccctaacggtcgggaccggtacccgaagtaacggtacggtttcgaggttcgggacgtaggggtcgggtacgtacggggaactacggttaccttacaccgttcctaccgtaacctaacgtcgacggtaccgtacggtcccggtagggtaacgtccgttaagtaacgttacgtttccgtacgttacgtttaagttttaaccgtacgttacggttaccaacggtaccgttacgggttaccgtttaacggtccggttttcccgggtacccttccggtaccttccggtttaaccggttccggggtacgggtaacgggttaccgtaagggtacgtaacggtaacaacgtaaccgtagtcgcggtacncgaactctcgttctcgttcttcaaccttccgtccctgtacg

SEQ ID NO: 82392 - DNA, 782 bp, Homo sapiens
  misc_feature: GYAE6OF01AZLKG.36.53.E09.1.454.CMB.1.raw
tcagtacgctgtctcacgaccggtgctcgatttagagagagtgtgttgggtttgggggaggaactgctcagttaggacccagagggaaccatggaagccccagctcagcttctcttcctcctgctactctggctcccagataccgaccggggaagttgtgttgacacagtctccagccaccctgtactttgtcgtaccgggggaagacgcccaccctctcctgcacgggccagtcggagtgttttcagtctacttaatggtacgtaccaacacgaaacctggaccaggcctaccgaggcctcctcactctatgactacactaccaacgacgggccacgtcggccgtacccagtacgtacggttcaggttggacctagggtcggggtccgtaggggaacgtagtacctttcgacctctaccgacctacgtacgacggtaccaccggtcccgttagggaccgttacctagggaacgttacgttccgtacggtactttaaacggttttaaccttacggttacggttaccaacggttacgtaccggttaaccggtttaacggtccgggtttcccgggtccccgttacccggtcccgttttaccggtaacccggggtttttaccgggggaccggggttacccggggttaaccggttaaaggggtcggaacggtaacgttaaacccggaaaacgttaccggttagggtcccggtacgtaccgaaccgtacgttaaccgttcgttacggttacccttcgtacctttccccggtccccgtcgttaacccg

SEQ ID NO: 82393 - DNA, 800 bp, Homo sapiens
  misc_feature: GYAE6OF01C5R52.36.53.E09.1.454.CMB.1.raw
  modified_base (269)..(269): a, c, t, g, unknown or other
  misc_feature (269)..(269): n is a, c, g, or t
tcagtacgctgtctcacgaccggtgctcgatttagagagagtgtgttgggtttgggggaggaactgctcagttaggacccagagggaaccatggaagccccagctcagcttctcttcctcctgctactctggctcccagataccgaccggggaagttgtgttgacacagtatccagccaccctgactttgtcgtccgggggaaagacgccaccctctcctgcagggccaggtcggagttgttttcagcttacttaatgtggtaaccaanacgaacctggccacggctccgaggcctcctcatctatgatacactaccaacgacgggacccacgtcggccgtacccaggtactgggttacaggtcggacgtagggtcgggtcgtacggggactaacggtacctttccgaaccttcctaccaacctacttaccgaagtcccaacggcccgttagggaaccgcccgttaaggaacgttctttaccgtaggtacctttaaggttttttacttaacggttcggttaccaagggtaccctaagggttacccgttttaaacgttcgggtttacccgggccctttaccccgggtcgtttacccgttacccgggtttttacccgggggacgggggttaaccggggttttaaccggaaacgggggttcggttaacgggtaaacttaaaccccgggaaaaggtcccggtttagggtacggtcccggttaacgacccggttaaacccttacgtttacccgtttcgttttaccgttccctaaccgttttcccgttcccccggtaccttaacgg

SEQ ID NO: 82394 - DNA, 738 bp, Homo sapiens
  misc_feature: GYAE6OF01DOH8C.36.53.E09.1.454.CMB.1.raw
tcagtacgctgtctcacgaccggtgctcgatttagagagagtgtgttgggtttgggggaggaactgctcagttaggacccagagggaaccatggaagccccagctcagcttctcttcctcctgctactctggctccagataccgaccgggaagttgtgttgacacagtctccagccaccctgactttgtccgtaccgggggaaagacgccaccctctcctgcgagggccagtcggagttgttttcagtctacttaatgtaggtaaccaacgacgaaaccgtggaccaaggcctccgaggtcctcctacacttctatgactacatacccaacgacggaccacgtcggaccgtacccagtaccgtaggttcgaggtcggacgtagggttcgggtcgtacggggaactacgtaccttcgaaccttctaccgaacctatccgacgtccgaacggtccgttagggacctaccgtaggaacgttacttccgtaggtacctttaagttttactacgtgtacgagtaccgtagttaccgttacgtacggtttccggtccctaccgtccttcggttaaccggttttccggggacgggttaaccgggtaccggtaaggggttacggacgtaacgttaaccggaaaacggttacgttcgggtacggttacctacggtacccgtaacccgtcgtttaccgttaccggttaccttacctaaccggtttccccttacccggaccgttaacgg

SEQ ID NO: 82395 - DNA, 406 bp, Homo sapiens
  misc_feature: GYAE6OF01ER3Y2.36.53.E09.1.454.CMB.1.raw
  modified_base (209)..(209): a, c, t, g, unknown or other
  misc_feature (209)..(209): n is a, c, g, or t
  modified_base (397)..(406): a, c, t, g, unknown or other
  misc_feature (397)..(406): n is a, c, g, or t
tcagtacgctgtctcacgaccggtgctcgatttagagagagtgtgttgggtttgggggaggaactgctcagttaggacccagagggaaccatggaagccccagctcagcttctcttcctcctgctactctggctcccagataccgaccggggtaagttgtgttgacacagtctccagcccaccctgtactttgtcgtaccgggggaaancgccaccctctcctgcgagggccagtcggagttgtttcagtcttacttaagtcggtacggtaaccaaacgaacgtaaaaccgtggaccaacggccttacccgaggtcctccctactaacttcctaagtgtaactaaccgaacttacccgaaaacggacggggccctaacggttccggaccccgttaannnnnnnnnn

SEQ ID NO: 82396 - DNA, 681 bp, Homo sapiens
  misc_feature: GYAE6OF01CYL7S.36.53.E09.1.454.CMB.1.raw
  modified_base (224)..(224): a, c, t, g, unknown or other
  misc_feature (224)..(224): n is a, c, g, or t
  modified_base (241)..(241): a, c, t, g, unknown or other
  misc_feature (241)..(241): n is a, c, g, or t
  modified_base (366)..(366): a, c, t, g, unknown or other
  misc_feature (366)..(366): n is a, c, g, or t
  modified_base (626)..(626): a, c, t, g, unknown or other
  misc_feature (626)..(626): n is a, c, g, or t
  modified_base (641)..(641): a, c, t, g, unknown or other
  misc_feature (641)..(641): n is a, c, g, or t
  modified_base (654)..(654): a, c, t, g, unknown or other
  misc_feature (654)..(654): n is a, c, g, or t
tcagtacgctgtctcacgaccggtgctcgatttagagagagtgtgttggggttgggggaggaactgctcagttaggacccagagggaccatggaacgccccagctcagtccttctcttcctcctgctactctggcctccagactaaccggaccgggtaagttgtgttacgacactagtcctccacgccctacccgtgtactttcggtccggtaccgggggaaancgccctaccctctccgngcgacgggcctaggtcggtagtttcgtttcagtacttaacgttaagtcggttacggtaaccaaacaacggtaaaccgtggaccgtacgggccctaccccgaggtccctacctctaattcgtagtntaaactctaacgtaccaacggtacggaccgacgtcgacccgtacccgagtaccgtaggttcaggtcggcgtacgggtcggtcgacgggactacgtaccttcgactctaccacatccagccagtccgtagactcgtagactactcgtagtacttagtttactcggtatcagacgtcgtacgttacgtcgttccggcctccgtcgtaaccgtcggttaccgggcggtacggtaccgagggtacgtagaacgtaacgtaacgnggttcgtaagcgtanacgtcacgttcgnttacgtacctggtaccctcgtactacg

SEQ ID NO: 82397 - DNA, 639 bp, Homo sapiens
  misc_feature: GYAE6OF01A00XB.36.53.E09.1.454.CMB.1.raw
  modified_base (269)..(269): a, c, t, g, unknown or other
  misc_feature (269)..(269): n is a, c, g, or t
  modified_base (383)..(383): a, c, t, g, unknown or other
  misc_feature (383)..(383): n is a, c, g, or t
tcagtacgctgtctcacgaccggtgctcgatttagagagagtgtgttgggtttgggggaggaactgctcagttaggacccagagggaaccatggaagccccagctcagcttctcttcctcctgctactctggctcccagataccaccgggggaagttgtgttgacacagtcctccagccaccctgactttgtcgtccgggggaaagagcccaccctctcctgcgagggccagtcggagttgtttcagctaacttaatgtcggtaccaanagaaacctggccaggctcccaggcctcctcatctatgatacatccaacagggccacgtcggcgtcccagactaggtcagtggcaggtgggtctgggacagacttcactctcacntacagcacgcctagggactccgtagaacgtattcctagtcttaagtttacttactgtacgagtacacgtacgttactaggttcggtcctccgtcttaccgtacgtttcgggacgggtacgggtaccgtaagggtcggaacgtacgtaaccgaaaacgtacgttacgggtacggtccgtacggacccgaaccttacgttccgtttacggtttaccttaccgttaccgtttaccccgttacccccggtcttaacccgg

SEQ ID NO: 82398 - DNA, 666 bp, Homo sapiens
  misc_feature: GYAE6OF01BBSV2.36.53.E09.1.454.CMB.1.raw
  modified_base (205)..(205): a, c, t, g, unknown or other
  misc_feature (205)..(205): n is a, c, g, or t
tcagtacgctgtctcacgaccggtgctcgatttagagagagtgtgttgggtttgggggaggaactgctcagttaggacccagagggaaccatggaagccccagctcagcttctcttcctcctgctactctggctcccagataccgaccggggaagttgtgttgacacagtctccagccaccctgactttgtcgtccgggggaaanacgccaccctctcctgcagggccagtcggagttgtttcagcttacttaatgtggtaccaacagaaacctggccaggcctcccaggcctcctcatctatgactacactacccaaacgacgggcctacgtcggcctccagaccgaggttccaggttcggactagggttcgggtctggggaactaggtacttcacttcctacaccatcagcacgccgtaggacgtccgtaagtagtactttcgacgtacttagtttacgtacgtgtacagtacgtacggtaccgttacgtaggtttccggaccctcgtctcgttaaccgtttcgggacgggtacgggttacgaagggttcggaacgtacgtaaccgtaaacggtacgttcggtacgggtacgttacgacccgtaacctacgttaccgttacgttccttacgttaacctttccccgttcccgtaaccgttaaccg

SEQ ID NO: 82399 - DNA, 717 bp, Homo sapiens
  misc_feature: GYAE6OF01C68UX.36.53.E09.1.454.CMB.1.raw
  modified_base (205)..(205): a, c, t, g, unknown or other
  misc_feature (205)..(205): n is a, c, g, or t
  modified_base (304)..(304): a, c, t, g, unknown or other
  misc_feature (304)..(304): n is a, c, g, or t
tcagtacgctgtctcacgaccggtgctcgatttagagagagtgtgttgggtttgggggaggaactgctcagttaggacccagagggaaccatggaagccccagctcagcttctcttcctcctgctactctggctccagataccgaccggggaagttgtgttgacacagtctccagccaccctgactttgtcgtaccgggggaaancgccaccctctcctgcgagggccagtcggagttgttttcagtcttacttaagtgtacggtaaccaacgaagaacctggccaaggcctcccgagctcctnatctatgatacactaccaaacgcgggccacgtcggaccgtacccaggactacggttacgaggtggaccagggttcgggtcgtaggggactagtacttacacgtctacaccagtacagcacggtccgtagggactccgtagtaacgtctttcgtagtacgttagttttactacgttcgtacgtacggtacgtaacggttaccggtttaacgtacgggtttcccggtacccttaccggtccctttaccggttaccgggttttaccgggggaccggggttacggggttacccggtaaaggggttcggtaacggtaacgttaaaccgtaaaacggtacggttcgggtacggtccgtacggacccttacgtacgttacgttcgtttaccttactaccgtttcccctcccgccttaacg

SEQ ID NO: 82400 - DNA, 750 bp, Homo sapiens
  misc_feature: GYAE6OF01DJSKX.36.53.E09.1.454.CMB.1.raw
  modified_base (203)..(203): a, c, t, g, unknown or other
  misc_feature (203)..(203): n is a, c, g, or t
  modified_base (261)..(261): a, c, t, g, unknown or other
  misc_feature (261)..(261): n is a, c, g, or t
tcagtacgctgtctcacgaccggtgctcgatttagagagagtgtgttgggtttgggggaggaactgctcagttaggacccagagggaaccatggaagccccagctcagcttctcttcctcctgctactctggctcccagataccaccggggaagttgtgttgacacagtctccagccaccctgactttgtctccgggggaaangccaccctctctgcagggccagtcggagtgttttcagcttacttaatgtggtaccaanaagaacctggcaggctcccaggtctcctcatctatgatacatccaacgacgggccacgtcggccgtcccagacctaggttccaaggtgggactaggttgggtctaggggaactaggtacctttcaccttcctacaaccctagtaccaggccgacggtacccgtgggacgtaccgttaggaagtacgtttcgtacgtaacttagtttttaacgtttacgtagttcgaacgtcgtaaacggttccgttttaactacgggtttccgtacccgttcccgtacgttaccgttaccggttttaccggggaccggggttaacggggttacccgtaaagggggttacggaacggtaaccgttaaaacccgtaaaaccgggtacccgtttaggggacccggtttacggtacccggtaccgtaaccccgtaagtttccgtttacggtttccccgttaaccgttacccgtttcccctttacccccggacgtttaaacccg

SEQ ID NO: 82401 - DNA, 645 bp, Homo sapiens
  misc_feature: GYAE6OF01BSH8K.36.53.E09.1.454.CMB.1.raw
  modified_base (201)..(201): a, c, t, g, unknown or other
  misc_feature (201)..(201): n is a, c, g, or t
  modified_base (426)..(426): a, c, t, g, unknown or other
  misc_feature (426)..(426): n is a, c, g, or t
tcagtacgctgtctcacgaccggtgctcgatttagagagagtgtgttgggtttgggggaggaactgctcagttaggacccagagggaaccatggaagccccagctcagcttctcttcctcctgctactctggctcccagataccaccgggaagttgtgttgacacagtctccagccaccctgactttgtctccggggaaanacgccaccctctcctgcagggccagtcggagtgtttcagctacttaatgtgtaccaacagaaacctggccaggctcccgaggctcctcatctatgatacactccaacgacgggccctaacgtcggccgttacccagaccagggtttccaaggttcggcaggttgggtcgtggggacaggtacctttcgaactccgtacaccagtccaagccaagccgtagggacnccgtagaacgtacgtttcgagtactagttttaacttacttagtactagtctacggtcgtttaacgagtttcggacccttccgcttcgtaccgtttccgggacggttacggtaccgtagggtcggagtaacgtaccgaaacgtacgtggtcggactacggacctaccgtagtttcctacggttcccttacgtaccttccccgttacccggccttaaccgg

SEQ ID NO: 82402 - DNA, 667 bp, Homo sapiens
  misc_feature: GYAE6OF01AZPRY.36.53.E09.1.454.CMB.1.raw
tcagtacgctgtctcacgaccggtgctcgatttagagagagtgtgttgggtttgggggaggaactgctcagttaggacccagagggaaccatggaagccccagctcagcttctcttcctcctgctactctggctcccagataccaccggggaagttgtgttgacacagtctccagccaccctgactttgtcgtccgggggaaagagccaccctctcctgcagggccagtcggagtgtttcagtctacttaatgtggtaccaacagaacctggccaggcctccaggcctcctcatctatgactacataccaacgacgggccacgtcggccgtcccagacgtacggttcaggtggccgtaggtcgggtcgtgggaacagtaccttcacgttctacaccgtactacacgcgacggtcccgtacgggacgtccgtagtaacgtacttcgtagtaccttagttttacttactcgttacgacgtacgtacgtcgttaacgtcggttacgtcccgttcccgtcttccgtacggttttccgggacgggtacgggttaccgaagggttacgggacgtaagtaaccgaaaacggttacgtagggtcggtcgtacgacgtacctaccgttacctacgtttccgttactaccgtttccccgttccccgtaccgttaacg

SEQ ID NO: 82403 - DNA, 758 bp, Homo sapiens
  misc_feature: GYAE6OF01A6DEZ.36.53.E09.1.454.CMB.1.raw
tcagtacgctgtctcacgaccggtgctcgatttagagagagtgtgttgggtttgggggaggaactgctcagttaggacccagagggaaccatggaacgccccagctcagcttctcttcctcctgctactctggcctcccagactaccgaccggggtaagttgtgttgacacagtctccagccacctgtactttgtcgtaccggggaagcgccacctctcctgcgagggccaggtcggagttgtttcagtcttaacttaatgtcgtaaccaacacgaaaccgtcggaccaggcctacccgacggtccttcctactactctatacgaacttaccactaccaacgcgggaccctacggtcggcccgtacccgaggaaccgtaggttcaggtcggtactagggtcggggtactacggggaactacggtaccttacgaccttccgtacccaacctacgtcgaacgtccgaaccggtcccgtaagggtacccggtaccgtaaggtaaacgttacgtttccggtacgtacgttttaacgttttaacgttaccgttaggtacccgaggtaccgtaacggtttccgttaaacgtcggggtttcccgtacccttccgtacgttaccggtttaccgggttaccgggaccgggggttaacggtaccgtaagggtacggtaacgtacgtaaacggaaccgttacgtggtacgcggttacgcgtaccttacggttcttacgttaccttcgtaccgttccctccgtacgtacg

SEQ ID NO: 82404 - DNA, 640 bp, Homo sapiens
  misc_feature: GYAE6OF01AXV2M.36.53.E09.1.454.CMB.1.raw
  modified_base (206)..(206): a, c, t, g, unknown or other
  misc_feature (206)..(206): n is a, c, g, or t
  modified_base (433)..(433): a, c, t, g, unknown or other
  misc_feature (433)..(433): n is a, c, g, or t
tcagtacgctgtctcacgaccggtgctcgatttagagagagtgtgttgggtttgggggaggaactgctcagttaggacccagagggaaccatggaagccccagctcagcttctcttcctcctgctactctggctcccagataccgaccggggaagttgtgttgacacagtctccagcccaccctgactttgtctaccgggggaaanagcccacctctcctgcagggccagtcggagtgttttcagtcttacttaatgtacggtaccaacgagaaacctggccaggcctcccgaggcctcctcattctatagatacataccgaacgagggccacgtggccgtcccagctaggttcaggtggcaggtgggtctggggacaggacttcactctaccaccatcagcacgcctagggactccgtagaagtactttcgngtcttaagttttattacttgtacacgtcgtacgtccgttacgtacgttccggtccttcccgtcgttccgtaccgtttccgggaccgggttacgggttaccgaacggggttaggacgtaacttaccgaaacggtacgtaggtcggtacgtgacccgtacgtagtccgttacttccgtttaccaccgtttcccttccccggtcttaccg

SEQ ID NO: 82405 - DNA, 707 bp, Homo sapiens
  misc_feature: GYAE6OF01EMSNE.36.53.E09.1.454.CMB.1.raw
  modified_base (204)..(204): a, c, t, g, unknown or other
  misc_feature (204)..(204): n is a, c, g, or t
  modified_base (263)..(263): a, c, t, g, unknown or other
  misc_feature (263)..(263): n is a, c, g, or t
  modified_base (702)..(702): a, c, t, g, unknown or other
  misc_feature (702)..(702): n is a, c, g, or t
tcagtacgctgtctcacgaccggtgctcgatttagagagagtgtgttgggtttgggggaggaactgctcagttaggacccagagggaaccatggaagccccagctcagcttctcttcctcctgctactctggctcccagataccaccggggaagttgtgttgacacagtctccagccaccctgactttgtcgtccgggggaaangccaccctctcctgcgagggccagtcggagttgtttcagctacttaatgtagtaccaanagaaacctggccaggcctcccaggcctacctcactctaatgactaacacttaccaacgacggggaccctacggtccggaccgttcccgaaggacgtacgggtttcaaggtcggaccgtagggttcgggtcgtacgggggaactacggtacttcaccgttctacgaaccctatacgagccacggtccgtgggaacgcccgtaaggaacgttacgtttcctaggttacttaaggtttttaacttaacgttcggtaccgtaaggtccgtaaggttacccgtttaacgtcggtttacccgggtcccctaccggtccttaccggttaaccggtttccggggacggggttacgggtacccgtaagggtcggaacgtacgtaaccgaaacggtacgtgtcgggtctcgactaccgagttcgcgttccttactacttcccttcccgntaacg

SEQ ID NO: 82406 - DNA, 680 bp, Homo sapiens
  misc_feature: GYAE6OF01DSUE8.36.53.E09.1.454.CMB.1.raw
  modified_base (300)..(300): a, c, t, g, unknown or other
  misc_feature (300)..(300): n is a, c, g, or t
tcagtacgctgtctcacgaccggtgctcgatttagagagagtgtgttgggtttgggggaggaactgctcagttaggacccagagggaaccatggaagccccagctcagcttctcttcctcctgctactctggctcccagataccaccgggaagttgtgttgacacagtctccagccaccctgactttgtctccggggggaaagagccaccctctcctgcagggccagtcggagtgttttcagctacttaatgtggtaccaacagaaacctggccaggctccaggctcctcatctatggtncatccagggagggccacgtggcactcccagacaggttcaggtggcaggtgggtctgggactaggacttcactctcaccatccgagcagactggacgcctagagtagtttgctagttgttaattacgtgtacagcgtaaggttagttcgggttacgtccccggttttcggggacggggtaacgggaaccgtaaggggttacgggaagtaaccgtaacgtaaaaccgggtacgttacgggttacggggtaccttccgggaaccctaaaccccgttagtttaccccgttaagggttttacccctttaccggttaacccttttaccccggtttacccccggaccctttaaccgtttaccgttaaccgggaaacggtaaacccgg

SEQ ID NO: 82407 - DNA, 941 bp, Homo sapiens
  misc_feature: GYAE6OF01CUALH.36.53.E09.1.454.CMB.1.raw
tcagtacgctgtctcacgaccggtgctcgatttagagagagtgtgttgggtttgggggaggaactgctcagttaggacccagagggaaccatggaagccccagctcagcttctcttcctcctgctactctggcctccagataccgaccggggtaagttgtgttgacacagtctccacgccaccctgtactttcgtcgtccgggggaaagacgcccacctctcctgcgacggggccaggtcgggtagttcgttttcacgtacttaacgttaaagtcggttacggtaaccaaactacggaaaacccgtcgggaccacgggccctcccgacgggccttccctactaattccgttaattcgaaacttaaccaactaccccgaaaacggccgggaccctaaccggttaccgggcctaccccggaaggtaaccgtagggtttacccgaagggttccggcgtaaggggttcggggtcttacgggggactaacggtaccttacctaccttacctaccggtaaccctaagttaccgaacgtaccgtaacggtcccggttagggaccggttaccgagggtaaacggttacgtttaccgtcgtacgtttaggtttttaattacccgttggttaaccgaccggttacgtaacgggttaccccgtttaaggttaccggtttcccgggttaccctcccgggttacccgtttacccggtttaaacccggggttttccggggggaaccccgggggtaaaccgggggtttaacccggtaaaggggggtttacggaaaacgggggtaaacccttaaacccggtaaaaacggttaaccgggtttacgggttaccgggtacgtttaaccgggaacccttaaaccgttccggttttaccggttaccggttttacccttacgggttaacccttttcccccgttcccgtacccccggttaacgg

SEQ ID NO: 82408 - DNA, 800 bp, Homo sapiens
  misc_feature: GYAE6OF01AIX89.36.53.E09.1.454.CMB.1.raw
  modified_base (215)..(215): a, c, t, g, unknown or other
  misc_feature (215)..(215): n is a, c, g, or t
tcagtacgctgtctcacgaccggtgctcgatttagagagagtgtgttgggtttgggggaggaactgctcagttaggacccagagggaaccatggaacgccccagctcagcttctcttcctcctgctactctggcctcccagactaccgaccgggggtagttgtgttgacacgagtcctccagcccaccctgtactttgtccgtaccgggggaaancgcccacccgtctccgtgcagggccaggtcggagtttcgtttcagtacttacttaagtcggtacggtaacccaaacgaacgtaaaccgtcggacccagggtcctacccgacggtccctccctacacttacgtatacgtacttaaccactacccgaaccggcgggaccctacgtcggaccgttcccgaagacgtacggttcgaggtcggacgtaggtcgggtacgtacggggactacgtacgttacgaccttcctaccaacctagtacacggcctaacggtcccgtcggaccgtaccgtagtaacgttcttacgcttacgtttaagtttacttacgtcgtaccgacggtacttacggtacgtttacgtccgggtttaccgtcccgttaccgttccttacccggttacgggtttccgggaaccggggttacgggtaaccggttaacggggcggttaaaccggtacgttaaacccggtaaaccggttacgtacgggttaccgggtccgttaaccggaacccgtaccgttacgttacccgttacgtttcccgttaacccttccgtaccccgtttcccgtaccgttaacg

SEQ ID NO: 82409 - DNA, 728 bp, Homo sapiens
  misc_feature: GYAE6OF01AGXO5.36.53.E09.1.454.CMB.1.raw
  modified_base (199)..(199): a, c, t, g, unknown or other
  misc_feature (199)..(199): n is a, c, g, or t
tcagtacgctgtctcacgaccggtgctcgatttagagagagtgtgttgggtttgggggaggaactgctcagttaggacccagagggaaccatggaagccccagctcagcttctcttcctcctgctactctggctccagataccacggggagttgtgttgacacagtctccagccaccctgtacttgtcgtccggggaanacgccacctctcctgcagggccaggtcggtagttgttttacagtctaacttagtcgtacggtaaccaacaagaaccgtggaccgaggtcctacccgaggcctactcacttctatagactacataccgaacgacgggtaccacgtcgccgtaccgagacgtacggttcgaggtcggagtcgggttacgggtctaccggggactagtacgttacaccttctacgaaccctgtaccgacgacgtaacgtcccggagggtaacgtcccgttaagtaacgtacttttaccggtacgtacgttttaaacgttttaactttacggttacgtaacgtacgtacgtaagttaaccgttagggtaacctaccggttaccgttacgggttaaccggtaccgggtaaccgggtaaagggtaacccgtaaagggtacgaaacggttaaccggaaaggttaacgtacggttcggactacgaacgtactaccggttattcgtacgttacctaccgttccgtacccaaccgtctaggtccgaaag

SEQ ID NO: 82410 - DNA, 884 bp, Homo sapiens
  misc_feature: GYAE6OF01AO5CP.36.53.E09.1.454.CMB.1.raw
tcagtacgctgtctcacgaccggtgctcgatttagagagagtgtgttggggtttgggggaggaactgctcagttaggacccagagggaaccatggaacgccccagctcagcttctcttcctcctgctactctcggcctcccagactaccgaccggggtaagttgtgttgacactacgtctccggcctacctgtactttcggtccggtaccgggggaaagcgcccgtaccctctccgtgaccgacgggccacggtcgggtagttcgtttacacggtaccttactttaagtcggtaccggtaaccaaacgtaacggtaaaccgtcggaccgtacggtcccgtacccgacggtccttaccctactaacttacttaacgtcgtaactaacctaccgtaacccgaaaccggaccggggtaccctaaccgggtccggggtaaccccgttacccgaaaggtaccggttacgggttacgtacggggtcggtacggttagggttcggggtaccgtaggggtaacctaacggtacctttaccgacttaccgacctaaaccctaggtaccagtacccgacggtccggtaacggacgtacccgtaagtaaccgtttctttaaccggtcgttaaccgtttaaaggttttacccttacgtacggtacctaacgggtccgtttaacggtcgttaacccgtgggttacccgcccgttccgtacgtttaacgttaccgggttacgggggacggttaccggtaacgggtacgggttcgaacccttagttaaaacccgggaagttccgggttggaaaccgtccgtaacggactaaccccggttgttaacttcccgttttaaccgtcctaacccggttttcccacccctagttgttaaacccgg

SEQ ID NO: 82411 - DNA, 673 bp, Homo sapiens
  misc_feature: GYAE6OF01D5ELN.36.53.E09.1.454.CMB.1.raw
  modified_base (351)..(351): a, c, t, g, unknown or other
  misc_feature (351)..(351): n is a, c, g, or t
  modified_base (464)..(464): a, c, t, g, unknown or other
  misc_feature (464)..(464): n is a, c, g, or t
tcagtacgctgtctcacgaccggtgctcgatttagagagagtgtgttgggtttgggggaggaactgctcagttaggacccagagggaaccatggaagccccagctcagcttctcttcctcctgctactctggctcccagataccaccggggaagttgtgttgacacagtctccagccaccctgtactttgtcgtccgggggaaagcgccaccctctccgtgcgagggccaggtcggagttgttttcagtctacttatggtaggtaccaacagaaacctggaccaggcctcccgaggcctcctacactctattagactacacttaccacgacgggaccacggtcggactacncccgacgaccgtaggttcgaggtggaccgaggttcgggtccgtagggaaccaggtaccgttacacgttctaccacctatcagcacgacctagaaccgtagaacgttacgtttnacgtttaagtttacttacgtacgtcgagacgaaggtccggtaagtcggttaccgttcggaccggtacgggaactaaggtcggaattaacgtaaccgtaaacgtaccgttggtccgtaggttcgaccgtaacctagttacgtctttaccgttacttacccttcccgttacccgacctacgttacgaacgaaaccgtccgaggttacccgg

SEQ ID NO: 82412 - DNA, 792 bp, Homo sapiens
  misc_feature: GYAE6OF01CQ659.36.53.E09.1.454.CMB.1.raw
  modified_base (210)..(210): a, c, t, g, unknown or other
  misc_feature (210)..(210): n is a, c, g, or t
  modified_base (223)..(223): a, c, t, g, unknown or other
  misc_feature (223)..(223): n is a, c, g, or t
  modified_base (628)..(628): a, c, t, g, unknown or other
  misc_feature (628)..(628): n is a, c, g, or t
tcagtacgctgtctcacgaccggtgctcgatttagagagagtgtgttgggtttgggggaggaactgctcagttaggacccagagggaaccatggaagccccagctcagcttctcttcctcctgctactctcggcctcccagatacccgaaccggggaagttgtagttgacacagtctccagccaccctgactttgcgtaccgggggaaancgccacctctccngcagggccaggtcggagttcgttttacagtactaacttaagtgtacggtaaccaacgaacgaaaccgtggaccaggccttacccgaggtcctcctacaacttctatacgaactacactacccgaaacgcgggtacccacgtcgggaccgtacccaaggtactacgggtttacaacgggttcggacgtacggggttggggttaccgtacgggggaacttaacggtaccttttaccggaaaccgtttccctaacccgtaacccgtaagttacccgaacggtaccgtaaaccgggtccccgttaggggaaccgttacccgtaaggtaaagttcctttacggtacgtacttaaggttttacttacgtcgtacgagtacgtacgttcgtacgttcgtacgtccctacgtnttaccggtacggttaccggggaccggttacgggtaccgtaagggtacggacgtaaactaaccggaaacggttcgttcgggtacggtaccgttacggaccctaaccgttacgttcgttacccgtttacgttaaacctcctttaaccccggtccgtccgttaaacg

SEQ ID NO: 82413 - DNA, 769 bp, Homo sapiens
  misc_feature: GYAE6OF01DU4CE.36.53.E09.1.454.CMB.1.raw
tcagtacgctgtctcacgaccggtgctcgatttagagagagtgtgttgggtttgggggaggcttggtaaagccgggggggtccctgagactctcctgtgcagcctctggattcgtctttgatgattatgccatgagttgggtccgccaggcctccgaggggaaggggctggaatgggtctcggccatcagtgtcagtggtagaaaagactattctacgcagacctccgtaggaacggggtccgttcaccatcctaccagacgaacaactcccaacagtatactgtatcgtagacatagaacagcctagacgacggccggaaggaaccgaccggtccttaattactttagttgtacggaacggtaaaacgggacctaaactccctacaactcctaaccttaccccgttaacttaaccgtttagaaaccgttacggtacgggggacccgaaggggaccgtccccggttacgggtaccctaaccccggtttcctcccctacgtaccgtccccctaaccccgaaccccgggaaccgggtccccctaacggtttccccgggttccccctttaccccccggtccgggtccccgtcccccgttccgtacccgtacccgaacgggtacctacccgtaaccccgtcccgggaacgtaccggaccgaccgaccgggtacccggtcccggtacgggccttaccgggtcccgtacggtaccgtaaaccgtacctactaccgagtaccgacgtcgtacgtggacggcgggtctggacgacgg

SEQ ID NO: 82414 - DNA, 879 bp, Homo sapiens
  misc_feature: GYAE6OF01BT9GK.36.53.E09.1.454.CMB.1.raw
  modified_base (205)..(205): a, c, t, g, unknown or other
  misc_feature (205)..(205): n is a, c, g, or t
tcagtacgctgtctcacgaccggtgctcgatttagagagagtgtgttgggtttgggggaggaactgctcagttaggacccagagggaaccatggaagccccagctcagcttctcttcctcctgctactctggcctccagataccaccggggaagttgtgttgacacagtctccagccaccctgtactttgtcgtccgggggaaanagccaccctctcctgcagggccagtcggagttgttttcagctacttaatgtggtaccaacagaaacctggccaggcctccaggcctcctcatctatgatacactaccaacgacggggacccaacgttcgggaccgttacccgaaggtaaccgtagggttttaccgaagggttacgggtaccgtaaggggtttacgggggtttcccggtaggggggggtaaacctaaccggggttaacccttttacccggaaacccgtttcccgtaaccctaaaccccggtaattacccgaaaccggccgtaaacggtcccccgtaaggggtaaccgtacccgttaacggaaacggtttacgtttaccgtacggtaccgtttaaacgtttttaacgtttaccgtttcggttacccgaacggtaccgttaacggtacccgttttaaccggtaacggttttcccgggtacccccttaccccgggttccgttaacccgttacccgggttttaccggggaacccgggggttaaccggggttacccggtaaacgggggttagggtaaccggtaaacgtaaacccggtaaaaacggtaccgttaagggtccggtaccgttacgaccgtacccgttaacgttccgttcgtttacctttacgtaccgttttccccgttaccccgtcttaaccg

SEQ ID NO: 82415 - DNA, 675 bp, Homo sapiens
  misc_feature: GYAE6OF01A1HBX.36.53.E09.1.454.CMB.1.raw
  modified_base (207)..(207): a, c, t, g, unknown or other
  misc_feature (207)..(207): n is a, c, g, or t
  modified_base (220)..(220): a, c, t, g, unknown or other
  misc_feature (220)..(220): n is a, c, g, or t
  modified_base (302)..(302): a, c, t, g, unknown or other
  misc_feature (302)..(302): n is a, c, g, or t
  modified_base (529)..(529): a, c, t, g, unknown or other
  misc_feature (529)..(529): n is a, c, g, or t
  modified_base (640)..(640): a, c, t, g, unknown or other
  misc_feature (640)..(640): n is a, c, g, or t
tcagtacgctgtctcacgaccggtgctcgatttagagagagtgtgttgggtttgggggaggaactgctcagttaggacccagagggaaccatggaagccccagctcagcttctcttcctcctgtctactctggactcccagatacccgaccggggaagttgtgttgacacagtctccagccaccctgtactttgcgtccggggaaancgccacctctccncgcgaggccagtcggagttgttttcagtacttacttatgtacgtaccaacagtaaacctggccaggcctccgaggcctccgnaatctatagactacctactaccaacggtcggacctacgtcggaccgtacccgagaacgtcggttaccgaggtcgtacacgggttgggttaccgaggggactaacggtacctttacggaacttccgtaaccactacggtacaacgtccgaccgtcggttggacccgtcgttaacggacgttaccgttaccgtggttaacgttacgttttaacgtacgttcgtaaccgngttaacgacggttacgttacgtacgtcgtaccgtcctcgtacgtacggttcgggacggttacgggtacgtaggtaagctaacgtcgaaacgttagcgtaacgctcaactcngttcctcgtactcgtaccctcgtcccgcgttaacg

SEQ ID NO: 82416 - DNA, 770 bp, Homo sapiens
  misc_feature: GYAE6OF01CXC02.36.53.E09.1.454.CMB.1.raw
  modified_base (227)..(227): a, c, t, g, unknown or other
  misc_feature (227)..(227): n is a, c, g, or t
tcagtacgctgtctcacgaccggtgctcgatttagagagagtgtgttgggtttgggggaggaactgctcagttaggacccaggagggaaccatggaacgccccagctcagcttctccttcctcctgctactctcggctcccagactacccgaccggggtaagttgtgttacgacacgagttcctccacgcccacccttagtacttttggtccggtaccgggggaaanacgcccaccccttctcctcggcgacgggcctaggtcggtagtttcgtttcacgtacttaaccgttaagtcggttacggtaaaccaaacgaaacggtaaaccgtcggaccgtacggcccgtacccgacggtcccttccctactaacttacttaagtacgtaacctaacctaccgtaacccgaaccggacgggccctacggtccggcccctaccgacgtacgtacggttcgaggtcggacgtaggttcgggtcgtaggactacgtaccttaccactacctacccacgactacgacgtacgcggtccgtgggaccgttacgtacggtaactgttcctagttacttaagttttactacgtcggtactacgacgttcggtacgtacgtccgttccggacccttccgttcctacgttaccgggttcgggaccgggttacggtacggtaacgggtacggtactaacggtaaccgtaacgtacggtcgtacggtcctacgtccgtactcgttcgttactccgttacgttacccttcccgtcctctaaccgg

SEQ ID NO: 82417 - DNA, 1019 bp, Homo sapiens
  misc_feature: GYAE6OF01DNQ8O.36.53.E09.1.454.CMB.1.raw
  modified_base (213)..(213): a, c, t, g, unknown or other
  misc_feature (213)..(213): n is a, c, g, or t
  modified_base (582)..(582): a, c, t, g, unknown or other
  misc_feature (582)..(582): n is a, c, g, or t
  modified_base (966)..(966): a, c, t, g, unknown or other
  misc_feature (966)..(966): n is a, c, g, or t
tcagtacgctgtctcacgaccggtgctcgatttagagagagtgtgttgggtttgggggaggaactgctcagttaggaccagagggaaccatggaagccccagctcagcttctcttcctcctgctactctggcctccagactaccgaccggggaattgtgttacgacacgaagtcctccgacgccacctgtactttgccggtaccgggggaaanaccgccaaccccgttctccgtacggccgtacggggccctagggttaccgggtacgttacgggtttttccacgttacctttaaccgttaagttccggtaacggttaacccaaacgaaccggtaaaccgttcggggaaccgtaacgggttccccgtaacccgaccggggttccttaccccgttaacgtaactaccggtttaaactcggtaaacttaacccggtaaccttaacccggaaaaaccgggtaccgggggtaccccttttaaacggccgggggtacccccttaaccccggtttaagggaccccggttaaggggtttaccccgtaaggggtttaccggggaccttaagggggtttacccggggtttntaaccggggggtaacctttaacggttaaccccggtttccaacccggtttaccccttaacgaaccccggtttaataccccgacgggacccctaaggggttacccccggttaggggtaaccgtacccggttaaagggtaaccgtttacgtttaacccggtcggtttaaccgttaggtttttttaccgtacggtttaccggcgttaaaccggtcgttaaacccggtttcggttaccgtaacgggtttccggtcccctaaccgtccgttaccggttacgggttaccgggacggggtaagggttaacccgtagggttacggtacgtaaccgaaccggtaaaaggtacccggttagggtacggtaccacccggtacttaaccccgggttntttaaccggtctttaccggtaaccttactttccccggaacccgttctaaccgg

SEQ ID NO: 82418 - DNA, 736 bp, Homo sapiens
  misc_feature: GYAE6OF01B4ZBP.36.53.E09.1.454.CMB.1.raw
  modified_base (267)..(267): a, c, t, g, unknown or other
  misc_feature (267)..(267): n is a, c, g, or t
tcagtacgctgtctcacgaccggtgctcgatttagagagagtgtgttgggtttgggggaggaactgctcagttaggacccagagggaaccatggaagccccagctcagcttctcttcctcctgctactctggctcccagataccaccggggaagttgtgttgacacagtctccagccaccctgtactttgtcgtaccgggggaaagacgccaccctctcctgcagggccaggtcggagttgtttcagtctacttaatgtcgtacaanagaacctgcaggcctcccgaggcctcctcatctatagactacactaccaacgacgggtacccacgtcggccgtacccaaggaccgtacgggttacaggtcggacgtaggtgggtcgtacgggtactacgtaccttaccgacttctaccacccgtagtaccgacgtaccacggccgttacgggacgtcccgttaagaagtctttcgacgttacgtttacgttttattacgtgtaaccgagtaccgtagtacccggttaatacgggtttccggcccttccggtaccgttccgttaaccggtttccggggaccggggttaacggggtacccgtaaaggggtcggtaaacgtaccggtaaaaccgaacgggttaccgttgggcggtaacccttaggacccgttaccgtcgtttacccggtaccgtttaccgttaacctacccggtttacccccgttaccgtcccttaaaccgg

SEQ ID NO: 82419 - DNA, 914 bp, Homo sapiens
  misc_feature: GYAE6OF01BF4M8.36.53.E09.1.454.CMB.1.raw
tcagtacgctgtctcacgaccggtgctcgatttagagagagtgtgttgggtttgggggaggaactgctcagttaggacccagagggaaccatggaacgccccagctcagcttctcttcctcctgctactctggctccagactaccgaccggggtagttgtgtgacactagtcctccgacgcccaccctgtacgttttcggtccggtaccgggggaaagacgcccgaccctcctccgtcggcgacgggcctacggtcggtacgtttgttttacagtaccttaacgtttaagttggtacgtaaccaacgtaacgtaaaccgtcggacccgacggccctcccgacggtccctaccgtactactcttaagactacgttaccaaccgttacccaacggtaacggggacccctacggtcggtacccgtacccgaacgtacggtaacggttccgaggtccgggacgtagggttcgggtacggtacggggaactacgtaccttcaccttacgtacccaactacgacgacgtaccgacggtaccggtacgggtaccgtacggttaggtaacgttacgtttaccgttacggttaacgtttaacggtttacgtttacggttacgtacgtacggtaacgtaccggtttaacgtttaacggttaccggtttccggtaccccggttacccgtacccgttaccgggttttaacccgggtttaccgggggtaccggggttaaccggggttaaccggttaacggggttaaccgggttaacgggtaaaccgttaaaccggttaaacggtacggttaacgggtaccgggtaccgttaacccgggtaccgttaccgttaccgtttaccggtttaccctttaccggttacccccgttaaccgtttcccccccgttaaccgtccccgggttaaacc

SEQ ID NO: 82420 - DNA, 804 bp, Homo sapiens
  misc_feature: GYAE6OF01B6JW1.36.53.E09.1.454.CMB.1.raw
  modified_base (97)..(97): a, c, t, g, unknown or other
  misc_feature (97)..(97): n is a, c, g, or t
  modified_base (226)..(226): a, c, t, g, unknown or other
  misc_feature (226)..(226): n is a, c, g, or t
  modified_base (245)..(245): a, c, t, g, unknown or other
  misc_feature (245)..(245): n is a, c, g, or t
tcagtacgctgtctcacgaccggtgctcgatttagagagagtgtgttgggtttgggggaggaactgctcagttaggacccagagggaaccatggaanccccagctcagcttctcttcctcctgctactctcgacctccagactacccggaacggggtaagttgtgttacgacacgacgtcctaccacgccctaccctgtactttcggtaccggtaccgggggaaanccgtccccaccttctccgnggacgacgggcctagggtcggtagtttgttccgacgtacttaactaagttggtaaccgaacctaacgaacggtaaccgtcgaccggacgtaccgtcccgacgtacctaccgtactacttactagtactactacctacaccgaacggaccggtaccgtacgtccgacccgtaccgaaggtacggtagtcggtacggtacggtacggtacgggttggtaccgaggtacctaacgttcccttacgtaccttaccaccctaacacgtaccgacgtaccgcggtaccggtacggtaccgtacgtacgtacgtacgttcgtacgttacgttaagtttacgttcgtagtacgtaggtaccgtacgttaaccgttacggtcgtaccgtaccgttccgtaccgttaccggtttacgggtaccgggtacgggtaccgggtaacggtaagggttaccggtacgtaaccgtaacggtaccgtaggtaccggtagtaccgtaaccgacttacccggttacttaccggtttccgttaccgttaccttaacccggtcccgttaccgtcgtaacg

SEQ ID NO: 82421 - DNA, 682 bp, Homo sapiens
  misc_feature: GYAE6OF01AWWHC.36.53.E09.1.454.CMB.1.raw
  modified_base (474)..(474): a, c, t, g, unknown or other
  misc_feature (474)..(474): n is a, c, g, or t
tcagtacgctgtctcacgaccggtgctcgatttagagagagtgtgttgggtttgggggaggaactgctcagttaggacccagagggaaccatggaagccccagctcagcttctcttcctcctgctactctggctcccagataccaccggggaagttgtgttgacacagtctccagccaccctgactttgtcgtccgggggaaagacgccacccgtctcctggcgagggccaggtcggtagttgttttcagtacttaactttaagtggttacggtaaccaacgaacgaaaccgtggaccagggccctacccgaagggtcctccctacacttcctatacgataccactacccgaaacgtacgggcccacgtcggaccgtcccgagtacgtaggttcaggtcggacgtagggttcgggtcgtaggggaacacgtacttacacgtcctaccaacctatcaacgcacggtcctgggacnccgtaggaatgttcgaggtacttaagtttacttactcgtacagtactaggttccgtagtcgttccggtcctccggtctccgttacggttcgggaccggggtacggtaccggtaagggtacggacgtaacgtaaccgtaaacgtacgtggtcggcgttacgactaccgtacgttcttacggtcctacttacctcccgttccgacttacg

SEQ ID NO: 82422 - DNA, 594 bp, Homo sapiens
  misc_feature: GYAE6OF02H684E.36.53.E09.1.454.CMB.1.raw
  modified_base (439)..(439): a, c, t, g, unknown or other
  misc_feature (439)..(439): n is a, c, g, or t
tcagtacgctgtctcacgaccggtgctcgatttagagagagtgtgttggggtttggggagggaactggctcccacgttagggtaccccaggagggtaaccatggtaaggccccagctcagcttctcttcctccctgactactctggctcccgagtagtaccaccgggggaagttgtggttttcgtacgtacagttctttaccgagtcccacccttgactttggtctccgggggaaagagccgacccgtctccctgggcagggtccagtcggacgttgggttttccagctacttaatcgtggtaccacagaacctggccaggctcccaggctccttcatctatgatacagtcccaacagggccactgggcgtccagacaggttcagtgcagtgggtactgggcagaacttcactctacaccatcaagcagcctagggacncctgaacgattctgcagtttatacttgtacagctagtcgttacagttgtactccggctcgactttcggcggtaggtccaagggtggagatcaacgacttagtggtcgtggacgaccgagtacgtcggttacttacgagttcgttcccggctacgg

SEQ ID NO: 82423 - DNA, 539 bp, Homo sapiens
  misc_feature: GYAE6OF02I0Q86.36.53.E09.1.454.CMB.1.raw
tcagtacgctgtctcacgaccggtgctcgatttagagagagtgtgttgggtttggggaggcttggtaaagccggggggtccctgagactctcctgtgcagcctctggattcgtctttgatgattatgccatgagttgggtccgccaggctccagggaaggggctggaatgggtctcggccatcagtgtcagtggtgaaaagacattctacgcagactccgtgaagggccgattcaccatctccagagacaattccaagaacactctgtatctgcaaaatgaaacagcctgagagctgaggacacggctgtctattactgtgcgaaagatcgaggtgtactggtaccagatggtatggtttaactatattacggtatggacgtcgtggggccaagggacacggtcaccgtctctcagcctacaccaggcccatcgtcttccctcgcaccctcctaccaacgacgccaccgtccgtgggccacgcgtggccctgggctcgccgtggtaccaaggacctaccttccgagtacacgtcgtacg

SEQ ID NO: 82424 - DNA, 596 bp, Homo sapiens
  misc_feature: GYAE6OF02GQFWZ.36.53.E09.1.454.CMB.1.raw
tcagtacgctgtctcacgaccggtgctcgatttagagagagtgtgttgggtttgggggaggaactgctcagttaggacccagagggaaccatggaagccccagctcagcttctcttcctcctgctactctggctcccagataccgaccggggaagttgtgttgacacagtctccagccaccctgtactttgtcgtaccgggggaaagacgccaccctctcctgcgagggccagtcggagttgtttcagtctacttaatgtggtaccaacagaaacctggccaggcctcccaggcctcctcatctatgatacactaccaaacgacgggcccacgtggcctacccgagaccgtaggttcaggtcggacaggtgggtcgtggggaacaggtacttcactctacaccatcagcagccgtggacgcctagaacgtattcgtgacttagtttattacgtgtacagacgagtacgttacagttcggcccttccgccttaccgtacgtttcgggacgggtacgggtaccgtaagggtggagtatacgaaacggtactggtcggctagaccacctatcgttagtcttcacttcctccccgctacg

SEQ ID NO: 82425 - DNA, 515 bp, Homo sapiens
  misc_feature: GYAE6OF02I4LNS.36.53.E09.1.454.CMB.1.raw
  modified_base (386)..(386): a, c, t, g, unknown or other
  misc_feature (386)..(386): n is a, c, g, or t
  modified_base (426)..(426): a, c, t, g, unknown or other
  misc_feature (426)..(426): n is a, c, g, or t
tcagtacgctgtctcacgaccggtgctcgatttagagagagtgtgttgggtttgggggaggaactgctcagttaggacccagagggaaccatggaagccccagctcagcttctcttcctcctgctactctggctcccagataccaccggggaagttgtgttgacacagtctccagccaccctgactttgtctccgggggaaagagccaccctctcctgcagggccagtcggagtgttttcagctacttaatgtggtaccaacagaaacctggccaggctcccaggctcctcatctatgatacatccaacagggccactggcgtcccagacaggttcagtggcagtgggtctgggacagacttcactctcacatcagcagcctggancctgaagattctgctagtttatactgtcagcagcgttacngttcgcctccgctcactttcggcggtacggtcaaggtgagatacgaacgactggtaggctcgcaccatctgtcttcatcttccgcctac

SEQ ID NO: 82426 - DNA, 525 bp, Homo sapiens
  misc_feature: GYAE6OF02IBSG4.36.53.E09.1.454.CMB.1.raw
tcagtacgctgtctcacgaccggtgctcgatttagagagagtgtgttgggtttgggggaggaactgctcagttaggacccagagggaaccatggaagccccagctcagcttctcttcctcctgctactctggctcccagataccaccggggaagttgtgttgacacagtctccagccaccctgactttgtctccgggggaaagagccaccctctcctgcagggccagtcggagtgttttcagctacttaatgtggtaccaacagaaacctggccaggctcccaggctcctcatctatgatacatccaacagggccactggcgtcccagacaggttcagtggcagtgggtctgggacagacttcactctcacatcagcagcctggacgcctgaagtattctgctagtttatactgtcagcagtcgttacagttgcctccgctctacgtttcggcggtagggtccgaagggtggagatacgaaacgtacgtgtaggctgacacatctgtcttcatccttcccgctac

SEQ ID NO: 82427 - DNA, 497 bp, Homo sapiens
  misc_feature: GYAE6OF02GJPTR.36.53.E09.1.454.CMB.1.raw
  modified_base (452)..(452): a, c, t, g, unknown or other
  misc_feature (452)..(452): n is a, c, g, or t
  modified_base (479)..(479): a, c, t, g, unknown or other
  misc_feature (479)..(479): n is a, c, g, or t
  modified_base (492)..(492): a, c, t, g, unknown or other
  misc_feature (492)..(492): n is a, c, g, or t
tcagtacgctgtctcacgaccggtgctcgatttagagagagtgtgttgggtttgggggaggaactgctcagttaggacccagagggaaccatggaagccccagctcagcttctcttcctcctgctactctggctcccagataccaccggggaagttgtgttgacacagtctccagccaccctgactttgtctccaggggaaagagccaccctctcctgcagggccagtcagagtgttagcagctacttagcctggtaccaacagaaacctggccaggctcccaggctcctcatctatgatacatcctacagggccactggcatcccagccaggttcagtggcagtgggtctgggacagacttcactctcaccatcagcagcctagaacctgaagtatttgctagtttattactgtcagcagcgagagtctttcggcctggaccaagtgatancaaacgactgtgctgcacatctgtctnactctccgcatcngaacg

SEQ ID NO: 82428 - DNA, 519 bp, Homo sapiens
  misc_feature: GYAE6OF02IHBE2.36.53.E09.1.454.CMB.1.raw
  modified_base (388)..(388): a, c, t, g, unknown or other
  misc_feature (388)..(388): n is a, c, g, or t
tcagtacgctgtctcacgaccggtgctcgatttagagagagtgtgttgggtttgggggaggaactgctcagttaggacccagagggaaccatggaagccccagctcagcttctcttcctcctgctactctggctcccagataccaccggggaagttgtgttgacacagtctccagccaccctgactttgtctccgggggaaagagccaccctctcctgcagggccagtcggagtgttttcagctacttaatgtggtaccaacagaaacctggccaggctcccaggctcctcatctatgatacatccaacagggccactggcgtcccagacaggttcagtggcagtgggtctgggacagacttcactctcaccatcagcagcctgggancctgaagattctgctagtttatactgtcagcagtcgttacagttcggcctccgctcgactttcggcgtagggtccaagggtgagatcaaacgactgtaggctgcaccatctgtcttcatcttcccgctacg

SEQ ID NO: 82429 - DNA, 548 bp, Homo sapiens
  misc_feature: GYAE6OF02JOJWP.36.53.E09.1.454.CMB.1.raw
  modified_base (203)..(203): a, c, t, g, unknown or other
  misc_feature (203)..(203): n is a, c, g, or t
  modified_base (309)..(309): a, c, t, g, unknown or other
  misc_feature (309)..(309): n is a, c, g, or t
  modified_base (390)..(390): a, c, t, g, unknown or other
  misc_feature (390)..(390): n is a, c, g, or t
  modified_base (399)..(399): a, c, t, g, unknown or other
  misc_feature (399)..(399): n is a, c, g, or t
  modified_base (543)..(543): a, c, t, g, unknown or other
  misc_feature (543)..(543): n is a, c, g, or t
tcagtacgctgtctcacgaccggtgctcgatttagagagagtgtgttgggtttgggggaggaactgctcagttaggacccagagggaaccatggaagccccagctcagcttctcttcctcctgctactctggctcccagataccaccggggaagttgtgttgacacagtctccagccaccctgactttgtctccgggggaaanagccaccctctcctgcagggccagtcggagtgttttcagctacttaatgtggtaccaacagaaacctggccaggctcccaggctcctcatctatgatacatccaanagggccactggcctcccagaccaggttcagtggcaggtggtctgggacagacttcactctcaccatcaagcagcctggacncctagaagnttctgctagtttatactgctagctagtcgttacagttcgcctcgctctacgtttcggcggtaggtccgaagggtggatactacgaaaccgacttggtacggcttggacctacctagttcgtacgttctacgacttccgttcccncgtac

SEQ ID NO: 82430 - DNA, 552 bp, Homo sapiens
  misc_feature: GYAE6OF02IXTSV.36.53.E09.1.454.CMB.1.raw
  modified_base (439)..(439): a, c, t, g, unknown or other
  misc_feature (439)..(439): n is a, c, g, or t
tcagtacgctgtctcacgaccggtgctcgatttagagagagtgtgttgggtttgggggaggaactgctcagttaggacccagagggaaccatggaagccccagctcagcttctcttcctcctgctactctggctcccagataccaccggggaagttgtgttgacacagtctccagccaccctgactttgtctccgggggaaagagccaccctctcctgcagggccagtcggagtgttttcagctacttaatgtggtaccaacagaaacctggccaggctcccaggctcctcatctatgatacatccaaacaggggccactggccgtcccagaccaggttcagtggcagtgggtctgggacagacttcactctcaccatcagcagccctgggacgcctgaagtattcgtgctagttttattactgtcagcagtcgttacngttcggccctccgctctactttcgggcggtacgggtccgaagggttggagtacgtacgaacgacttggtcgctaggccaacatcgttgtccttcacttcccttcccgcctacg

SEQ ID NO: 82431 - DNA, 586 bp, Homo sapiens
  misc_feature: GYAE6OF02HDOXH.36.53.E09.1.454.CMB.1.raw
  modified_base (204)..(204): a, c, t, g, unknown or other
  misc_feature (204)..(204): n is a, c, g, or t
tcagtacgctgtctcacgaccggtgctcgatttagagagagtgtgttgggtttgggggaggaactgctcagttaggacccagagggaaccatggaagccccagctcagcttctcttcctcctgctactctggctcccagataccaccggggaagttgtgttgacacagtctccagccaccctgactttgtcgtccgggggaaanagccaccctctcctgcagggccagtcggagtgtttcagctacttaatgtggtaccaacagaaacctggccaggctccaggctcctcatctatgatacataccaacgacgggccactggccgtaccagaccaggttcagtggcaggtgggtctgggacagacttcactctacaccatcagcagcctgggactcctagaacgtattctgacttagtttattactgtacagcagtcgttacgagttcgcctccgctcgtacgtttcggacgggtacggtaccgaaggtcggaagtaacgtacgaaacggtagtggtacgggcttcggacctaacctacgttccgttacgttcctttacctacgtttcccttaccccgaccttacg

SEQ ID NO: 82432 - DNA, 540 bp, Homo sapiens
  misc_feature: GYAE6OF02HETTF.36.53.E09.1.454.CMB.1.raw
  modified_base (203)..(203): a, c, t, g, unknown or other
  misc_feature (203)..(203): n is a, c, g, or t
  modified_base (389)..(389): a, c, t, g, unknown or other
  misc_feature (389)..(389): n is a, c, g, or t
tcagtacgctgtctcacgaccggtgctcgatttagagagagtgtgttgggtttgggggaggaactgctcagttaggacccagagggaaccatggaagccccagctcagcttctcttcctcctgctactctggctcccagataccaccggggaagttgtgttgacacagtctccagccaccctgactttgtctccgggggaaanagccaccctctcctgcagggccagtcggagtgttttcagctacttaatgtggtaccaacagaaacctggccaggctccaggctcctcatctatgatacatccaacagggccacgtggccgtcccagacaggttcagtggcagtgggtctgggacagacttcactctcacatcagcagcctgggacncctgaagattctgctagtttacttactgtacagctacgtcgttacaggttcgcctccgctctacgtttcgggcggtagggtccaagggtggagactacgaacgtacgtgtcggctgacaaccatctagtcttacacttccttcccgctacg

SEQ ID NO: 82433 - DNA, 649 bp, Homo sapiens
  misc_feature: GYAE6OF02HOXDE.36.53.E09.1.454.CMB.1.raw
  modified_base (208)..(208): a, c, t, g, unknown or other
  misc_feature (208)..(208): n is a, c, g, or t
tcagtacgctgtctcacgaccggtgctcgatttagagagagtgtgttgggtttgggggaggaactgctcagttaggacccagagggaaccatggaagccccagctcagcttctcttcctcctgctactctggcctccagataccgaccgggaagttgtgttgacacagtctccagcccaccctgtactttgtccgtaccgggggaaancgccacctctcctgcagggccaggtcggagttgtttcagtcttaacttaagtgtacggtaaccaaacagaaacctggaccaaggcctccgaggcctcctcactctatgatacactacccaacgacgggccacgtcggaccgtcccaagacgtaggttcaggtggacaggtgggtcgtgggacagtactcactctcacatcagcagcctgcagctagaagagtgtaggcgttagtttattactgtacgtagactaattaattaatagttactcccgtacttaccgttaccgtttaccgggacggtaacggggtaaccgtaagggttacgggaaagtaacgtaaccgaaaacgtacgttagggtacggtacgtcggtaaccgtaacctaacgttccgttacgttaccttaccgtaccgtttccccgttaccccgacttaaccg

SEQ ID NO: 82434 - DNA, 607 bp, Homo sapiens
  misc_feature: GYAE6OF02I5HVS.36.53.E09.1.454.CMB.1.raw
  modified_base (256)..(256): a, c, t, g, unknown or other
  misc_feature (256)..(256): n is a, c, g, or t
  modified_base (381)..(381): a, c, t, g, unknown or other
  misc_feature (381)..(381): n is a, c, g, or t
tcagtacgctgtctcacgaccggtgctcgatttagagagagtgtgttgggtttgggggaggcttggtaaagccggggggtccctgagactctcctgtgcagcctctggattcgtctttgatgattatgccatgagttgggtccgccaggctccagggaaggggctggaatgggtctcggccatcagtgtcagtggtagaaaagcattcacgcagactcgtgaagggccttcaccatctccagagacaatcccaaangtatactgtatctagacatgaacagcctgacagccgaggacacggcctatattattgtagacgaaagggaccaatcctacaatcaatcccctaatacttttagaactactggggaccaagggacncccgttagggtaccacccggttcctccctactacgtacctacccaccgaaccggacccgacgtccggtaccgttccccgtccggccgtcccgtcgtccgtccgtacggacgaccgacccgtaccgtacgacgaccgacgacgaccgccgtcggcgtcgccgtcgtacgaacggtaactaccgtaccgtacgacgacgtacgtacgtacggacggacggacgtacgg

SEQ ID NO: 82435 - DNA, 707 bp, Homo sapiens
  misc_feature: GYAE6OF02HIYGO.36.53.E09.1.454.CMB.1.raw
tcagtacgctgtctcacgaccggtgctcgatttagagagagtgtgttgggtttgggggaggaactgctcagttaggacccagagggaaccatggaagccccagctcagcttctcttcctcctgctactctggctcccagataccgaccggggaagttgtgttgacacagtctccagccaccctgtactttgtcgtaccgggggaaagacgccaccctctcctgcgagggccaggtcggagttgttttcagtcttacttaatgtaggtaccaacaagaaacctggccaggcctcccaggcctcctcatctatgatacataccaaacgcgggccacgtcggcctacccgagaccgtaggttcgaggttcggcgtagggtcggggtcgtaggggaactacggtaccttcaaccttcctaccaacctactacaagccaacggccgtagggacgtaccgtacgtaacgtacgttacgtcgtacgttagtttaactttacgttacgttactaaacgtaacgtaactaacgtacgtacgtacgtaccttaccttaccgttaccgttaccgggtacgggtacgggtaaccggtaacgggtacgggtaacggtaacgtaacgtaaaccgtaacgtaggtacggtacgtacggaccgtaccgtacgttacgttacgttcttactaccgttacccgttacccgtccctaaaaactccg

SEQ ID NO: 82436 - DNA, 573 bp, Homo sapiens
  misc_feature: GYAE6OF02JEUS1.36.53.E09.1.454.CMB.1.raw
  modified_base (258)..(258): a, c, t, g, unknown or other
  misc_feature (258)..(258): n is a, c, g, or t
tcagtacgctgtctcacgaccggtgctcgatttagagagagtgtgttgggtttgggggaggcttggtaaagccggggggtccctgagactctcctgtgcagcctctggattcgtctttgatgattatgccatgagttgggtccgccaggctccagggaaggggctggaatgggtctcggccatcagtgtcagtggtgaaaagcattctacgcagactccgtgaagggccggttcaccatctccagagacaatcccaanagtatactgtatctagacatgaacagcctgacagccgaggacacggccgtatattattgtgcgaaagggaccaatcctcatcatccctactactttgaatactggggccagggagcccctggtccaccgtctccctcacgccctcccaccaaacgggccccagttccggttccttccccccgtcgggcccgtccccgtcgccttcccgacggacgccaccctccgacgacgccacacggccggcccgtgggcctcgcctggtcaaggaccttacgttcccagaccagccgtacgtcggagcgggctggcaacggg

SEQ ID NO: 82437 - DNA, 518 bp, Homo sapiens
  misc_feature: GYAE6OF02HPRKA.36.53.E09.1.454.CMB.1.raw
  modified_base (203)..(203): a, c, t, g, unknown or other
  misc_feature (203)..(203): n is a, c, g, or t
  modified_base (479)..(479): a, c, t, g, unknown or other
  misc_feature (479)..(479): n is a, c, g, or t
  modified_base (492)..(492): a, c, t, g, unknown or other
  misc_feature (492)..(492): n is a, c, g, or t
  modified_base (497)..(497): a, c, t, g, unknown or other
  misc_feature (497)..(497): n is a, c, g, or t
tcagtacgctgtctcacgaccggtgctcgatttagagagagtgtgttgggtttgggggaggaactgctcagttaggacccagagggaaccatggaagccccagctcagcttctcttcctcctgctactctggctcccagataccaccggggaagttgtgttgacacagtctccagccaccctgactttgtctccaggggaaangccaccctctcctgcagggccagtcagagtgttagcagctacttagcctggtaccaacagaaacctggccaggcctcccaggcctcctcatctatgatacatcctacgagggccactggcactcccagccaggttcagtggcaggtgggtctgggacagtacttcactctacaccatcagcagcctaagacctgaagtatttgactagtttattactgtcagcagcgagaggtctttcggccgtagggacctaagtggatactacgaaacgactgngctgcacatcgtntctcncttcctccgctactctgaacg

SEQ ID NO: 82438 - DNA, 842 bp, Homo sapiens
  misc_feature: GYAE6OF02IBQZN.36.53.E09.1.454.CMB.1.raw
  modified_base (203)..(203): a, c, t, g, unknown or other
  misc_feature (203)..(203): n is a, c, g, or t
tcagtacgctgtctcacgaccggtgctcgatttagagagagtgtgttgggtttgggggaggaactgctcagttaggacccagagggaaccatggaagccccagctcagcttctcttcctcctgctactctggctcccagataccaccggggaagttgtgttgacacagtctccagccaccctgactttgtctccgggggaaanagccacctctcctgcagggccagtcggagtgtttcagctacttaatgtaggtaccaacagaacctggccaggcctccaggtctcctcatctatgactacatccaaacgaggggccctaacgtgggcccgtacccaaggacgtaacgggtttccaaggttcggcctaaggttcgggggtcttacgggggaactacggtacctttccaacttcccgttaccaaacccgtaattcccgaaggccgtaaaccgggtccccttagggggaacccgtcccgtttaagggtaaacggtactttttacccggtagtaacccgtttaaggttttttaaactttaaccgttcggtttaaccgaacggtaccgttaaacgggttaccgttttaacgtaacgggtttttccgggccccgttaacccgggtccctttacccgggttaaccgtttttcccgggggaacccgggggttaacggggtttaacccccggaaaggggtttcgggtaaaggtaaaccgtaaccgggttaaaaaccggaaccgttttggggtaaccgggtctaccggttaacccgtaaccccgtaagtttccgtttaacggttccctttaaccgtaaccgttttcccccgtttacccgcccgtttaacg

SEQ ID NO: 82439 - DNA, 595 bp, Homo sapiens
  misc_feature: GYAE6OF02GJFH3.36.53.E09.1.454.CMB.1.raw
  modified_base (337)..(337): a, c, t, g, unknown or other
  misc_feature (337)..(337): n is a, c, g, or t
tcagtacgctgtctcacgaccggtgctcgatttagagagagtgtgttgggtttgggggaggcttggtaaagccgggggggtccctgagactctcctgtgcagcctctggattcgtctttgatgattatgccatgagtcgggtccgccaggctccagggaaggggctggaatgggtctcggccatcagtgtcagtggtgaaaagacattctacgcagactccgtgaagggccgttcaccatctccagagacaatcccaacagtatactgtatctagacatgaacagcctgacagccgaggacacggccgtatattatgtgcgaaagggaccaatcctnatcatccctactactttgaatacgtggggccagggacgcccgtggtccaccggtctcctcacgccctaccacccgaacgggcccctacgtccggttcccttcccccgtcgggcccgtccccttcggcctcccgaggacgccaccctccggacgacgccacgacggccggcccgtcgggcctggcccgttgggtaccaacggtaccttaacttccgaggaaccacgtcgtacgtcggacggccgggcgtcggcgaacgg

SEQ ID NO: 82440 - DNA, 593 bp, Homo sapiens
  misc_feature: GYAE6OF02HIYHO.36.53.E09.1.454.CMB.1.raw
  modified_base (402)..(402): a, c, t, g, unknown or other
  misc_feature (402)..(402): n is a, c, g, or t
  modified_base (447)..(447): a, c, t, g, unknown or other
  misc_feature (447)..(447): n is a, c, g, or t
tcagtacgctgtctcacgaccggtgctcgatttagagagagtgtgttgggtttgggggaggaactgctcagttaggacccagagggaaccatggaagccccagctcagcttctcttcctcctgctactctggctcccagataccaccggggaagttgtgttgacacagtctccagccaccctgactttgtctccgggggaaagagccaccctctcctgcagggccagtcggagtgtttcagctacttaatgtggtaccaacagaaacctggccaggcctccaggcctcctcatctatgatacataccaacagggcccacgtcggccgtccccagacaggttcaggtggcaggtgggtctgggacagtacttcactctaccaccatcagcacgccgtgggacncctagaagtattcgtgctagtttatactgtcagctagtccgttanagttcggccctcgtccttcgtacgtttccgggcggtacgggtccgtaaagggttcggaacgtaagtaccgaaacggtacgttaggtacggctcgacctaaccgtagttccgttggtcctttacgactttcccttcccggacctacg

SEQ ID NO: 82441 - DNA, 624 bp, Homo sapiens
  misc_feature: GYAE6OF02JGX6T.36.53.E09.1.454.CMB.1.raw
  modified_base (203)..(203): a, c, t, g, unknown or other
  misc_feature (203)..(203): n is a, c, g, or t
  modified_base (310)..(310): a, c, t, g, unknown or other
  misc_feature (310)..(310): n is a, c, g, or t
  modified_base (354)..(354): a, c, t, g, unknown or other
  misc_feature (354)..(354): n is a, c, g, or t
  modified_base (392)..(392): a, c, t, g, unknown or other
  misc_feature (392)..(392): n is a, c, g, or t
  modified_base (405)..(405): a, c, t, g, unknown or other
  misc_feature (405)..(405): n is a, c, g, or t
tcagtacgctgtctcacgaccggtgctcgatttagagagagtgtgttgggtttgggggaggaactgctcagttaggacccagagggaaccatggaagccccagctcagcttctcttcctcctgctactctggctcccagataccaccggggaagttgtgttgacacagtctccagccaccctgactttgtctccgggggaaanagccaccctctcctgcagggccagtcggagtgtttcagctacttaatgtggtaccaacagaaacctggccaggctcccaggcctcctcatctatgatacatcccaanagggccacgtggccgtcccagacaggttcagtggcaggtggtcngggacagacttcactctcaccatcagcacgcctggacncctagaagattcngctaagttttatacgtgtcagtcagtccgttacgtcggttcggtccctccggtcttaccgtaccgttttccgggacgggtacgggttccgaaagggttcgggaagtacgtacgaaaaccggtacgttacggtcgggtcgttacggaccgtaacccttacgttaccgtttacggtttaccttccgtaacgtttccccgtttaccccggaccctttaacgg

SEQ ID NO: 82442 - DNA, 576 bp, Homo sapiens
  misc_feature: GYAE6OF02FSSP4.36.53.E09.1.454.CMB.1.raw
  modified_base (372)..(372): a, c, t, g, unknown or other
  misc_feature (372)..(372): n is a, c, g, or t
tcagtacgctgtctcacgaccggtgctcgatttagagagagtgtgttgggtttgggggaggcttggtaaagccggggggtccctgagactctcctgtgcagcctctggattcgtctttgatgattatgccatgagttgggtccgccaggctccagggaaggggctggaatgggtctcggccatcagtgtcagtggtgaaaagacattctacgcagactccgtgaagggccggttcaccatctccagagacaatcccaacagtatactgtatctagacatgaacagcctgacagccgaggacacggccgtatattatgtgcgaaagggccaatcctcatcatccctatactttgaatactggggccagggacnccctggtccaccgtctcctcacgccctccaccaacgggcccatccggtccttccccgtggcccgcccttcgcctccgaggacgccagtcctccgagacgccacacggccggcccgtgggcctcggcccgttgggtaccaagggtacccttaccgttcccgaaggtaccaggccgttacgtcggacggccgggtacctgggaccg

SEQ ID NO: 82443 - DNA, 530 bp, Homo sapiens
  misc_feature: GYAE6OF02GYZJG.36.53.E09.1.454.CMB.1.raw
  modified_base (371)..(371): a, c, t, g, unknown or other
  misc_feature (371)..(371): n is a, c, g, or t
  modified_base (403)..(403): a, c, t, g, unknown or other
  misc_feature (403)..(403): n is a, c, g, or t
  modified_base (408)..(408): a, c, t, g, unknown or other
  misc_feature (408)..(408): n is a, c, g, or t
  modified_base (506)..(506): a, c, t, g, unknown or other
  misc_feature (506)..(506): n is a, c, g, or t
  modified_base (527)..(527): a, c, t, g, unknown or other
  misc_feature (527)..(527): n is a, c, g, or t
tcagtacgctgtctcacgaccggtgctcgatttagagagagtgtgttgggtttgggggaggaactgctcagttaggacccagagggaaccatggaagccccagctcagcttctcttcctcctgctactctggctcccagataccaccggggaagttgtgttgacacagtctccagccaccctgactttgtctccgggggaaagagccaccctctcctgcagggccagtcggagtgttttcagctacttaatgtggtaccaacagaaacctggccaggctcccaggctcctcatctatgatacatccaacagggccactggccgtcccagacaggttcagtggcaggtgggtctggggacagacttcactcncaccatcagcagccctggacgcctagaacgtntttcngctagtttattactgtcagcagcgtagcaacgtggccgtccgggtacttcgggcggtagggaccgaggtgagtatacgaacgagtgtgcgtgaccacntctgtctcacttcctccgctntcg

SEQ ID NO: 82444 - DNA, 679 bp, Homo sapiens
  misc_feature: GYAE6OF02HM4EH.36.53.E09.1.454.CMB.1.raw
  modified_base (202)..(202): a, c, t, g, unknown or other
  misc_feature (202)..(202): n is a, c, g, or t
  modified_base (259)..(259): a, c, t, g, unknown or other
  misc_feature (259)..(259): n is a, c, g, or t
tcagtacgctgtctcacgaccggtgctcgatttagagagagtgtgttgggtttgggggaggaactgctcagttaggacccagagggaaccatggaagccccagctcagcttctcttcctcctgctactctggctccagataccaccggggaagttgtgttgacacagtctccagccaccctgactttgtctccgggggaaanagccacctctcctgcagggccagtcggagtgtttcagctacttaatgtggtaccaanagaaacctggccaggctcccaggcctcctcatctatgatacatccaacgacgggccacgtggccgtacccagacctagggttcaggtcggctaggtgggtctggggacaggtacttcgacttcgtaccaccgtatccgagtccacgtccgtgggacctccgttaggaaacgtactttcgtagtacttaggttttaactttaaccgtgttacagccgtacggtaccgttaacgtagggttccgtcctcccggtcttaccgttaccggtttccggggcgggtaacgggtaccgtaaaggggttcgggaaacgtacgttaaccgaaaaccgtacgttcgggtaccgggtactcgggacctaacccgtacgttaccgttcggttacctttaccgaacgtttccccgtttacccgaccgttaccg

SEQ ID NO: 82445 - DNA, 656 bp, Homo sapiens
  misc_feature: GYAE6OF02H91OB.36.53.E09.1.454.CMB.1.raw
  modified_base (203)..(203): a, c, t, g, unknown or other
  misc_feature (203)..(203): n is a, c, g, or t
  modified_base (293)..(293): a, c, t, g, unknown or other
  misc_feature (293)..(293): n is a, c, g, or t
  modified_base (388)..(388): a, c, t, g, unknown or other
  misc_feature (388)..(388): n is a, c, g, or t
tcagtacgctgtctcacgaccggtgctcgatttagagagagtgtgttgggtttgggggaggaactgctcagttaggacccagagggaaccatggaagccccagctcagcttctcttcctcctgctactctggctcccagataccaccggggaagttgtgttgacacagtctccagccaccctgactttgtctccgggggaaanagccaccctctcctgcagggccagtcggagttgttttcagtctacttaatgtggtaccaacagaaacctggccaggctcccaggctcctnatctatgatacatccaacagggcccaacgtggccgtcccgagacaggttcagtggcaggtgggtctgggacagacttcactctcacatcaagcancccgtggacgtcctaggaacgtactttacgtgtctaaacgttttagttactggttaccaaggtcctaaggtaccgtttacgtaggtttccggcccttcccggtccttaccgttaccgttttaccgggccgggttaacgggtcccgtaaaggggttcgggagtaaacgttacgaaaaccggtacgttcgggtaggccgttcggaccgtaaccctagttccgttacggttcctttacccgtaactttccccttaccccggtccttaaccg

SEQ ID NO: 82446 - DNA, 570 bp, Homo sapiens
  misc_feature: GYAE6OF02GIKFL.36.53.E09.1.454.CMB.1.raw
tcagtacgctgtctcacgaccggtgctcgatttagagagagtgtgttgggtttgggggaggaactgctcagttaggacccagagggaaccatggaagccccagctcagcttctcttcctcctgctactctggctcccagataccaccggggaagttgtgttgacacagtctccagccaccctgactttgtctccgggggaaagagccaccctctcctgcagggccagtcggagtgttttcagctacttaatgtggtaccaacagaaacctggccaggctcccaggctcctcatctatgatacatccaacacgggccacgtcggccgtcccagacaggttcaggtggcaggtgggtctgggacagacttcgactctcacatcagcagccctggacgcctagaagactttcgtgtacgtagttttattacctgtcagtcgagtcgttacgtagttcggcctccgcttctacgtttccggcgggtacgggtccaagggtgatacgtacaaacgtactggtacggctacgaccaactctcgtcgttcttcctacgtccctttcccgaccttacg

SEQ ID NO: 82447 - DNA, 588 bp, Homo sapiens
  misc_feature: GYAE6OF02GZE0T.36.53.E09.1.454.CMB.1.raw
  modified_base (203)..(203): a, c, t, g, unknown or other
  misc_feature (203)..(203): n is a, c, g, or t
  modified_base (395)..(395): a, c, t, g, unknown or other
  misc_feature (395)..(395): n is a, c, g, or t
  modified_base (403)..(403): a, c, t, g, unknown or other
  misc_feature (403)..(403): n is a, c, g, or t
  modified_base (441)..(441): a, c, t, g, unknown or other
  misc_feature (441)..(441): n is a, c, g, or t
tcagtacgctgtctcacgaccggtgctcgatttagagagagtgtgttgggtttgggggaggaactgctcagttaggacccagagggaaccatggaagccccagctcagcttctcttcctcctgctactctggctcccagataccaccggggaagttgtgttgatacagtctccagccaccctgactttgtctccgggggaaanagccaccctctcctgcagggccagtcggagttgtttcagctacttaatgtggtaccaacagaacctggccaggctcccaggctcctcatctatgatacatccaacagggccacgtcggccgtcccagacgaggttcaggtggcaggtgggtctggggacagacttcactctcaccatcagcagccgtggacnctgaagtnttctgtactagtttattacgttgtcagcagtcgttacncgttcgcctccgctcgtaccgtttcgggacgggtacgggtaccgaagggtcggagtaacgtacgaaacgtacgttgtacgggtctacggacctaacgtacgttccgttacgttcctttccgtacttcccgtttaccccgaccttacg

SEQ ID NO: 82448 - DNA, 601 bp, Homo sapiens
  misc_feature: GYAE6OF02JGFYN.36.53.E09.1.454.CMB.1.raw
tcagtacgctgtctcacgaccggtgctcgatttagagagagtgtgttgggtttggggaggcttggtaaagccggggggtccctgagactctcctgtgcagcctctggattcacctttagcagctatgccatgacctgggtccgccaggctccagggaagggactggagtgggtctcgtctattagtggaagtggtggttatacaaactacgcagcctccgtgaagggccgcttcaccatctccagagactattccaagagcactctgtatctgcaaatgaacagctgagtgccgaggacacggccctatattatgtgcgaaatggtgggggagtgggggctacgtccgtggtcgttttgacttacgtggggccagggacgccgtggtcaccgtctcctcgagcctccaccaacgggcccagtccggtccttccccgtggccgtccccgtgcctcccgaggcgccacccgtccgagacgccacgacgccggtcccgtggggcctcggcccgttgggtaccaacggtaccttaccttaccgacgaaccacggtcccgttacgtacggacggtccgggaccgttcgggcgtaacgggcgtaccg

SEQ ID NO: 82449 - DNA, 602 bp, Homo sapiens
  misc_feature: GYAE6OF02FW6CW.36.53.E09.1.454.CMB.1.raw
  modified_base (204)..(204): a, c, t, g, unknown or other
  misc_feature (204)..(204): n is a, c, g, or t
  modified_base (261)..(261): a, c, t, g, unknown or other
  misc_feature (261)..(261): n is a, c, g, or t
  modified_base (372)..(372): a, c, t, g, unknown or other
  misc_feature (372)..(372): n is a, c, g, or t
  modified_base (403)..(403): a, c, t, g, unknown or other
  misc_feature (403)..(403): n is a, c, g, or t
  modified_base (409)..(409): a, c, t, g, unknown or other
  misc_feature (409)..(409): n is a, c, g, or t
  modified_base (442)..(442): a, c, t, g, unknown or other
  misc_feature (442)..(442): n is a, c, g, or t
tcagtacgctgtctcacgaccggtgctcgatttagagagagtgtgttgggtttgggggaggaactgctcagttaggacccagagggaaccatggaagccccagctcagcttctcttcctcctgctactctggctcccagataccaccgggggaagttgtgttgacacagtctccagccaccctgactttgtctccgggggaaanagccaccctctcctgcagggccagtcggatgtttcagctacttaatgtggtaccaanagaaacctggccaggctcccaggctcctcatctatgatacatccaacagggccacgtggccgtcccagacaggttcagtggctaggtggtctggggacaggacttcactcncacatcagcagcctgggacgtcctagaagtntttcgngcttagtttactacgtgtcagctagtcgttacngttcggccttacgctcgtacgtttccgggacggtacgggtacctaagggtcgaacggtaacgtaccgaaaacggtacgttacggtacgggtccgttagaccctaccgtaagttccgttacggttcctttcgtaaccgttcccgtttaccccgccttaacg

SEQ ID NO: 82450 - DNA, 573 bp, Homo sapiens
  misc_feature: GYAE6OF02GP78E.36.53.E09.1.454.CMB.1.raw
  modified_base (391)..(391): a, c, t, g, unknown or other
  misc_feature (391)..(391): n is a, c, g, or t
tcagtacgctgtctcacgaccggtgctcgatttagagagagtgtgttgggtttgggggaggaactgctcagttaggacccagagggaaccatggaagccccagctcagcttctcttcctcctgctactctggctcccagataccaccggggaagttgtgttgacacagtctccagccaccctgactttgtctccgggggaaagagccaccctctcctgcagggccagtcggagtgttttcagctacttaatgtggtaccaacagaaacctggccaggctcccaggctcctcatctatgatacatccaacagggccactggcctcccagacaggttcagtggcaggtgggtctgggacagtacttcactctcacatcagcagccctgggacncctagaagtattctgctagtttattacttgtacagcagtcgttacgagttcggcctccgtctctaccgttttcgggcggtacggggtaccgtaagggtcggaggtactaccgaaacgtacgtgtacggtctacgctaaccgtacgttcgttcgttcttccgtactccgttaccccgctaacg

SEQ ID NO: 82451 - DNA, 573 bp, Homo sapiens
  misc_feature: GYAE6OF02HAAKM.36.53.E09.1.454.CMB.1.raw
  modified_base (203)..(203): a, c, t, g, unknown or other
  misc_feature (203)..(203): n is a, c, g, or t
  modified_base (378)..(378): a, c, t, g, unknown or other
  misc_feature (378)..(378): n is a, c, g, or t
  modified_base (400)..(400): a, c, t, g, unknown or other
  misc_feature (400)..(400): n is a, c, g, or t
  modified_base (404)..(404): a, c, t, g, unknown or other
  misc_feature (404)..(404): n is a, c, g, or t
tcagtacgctgtctcacgaccggtgctcgatttagagagagtgtgttgggtttgggggaggaactgctcagttaggacccagagggaaccatggaagccccagctcagcttctcttcctcctgttactctggctcccagataccaccggggaagttgtgttgacacagtctccagccaccctgactttgtctccgggggaaanagccaccctctcctgcagggccagtcggagtgttttcagtctacttaatgtgtaccaacagaaacctggccaggctcccaggctcctcatctatgatacataccaacagggcccagttcggccgtcccagacaggttcaggcggcaggtggtctgggacagacttcactctcacntcagcagcctgacgcctgaagnttcngtctagtttatacgtgtcagcagtcgttacagttcgcctccgctctaccgtttcggcggtaggtccgagggtgagtagtaacgaacgtaacgtggtacgtacgtcggacctaccgtacgttccttggttacctttaccgaactttcccgttaccccgacctattacccg

SEQ ID NO: 82452 - DNA, 527 bp, Homo sapiens
  misc_feature: GYAE6OF02G00YY.36.53.E09.1.454.CMB.1.raw
  modified_base (385)..(385): a, c, t, g, unknown or other
  misc_feature (385)..(385): n is a, c, g, or t
  modified_base (427)..(427): a, c, t, g, unknown or other
  misc_feature (427)..(427): n is a, c, g, or t
tcagtacgctgtctcacgaccggtgctcgatttagagagagtgtgttgggtttgggggaggaactgctcagttaggacccagagggaaccatggaagccccagctcagcttctcttcctcctgctactctggctcccagataccaccggggaagttgtgttgacacagtctccagccaccctgactttgtctccgggggaaagagccaccctctcctgcagggccagtcggagtgttttcagctacttaatgtggtaccaacagaaacctggccaggctcccaggctcctcatctatgatacatccaacagggccactggctccagacaggttcagtggcagtgggtctgggacagacttcactctcaccatcagcagcctggancctgaagattctgctagtttattactgtcagcagcgtttacngtttcggcctccgctcctacgtttcgggcggtagggtccaagggttgagatacgaaacgactgtggcgtgccacatctgttccttcatccttccgctacg

SEQ ID NO: 82453 - DNA, 582 bp, Homo sapiens
  misc_feature: GYAE6OF02H79UM.36.53.E09.1.454.CMB.1.raw
  modified_base (341)..(341): a, c, t, g, unknown or other
  misc_feature (341)..(341): n is a, c, g, or t
  modified_base (382)..(382): a, c, t, g, unknown or other
  misc_feature (382)..(382): n is a, c, g, or t
  modified_base (456)..(456): a, c, t, g, unknown or other
  misc_feature (456)..(456): n is a, c, g, or t
tcagtacgctgtctcacgaccggtgctcgatttagagagagtgtgttgggtttgggggaggcttggtaaagccgggggggtccctgagactctcctgtgcagcctctggattcgtctttgatgattatgccatgagttgggtccgccaggctccagggaaggggctggaatgggtctcggccatcagtgtcagtggtgaaaagacattctacgcagactccgtgaagggccggttcaccatctccagagacaactcccaacagtatactgtatctagacatgaacagcctgacagccgaggacacggccgtatattatgtgacgaaaagggccaatcctanatcactccctactactttgaatacgtggggccaaggggacnccctggtcaccgtctcctcacgcctccaccgacggcccagtccgtcctccccgtggccgcctgcctccgagacnccgacctccgacgacgcacacggccggcccgtgggctcgccgtggtaccgaacggtaccttccgttaccgacgaaccgtacgtaccgtacgtggaaccggtccgggtcgtacggaccgtaacgggg

SEQ ID NO: 82454 - DNA, 591 bp, Homo sapiens
  misc_feature: GYAE6OF02GB8XW.36.53.E09.1.454.CMB.1.raw
  modified_base (406)..(406): a, c, t, g, unknown or other
  misc_feature (406)..(406): n is a, c, g, or t
  modified_base (445)..(445): a, c, t, g, unknown or other
  misc_feature (445)..(445): n is a, c, g, or t
tcagtacgctgtctcacgaccggtgctcgatttagagagagtgtgttgggtttgggggaggaactgctcagttaggacccagagggaaccatggaagccccagctcagcttctcttcctcctgctactctggctcccagataccaccggggaagttgtgttgacacagtctccagccaccctgactttgtctccgggggaaagagccaccctctcctgcagggccagtcggagtgttttcagctacttaatgtggtaccaacagaaacctggccaggctcccaggctcctcatctatgatacataccaacgacgggccacgtcggccgtcccagaccaggttcagtggcaggtgggtctgggacagacttcactctcacatcagcagcctgggacgcctagaagtnttctgctagtttacttacgtgtacagctagtccgttacnggtttcgcctcccgcttccgtacgtttccgggacgggtacgggtccgtaaagggtcggaacgtaagtaccgaaacgtaccgttggtacggctacggaccacccgtagttcgtcgttaccttacgacctttccttaccccgactacg

SEQ ID NO: 82455 - DNA, 578 bp, Homo sapiens
  misc_feature: GYAE6OF02HO79M.36.53.E09.1.454.CMB.1.raw
  modified_base (287)..(287): a, c, t, g, unknown or other
  misc_feature (287)..(287): n is a, c, g, or t
  modified_base (295)..(295): a, c, t, g, unknown or other
  misc_feature (295)..(295): n is a, c, g, or t
  modified_base (320)..(320): a, c, t, g, unknown or other
  misc_feature (320)..(320): n is a, c, g, or t
  modified_base (339)..(339): a, c, t, g, unknown or other
  misc_feature (339)..(339): n is a, c, g, or t
  modified_base (357)..(357): a, c, t, g, unknown or other
  misc_feature (357)..(357): n is a, c, g, or t
  modified_base (375)..(375): a, c, t, g, unknown or other
  misc_feature (375)..(375): n is a, c, g, or t
  modified_base (458)..(458): a, c, t, g, unknown or other
  misc_feature (458)..(458): n is a, c, g, or t
tcagtacgctgtctcacgaccggtgctcgatttagagagagtgtgttgggtttgggggaggcttggtaaagccgggggggtccctgagactctcctgtgcagcctctggattcgtctttgatgattatgccatgagttgggtccgccaggctccagggaagggctggaatgggtctcggccagtcagtgtcagtggtagaaaagcattctacgcagactccgtgaacgggccggttcaccatctccagagacaatcccaacagtatactgtatctagacatgaaacngcctgacngccgaggacacggctatattattgngacgaaaggaccaatccanatcatccctatacgtttnaatcgtgggccagggacnccctggtccacccgtctcctcacgccctccaccgaacggcccacgtccgtccttcccctcggccgcctcgcctccgacggacnccacccgtcgacgacgccacacggccgcccgcgggcctcggccgtcggtaccgaacggtaccgttaccttccgaacgaccgtacgtcgtacgtcggacggccgggcgtacgggcgaacgg

SEQ ID NO: 82456 - DNA, 565 bp, Homo sapiens
  misc_feature: GYAE6OF02GM0UV.36.53.E09.1.454.CMB.1.raw
  modified_base (203)..(203): a, c, t, g, unknown or other
  misc_feature (203)..(203): n is a, c, g, or t
tcagtacgctgtctcacgaccggtgctcgatttagagagagtgtgttgggtttgggggaggaactgctcagttaggacccagagggaaccatggaagccccagctcagcttctcttcctcctgctactctggctcccagataccaccggggaagttgtgttgacacagtctccagccaccctgactttgtctccgggggaaangccaccctctcctgcagggccagtcggagtgttttcagctacttaatgtggtaccaacagaaacctggccaggctcccaggctcctcatctatgatacatccaacagggccaactcggcgtcccagacaggttcagtggcaggtgggtctgggacagacttcgactctcacatcagcacgcctgggacgcctagaactattctgtactagttttactacgtcgtacagtcgagtacgtttacaggttcgcctccgctctacgttcggcggtagggtccaagggtcgagtagtacgaacgtacgtggtcggctacgcctaaccgtatcgttacgttcttacgtactttccgtacccgactacg

SEQ ID NO: 82457 - DNA, 568 bp, Homo sapiens
  misc_feature: GYAE6OF02FR6ST.36.53.E09.1.454.CMB.1.raw
  modified_base (399)..(399): a, c, t, g, unknown or other
  misc_feature (399)..(399): n is a, c, g, or t
tcagtacgctgtctcacgaccggtgctcgatttagagagagtgtgttgggtttgggggaggaactgctcagttaggacccagagggaaccatggaagccccagctcagcttctcttcctcctgctactctggctcccagataccaccggggaagttgtgttgacacagtctccagccaccctgactttgtctccgggggaaagagccaccctctcctgcagggccagtcggagtgttttcagctacttaatgtggtaccaacagaaacctggccaggctcccaggctcctcatctatgatacatccaacagggccactggctcccagacaggttcagtggcaggtggtctggggacagacttcactctcaccatcagcagcctggagcctgaagattcngtctagtttattactgtcagctagcgttacagttcgcctccgctctacgtttcgggacggtacgggtccgaagggttcggaacgtagtaccgaaacgtacgtaggtacggtctaggaccctaacccgtattccgtcgttcctttcgactttcccttccccgcttaaccg

SEQ ID NO: 82458 - DNA, 692 bp, Homo sapiens
  misc_feature: GYAE6OF02HSNMU.36.53.E09.1.454.CMB.1.raw
  modified_base (203)..(203): a, c, t, g, unknown or other
  misc_feature (203)..(203): n is a, c, g, or t
  modified_base (316)..(316): a, c, t, g, unknown or other
  misc_feature (316)..(316): n is a, c, g, or t
tcagtacgctgtctcacgaccggtgctcgatttagagagagtgtgttgggtttgggggaggaactgctcagttaggacccagacggaaccatggaagccccagcgcagcttctcttcctcctgctactctggctcccagattccactggagaaatagtgatgacgcagtctccagccaccctgtctgtgtctccaggggaaanagcccaccctctcctgcagggccaatcagagtattagcagcaacttagcctggtaccagcaagaaacctggccaggctcccgaggcctcctcatctatggtgcactccaccgngggccacgtgacctatcccgacgtccgtacggttcaacggtggccgtagggtttacgggtcgtaggggtacaagtacggtttacaccgttctacccaaccgtacttaccgaaggccgtaacggcccgttagaccgtaacggttaccgtaggtaaaaggtttacttttacggtacttaagtttttttactttccgttagtcccgtaagtacccttaacttaagtttaacctttaacgttccggtaccgttacggttacggtacgggttaaccgttacgggtacccgaaacggggtaccgtaaaggttaccggtaaaacgtaacccgtaaaacggaacgtttcggacggtccgtacgaacccttaccgactttaccgg

SEQ ID NO: 82459 - DNA, 752 bp, Homo sapiens
  misc_feature: GYAE6OF02HCE9C.36.53.E09.1.454.CMB.1.raw
  modified_base (203)..(203): a, c, t, g, unknown or other
  misc_feature (203)..(203): n is a, c, g, or t
  modified_base (294)..(294): a, c, t, g, unknown or other
  misc_feature (294)..(294): n is a, c, g, or t
tcagtacgctgtctcacgaccggtgctcgatttagagagagtgtgttgggtttgggggaggaactgctcagttaggacccagagggaaccatggaagccccagctcagcttctcttcctcctgctactctggctcccagataccaccggggaagttgtgttgacacagtctccagccaccctgactttgtctccgggggaaanagccaccctctcctgcagggccagtcggagttgtttcagtctacttaatgtggtaccaacagaaacctggccaggcctacccaggctcctnatctatgatacactccaaacgcgggcctacgtgggccgtccccaaggacctagggtttaccaaggttcggcaaggttcggggtctggggacacggtactttcgacttcctacactacgtccaagtccagcccgttgggaacgtccctaggaacgtatttcgacgtaccgttaagtttttactacttaggtccgtaacggtctaacgttaccggtttaaccgaggttttcccggacccctttcccggactttacccgtaccgggttttacggggaccggggttaacgggggttccccgtaaaagggggtttcgggaaaaccgttacgttaaacccgaaaaacccggggttacgttagggtaccgggtaccgttccggaaacctaaccccttaacgttccggtttaccggtttacctttacccgaaccgttttcccccgttttaccccgcccgtttaacc

SEQ ID NO: 82460 - DNA, 647 bp, Homo sapiens
  misc_feature: GYAE6OF02I6VHY.36.53.E09.1.454.CMB.1.raw
  modified_base (202)..(202): a, c, t, g, unknown or other
  misc_feature (202)..(202): n is a, c, g, or t
  modified_base (303)..(303): a, c, t, g, unknown or other
  misc_feature (303)..(303): n is a, c, g, or t
  modified_base (445)..(445): a, c, t, g, unknown or other
  misc_feature (445)..(445): n is a, c, g, or t
tcagtacgctgtctcacgaccggtgctcgatttagagagagtgtgttgggtttgggggaggaactgctcagttaggacccagagggaaccatggaagccccagctcagcttctcttcctcctgctactctggctccagataccaccggggaagttgtgttgacacagtctccagccaccctgactttgctccgggggaaagngccacctctcctgcagggccagtcggagtgttttcagtctacttaatgtacggtacccaacagaaacctggccaggtcctcccgaggcctcctcatctatnactacactccaacgcgggccacgtgggccgtcccgagaccgtaggttcaggtcggctaggtcgggtctggggacagtaccgttcacctcctaccacctagtaccagcacggcctgggacgccgttagaaacggtctttacgngtacgttagttttactacgttcgtacagcgtaggtccgttaactaggttacggccctaccgtcttccgtaccgtttcgggccgggtaagggttacccgaaggggttggaaacgtagtaaccgaacggtacgtggtacggcgtcggtcctaaccgacgttccgttacgttctttaccgtccgttacccgttccgaccgttacg

SEQ ID NO: 82461 - DNA, 591 bp, Homo sapiens
  misc_feature: GYAE6OF02HDAS6.36.53.E09.1.454.CMB.1.raw
  modified_base (203)..(203): a, c, t, g, unknown or other
  misc_feature (203)..(203): n is a, c, g, or t
  modified_base (308)..(308): a, c, t, g, unknown or other
  misc_feature (308)..(308): n is a, c, g, or t
  modified_base (444)..(444): a, c, t, g, unknown or other
  misc_feature (444)..(444): n is a, c, g, or t
tcagtacgctgtctcacgaccggtgctcgatttagagagagtgtgttgggtttgggggaggaactgctcagttaggacccagagggaaccatggaagccccagctcagcttctcttcctcctgctactctggctcccagataccaccggggaagttgtgttgacacagtctccagccaccctgactttgtctccgggggaaanagccaccctctcctgcagggccagtcggagtgttttcagctacttaatgtggtaccaacagaaacctggccaggctccagctcctcatctatgatacatccaacngggccactcggcgtcccagacaggttcagtggcaggtgggtctggggacagtacttcgactctcaccatcacgtcagccgtggacgcctgaagtattctgctagtttattactggttaccagcgtagtccgttaanagttcggtcctccggcttaccgtacctttcgggacggtacgggtccgtaacgggtgggaacgtaagttaccgaaacgtacgtgggtacggtacgtgaccgtacctagttcctcgttacgttacctacgtccctttccggaccctacg

SEQ ID NO: 82462 - DNA, 711 bp, Homo sapiens
  misc_feature: GYAE6OF02JGEGZ.36.53.E09.1.454.CMB.1.raw
  modified_base (208)..(208): a, c, t, g, unknown or other
  misc_feature (208)..(208): n is a, c, g, or t
  modified_base (222)..(222): a, c, t, g, unknown or other
  misc_feature (222)..(222): n is a, c, g, or t
  modified_base (431)..(431): a, c, t, g, unknown or other
  misc_feature (431)..(431): n is a, c, g, or t
tcagtacgctgtctcacgaccggtgctcgatttagagagagtgtgttgggtttgggggtagggaacgtgcgtcagttaggaccagagggaaccatggaagccccagctcagcttctcttcctcctgctactctgcctcccagactaccgaccgggaagttgtgttgacacagtcctcagcccacctgtactttgcgtaccggggaaanacgccacctctccngcagggccagtcgagttgtttcagtctacttaatggtacgtaaccaacgaagtaacctgggccaggcctacccgagtctcctcatcctatcgactacgacttaccgtacgacgggcctacgtcggactaccgtcccaaggtcccctaggtttacacgggttcgaccgttaggtccgggtcgtacgggactaacgtcgtttcaaccgttnacccgaccttagtcaccgacaccgccgttaaagacccgtagaagttaacgtttcgtacgttacgtttaactttacgtagttacacgtacgtagtcgtaaggtacggttccgttaccgggtccgtacgggaaccgtaagggtacgtaacgtaagtaaccgtaaacgtaacgttaacggtcggacgtacgtaccacgtaacgttccgttacggttcctttacggtaccttcccgtttacccgacgttacgtttaccgacggtaacgtaccgtagtaacccgg

SEQ ID NO: 82463 - DNA, 636 bp, Homo sapiens
  misc_feature: GYAE6OF02H0YW9.36.53.E09.1.454.CMB.1.raw
  modified_base (435)..(435): a, c, t, g, unknown or other
  misc_feature (435)..(435): n is a, c, g, or t
  modified_base (460)..(460): a, c, t, g, unknown or other
  misc_feature (460)..(460): n is a, c, g, or t
tcagtacgctgtctcacgaccggtgctcgatttagagagagtgtgttgggtttgggggaggaactgctcagttaggacccagagggaaccatggaagccccagctcagcttctcttcctcctgctactctggcctccagataccgaccggggaagttgtgttgacacagtctccagccaccctgtactttgtcgtaccgggggaaagacgcccacctctcctgcgagggccaggtcggagttgttttcagtcttaacttaagtggtacggtaaccaacgaagaaaaccgtggaccaggccctccgaggcctcctacatctatagactaacactaccaaacgacgggtaccacgtcggccgtacccgaagaccgtaggttccaggtcggcgtaagggttcgggtcgtaggggacagtacttcgactctacacgtancaagcacggctagggactctagatntttcgtgacttagtttactcgtatcagtctacgtcgttacgtgtacgcctcggtctacgttacggttacgggacggttacggtacgtaacgggtggaactacgtaacgaacgtagttcggacgtcgtacgactactcgttccgttgttacctactaccgtcctacccgattaacgg

SEQ ID NO: 82464 - DNA, 659 bp, Homo sapiens
  misc_feature: GYAE6OF02H6C9Z.36.53.E09.1.454.CMB.1.raw
  modified_base (373)..(373): a, c, t, g, unknown or other
  misc_feature (373)..(373): n is a, c, g, or t
  modified_base (425)..(425): a, c, t, g, unknown or other
  misc_feature (425)..(425): n is a, c, g, or t
  modified_base (448)..(448): a, c, t, g, unknown or other
  misc_feature (448)..(448): n is a, c, g, or t
tcagtacgctgtctcacgaccggtgctcgatttagagagagtgtgttgggtttgggggaggaactgctcagttaggacccagagggaaccatggaagcccccagctcagcttctcttcctcctgctactctggctcccagataccaccggggaagttgtgttgacacagtctccagccaccctgactttgtctccgggggaaagagccaccctctcctgcagggccagtcggagttgttttcagtctacttaatgtacggtaccaacaagaaacctggaccaggcctcccaaggtctcctacattctatgaatacataccaaaccgagggccaacgtcggaccgtcccaagtacgtaggtttacaggttcggngacggttggggtctaggggacaggactttcacgtctacaacctatcagtacngaccgtgggacgcctagaaagtntttctgacttaagtttaacttactgtacacgtctagtcgttagacgttcgaccgtaccgtctaccgtaccgtttccgggagggtacgggtaccgaagggttacggagtacgtaacgaaaccggtacgttggtacggctaccggtaccctaacctacgtttcccttacggtttccctttacccgaacttttccccgttaccccgtacgtaac

SEQ ID NO: 82465 - DNA, 785 bp, Homo sapiens
  misc_feature: GYAE6OF02ID99T.36.53.E09.1.454.CMB.1.raw
  modified_base (216)..(216): a, c, t, g, unknown or other
  misc_feature (216)..(216): n is a, c, g, or t
  modified_base (218)..(218): a, c, t, g, unknown or other
  misc_feature (218)..(218): n is a, c, g, or t
tcagtacgctgtctcacgaccggtgctcgatttagagagagtgtgttggggtttgggggaggaactgctcagttaggacccagagggaaccatggaacgcccagctcagcttctcttcctcctgctactctggcctccagactaccgacggggtagttgtgttgacacgagtcctccgagccctacctgtaccttttggccgtaccggggggaaancnccctaccttctccgtggacgcggggtccaggtcgggtagttcgttttacgatccttaacttaagtggtacggtaaacccaaacgtaacgaacccgttgggcccgacgggtaccctccgaaggggtcccttccgtccaattccttaaggttacgacttaacacttacccgaacgtacggggccctaacggtccggaccttacccgagaccgttacggttcacggtggtacgaggggttcggtcggtacggggaactacggttacctttaccacgttcctaccggtaacgtaacttcccgaaaggcccgttaacggtcccggagggtacctccggtacgtaacgtaacgttccgtacgtacgtttagtttacgtttacgttacgtacgtacgtacgtacggtacttacgtccggtcgttcctccgtcttaccgttcgtcggacgggtaaccggtcggtaagttacggacgtaacgtaccggtaaacgtacgttcggtacgtcggtaaccgccgtaccgttaaccgttcggttccgtacctttacgttcctccgggttaccttaccggtc

SEQ ID NO: 82466 - DNA, 885 bp, Homo sapiens
  misc_feature: GYAE6OF02HJO23.36.53.E09.1.454.CMB.1.raw
  modified_base (204)..(204): a, c, t, g, unknown or other
  misc_feature (204)..(204): n is a, c, g, or t
tcagtacgctgtctcacgaccggtgctcgatttagagagagtgtgttgggtttgggggaggaactgctcagttaggacccagagggaaccatggaagccccagctcagcttctcttcctcctgctactctggctcccagataccaccggggaagttgtgttgacacagtatccagccaccctgactttgtcgtccgggggaaanagccacctctcctgcagggccaggtcggagttgttttcagtctacttaatggtacgtaaccaacgaacgaaccgtcggaccaagggcccttacccgaggtcccttccgtacacttactatcgaactacgacttacccaaacggccggggaccctaacgtccgggacccgttacccgaaggtaaccgtacgggtttacagggttcggaccgttagggttcggggtacggtaggggaactacggtacctttacgaccttccgtaccaacctacttaccgaacgccgtaacggcccgttggggaaccgttcccgtaaggtaaacgtttacgtttccgtaaggtaccgttttaaagttttttacttaacgttcggttaccgtaacggtaccgttaacggtttacccgtttaacggttaccgggtttccgggtcccctttacccggttcctttaacccggtttaacccgggtttttccgggggaaccgggggttaaccggggtttacccggttaaacggggtacggggtaaaccgttaaaccgttaaacccggaaaacgggttacccgtttgggggttacccggttacgaaccggttaccctaaaccggttaccgtttcggtttaccggttttaccttacccgttaacccggtttttcccccgttacccccgtacgtttaacccgg

SEQ ID NO: 82467 - DNA, 712 bp, Homo sapiens
  misc_feature: GYAE6OF02JRQAO.36.53.E09.1.454.CMB.1.raw
  modified_base (379)..(379): a, c, t, g, unknown or other
  misc_feature (379)..(379): n is a, c, g, or t
  modified_base (505)..(505): a, c, t, g, unknown or other
  misc_feature (505)..(505): n is a, c, g, or t
tcagtacgctgtctcacgaccggtgctcgatttagagagagtgtgttgggtttggggaggaacgtgctcagttacggacccagagggaaccatggaagccccagctcagcttctcttcctcctgctactctggctccagactaccaccgggaagttgtgttgacacagtctccagccacctgacctttgcgtccggggaaagtcgccaccctctcctgcgagggtccaggtcggagttgtttcagtcttacgtaatgtcggtaaccacagaacctggccagctcccaggccttcctcatctatgataccataccaacaggcctacgcggtccgtccaagcaggttcaggtcgctagtcggtcagggtacaggcctttanactcgtacacctagtcaacggctacggccttgggaacctccgtaggtaaatcgtccgttcggaccttaagggtttttaacctacgttcgacgttaacggaccgtaacggttacgttttaaacccgnggttttacccgggccccgttaccggttccgttaaacccgttacccgggtttttcccgggaccggggaaccgggttttaaccccggaaggggttccggagttaaccggtaaccgtaacggtaacccgggtgttcccgggccgtacgttcccgaaacttcgggtaacctttcggttaactccctaatttccccggttacccgcttaacg

SEQ ID NO: 82468 - DNA, 614 bp, Homo sapiens
  misc_feature: GYAE6OF02H18Q2.36.53.E09.1.454.CMB.1.raw
  modified_base (291)..(291): a, c, t, g, unknown or other
  misc_feature (291)..(291): n is a, c, g, or t
  modified_base (360)..(360): a, c, t, g, unknown or other
  misc_feature (360)..(360): n is a, c, g, or t
tcagtacgctgtctcacgaccggtgctcgatttagagagagtgtgttgggtttgggggaggaactgctcagttaggacccagagggaaccatggaagccccagctcagcttctcttcctcctgctactctggctccagataccaccggggaagttgtgttgacacagtctccagccaccctgactttgtcgtccgggggaaagagccaccctctcctgcagggccagtcggagtgttttcagctattaatgtaggtaccaacagaaacctggccaggctcccaggctcctnatctatgataacatccaacagggccactcggcgtcccagacaggttcagtggcaggtgggtctggggangacttcaactctacaccagtcaagcacgcctggactccgtgaacgtatttcctgtatagtttaatttacgtgtcagactaaggtctttaacgagtttcgggcccttccgccttactaaccgttttcgggacgggtacgggttacccgaaaggggttggagtaacgtacaaaaacgggtacttacggtaggcgttaccacgtaaccctacttaccgtcggttactttcctaagttcccgtttaccccggctaacg

SEQ ID NO: 82469 - DNA, 695 bp, Homo sapiens
  misc_feature: GYAE6OF02GCRXX.36.53.E09.1.454.CMB.1.raw
  modified_base (398)..(398): a, c, t, g, unknown or other
  misc_feature (398)..(398): n is a, c, g, or t
tcagtacgctgtctcacgaccggtgctcgatttagagagagtgtgttgggtttgggggaggaactgctcagttaggacccagagggaaccatggaagccccagctcagcttctcttcctcctgctactctgctcccagataccaccggggaattgtgttgacacagtctccagccaccctgactttgtcgtccgggggaaagacgccaccctctcctgcagggccaggtcgagttgttttcagtctaacttaagtgtacggtaaccaacagaaacctggccaggcctacccgaggaccttcccgtacacttacttactgaacttaccaactacccgaaacgacggggccctaacgtcggccgtacccagacgtacggtcaggtggcgaggtcgggtgngggacaggtacttacacctcgtccaacatcgagctacggccgtagggacgtccgtaggaaacgtactttcgtacggtacttaagttttacttacgttcgtactagacgttaacgtacgttaacgtacggttacgcccgttaccgtcttaccgttaccgtttccggggaccgggtacgggttaaccggtaagggttacggaacgaacgtaaccgaaacggtacgtacggtacggtacgcgtacctaaccgtagttaccgttcggttaccttccgtaacttcccgttacccgactaccg

SEQ ID NO: 82470 - DNA, 605 bp, Homo sapiens
  misc_feature: GYAE6OF02FZUO7.36.53.E09.1.454.CMB.1.raw
  modified_base (203)..(203): a, c, t, g, unknown or other
  misc_feature (203)..(203): n is a, c, g, or t
  modified_base (314)..(314): a, c, t, g, unknown or other
  misc_feature (314)..(314): n is a, c, g, or t
  modified_base (406)..(406): a, c, t, g, unknown or other
  misc_feature (406)..(406): n is a, c, g, or t
  modified_base (419)..(419): a, c, t, g, unknown or other
  misc_feature (419)..(419): n is a, c, g, or t
tcagtacgctgtctcacgaccggtgctcgatttagagagagtgtgttgggtttgggggaggaactgctcagttaggacccagagggaaccatggaagccccagctcagcttctcttcctcctgctactctggctcccagataccaccggggaagttgtgttgacacagtctccagccaccctgactttgtctccgggggaaanagccaccctctcctgcagggccagtcggagtgttttcagtcttacttaatgtggtaccaacagaaacctggccaggcctcccaggcctcctcatctatgatacatccaacngggccacgtggccgtcccagacaggttcaggtggctaggtgggtcgtgggacaggtacctttcacctctacacctatcagcagcctgggacnctagaagtattcngtctagtttacttactgtcagtcagtcgttacagttcgccctcgtcttctacggttcggacgggtacggtacgtaagggtcggagtaacgtaacgaaacgtacgttcggtacggtctacggaccctaacgttacgttacgttcgttaccgttaccgtacctttccccggttaccccgaccttacgg

SEQ ID NO: 82471 - DNA, 868 bp, Homo sapiens
  misc_feature: GYAE6OF02H8HMV.36.53.E09.1.454.CMB.1.raw
  modified_base (558)..(558): a, c, t, g, unknown or other
  misc_feature (558)..(558): n is a, c, g, or t
tcagtacgctgtctcacgaccggtgctcgatttagagagagtgtgttgggtttgggggaggaactgctcagttaggacccagagggaaccatggaagccccagctcagcttctcttcctcctgctactctggctcccagataccgaccggggaagttgtgttgacacagtctccagcccaccctgtactttcgtcggtaccgggggaaagacgccctaccctcttcctgccgacgggccacggtcggtagttcgttttcgacgtcttaacttaagtcggttacggtaacccaacgaaacgtaaaacccgtcgggacctaacgggtccctaccccggacggtcccttcctacgtaactaccgtttaagacggtaactaacctaaccttacccgaaacggtaccggggaccctaaccgtcgggtaccccgttacccgaacgtaaccggttaacgggtttaccgaacgggttcggtaccgtaagggggttcggggtaaccgttcgggggaaacctacggttaaccttccgtaacttccgaacctaccgaacgttacgaacnccgaacggccgttagggacctacctagggtaaacttcgtttacgtcgaacgtttagtttacttacgtcgtaacggagtccggtaagttcccgtttaagtccggttaccggcccttaacccgtgtttaccccgttagggtttacccggggaccggggtaacgggttaaccggtaaggggtaccggtaacgttaaacgttaaccgaaaggtttaccgtacggttcgggtacgggttaccacggttaacccgtacccgtagtttcccgttccggttaactttacccgtaccgttacccccgttcccgtaacgg

SEQ ID NO: 82472 - DNA, 779 bp, Homo sapiens
  misc_feature: GYAE6OF02FIT0Z.36.53.E09.1.454.CMB.1.raw
  modified_base (289)..(289): a, c, t, g, unknown or other
  misc_feature (289)..(289): n is a, c, g, or t
tcagtacgctgtctcacgaccggtgctcgatttagagagagtgtgttgggtttgggggaggaactgctcagttaggacccagagggaaccatggaagccccagctcagcttctcttcctcctgctactctggctcccagataccaccggggaagttgtgttgacacagtctccagccaccctgactttgtctccgggggaaagagccaccctctcctgcaggccaggtcggagttgttttcagtctacttaatgtgtaccaacagaaacctgccagctaccgagcctcncatctatgatacatccgaacacggccacgtggccgtacccaagacctagggttacaggtcggacgtaggtgggttccgtgggggactaacggtacctttacaacgtttcctacctaacccgtaattaccgacggtacccgtacggacccgttacggggacgtacccgttaaggtaaacggtaactttccggtacgtacgtttaaacggtttttaacttaaccgttcggttaaccgtaacgtaccgtaacggttacccgtttaacgtacgggtttcggtaccccttcccggtaccgttaccgtacgggttttacccgggaccggggttaccggggttacccgttaaaggggttcggaaacggttaacgttaaccggtaaaaccggttaccgtcggtaccgggtaccgttccggaacctaaccccgttacgtttaccgtacgtttaccctttaaccgtaaccgttttccccgttaccccgtcccgttaaccg

SEQ ID NO: 82473 - DNA, 727 bp, Homo sapiens
  misc_feature: GYAE6OF02FGYYK.36.53.E09.1.454.CMB.1.raw
  modified_base (209)..(209): a, c, t, g, unknown or other
  misc_feature (209)..(209): n is a, c, g, or t
tcagtacgctgtctcacgaccggtgctcgatttagagagagtgtgttgggtttgggggaggaactgctcagttaggacccagagggaaccatggaagccccagctcagcttctcttcctcctgctactctggcctcccagactaccgacggggtaagttgtgttgacacagtctccagcccaccctgtactttgtcgtaccggggaaancgccaccctctcctgccgacgggccaggtcggagtttcgttttcagtccttaacttaatggtacggtaccaacaacgaacctggaccacggcctcccgaggtcccttccactactctagtagacttacactaccaagacggtccacgtcggaccctaccagtacgtcgttacgaggtcggactaggggtcggtacgtgggactaagtccttcgaccttccgacacctatcgaacgtccgtacgtcccgtagggacgtccgtagaactacttcgagtaccgtttatttaacgtcggtcgtacacggtcgtacggtaccgtttaacgtcggttcgccctcggtaccttccggttacggtttccgggacggggttaccgggtaaccgtaaggggtacgaaacgtcgtaacccgtaaacgggtcgttacggtcggtaacccgtcggtaaccctaccgttaacgttcccggttctttacccgtaacgttccccgtttaccccgttaccccgtacttaacccgg

SEQ ID NO: 82474 - DNA, 739 bp, Homo sapiens
  misc_feature: GYAE6OF02IFDMT.36.53.E09.1.454.CMB.1.raw
tcagtacgctgtctcacgaccggtgctcgatttagagagagtgtgttgggtttgggggaggaactgctcagttaggacccagagggaaccatggaagccccagctcagcttctcttcctcctgctactctggctcccagataccaccggggaagttgtgttgacacagtcctccagccaccctgtactttgtctaccgggggaaagacgccaccctctcctgcgaggccaggtcggagttgttttcagcttacttaagtgtagaccaacagaacctggaccaggcctccaggcctcctacagtctatgatacacttaccgaacgcggaccacgtcggccgaccagactacggttcaggtgacgtaggtcggtcgtaggactacgtacgttacctacgtcctacccgtactaacgttcgaacgtacctacggtaccccgtagggtacctacccggttaaggaacgttacttcgttacgtactttaagttttactacgttcgtacgtaccgtacgtaacggtttaccgttaacgttacggttaccgtccgtacccggttccgtttacccggttaacgggtttcccggaccggggttaaccgggttaccggaacgggttacggaacggtaaccgttaaccgggaaacgttacggttcggttcgggtacgttaccggaccttaacccgtacgttcgtaccggtttcttacccgtcccttttaccggtccccgtaacgttaccg

SEQ ID NO: 82475 - DNA, 713 bp, Homo sapiens
  misc_feature: GYAE6OF02GBBPD.36.53.E09.1.454.CMB.1.raw
  modified_base (444)..(444): a, c, t, g, unknown or other
  misc_feature (444)..(444): n is a, c, g, or t
tcagtacgctgtctcacgaccggtgctcgatttagagagagtgtgttgggttggggaggaactgctcagttaggacccagagggaaccatggagcccagctcagcttctcttcctccttgctactctggcctcccagataccgaccggggtaagttgtgttgacacagtctccagccaccctgacgtttgtcgtaccgggggaaagacgccaccctctcctgacgacggccaggtcggagttgtttcagtcttaacttagtgtacgtaaccaacgaacgtaaacctggacctaggcctcccgagtccttccacgtactctatgtaactacgtatacccgaagcgggtaccaacggtcggacctccgaagtacgtacggttcagggtcggacgtaggttgggtcgtcgggaactacgtactacgacttactacaacgtactacgngcccgtagccgttggacgtacccgtaggatacctttagaggtacctttaagtttacttggttactacgtacgtacgtacgtacgttacgtaacggttcgtacccttccgtacgttaccttccgggtttacgggtaccgggtacggtaccggtagggtacggtaacgtaagtaaccgtaacgttacgtacggtacgtcggtaccgtagtaccctacgttaaccgttccgttacgtttcccgttaccgttcccttaccggtaccttaacgg

SEQ ID NO: 82476 - DNA, 612 bp, Homo sapiens
  misc_feature: GYAE6OF02HJMJ9.36.53.E09.1.454.CMB.1.raw
  modified_base (421)..(421): a, c, t, g, unknown or other
  misc_feature (421)..(421): n is a, c, g, or t
  modified_base (477)..(477): a, c, t, g, unknown or other
  misc_feature (477)..(477): n is a, c, g, or t
tcagtacgctgtctcacgaccggtgctcgatttagagagagtgtgttgggtttgggggaggaactgctcagttaggacccagagggaaccatggaagccccagctcagcttctcttcctcctgctactctggctcccagataccaccggggaagttgtgttgacacagtctccagccaccctgactttgtctccgggggaaagagccaccctctcctgcagggccagtcggagtgttttcagtctacttaatgtcggtaccaacagaaacctggaccaggcctcccaggcctcctcatctatgactacactccaaacgcgggcctacgtcggccgtacccagaccgaggttccaggtcggcgtaggtgggtctggggacaggtacttcgacttcgtacacatcagccacgtccgtgggacncccgtaggaagtacttcgtgtacttaagtttacttacgtgtcagcgtagtcgttancgttcgccctccggcttcgtacgtttcgggacgggtacggtaccgaagggtggactaagtaccgaaacgtacgtggtcggctcggacctacctagttcttcggttaccttcgtaccttcccgttcccgacgtacg

SEQ ID NO: 82477 - DNA, 641 bp, Homo sapiens
  misc_feature: GYAE6OF02JLN4Q.36.53.E09.1.454.CMB.1.raw
  modified_base (206)..(206): a, c, t, g, unknown or other
  misc_feature (206)..(206): n is a, c, g, or t
  modified_base (316)..(316): a, c, t, g, unknown or other
  misc_feature (316)..(316): n is a, c, g, or t
  modified_base (407)..(407): a, c, t, g, unknown or other
  misc_feature (407)..(407): n is a, c, g, or t
tcagtacgctgtctcacgaccggtgctcgatttagagagagtgtgttgggtttgggggaggaacgtgctcagttaggacccagagggaaccatggaagccccagctcagcttctcttcctcctgctactctggctcccagataccaccggggaagttgtgttgacacagtctccagccaccctgactttgtcgtaccgggggaaancgcccaccctctcctgcgacgggcagtcggagtcgttttcgagtctacttaatggtcgtaaccaacaagaacctggccagcctcccaggcctctcagtctagtgactacnctaccaacgcggcctacgtgcccggtcccagactggttcaggtgaccgtgtgggtcaggacagtacttcactcctacaccgatcgaacgcncggtccgtagaccgtccgtagaagtacttcgtcgcttagtttacttacgtcgttaccgacgtcgtacgttacgttaccgtggttaccgtccgtaccgtccttcggtcgtttcccgggtagggtacggttaccgacggttcgggtaataccggtaaccgaacgtaccgtggtacggcgtacgtaccgtaccgtagttccgtacgttctaccgtaccttccgttccgtacccgtcg

SEQ ID NO: 82478 - DNA, 707 bp, Homo sapiens
  misc_feature: GYAE6OF02FNSUY.36.53.E09.1.454.CMB.1.raw
  modified_base (261)..(261): a, c, t, g, unknown or other
  misc_feature (261)..(261): n is a, c, g, or t
  modified_base (354)..(354): a, c, t, g, unknown or other
  misc_feature (354)..(354): n is a, c, g, or t
tcagtacgctgtctcacgaccggtgctcgatttagagagagtgtgttgggtttgggggaggcttggtaaagccgggggggtccctgagactctcctgtgcagcctctggattcgtctttgatgattatgccatgagttgggtccgccaggctccagggaaggggctggaatgggtctcggccatcagtgtcagtggtagaaaagacattctacgcagactccgtgaacgggccgttcacatctccagagacaactcccaanatatactgtactctagacatcgaacagcctagacgacgccggaggaccaccggccgttaatattagtgtagacggaaagggaccaagtcctanatcacttccctaattacgtttgaaacttcgtcggggaccctagggaccgtcccgtgggtaccacccggttcctaccgtactaccgtccctacccgaccccgtaaacgggcccctacgttcccggttacccttcccccggtacggtcccgtcccgttcgtcccgtaccgacgggtacgcccgtaacccgtccggaaggtaaccgcgaaccgtacggcccgggtacccgtcgggtcctaccggtccgttacgggtaaccgtaacgggtaacccgtttaacgttacccgaagggtaaccctacggtacccgttacggtaggaccggggtccgggtacgtacgggacgtaacccggg

SEQ ID NO: 82479 - DNA, 675 bp, Homo sapiens
  misc_feature: GYAE6OF02HSD92.36.53.E09.1.454.CMB.1.raw
  modified_base (166)..(166): a, c, t, g, unknown or other
  misc_feature (166)..(166): n is a, c, g, or t
  modified_base (190)..(190): a, c, t, g, unknown or other
  misc_feature (190)..(190): n is a, c, g, or t
tcagtacgctgtctcacgaccggtgctcgatttagagagagtgtgttgggtttgggggaggaactgctcagttaggacccagagggaaccatggaagccccagctcagcttctcttcctcctgctactctggctcccagataccaccggggaagttgtgttgacanagtctccagccaccctgactttgngtccggggaagagccacctctcctgcaggccagtcggagtgttttcagctacttaatgtggtaccaacagaaacctggacaggctccaggcctcctacagtctatcgattacaactcccgaacgacggggcctacgtcgggaccgtcccaagaccgaggtttcacggtggctaggtcggggtctaggggacagtacctttcgacctctacaccgatacagccagcccgtagggacgtccgtagaacgtattcgtagtcttaaggttttataccgtaggttacacgggtacctagggtaccgttaagtaccggttcggtacccttacccgcttaccgttaccgttttacgggggaccggttaaccggtccgtaaacgggttcggacgtaacgtaccggaaacgtacgtaggttacgggccttacggacccaaccgttagtccgttcggttaccttaccttacccgttcccgtttaccccgactacg

SEQ ID NO: 82480 - DNA, 1046 bp, Homo sapiens
  misc_feature: GYAE6OF02J00NW.36.53.E09.1.454.CMB.1.raw
tcagtacgctgtctcacgaccggtgctcgatttagagagagtgtgttgggtttgggggaggaactgctcagttaggacccagagggaaccatggaacgccccagctcagcttctcttcctcctgctactctggcctcccagactaccgaccggggaagttggtgttggacacgagtcctccgacgcccaccctgtactttcggtccgtaccggggggaaagcgacccctacccgtcctcccgtacggccgacggggcccgacgggttccgggtaggtttcggtttttacgacggtacctttaacgtttaagttcggttacgggtaacccaaacgaaaccggtaaaacccgttcgggacccgaaccgggcccctaccccgaacggtccccttccgtactacttaccgttaatcggtaattaccaaccgtacccaaaccggtaccgggtcccaaccggttccggacccgtacccggaacgaccggtaacggggttacctacgggggtcgaccggtaggttcgggtaccggtagggacctacggtaccgtttaccgaccgttacttacccgaactaaccgtaccgacggtaccgccggtacccggtacgggaccggttacccgtaagggtaaacgttaccgtttacgtaaccggtttaccggttaacgttttttaaccgttacggttccgttaaccgtaacggtacccgttaaccgggtttaaaccgtttaacccggggttaccggtttacccggttcccccgttacccgggtacccgttttaaacccgggttaccccgggggtttttaccgggggtacccggggggttaaacccggggttttaaccccgggtaaacgggggttaccgggtaaacggtttaaaccccgggtaaccgggttaaacccgggttaacgggtaccggttaaccggggttaaccccgtccgggttaaaccctaacccggttaacggttttccgttaccgttttacccccgttaccggtttaccccgttaacccccgggttttacccccgtaacgtttacccggg

SEQ ID NO: 82481 - DNA, 650 bp, Homo sapiens
  misc_feature: GYAE6OF02HL2BT.36.53.E09.1.454.CMB.1.raw
  modified_base (200)..(200): a, c, t, g, unknown or other
  misc_feature (200)..(200): n is a, c, g, or t
  modified_base (247)..(247): a, c, t, g, unknown or other
  misc_feature (247)..(247): n is a, c, g, or t
  modified_base (286)..(286): a, c, t, g, unknown or other
  misc_feature (286)..(286): n is a, c, g, or t
tcagtacgctgtctcacgaccggtgctcgatttagagagagtgtgttgggtttgggggagaactgctcagttaggacccagagggaaccatggaagccccagctcagcttctcttcctcctgctatctggctccagactaccaccggggaatttcgtgttgacacagtctccagccacctgactttgcgtccggggaaangccaccctctcctgcgaggccagtcggagtgtttcagcttacttaangtacgtaacaactaagaactggccaggcctccgaggtcncctcgatcgtatgaattacactacaacacgggtccagtcggcgtaccaggactaggttcagtcggcaggtaggtcctggactagtacttcaacttcgtacactagtacacgtcaacgtcccgtggaacgtccgtagaagtacgttacgtcgtacgtaagtttaattacgtgtaaccgtacgtacgtaagtccgttaacgtagttcccggtacctaccgtaccgttctaccggttttacgggacgggtaaccggtacgtaagggttacggaacgtaactaaccgaaacggtactaggtcggtacgtacgaccgtaaccgtaattccgttagttccttacgtacttaccccgttccgaccttaacg

SEQ ID NO: 82482 - DNA, 681 bp, Homo sapiens
  misc_feature: GYAE6OF02HU6YD.36.53.E09.1.454.CMB.1.raw
tcagtacgctgtctcacgaccggtgctcgatttagagagagtgtgttgggtttgggggaggaactgctcagttaggacccagagggaaccatggaagccccagctcagcttctcttcctcctgctactctggctcccagataccaccggggaagttgtgttgaccacagtctccagccaccctgactttgtcgtccggggaaagcgccacctctcctgcagggccaggtcgagtgtttcagtctacttaatgtcgtaccaacgagtaaaccgtggccaggcctcccgagtctcctcatactatagactaactacgtaccaaacgacggggcctaacggtcggccgttacccagaaccgtaggttcaggtggctaggtcggggtactaggggtacacgtaccttaccgacgtactaccaaccgagtcctaggacctacggccgtacggaccgtaccgtaagtaacgtacttccggtagtaccttagttttaacttcgtacgtacatccgtaagtcgttacgtaggttcgtccctaccgcttccgtaccggtttcggcggggtaacgttccgaacgggttacggtactaacgtaacgtaacggtacgtggttaccggcgttccggaacacccgttaagttccgttcttacgttaacctcgttacccgttacccgacttaccgg

SEQ ID NO: 82483 - DNA, 754 bp, Homo sapiens
  misc_feature: GYAE6OF02F0JII.36.53.E09.1.454.CMB.1.raw
  modified_base (711)..(711): a, c, t, g, unknown or other
  misc_feature (711)..(711): n is a, c, g, or t
  modified_base (747)..(747): a, c, t, g, unknown or other
  misc_feature (747)..(747): n is a, c, g, or t
tcagtacgctgtctcacgaccggtgctcgatttagagagagtgtgttggggtttgggggaggaactgctcagttaggacccagagggaaccatggaagccccagctcagcttctcttcctcctgctactctggcctcccagactaccgaccggggtaagttgtgttgacacagtcctccacgcccaccgtgtactttcgtcggtaccgggggaaagacgcccaccctcctccgtcgcgacgggcctaggtcggtagttcgtttcacgtacttacttaagtcggtacggtaaccaaacgtaaccgaaaccgtcggaccgacgggtccctaccccggacggtcccttcccgtactaacttcctagttacgtaactaacctactaacccgaaaccggacgggaccctacggtccgggcccgtacccgaaggtacgtacgggttacgtaggtcggtacggtaggggttcgggtacggtacggaaccgtacgtacctttaccgtacctcctaccaccgtactaccgagtccgacggtaccgtacgggacctcggtaaagtacgttcttcgtacgtacttttacgttaactccgtagtacgacgcgttaacgttaccgttggtaccgttccgaccctcggcttacgttcggtcgggacggtacgtcgagggtacacgttaacgaacgactaggtcggtacgtctaccgctaaccgtnttccgttacttaccttccaccgtttcccgttaccgngttaccg

SEQ ID NO: 82484 - DNA, 790 bp, Homo sapiens
  misc_feature: GYAE6OF02G5GS8.36.53.E09.1.454.CMB.1.raw
  modified_base (178)..(178): a, c, t, g, unknown or other
  misc_feature (178)..(178): n is a, c, g, or t
  modified_base (439)..(439): a, c, t, g, unknown or other
  misc_feature (439)..(439): n is a, c, g, or t
tcagtacgctgtctcacgaccggtgctcgatttagagagagtgtgttgggtttgggggaggaactgctcagttaggacccagagggaaccatggaagccccagctcagcttctcttcctcctgctactctggctacccagataccgaccggggaagttgtgttgacacagtctccacncccaccctgtactttgtccgtaccgggggaaagacgccacccgtctcctgcgaacgggcctaggtcgggtagtttcgttttcgaacgtcttaacttaagtggttacggtaacccaaacgaaacgtaaaccgttcggaccctaacgggcccttaccccgaggtcccttcctaccaacttccttaagtcgtaacttactacctaccgaaacgtaccgggccctaacggtcggcccgttacccgaacgtacgtaacggttccgnggttcgggcgtagggttcgggtacgtacggggtaactacgggttaccttcgtaccttccgtacccaaacgtcgtacaacgtacctaacggtccgtacgggtacctcgtaggtaaacgttcgtttaacgtcgtacgtttagttttaacttcgtaacgtccagttaccgtacgttacgttaacgttcggttccgtaccgtccggttccttacgggttaccggttcgggacggggtacggtaacggacggtaggtaaactaacgtacgtaaacggcgttaggtaacgtccgttaacgaccgtaccttaacgtccgtttacgtccttaccgcgtttacccctccgtaccgtaccg

SEQ ID NO: 82485 - DNA, 625 bp, Homo sapiens
  misc_feature: GYAE6OF02FOWCL.36.53.E09.1.454.CMB.1.raw
  modified_base (440)..(440): a, c, t, g, unknown or other
  misc_feature (440)..(440): n is a, c, g, or t
  modified_base (459)..(459): a, c, t, g, unknown or other
  misc_feature (459)..(459): n is a, c, g, or t
  modified_base (462)..(462): a, c, t, g, unknown or other
  misc_feature (462)..(462): n is a, c, g, or t
tcagtacgctgtctcacgaccggtgctcgatttagagagagtgtgttgggtttgggggaggaactgctcagttaggacccagagggaaccatggaagccccagctcagcttctcttcctcctgctactctggctcccagataccgaccggggaagttgtgttgacacagtctccagcccaccctgactttgtccgtccgggggaaagcgcccaccctctcctgcacgggccagtcggagttgtttcagtcttactaatgtacggtaccaacacgaaacctggccaggcctacccgaggcctcctcactctatgatacactaccaacgtaggccctacgtggcccgtcccagacctaggtcgagtcggctagggtgggtccgtggggactagtacctttcacttctaccacgatcacgcacgcgtggacgtccgtagaatnttcagtcttagttatactncgngcgtagtacgttatgttcgcctcctactcgtacgttcgggcggtacggtacgaaggtcggacgtaacgtacgaaacgttacgtggtacgtcgttaccgacctaacccgttgttacccgtttagttcccttaacgttccctttcccgttaccccgtctaaccgg

SEQ ID NO: 82486 - DNA, 654 bp, Homo sapiens
  misc_feature: GYAE6OF02JAK7X.36.53.E09.1.454.CMB.1.raw
  modified_base (208)..(208): a, c, t, g, unknown or other
  misc_feature (208)..(208): n is a, c, g, or t
  modified_base (211)..(211): a, c, t, g, unknown or other
  misc_feature (211)..(211): n is a, c, g, or t
tcagtacgctgtctcacgaccggtgctcgatttagagagagtgtgttgggtttgggggaggaactgctcagttaggacccagagggaaccatggaagccccagctcagcttctcttctcctgctactctcggctcccagactaccgaccggggaagttggtgttgacacgagtctccagccacctgtactttgccgtacgggggaaanacnccgaccctctcctgacgaggccaggcggtagttggtttcagcttacttaagtgtacggttaaccaacgtaacgtaaaccgtcggacgacggtcctacccgagccttacctactacgtactagttacgacgtacctactaccgaaacgtcgggacctacggtcgtaccggtcccagtaacgtcggtatacggcgtcgtaggtcgtcgtacgggacacgtcttacgctacgtcactacacgtatccgaagtccggtagactcgtacgaacgtatccgtagtacgttagttacgtttatcgtagacgtagtacgtacggttacaacggtttgcccgtacgtctacgtcgggtcgacggtacggtacgacgggtgatacgtacgaactcgacgtggacgtcgtaacagttctagttcgtacgtccttacgtacccgtcttaccgtag

SEQ ID NO: 82487 - DNA, 795 bp, Homo sapiens
  misc_feature: GYAE6OF02INYKU.36.53.E09.1.454.CMB.1.raw
  modified_base (215)..(215): a, c, t, g, unknown or other
  misc_feature (215)..(215): n is a, c, g, or t
  modified_base (674)..(674): a, c, t, g, unknown or other
  misc_feature (674)..(674): n is a, c, g, or t
tcagtacgctgtctcacgaccggtgctcgatttagagagagtgtgttgggtttgggggaggaactgctcagttaggacccagagggaaccatggaagccccagctcagcttctcttcctcctgctactctggcctcccagactaaccgaccggggtaagttgtgttgacacagtcctccagcccaccctgtactttgtccgtaccggggggaaanacggcccacccgttcctccgtcgcgacgggcccaggtccggtagttcgttttacgacgtccttaactttaagtcggtacggtaaccaaacgacgtaaacccgtcggaccgacggccctacccgacggtccttcccctacgtaaccttcgtaatcgtactactacgtacccaacgacggcctaacggtcggacctacccgaggacgttacgggttcaggtcggacgtacgggttcgggtacgtcggacacgtaccgttcctacctcgtacccaccgtactaccgaagtaccacgtcccggtaggtacgtaccgtagtaaacgtcgttacgttacgtacgtttaagttttactacgttcttaacgacgtaccgttacggttaccgttaacgttcggttaccggtacccgtccgttaccgttacccggttacggttccggtaacgggtaccgggttaaccgngggttaaccggtaaagtaccgttaaccgaaccggttagtacggtccgtacgtaccgccgttaacctcggtttacgttaccgttacttccgtaaccgtttcccggtcccttaccgttaacgg

SEQ ID NO: 82488 - DNA, 714 bp, Homo sapiens
  misc_feature: GYAE6OF02FR07G.36.53.E09.1.454.CMB.1.raw
  modified_base (204)..(204): a, c, t, g, unknown or other
  misc_feature (204)..(204): n is a, c, g, or t
tcagtacgctgtctcacgaccggtgctcgatttagagagagtgtgttgggtttgggggaggaactgctcagttaggacccagagggaaccatggaagccccagctcagcttctcttcctcctgctactctggctcccagataccaccggggaagttgtgttgacacagtctccagccaccctgactttgtcgtccgggggaaancgccaccctctcctgcgagggccagtcggagttgtttcagtctacttaatgtcgtaccaacagaacctggccaggcctcccaggtcctcctacatcctatcgtaataccactaccaacgcgggccagtcggcctccaggaccgtggttcaggtcggctaggttggtcgtaggggacacggtcttcgactcctacactactcacgctaccgtcgtggaaccgttccgtaaggaacgtacgtttcgtacgtacgtttagttttacgtttaacgtcggttacgacggtacctacgttaccgtttacgtaacgggttcccggttcccgttaccgttccggttccgttacggttttcccggggaccgggttaaccgggtacccggttaaagggtacgggtaacgtaaccggtaaccggtaaacccgtacgttacgggtcggtcgttccgaccgttaacccgtacgtttccgttcgtttaccttaccgtaccgtttccccttacccgcgttacccg

SEQ ID NO: 82489 - DNA, 815 bp, Homo sapiens
  misc_feature: GYAE6OF02G6FB6.36.53.E09.1.454.CMB.1.raw
  modified_base (211)..(211): a, c, t, g, unknown or other
  misc_feature (211)..(211): n is a, c, g, or t
tcagtacgctgtctcacgaccggtgctcgatttagagagagtgtgttgggtttgggggaggaactgctcagttaggacccagagggaaccatggaagccccagctcagcttctcttcctcctgctactctggcctcccagataccgaccggggaagttgtgttgacacagtcctccagcccaccctgtactttcgtcgtaccgggggaaanacgccaccctctcctgcgacggccaggtcggtagttcgttttcacgtctaacttaagtcgtacggtaaccaaacgaacgtaaaccgtcggacctaacgggtccccttacccggaggtccctttacccgtactacgttactaacgtacgtaacttaacctaccgtacccgtaaacggaccgggtaccctaaccggtcgggcccgtacccgtaaggtaaccgtacggtttacgacgggttcggaccggtagggtccggggtacgtacggggaaccgtacggtacctttacgaccttccgttaccaaccgtactaccgtacggtacctaccggtaccgtacggggtactacccggttaaagaacggtttcctttaccgtcggtaaacgttttaactttacgttacgttccgtacgtaccggtataccggtttagtttaaccgtggttacccgttcctaccggtacgtttccgttaacccgggtcggggtaacggtcggtaacgtaagggtccggaacttaaacgtaaccacgggttactgggtaccgtccgtagacccttacgtcgtttaccgtcgttttaccacgtaccgtttccccactctaccg

SEQ ID NO: 82490 - DNA, 940 bp, Homo sapiens
  misc_feature: GYAE6OF02IS20J.36.53.E09.1.454.CMB.1.raw
  modified_base (218)..(218): a, c, t, g, unknown or other
  misc_feature (218)..(218): n is a, c, g, or t
tcagtacgctgtctcacgaccggtgctcgatttagagagagtgtgttggggtttgggggaggaactgctcagttaggacccagagggaaccatggaagccccagctcagcttctcttcctcctgctactctcggcctcccagactacccgaccggggtaagttgtgttgacacagtcctccacgcccaccctgtactttcgtccgtaccgggggaaanacgccctaccctcttcctggccacgggtccacgggtcggtagtttcgttttacacggtacctttaacgtttaagtcgggttacggtaacccaaacaacggtaaaccctcgggacccgacgggtacccttaccccgaggtccccttaccctcgtacttaccgttatacgtaactaaccgtaacttaccccgaaacggtacggggtcccctacggttcgggtacccgttacccgacggtaaccgtacgggtttacgaggtcggtacgtagggtcgggtcgaggggtacctaggtactttaccaccgttcctaccgacctactaccgaacgtcgaacggcccgttacgggaaccgttcccgtaacggttaaacgttaacgtttccgtaacggttaccgtttaacggtttttaacgtaacccgtttacggttaaccgtaccgggtaaccgttaaccggttacccgggttttaacgttaaccgggtttcccggtaaccccgtttcccggttaccgttttaccccggtttaacgggttttcccggggaaaccgggtttacggggttaccctaaggggggttaaccggacgttaaaacccgtaaccgtaaaccggggtaacttaccggggtttacgggaccgttacccgtaacgtaaccccggtacgtttaaccgtttcgtttaccgtttaccgtccccggtttacccgttccccggtactttacccgg

SEQ ID NO: 82491 - DNA, 763 bp, Homo sapiens
  misc_feature: GYAE6OF02ITYRN.36.53.E09.1.454.CMB.1.raw
  modified_base (132)..(132): a, c, t, g, unknown or other
  misc_feature (132)..(132): n is a, c, g, or t
  modified_base (168)..(168): a, c, t, g, unknown or other
  misc_feature (168)..(168): n is a, c, g, or t
  modified_base (212)..(212): a, c, t, g, unknown or other
  misc_feature (212)..(212): n is a, c, g, or t
  modified_base (228)..(228): a, c, t, g, unknown or other
  misc_feature (228)..(228): n is a, c, g, or t
  modified_base (737)..(737): a, c, t, g, unknown or other
  misc_feature (737)..(737): n is a, c, g, or t
tcagtacgctgtctcacgaccggtgctcgatttagagagagtgtgttggggtttgggggaggaactgctcagttaggacccagagggaaccatggaacgccccagctcagcttctcttcctcctgctactcncggctccgagactaccgaccggggtaagttgtgttnacacagtctcacgccaccgtgtcgttgtccggtaccggggaaancgccgaccctctccgnggccgacgggccaggtcggtagtttcgtttcgacgtctaacgttaagtcggttaacggtaaccaaacgaacgtaaccgtcggaccgtacggcctacccgaacggtccttacccgtacaacgttacctaagtactaacgtacctaacgttaacccaaacgggacggaccctaacgtcgggacccttaccggaacgtacggtacgttcgaggtcgtacgtaggtcgggtacgaggacctagtaccttacaccgtacgacccactacgtcaatcgacgtacggtagaaccgcgtaagtagtacttcgagttaacgttacgtttaagtaccgtagttaaccgacggtacgtaactttacccgggtattcggtttacccgccctttacggcgttaccggtaacggttcgggtaacgggtccggtaacgacgggttacgaactaaccgtaacggtaacgttcgggacgtacggtagtaccgtactaacggttcctacgtttaccgtaccgttacncccggtttaacctcccggaacttcgg

SEQ ID NO: 82492 - DNA, 812 bp, Homo sapiens
  misc_feature: GYAE6OF02F1CB5.36.53.E09.1.454.CMB.1.raw
  modified_base (209)..(209): a, c, t, g, unknown or other
  misc_feature (209)..(209): n is a, c, g, or t
tcagtacgctgtctcacgaccggtgctcgatttagagagagtgtgttgggtttgggggaggaactgctcagttaggacccagagggaaccatggaagccccagctcagcttctcttcctcctgctactctggcctcccagataccgaccgggggaagttgtgttgacacagtctccagccaccctgtactttgtccgtccgggggaaanacgcccaccctcctcctgccagggccaggtccggagttgttttcagtccttaacttaagtggttacggtaacccaagaacggaaaacctcggaccacggcctcccgaggtcctcctcattcctatagtactacactaccaacgacgggccacgtcggccgtcccgacgtacgtacggtttcgaggtcggacgtagggtcgggtcggtagggactaggtacttaccaccgttcctaccactacgtaccacggccaacggtcctagggacgtccgtaacggtaaggtacctttcgtacggtactttaaggttttacttacgttcgttaccgacgtccgtaacgttacggtttaacgttacgggtttccgggtcccctttacccggtccgtttacccggtttaccggttttcccggggtaccggggtaccggggttaccggttaacgggggtacggtaacgggttaacgttaaacccggtaaacggttaccgggtttcggtaccgggttaccgtaccgggtacccgttaaccgttacgtttaccggttaccgtttccgtttaacccgttacccggtttaccccgtttaccccggtactttaaccgg

SEQ ID NO: 82493 - DNA, 255 bp, Homo sapiens
  misc_feature: GYAE6OF02JEV33.36.53.E09.1.454.CMB.1.raw
  modified_base (225)..(225): a, c, t, g, unknown or other
  misc_feature (225)..(225): n is a, c, g, or t
  modified_base (248)..(255): a, c, t, g, unknown or other
  misc_feature (248)..(255): n is a, c, g, or t
tcagtacgctgtctcacgaccggtgctcgatttagagagagtgtgttgggtttggggaggaactgctcagttaggacccagagggaaccatggaagccccagctcagcttctcttcctcctgctactctcggctcccagataccgaccgggtaagttgtgttgacacgagtcctccagccaccctgtactttgtccgtaccggggaaagagcccacctcctccgngcgacggccaggtcggtagtttnnnnnnnn

SEQ ID NO: 82494 - DNA, 867 bp, Homo sapiens
  misc_feature: GYAE6OF02I0QVM.36.53.E09.1.454.CMB.1.raw
  modified_base (167)..(167): a, c, t, g, unknown or other
  misc_feature (167)..(167): n is a, c, g, or t
  modified_base (209)..(209): a, c, t, g, unknown or other
  misc_feature (209)..(209): n is a, c, g, or t
tcagtacgctgtctcacgaccggtgctcgatttagagagagtgtgttgggtttgggggaggaactgctcagttaggacccagagggaaccatggaagccccagctcagcttctcttcctcctgctactctggctcccagataccgaccgggaagttgtgttgacacngtctccacgccaccctgtactttcgtcgttcccgggggaaanagcccaccccgtcctccgtgcgagggcccgaggtcggagttgttttacgagtccttagttaacttggtcgtaaccaacgacgtaaaccgtggcccgaggccttcccgtaggccttccctacgattctaagtgatacctactacccgaaacgacgggaccacgtcggtacccgtccccgaagtaacctacgggttttaccgacggttacgggtacctaacgggttagggggttccgttacgggggtaaccgaaacgggtaccctttacccgtaacccgttccttaaccccgtaccccgtaattacccggaaactcccgaacggttcccgttaacgggcccggtacccgttaggtaaacgtacgtttacgtacggtagtttaacgttttaagtttacccgttaggttaacacggtcggtaaccgttacggtttaacttaccggttacgtccccgttaggtacccgttccgttaaccgtttcccggggtaccggggtaccggggtttaccgtaaagggggtttacgaaagttaccgtaacccggttaaacgaacggttccgtacgggtacccggttacggaaaccctaaccggttacgttacccggttttgtttaccccttccgttaacccgttccccgtttaccccggaactttacccgg

SEQ ID NO: 82495 - DNA, 751 bp, Homo sapiens
  misc_feature: GYAE6OF02H3VT8.36.53.E09.1.454.CMB.1.raw
  modified_base (489)..(489): a, c, t, g, unknown or other
  misc_feature (489)..(489): n is a, c, g, or t
  modified_base (555)..(555): a, c, t, g, unknown or other
  misc_feature (555)..(555): n is a, c, g, or t
tcagtacgctgtctcacgaccggtgctcgatttagagagagtgtgttgggtttgggggaggaactgctcagttaggacccagagggaaccatggaagccccagctcagcttctcttcctcctgctactctggcctcccagactaccgaccgggggtaattcggtgtttacgacacaggtctaccgacgaccctaccctgtactttggtccggtaccgggggaaagacgccctacctctcctcggcgacgggcctaggtcggtagttcgttttacgagtacttaacttaagtcgtacggtaaccaacaacgtaaaccgtcggccgacggtccctaccgacgtcctccttacacttactaagtagacttaacactaccgaacgcggacctacgtccggtaccgtaccgtagcggttagtacgtacgggtgtacgtagggtcggtacgacggatacgtacgttcgaccttcctacacgtatcgaacgtaccncggacgtacgggactaccgtagtaaagtcttcgtacgtcgtttaagttacgttacgtacgtacgtntaacgttcggtaccgttaaggttcggtacccgttccgtccgttactccggttacgggtacgggacggggttaacggtacggtaagggtcggtaaatcggtaaccgtaaggttcggtcggttcggtaacgtctaacctaacgtctttacggttcggttaccttaccggttaccgtttacctccggtaccttaaccgg

SEQ ID NO: 82496 - DNA, 761 bp, Homo sapiens
  misc_feature: GYAE6OF02F6KQW.36.53.E09.1.454.CMB.1.raw
  modified_base (487)..(487): a, c, t, g, unknown or other
  misc_feature (487)..(487): n is a, c, g, or t
tcagtacgctgtctcacgaccggtgctcgatttagagagagtgtgttgggtttgggggaggaactgctcagttaggacccagagggaaccagtggaagccccagctcagcttctcttcctcctgctactctggcctccagactacccgaccggggaagttgtgttgacacagtcctccgagcccaccctgtactttgtcgtaccggggaaagcgcctacctctcctgcacggcctagtcggagttgtttcagtacttacttaagtcgttacggtaaccaaacgtacgaaaaccgttcgggacccaacgggtccctacccgacggtccttcctaactaacttcctaatagtaactaccttaactacccaaaaccggtccgggacctacggtccgggtaccctaccgaacgtacgtacggttacgacggtttacggcgtacggggttagcggttacgggaactaacgtcctacacgttctacaaccgtntaccgatccgaacgtccggtaggcctacgtaggtaaagttccgttgtacgatttagtttacgtaactggaccttgaaccgttacgtcggttaaccttcgggtccgtcccgtttccgtccttaccggttcggttttccgggaaccgggtaacggttaccggtaaggggtcgtaaacgttacgtaaacctaacgggttacctggggtaccgtccttaggacccttaacgtcgtttactcggtttaaccttccgtcttcccccggttcaaccgttcg

SEQ ID NO: 82497 - DNA, 211 bp, Homo sapiens
  misc_feature: GYAE6OF01BD80G.25.60.F05.1.454.CMB.1.raw
  modified_base (209)..(211): a, c, t, g, unknown or other
  misc_feature (209)..(211): n is a, c, g, or t
tcagactgtacagtcacgaccggtgctcgatttagtacgtcatcagggaaaggggaccacggtcatcgtctcctccacctccaccaagggcccatcggtcttcccctggcaccctcctccaagagcacctctggggcacagcggccctgggctgcctggtcaaggactacttccactgtacagctgagcgggctggcaaggcgcatagnnn

SEQ ID NO: 82498 - DNA, 230 bp, Homo sapiens
  misc_feature: GYAE6OF01EJFHB.25.60.F05.1.454.CMB.1.raw
  modified_base (211)..(230): a, c, t, g, unknown or other
  misc_feature (211)..(230): n is a, c, g, or t
tcagactgtacagtcacgaccggtgctcgatttagtacgtcatcagggaaaggggaccacggtcatcgtctcctccacctccaccaagggcccatcggtcttccccctggcaccctcctccaagagcacctctgggggcacagcggccctgggctgcctggtcaaggctacttccactgtacagtctgagcgggctggcaaggcgcatagnnnnnnnnnnnnnnnnnnnn

SEQ ID NO: 82499 - DNA, 418 bp, Homo sapiens
  misc_feature: GYAE6OF01B6KD5.25.60.F05.1.454.CMB.1.raw
  modified_base (411)..(418): a, c, t, g, unknown or other
  misc_feature (411)..(418): n is a, c, g, or t
tcagactgtacagtcacgaccggtgctcgatttagtacgtcatcagggaaaggggctggagtggattgggagtgtcgcttatagtgggaccacctactacaacccgtccctcaagagtcgattcaccatatcagtggacacgtcccagaaccagttctccctgaagttgaattttgtgaccgccgcggacacggccctatattattgtacggcaggggcgacagcagatgttggagcaagtgactggggccagggaaccctggtaaccgtctcctcaccttccaccaagggcccatcggtcttcccctggcgccctgctccaggagcacctctgggggcacagcggccctgggctgcctggtcaaggctacttccactgtacagtctgagcgggctggcaaggcgcatagnnnnnnnn

SEQ ID NO: 82500 - DNA, 427 bp, Homo sapiens
  misc_feature: GYAE6OF01D3F0Q.25.60.F05.1.454.CMB.1.raw
  modified_base (326)..(326): a, c, t, g, unknown or other
  misc_feature (326)..(326): n is a, c, g, or t
  modified_base (415)..(415): a, c, t, g, unknown or other
  misc_feature (415)..(415): n is a, c, g, or t
  modified_base (417)..(427): a, c, t, g, unknown or other
  misc_feature (417)..(427): n is a, c, g, or t
tcagactgtacagtcacgaccggtgctcgatttagtacgtcatcagggaaaggggctggagtggattgggagtgtcgcttatagtgggaccacctactacaacccgtccctcaagagtcgattcaccatatcagtggacacgtcccagaacccagttcctccctgaagttgaattttgtgaccgccgcggacacggccctatattattgtacggcaggggcgacagcagatggtggagcaagtgactggggccagggaaccctggtaaccgtctcctcaccttcaccaagggcccatcggtcttcccctggcgccctgctccaggngcacctcgtgggggcacgagcggccctgggctgcctggtcaaggctactcactgtacagtctgagcgggctgggcaaggcgacagtagngnnnnnnnnnnn

SEQ ID NO: 82501 - DNA, 433 bp, Homo sapiens
  misc_feature: GYAE6OF01EUUM6.25.60.F05.1.454.CMB.1.raw
  modified_base (409)..(409): a, c, t, g, unknown or other
  misc_feature (409)..(409): n is a, c, g, or t
  modified_base (430)..(433): a, c, t, g, unknown or other
  misc_feature (430)..(433): n is a, c, g, or t
tcagactgtacagtcacgaccggtgctcgatttagtacgtcatcagggaaagggctggagtggattgggagtgtcgcttatagtgggaccacctactacaacccgtccctcaagagtcgattcaccatatcagtggacacgtcccagaaccagttctccctgaagttgaactctgtgactgccgcggacacggccgtgtattactgtgcggcatactacgatactagtggccgatatcaccatcacgatgattttgatatctggggccaagggacaagggtcaccgtctcttcagcctccaccaagggcccatcggtcttccccctggcaccctcctccaagagcacctctgggggcacagcggccctgggctgcctggtcaaggactacttccactgtacagtctgancgggctggcaaggcgcatagnnnn

SEQ ID NO: 82502 - DNA, 229 bp, Homo sapiens
  misc_feature: GYAE6OF01D13MS.25.60.F05.1.454.CMB.1.raw
  modified_base (209)..(229): a, c, t, g, unknown or other
  misc_feature (209)..(229): n is a, c, g, or t
tcagactgtacagtcacgaccggtgctcgatttagtacgtcatcagggaaaggggaccacggtcatcgtctcctccacctccaccaaggcccatcggtcttccccctggcaccctcctccaagagcacctctggggcacagcggcctgggctgcctggtcaaggactacttccactgtacagtctgagcgggctggcaaggcgcatagnnnnnnnnnnnnnnnnnnnnn

SEQ ID NO: 82503 - DNA, 412 bp, Homo sapiens
  misc_feature: GYAE6OF01CECSR.25.60.F05.1.454.CMB.1.raw
  modified_base (321)..(321): a, c, t, g, unknown or other
  misc_feature (321)..(321): n is a, c, g, or t
  modified_base (407)..(412): a, c, t, g, unknown or other
  misc_feature (407)..(412): n is a, c, g, or t
tcagactgtacagtcacgaccggtgctcgatttagtacgtcatcagggaaaggggctggagtggattgggagtgtcgcttatagtgggaccacctactacaacccgtccctcaagagtcgattcaccatatcagtggacacgtcccagaaccagttctccctgaagttgaattttgtgaccgccgcggacacggccctatattattgtacggcaggggcgacagcagatggtggagcaagtgactggggccagggaaccctggtaaccgtctcctcaccttccaccaagggcccatcggtctccctgcgccctgctcaggngcacctctgggggcacagcggccctgggctgcctggtcaaggctacttccactgtacagtctgagcgggctggcaaggcgcatagnnnnnn

SEQ ID NO: 82504 - DNA, 419 bp, Homo sapiens
  misc_feature: GYAE6OF02I80DF.25.60.F05.1.454.CMB.1.raw
  modified_base (414)..(419): a, c, t, g, unknown or other
  misc_feature (414)..(419): n is a, c, g, or t
tcagactgtacagtcacgaccggtgctcgatttagtacgtcatcagggaaagggctggagtggattgggagtgtcgcttatagtgggaccacctactacaacccgtccctcaagagtcgattcaccatatcagtggacacgtcccagaaccagttctccctgaagttgaattttgtgaccgccgcggacacggccctatattattgtacggcaggggcgacagcagatggtggagcaagtgactgggggccagggaaccctggtaaaccgtctcctcaccttccaccaagggcccatcggtcttccccctggcgccctgctccaggagcacctctgggggcacagcggccctgggctgcctggtcaaggactacttccactgtacagtctgagcgggctggcaaggcgcatagnnnnnn

SEQ ID NO: 82505 - DNA, 213 bp, Homo sapiens
  misc_feature: GYAE6OF02GB83D.25.60.F05.1.454.CMB.1.raw
  modified_base (211)..(213): a, c, t, g, unknown or other
  misc_feature (211)..(213): n is a, c, g, or t
tcagactgtacagtcacgaccggtgctcgatttagtacgtcatcagggaaaggggaccacggtcatcgtctcctccacctccaccaagggcccatcggtcttcccctggcaccctcctccaagagcacctctgggggcacagcggccctgggctgcctggtcaaggactacttccactgtacagtctgagcgggctggcaaggcgcatagnnn

SEQ ID NO: 82506 - DNA, 212 bp, Homo sapiens
  misc_feature: GYAE6OF02FFT23.25.60.F05.1.454.CMB.1.raw
  modified_base (210)..(212): a, c, t, g, unknown or other
  misc_feature (210)..(212): n is a, c, g, or t
tcagactgtacagtcacgaccggtgctcgatttagtacgtcatcagggaaaggggaccacggtcatcgtctcctccacctccaccaagggcccatcggtcttcccctggcaccctcctccaagagcacctctggggcacagcggccctgggctgcctggtcaaggactacttccactgtacagtctgagcgggctggcaaggcgcatagnnn

SEQ ID NO: 82507 - DNA, 212 bp, Homo sapiens; identical to SEQ ID NO: 82506
  misc_feature: GYAE6OF02JB7LL.25.60.F05.1.454.CMB.1.raw
  modified_base (210)..(212): a, c, t, g, unknown or other
  misc_feature (210)..(212): n is a, c, g, or t

SEQ ID NO: 82508 - DNA, 211 bp, Homo sapiens
  misc_feature: GYAE6OF02I4M80.25.60.F05.1.454.CMB.1.raw
  modified_base (209)..(211): a, c, t, g, unknown or other
  misc_feature (209)..(211): n is a, c, g, or t
tcagactgtacagtcacgaccggtgctcgatttagtacgtcatcagggaaagggaccacggtcatcgtctcctccacctccaccaagggcccatcggtcttcccctggcaccctcctccaagagcacctctggggcacagcggccctgggctgcctggtcaaggactacttccactgtacagtctgagcgggctggcaaggcgcatagnnn

SEQ ID NO: 82509 - DNA, 488 bp, Homo sapiens
  misc_feature: GYAE6OF02GCBT2.25.60.F05.1.454.CMB.1.raw
  modified_base (452)..(452): a, c, t, g, unknown or other
  misc_feature (452)..(452): n is a, c, g, or t
  modified_base (458)..(460): a, c, t, g, unknown or other
  misc_feature (458)..(460): n is a, c, g, or t
  modified_base (462)..(464): a, c, t, g, unknown or other
  misc_feature (462)..(464): n is a, c, g, or t
  modified_base (470)..(488): a, c, t, g, unknown or other
  misc_feature (470)..(488): n is a, c, g, or t
tcagactgtacagtcacgaccggtgctcgatttagtacgtcatcagggaaaggggcgtgggagtgggattggggacgtgtcgcttatagtgggaccaccttactacaaccccgtccctcaagagtcgattcaccatagtcagtggacacgtcccagaaccagttctccctgaagttcgaatttttgttgaccgccgtacggacacggccctatattattgtacggcaggggcacaggcagatggtggagcgaagtgactggggccagggaaccctgggtaaccgtctcctcaccctttccaccgtaaggggcccatccggtcttcccccctggcgcccctggcctccaggcgccgaccgtcctggggggcaccgtacgccgggcccctggggccttggcccctgggtcaacggacctacttccactgtacagtctgagcggctggcaaggcncatagnnncnnnctgacnnnnnnnnnnnnnnnnnnn

SEQ ID NO: 82510 - DNA, 421 bp, Homo sapiens
  misc_feature: GYAE6OF02HHJKP.25.60.F05.1.454.CMB.1.raw
  modified_base (412)..(421): a, c, t, g, unknown or other
  misc_feature (412)..(421): n is a, c, g, or t
tcagactgtacagtcacgaccggtgctcgatttagtacgtcatcagggaaaggggctggagtggattgggagtgtcgcttatagtgggaccacctactacaacccgtccctcaagagtcgattcaccatatcagtggacacgtcccagaaccagttctccctgaagttgaattttgtgaccgccgcggacacggccctatattattgtacggcaggggcgacagcagatggtggagcaagtgactggggccagggaaccctggtaaccgtctcctcaccttccaccaagggcccatcggtcttccccctggcgccctgctccaggagcacctcgtggggcacagcggccctgggctgcctggcaaggactacttccactgtacagtctgagcgggctggcaaggcgcatagnnnnnnnnnn

SEQ ID NO: 82511 - DNA, 212 bp, Homo sapiens
  misc_feature: GYAE6OF02FVHWI.25.60.F05.1.454.CMB.1.raw
  modified_base (211)..(212): a, c, t, g, unknown or other
  misc_feature (211)..(212): n is a, c, g, or t
tcagactgtacagtcacgaccggtgctcgatttagtacgtcatcagggaaaggggaccacggtcatcgtctcctccacctccaccaagggcccatcggtcttcccctggcaccctcctccaagagcacctctgggggcacagcggccctgggctgcctggtcaaggactacttccactgtacagtctgagcgggctggcaaggcgcatagnn

SEQ ID NO: 82512 - DNA, 421 bp, Homo sapiens
  misc_feature: GYAE6OF02GOVEO.25.60.F05.1.454.CMB.1.raw
  modified_base (415)..(416): a, c, t, g, unknown or other
  misc_feature (415)..(416): n is a, c, g, or t
  modified_base (418)..(421): a, c, t, g, unknown or other
  misc_feature (418)..(421): n is a, c, g, or t
tcagactgtacagtcacgaccggtgctcgatttagtacgtcatcagggaaaggggctggagtggattgggagtgtcgcttatagtgggaccacctactacaacccgtccctcaagagtcgattcaccatatcagtggacacgtcccagaaccagttctccctgaagttgaattttgtgaccgccgcggacacggccctatattattgtacggcaggggcgacagcagatggtggagcaagtgactgggggccaggggaaccctggtaaccgtctcctcaccttccaccaagggcccatcggtcttccccctggcgccctgctccaggagcacctctgggggcacagcggccctgggctgcctggcaaggactacttccactgtacagtctgagcgggctgggcaaggcgcatagnngnnnn

SEQ ID NO: 82513 - DNA, 211 bp, Homo sapiens
  misc_feature: GYAE6OF02GH5BT.25.60.F05.1.454.CMB.1.raw
  modified_base (210)..(211): a, c, t, g, unknown or other
  misc_feature (210)..(211): n is a, c, g, or t
tcagactgtacagtcacgaccggtgctcgatttagtacgtcatcagggaaaggggaccacggtcatcgtctcctccacctccaccaagggcccatcggtcttcccctggcaccctcctccaagagcacctctggggcacagcggccctgggctgcctggtcaaggactacttccactgtacagtctgagcgggctggcaaggcgcatagnn

SEQ ID NO: 82514 - DNA, 231 bp, Homo sapiens
  misc_feature: GYAE6OF02HZH0L.25.60.F05.1.454.CMB.1.raw
  modified_base (212)..(231): a, c, t, g, unknown or other
  misc_feature (212)..(231): n is a, c, g, or t
tcagactgtacagtcacgaccggtgctcgatttagtacgtcatcagggaaaggggaccacggtcatcgtctcctccacctccaccaagggcccatcggtcttccccctggcaccctcctccaagagcacctctgggggcacagcggccctgggctgcctggtcaaggactacttccactgtacagtctgagcgggctggcaaggcgcatagnnnnnnnnnnnnnnnnnnnn

SEQ ID NO: 82515 - DNA, 509 bp, Homo sapiens
  misc_feature: GYAE6OF02HD922.25.60.F05.1.454.CMB.1.raw
  modified_base (485)..(486): a, c, t, g, unknown or other
  misc_feature (485)..(486): n is a, c, g, or t
  modified_base (488)..(489): a, c, t, g, unknown or other
  misc_feature (488)..(489): n is a, c, g, or t
  modified_base (491)..(509): a, c, t, g, unknown or other
  misc_feature (491)..(509): n is a, c, g, or t
tcagactgtacagtcacgaccggtgctcgatttagtacgtcatcagggaaaggggctggagtggattgggagtgtcgcttatagtgggaccacctactacaacccgtccctacaagagtcgattccaccatatcagtggacacgtcccagaaccagttcctccctgaagttgaacttttgtgaccgccgcggacacggccctatattagttgtacggcaggggcgacagcagatggtggagcaagtgactggggccaggggaaccctggtaaccgtctcctcaccttccaccaacgggcccatccggtcttcccccctgggccgtccccgtcgcctacccgagggacgccaccgttccggtaggggggctacgacggccgggccctcggggcctcggcctgggtaccgaacggtacctaccttcccgtaacttcgtaactagtcctggtacgtcggggcgtgggccgaaggccgacgtaagtcgnngnngnnnnnnnnnnnnnnnnnnn

SEQ ID NO: 82516 - DNA, 218 bp, Homo sapiens
  misc_feature: GYAE6OF02HBE08.25.60.F05.1.454.CMB.1.raw
  modified_base (212)..(218): a, c, t, g, unknown or other
  misc_feature (212)..(218): n is a, c, g, or t
tcagactgtacagtcacgaccggtgctcgatttagtacgtcatcagggaaaggggaccacggtcatcgtctcctccacctccaccaagggcccatcggtcttccccctggcaccctcctccaagagcacctctgggggcacagcggccctgggctgcctggtcaaggactacttccactgtacagtctgagcgggctggcaaggcgcatagnnnnnnn

SEQ ID NO: 82517 - DNA, 217 bp, Homo sapiens
  misc_feature: GYAE6OF02F0S7M.25.60.F05.1.454.CMB.1.raw
  modified_base (212)..(217): a, c, t, g, unknown or other
  misc_feature (212)..(217): n is a, c, g, or t
tcagactgtacagtcacgaccggtgctcgatttagtacgtcatcagggaaaggggaccacggtcatcgtctcctccacctccaccaagggcccatcggtcttccccctggcaccctcctccaagagcacctctgggggcacagcggccctgggctgcctggtcaaggactacttccactgtacagtctgagcgggctggcaaggcgcatagnnnnnn

SEQ ID NO: 82518 - DNA, 227 bp, Homo sapiens
  misc_feature: GYAE6OF02G4OTC.25.60.F05.1.454.CMB.1.raw
  modified_base (206)..(206): a, c, t, g, unknown or other
  misc_feature (206)..(206): n is a, c, g, or t
  modified_base (212)..(227): a, c, t, g, unknown or other
  misc_feature (212)..(227): n is a, c, g, or t
tcagactgtacagtcacgaccggtgctcgatttagtacgtcatcagggaaaggggaccacggtcatcgtctcctccacctccaccaagggcccatcggtcttccccctggcaccctcctccaagagcacctctgggggcacagcggccctgggctgcctggtcaaggactacttccactgtacagtctgagcgggctggcaaggcncatagnnnnnnnnnnnnnnnn

SEQ ID NO: 82519 - DNA, 273 bp, Homo sapiens
  misc_feature: GYAE6OF01CI9T3.36.78.H01.1.454.CMB.1.raw
  modified_base (260)..(273): a, c, t, g, unknown or other
  misc_feature (260)..(273): n is a, c, g, or t
tcagtacgctgtctcacgaccggtgctcgatttagtgtgagtagtttgggtttgggacagagttcactctcacaatcaccagcctgcaggctgaagatgtggcattttattactgtcagcagtatttgactagtcccgtgtacacatttggcctaggggaccaagctggtagctcaaacgaactgtggctgcaccatctgtcttcagtcttcccgccatctgaagacagcgtactgagcgggctggccaaggcgcatagnnnnnnnnnnnnnn

SEQ ID NO: 82520 - DNA, 257 bp, Homo sapiens
  misc_feature: GYAE6OF01D70L1.36.78.H01.1.454.CMB.1.raw
  modified_base (256)..(257): a, c, t, g, unknown or other
  misc_feature (256)..(257): n is a, c, g, or t
tcagtacgctgtctcacgaccggtgctcgatttagtgtgagtagtttgggtttgggacagagttcactctcacaatcaccagcctgcaggctgaagatgtggcattttattactgtcagcagtatttgactagtcccgtgtacacatttggccaggggaccaagctggagctcaaacgaactgtggctgcaccatctgtcttcatcttcccgccatctgaagacagcgtactgagcgggctggcaaggcgcatagnn

SEQ ID NO: 82521 - DNA, 256 bp, Homo sapiens
  misc_feature: GYAE6OF01ESRY8.36.78.H01.1.454.CMB.1.raw
  modified_base (256)..(256): a, c, t, g, unknown or other
  misc_feature (256)..(256): n is a, c, g, or t
tcagtacgctgtctcacgaccggtgctcgatttagtgtgagtagtttgggtttgggacagagttcactctcacaatcaccagcctgcaggctgaagatgtggcattttattactgtcagcagtatttgactagtcccgtgtacacatttggccaggggaccaagctggagctcaaacgaactgtggctgcaccatctgtcttcatcttcccgccatctgaagacagcgtactgagcgggctggcaaggcgcatagn

SEQ ID NO: 82522 - DNA, 278 bp, Homo sapiens
  misc_feature: GYAE6OF01BDXN6.36.78.H01.1.454.CMB.1.raw
  modified_base (259)..(278): a, c, t, g, unknown or other
  misc_feature (259)..(278): n is a, c, g, or t
tcagtacgctgtctcacgaccggtgctcgatttagtgtgagtagtttgggtttgggacagagttcactctcacaatcaccagcctgcaggctgtaagatgtggcattttattactgtcagcagtatttgactagtcccgtgtacacatttggccaggggaccaagctggagctcaaacgaactgtggctgcaccatctgtcttcatcttcccgccattctgaagacagcgtactgagcgggctggcaaggcgcatagcnnnnnnnnnnnnnnnnnnnn

SEQ ID NO: 82523 - DNA, 261 bp, Homo sapiens
  misc_feature: GYAE6OF01BVEL3.36.78.H01.1.454.CMB.1.raw
  modified_base (250)..(261): a, c, t, g, unknown or other
  misc_feature (250)..(261): n is a, c, g, or t
tcagtacgctgtctcacgaccggtgctcgatttagtgtgagtagtttgggttgggacagagttcactctcacaatcaccagcctgcaggctgaagatgtggcattttattactgtcagcagtatttgactagtcccgtgtacacatttggccaggggaccaagctggatctcaaacgactgtggctgcaccatctgtcttcatctccgcatctgaagcagcgtactgagcgggctggcaaggcgcatagnnnnnnnnnnnn

SEQ ID NO: 82524 - DNA, 258 bp, Homo sapiens
  misc_feature: GYAE6OF01AE8FL.36.78.H01.1.454.CMB.1.raw
  modified_base (254)..(258): a, c, t, g, unknown or other
  misc_feature (254)..(258): n is a, c, g, or t
tcagtacgctgtctcacgaccggtgctcgatttagtgtgagtagtttgggtttgggacagagttcactctcacaatcaccagcctgcaggctgaagatgtggcattttattactgtcagcagtatttgactagtcccgtgtacacatttggccaggggaccaagctggagctcaaacgactgtggctgcaccatctgtcttcatcttcccgccatctgaagacagcgtactgagcggctggcaaggcgcatagnnnnn

SEQ ID NO: 82525 - DNA, 582 bp, Homo sapiens
  misc_feature: GYAE6OF01BN22O.36.78.H01.1.454.CMB.1.raw
  modified_base (542)..(542): a, c, t, g, unknown or other
  misc_feature (542)..(542): n is a, c, g, or t
  modified_base (580)..(580): a, c, t, g, unknown or other
  misc_feature (580)..(580): n is a, c, g, or t
  modified_base (582)..(582): a, c, t, g, unknown or other
  misc_feature (582)..(582): n is a, c, g, or t
tcagtacgctgtctcacgaccggtgctcgatttagtgtgagtagtttgggtttggggggtccctgagactctcctgtgtagcctctggattcacctttaacaactactggatgtcctgggtccgccaggctccagggaaggggctggaatgggtggccaacatgaagccagatggaagtcagacatactatgtggactctgtgaaggccattcaccatctcagagacagcgccaatcactcactgtatctgcaaatgaaacagcctgagagccgaagacacggctgtttatacgtgtgcgagagaggctacgtttggagtggttatcgtccctttgactacgtcggggcacgggtacctggtctccgtctcctctcgtccttccaccgtaacgggccctacgttcccgttcccttcccccgtcggtcccgtcccctcgcctccgacggacgccacccgtccgagacgcacgaccgccgcccgtgggcctcggtcccgtggtacaacgggtaccttaccgtccgacgaccgacgccgttacgnggacggcgggccgtcgggaccgacgggcacgagtacgngn

SEQ ID NO: 82526 - DNA, 255 bp, Homo sapiens
  misc_feature: GYAE6OF01DJV37.36.78.H01.1.454.CMB.1.raw
tcagtacgctgtctcacgaccggtgctcgatttagtgtgagtagtttgggtttgggacagagttcactctcacaatcaccagcctgcaggctgaagatgtggcattttattactgtcagcagtatttgactagtcccgtgtacacatttggccaggggaccaagctggagctcaaacgaactgtggctgcaccatctgtcttcatcttcccgccatctgaagacagcgtactgagcgggctggcaaggcgcatag

SEQ ID NO: 82527 - DNA, 620 bp, Homo sapiens
  misc_feature: GYAE6OF01AUIEW.36.78.H01.1.454.CMB.1.raw
tcagtacgctgtctcacgaccggtgctcgatttagtgtgagtagtttgggtttgggggcagggtgtacacctgtggctctcagagaggagccttagccctggactccaaggcctttccacttggtgatcagcactgaacacagaggactcaccatggaattggggctgaccttgggttttccttgttgctattttagaaggtgtccagtctcaggtgcagctggtggagtcgtgggggagcgttggtccgagggcccgggggggtccctggacgactctcctgtgtagcctctggattcacctttaacaactacgtgatcgtccgtgggtccgccgaggcctaccgagggagggctaggaagtggggtcgaccaacgagtagaagccagagtaggaacgtcaagactatactagtgtggactcgtggtacggaacgggtcctaattccaacctagttccaccgaagacgaccgagccgaccaatccaactcctacgttgtaactcgacgtaacaaagttacgaaactacgccgtaggaacgaccgaccgaaagaccgtacgggttctttaagttttaacgtactgggacgacgaaaggtgggaccgggttcttaacgggg

SEQ ID NO: 82528 - DNA, 567 bp, Homo sapiens
  misc_feature: GYAE6OF01EXS34.36.78.H01.1.454.CMB.1.raw
  modified_base (360)..(360): a, c, t, g, unknown or other
  misc_feature (360)..(360): n is a, c, g, or t
  modified_base (432)..(432): a, c, t, g, unknown or other
  misc_feature (432)..(432): n is a, c, g, or t
  modified_base (449)..(449): a, c, t, g, unknown or other
  misc_feature (449)..(449): n is a, c, g, or t
  modified_base (532)..(532): a, c, t, g, unknown or other
  misc_feature (532)..(532): n is a, c, g, or t
  modified_base (567)..(567): a, c, t, g, unknown or other
  misc_feature (567)..(567): n is a, c, g, or t
tcagtacgctgtctcacgaccggtgctcgatttagtgtgagtagtttgggtttgggggggtccctgagactctcctgtgtagcctctggattcacctttaacaactactggatgtcctgggtccgccaggctccagggaaggggctggaatggggtggccaacatgaagccagatggaagtcagacatactatgtggactctgtgaaggccgattcaccatctccagagacagcgaccaatcactcactgtatctgacaaatcgaaacacgcctggagacgaccgaagacacggtcttgtttattacgtgtgcggagaggaggctacgttttggagttggttatcgtcctttgactacgngggccgagggaccctggtctccgtctctctgtcctccaccgacggccctactcccgttcctccccgtgcccnccctcgcctccgaggcnccaccgtccgagcgccaacgcgcccgcccgtggcctcgcccgtggtaccaacggtaccttactccgaagccacggccgtacgngacgggccggtcgagggaccgtacggcagaagtgn

SEQ ID NO: 82529 - DNA, 895 bp, Homo sapiens
  misc_feature: GYAE6OF01CN5MM.36.78.H01.1.454.CMB.1.raw
tcagtacgctgtctcacgaccggtgctcgatttagtgtgagtagtttgggtttgggggggtccctgagactctcctgtgtagcctctggattcacctttaacaactactggatgtcctgggtccgccaggcctccgaggggaaggggctaggaagtggggtgaccaacatgaagccagataggaagtcagacatactatgtggactctgtaggaacgggccattcaccatcctccagacgacagcgaccaatcactcactgtatctagacaaatgaacagcctaggaacgacggccgaaaagaccgaacgggtctttacgtttttaataccgttggtacgacggaaggaacgggtaggggtacccttttaaacggggttttttgggaacgggttttagggttttaacgttccggtttacccccgtttttaaggaaccgtttaacccggggtcggggggaaccccgtaaacggggggtaaacccctttgggttaccccgttcccggttcccgtttccctttacgtccggttaccccgtttaacccgaaacccggtaaacggggtcccccttaacccgtttcccccggttcccgtttcccccccggttcgggtcccccgtcccccgttcggtaccccttacccggacgggaccgtacccgtaaccccggtccggaacggacccggaccccgtaacggaccccggtcccccgggtaccccggttcgggggtcccgtcccgggtacccggtttacggggtaacccgttaaaacggggtacccctttaacccgttacccggaaccgtaaaccggtacgggaaccccggtttacggaccggggttaaccgggcgggggtaccgtacggggaaccgtaaccggggctaagtaacgaggctag

SEQ ID NO: 82530 - DNA, 730 bp, Homo sapiens
  misc_feature: GYAE6OF01DFMIO.36.78.H01.1.454.CMB.1.raw
  modified_base (383)..(383): a, c, t, g, unknown or other
  misc_feature (383)..(383): n is a, c, g, or t
  modified_base (728)..(728): a, c, t, g, unknown or other
  misc_feature (728)..(728): n is a, c, g, or t
tcagtacgctgtctcacgaccggtgctcgatttagtgtgagtagtttgggtttgggggggtcccgtgagactctcctgtgtagcctctggattcacctttaaacaactacgtgggactcgtccgtgggtcccgccgagggcctccgaggggaaggggctgggaatggggtcgcccaaagataggaaagccgaagatgggaaacgtcaagaccatacgttatcgtcggacttcgtgtaggaaacgggcctattccgaaccatccgtaccaagaacgacagccgaccaaatccaacttcacgttaggttaactccgtagacaaaagtcgaaacgagtcctaggaacgacgaaccgaaggtaccgacggtcttacgtttattacgngtgacgagaggacggtctaggtttggagttgttacgtcgtcccttagaccgtaaggtcgggaccgacggtacccgtggtcctccggtcttccgtagtcgtccttacccgaaccgacggccctacgtcccgtacccgttccccgcgcccgtccctcgcccgtaccggtacggacctccgtaccgtccgtaagaccggtacctaacggaccgccccgggtccgtacgggcccttaccgggtacccgttacggtaccggtaaaccggtcccgttaaccgtaccgacggaacgtacggtaccgtagaggaccggcgggtccgtagggacgtacgggtcgaactcgtagntc

SEQ ID NO: 82531 - DNA, 260 bp, Homo sapiens
  misc_feature: GYAE6OF01CGT97.36.78.H01.1.454.CMB.1.raw
  modified_base (256)..(260): a, c, t, g, unknown or other
  misc_feature (256)..(260): n is a, c, g, or t
tcagtacgctgtctcacgaccggtgctcgatttagtgtgagtagtttgggtttgggacagagttcactctcacaatcaccagcctgcaggctgaagatgtggcattttattactgtcagcagtatttgactagtcccgtgtacacatttggccaggggaccaagctggagctcaaacgaactgtggctgcaccatctgtcttcatcttcccgcatctgaagacagcgtactggagcgggctggcaaggcgcatagnnnnn

SEQ ID NO: 82532 - DNA, 549 bp, Homo sapiens
  misc_feature: GYAE6OF01C350T.36.78.H01.1.454.CMB.1.raw
  modified_base (485)..(485): a, c, t, g, unknown or other
  misc_feature (485)..(485): n is a, c, g, or t
  modified_base (537)..(537): a, c, t, g, unknown or other
  misc_feature (537)..(537): n is a, c, g, or t
  modified_base (542)..(542): a, c, t, g, unknown or other
  misc_feature (542)..(542): n is a, c, g, or t
tcagtacgctgtctcacgaccggtgctcgatttagtgtgagtagtttgggtttgggggcagggtgtacacctgtggctctcagagaggagccttagccctggactccaaggcctttccacttggtgatcagcactgaacacagaggactcaccatggaattggggctgacctgggttttccttgttgctattttagaaggtgtccagtctcaggtgcagctggtggagtcgtgggggagcttggtccaggcccgggggggtccctggagactctcctgtgtagcctctggattcacctttaacaactactggatgtcctgggtccgccaggctccgagggaagggctgggaatgggtgccaacatgaagccagatggaagtcagacatactatgtggactcgtgtgaacgggccgtaattccgaaccatacctaccgaagacgacgacgccgaccaatcactcactgtatctgacaaatcgaacngcctagaagacgacgaagaccacggtcttagttattacgtgtagacgagagngggtnttaacgg

SEQ ID NO: 82533 - DNA, 262 bp, Homo sapiens
  misc_feature: GYAE6OF01EHHD0.36.78.H01.1.454.CMB.1.raw
  modified_base (250)..(250): a, c, t, g, unknown or other
  misc_feature (250)..(250): n is a, c, g, or t
  modified_base (256)..(262): a, c, t, g, unknown or other
  misc_feature (256)..(262): n is a, c, g, or t
tcagtacgctgtctcacgaccggtgctcgatttagtgtgagtagtttgggtttgggacagagttcactctcacaatcaccagcctgcaggctgaagatgtggcattttattactgtcagcagtatttgactagtcccgtgtacacatttggccaggggaccaagctggagctacaaacgaactgtggctgcaccatctgtcttcatcttcccgcatctgaagacagcgtactgagcgggctggcaaggcncatagnnnnnnn

SEQ ID NO: 82534 - DNA, 259 bp, Homo sapiens
  misc_feature: GYAE6OF01DPU91.36.78.H01.1.454.CMB.1.raw
  modified_base (256)..(259): a, c, t, g, unknown or other
  misc_feature (256)..(259): n is a, c, g, or t
tcagtacgctgtctcacgaccggtgctcgatttagtgtgagtagtttgggtttgggacagagttcactctcacaatcaccagcctgcaggctgaagatgtggcattttattactgtcagcagtatttgactagtcccgtgtacacatttggccaggggaccaagctggagctacaaacgaactgtggctgcaccatctgtcttcatctcccgcatctgaagacagcgtactgagcggctggacaaggcgcataagnnnn

SEQ ID NO: 82535 - DNA, 313 bp, Homo sapiens
  misc_feature: GYAE6OF01CM5MZ.36.78.H01.1.454.CMB.1.raw
  modified_base (258)..(264): a, c, t, g, unknown or other
  misc_feature (258)..(264): n is a, c, g, or t
  modified_base (266)..(266): a, c, t, g, unknown or other
  misc_feature (266)..(266): n is a, c, g, or t
  modified_base (270)..(313): a, c, t, g, unknown or other
  misc_feature (270)..(313): n is a, c, g, or t
tcagtacgctgtctcacgaccggtgctcgatttagtgtgagtagtttggggtttggggacagagttcactctcacaatcaccagcctgcaggctgaagatgtggcattttattactgtcagcagtatttgactagtcccgtgtacacatttggccaggggaccaagctggagctcaaacgactgtggctgcaccatctgtcttcatcttcccgccatctgaagacagctactggagcgggctggctaaggcgcatagnnnnnnnanctannnnnnnnnnnnnnnnnnnnnnnnnnnnnnnnnnnnnnnnnnnn

SEQ ID NO: 82536 - DNA, 624 bp, Homo sapiens
  misc_feature: GYAE6OF01A3Z4G.36.78.H01.1.454.CMB.1.raw
  modified_base (438)..(438): a, c, t, g, unknown or other
  misc_feature (438)..(438): n is a, c, g, or t
tcagtacgctgtctcacgaccggtgctcgatttagtgtgagtagtttgggtttggggaggtctcagagaggagccttagccctggactccaaggcctttccacttggtgatcagcactgaacacagaggactcaccatggaattggggctgacctgggttttccttgttgctattttagaaggtgtccagtctcaggtgcagctggtggagtcgtggggggaggcttggtccaggccgggggggtccctgagactctcctgtgtgctctggattcacctttaacaactactggatgtcctgggtccgccaggcctccgaggggacggggctagggaagtggggtcggccaacagtacggaacgccagagtggaatacgagacatactaatgtagactcgtggtagaacgggccattcaccattcctaccagacgacgngccgacaactcacctcaactgtaactcgtgaactaaagtcgaaaccgagtccctagggtaacgaccggaaccgaacggaccgtacgggtcctttaggtttacttacgtggtggacgaggggacgtaggggtaccctttaaggttttcggggaagtttagggtttacgtccgtttccccggtttagg

SEQ ID NO: 82537 - DNA, 761 bp, Homo sapiens
  misc_feature: GYAE6OF01AJ3C0.36.78.H01.1.454.CMB.1.raw
tcagtacgctgtctcacgaccggtgctcgatttagtgtgagtagtttgggtttgggggcagggtgtacacctgtggctctcagagaggagccttagccctggactccaaggcctttccacttggtgatcagcactgaacacagaggactcaccatggaattggggctgacctgggttttccttgttgctattttagaaggtgtccagtctcaggtgcagctgggtggagtcgtggggggaggcgttgggtccgagggtcccgggggggtccctggacgacttcctccgttggtgtacgccgttcgtggtacttcctaaccctttaaacaaccttacgttggtacgttccggtttccggtccggggttcccgacccgtacgggtccgtaccgggaagggggaaacggggtccgttagggaaagggttcgggggtaccgacccgaaaacgtacgtacggaaccggaccgaagggtaagttaacgggaaacgttcgaaggtaactaacgttaacttagttacggtacggtaccttaccggttagggtacgggaaaccggggtccgtacttacccgaccgtacttcccgtaccgaaggtacgaaccgtaggcccgtacaactcccactacctactcgtaactgtaacgaactaaagtcaacgtcgacccgtaggaacgtaaccgaaccgaacgaccggtacggtacgttttgtttaacgttaccgtggtacgggaacgtaggagggtaccggtcgttttaacggg

SEQ ID NO: 82538 - DNA, 607 bp, Homo sapiens
  misc_feature: GYAE6OF01BVFDY.36.78.H01.1.454.CMB.1.raw
  modified_base (600)..(600): a, c, t, g, unknown or other
  misc_feature (600)..(600): n is a, c, g, or t
  modified_base (602)..(607): a, c, t, g, unknown or other
  misc_feature (602)..(607): n is a, c, g, or t
tcagtacgctgtctcacgaccggtgctcgatttagtgtgagtagtttgggtttgggggggtccctgagactctcctgtgtagcctctggattcacctttgacaagtgtgccatgacctgggtccgccaggctccagggaaggggctggagtgggtctcagttattagtggtagtggtagtagcacagattacgcagactccgtgaagggccggttcaccatctccagagacaattccaacagcacgctgtatttgcacatgaacagcctgagagccgaggacacggccatatattatgtgacgtaacttcctttgactggtttattactcccctagtcgaccacgtcgggccacgggaaccctggtccacccgtcctcctcacgtccctacccaacccgaacgggccctagtcccggttcccttacccccgtcgcccacccctcctacccaacgacgccgaccctcgtcgggggaccacgacggcccggcccgtcgggccgtcgccgtcggtaccgaacggtaccttacccgttaccgacgtaccgacgtaccgtacgtacggacgggccgggccgtcgggaccgaacgggcgacagtgncnnnnnn

SEQ ID NO: 82539 - DNA, 786 bp, Homo sapiens
  misc_feature: GYAE6OF01BPV0G.36.78.H01.1.454.CMB.1.raw
tcagtacgctgtctcacgaccggtgctcgatttagtgtgagtagtttgggtttgggggcagggtgtacacctgtggctctcagagaggagccttagccctggactccaaggcctttccacttggtgatcagcactgaacacagaggactcaccatggaattggggctgacctgggttttccttgttcgctattttagaaggtgtccagtctcaggtgcagctggtggagtcgtggggggagcttgggtcccgagggcccgggggggtccctggacggtactctccgtgtgtacgcctctggtattccaccttttaacaactactggatgtccgtgggtccgcaggcctccgaggggaagggctaggaagtggggtcgaccgaacagtgaacgccagacgtggaagtcaaggacatacgtatggtggaccttcgtaggtacgggaaacggggtcctaatttacccgaacccgtaattacccgtaccccaaagggtaaccggaaccgtaacggaccccgaaccctaaagtcccctaaaccgttccaaccgtttagggttaacttacccggtacggtaaccctaaaaaagttccgggaaaaacctaaccggtccccgttaagggaaaccggtaaaccggggtaaacccccggaaaaacggaaccccggttaaaccggggttcccggttttaaaggggttttttaaacccttaaacgggttcgggggtttaaccgaaccggggtaaagggtaaacggggttaaccgggggtccttttttaaaccgggggg

SEQ ID NO: 82540 - DNA, 263 bp, Homo sapiens
  misc_feature: GYAE6OF01AW5Y4.36.78.H01.1.454.CMB.1.raw
  modified_base (260)..(263): a, c, t, g, unknown or other
  misc_feature (260)..(263): n is a, c, g, or t
tcagtacgctgtctcacgaccggtgctcgatttagtgtgagtagtttgggtttgggacagagttcactctcacaatcaccagcctgcaggctgaagatgtggcattttattactgtcagcagtatttgactagtcccgtgtacacatttggccaggggaccaagctggagctcaaacgactgtggctgcaccatcgtgtcttcatcttcccgccatcgtgaagacagtccgtactgaggcgggctggcaaggcgcatagnnnn

SEQ ID NO: 82541 - DNA, 717 bp, Homo sapiens
  misc_feature: GYAE6OF01COH8W.36.78.H01.1.454.CMB.1.raw
  modified_base (214)..(214): a, c, t, g, unknown or other
  misc_feature (214)..(214): n is a, c, g, or t
tcagtacgctgtctcacgaccggtgctcgatttagtgtgagtagtttgggtttggggcagggtgtacacctgtggctctcagagaggagccttagccctggactccaaggcctttccacttggtgatcagcactgaacacagagactcaccatggaattgggctgaccttggttttcctgttgcttattttagaaggtgtccagtctcgaggtncagcgtggtggagtcggtgggggacgtcgtttcgggaccgacgggtcccgggggtccctaggacgccttcgtccgtgtgtacgccttcgtaggtacttacctaaccgtttaacaaccttacgtggtacgtacgttccgtacgggttcccgaccgtacggtccgtaccggaaggggaacggggtccgtagggaacggttcggggtacggaacccaaagtacgtacggaaacggccgaaggtaacgtagggaaacgtcgaacgaacgtaacttacgtagttagtacggtacgttcgtaggtacggaacggaccgttattaccgaacttcgttccaaccgagaacgacgacgacccgaactaacttccgaactaccgtacgtacgttactcgttaacggaacaaacgttacgaaacgtaccgacgtaacgaaggaccgaccgaagaaccgtacgtctttaacgtttataccgttagtacgacggaaggacgtaggtactttacggg

SEQ ID NO: 82542 - DNA, 723 bp, Homo sapiens
  misc_feature: GYAE6OF01BGKQ1.36.78.H01.1.454.CMB.1.raw
  modified_base (415)..(415): a, c, t, g, unknown or other
  misc_feature (415)..(415): n is a, c, g, or t
  modified_base (696)..(696): a, c, t, g, unknown or other
  misc_feature (696)..(696): n is a, c, g, or t
tcagtacgctgtctcacgaccggtgctcgatttagtgtgagtagtttgggtttgggggcagggtgtacacctgtggctctcagagaggagccttagccctggactccaaggcctttccacttggtgatcagcactgaacacagaggactcaccatggaagttggggctgaccttggttttccttgttgctatttagagtgtccagtctcaggtgcagcgttggtggagtcggtggggggaggtcttgggtcccgacggggtcccgggggggtccctggacgtaccttctccgtgttggtacgtcccttcgtggtactttcctaaccgttttaaacaaccttacgtcggtattcggtcccgtcgggtccgccgacggctaccggaggggagggctagggaagtgggtcgaccaagngtagacgcagagtggaacgtcgacgaactataacgttagtgtacggtacttcgtaggtagggaaccgggtcgtattacccgacctaacgtccctaccgaaggtaacgactacggcccgtaacctaaccgtacctaacttccctaagttcttaacgtccttaagaaaccgttaaatacgaaactaccgtacgtacggaacgtacccgaaccggaaacgtaccggtaccgggttacttttaacggttttacgttaaaccggtttggacggtagggtaaacggngggtaaccgggtttacgtttacggggg

SEQ ID NO: 82543 - DNA, 703 bp, Homo sapiens
  misc_feature: GYAE6OF01A8PD9.36.78.H01.1.454.CMB.1.raw
  modified_base (252)..(252): a, c, t, g, unknown or other
  misc_feature (252)..(252): n is a, c, g, or t
  modified_base (412)..(412): a, c, t, g, unknown or other
  misc_feature (412)..(412): n is a, c, g, or t
  modified_base (672)..(672): a, c, t, g, unknown or other
  misc_feature (672)..(672): n is a, c, g, or t
  modified_base (684)..(684): a, c, t, g, unknown or other
  misc_feature (684)..(684): n is a, c, g, or t
  modified_base (689)..(689): a, c, t, g, unknown or other
  misc_feature (689)..(689): n is a, c, g, or t
  modified_base (696)..(696): a, c, t, g, unknown or other
  misc_feature (696)..(696): n is a, c, g, or t
  modified_base (698)..(698): a, c, t, g, unknown or other
  misc_feature (698)..(698): n is a, c, g, or t
  modified_base (700)..(700): a, c, t, g, unknown or other
  misc_feature (700)..(700): n is a, c, g, or t
  modified_base (702)..(702): a, c, t, g, unknown or other
  misc_feature (702)..(702): n is a, c, g, or t
tcagtacgctgtctcacgaccggtgctcgatttagtgtgagtagtttgggtttgggggtccctgagactctcctgtgtacgcctctggattcacctttgacaagtgtgccagtgaccgtgggtccgcaggcctccgagggagggctggagtggtctcgagttattaggtggtagtggtagtagcacgagtattacggcagaccgtccgtggaacggtccgttcacgatccaccgagacgacaacttccaagngtcaaccgtcttagttattggacacgtagtacgaaccagtccgtaggagaccggacggacggacctaccggtactaagttaattagtttagtttggcgtaaccgttaaacttttccgtttagaccgtttaggtttacttaccgtccgtagtacgacccgngtacgggaaccaaccggtaaccgtcgtaccgtacgtccgacgtcgaccggtccctaacccgaccgaaccgggtcctaaccggttcccggttccctccccgtcgaccctacccgtcctaaccgaacgcgtaccgtacgtcggtcgggaccacggtacggcccgtccggtcgcgttcggccgtacggtacgaaccgtccgttacgtccggaacttacggccgtaacgtacgtcgggacggccggtccgtacggaccggtacncggtaacgtcgntaccncgacgtnangngng

SEQ ID NO: 82544 - DNA, 657 bp, Homo sapiens
  misc_feature: GYAE6OF01BH0A1.36.78.H01.1.454.CMB.1.raw
  modified_base (321)..(321): a, c, t, g, unknown or other
  misc_feature (321)..(321): n is a, c, g, or t
  modified_base (356)..(356): a, c, t, g, unknown or other
  misc_feature (356)..(356): n is a, c, g, or t
  modified_base (448)..(448): a, c, t, g, unknown or other
  misc_feature (448)..(448): n is a, c, g, or t
  modified_base (655)..(656): a, c, t, g, unknown or other
  misc_feature (655)..(656): n is a, c, g, or t
tcagtacgctgtctcacgaccggtgctcgatttagtgtgagtagtttgggtttgggggggtccctgagactctcctgtgtagcctctggattcacctttaacaactactggatgtcctgggtccgccaggctccgagggaaggggctgggaatgggtgccaaacatgaagccagatggaagtcagacatactatgtggactctgtggaacgggccattcaaccatctccagagacagcgacctaatccactcactgtatctagacaaaatgaacagcctagagagccgaaagacgacggcttagtttactatgtgacgagngaggctagtttggagtgtatcgtccttgactacgngggtccaaggtacccgtggtcctacgtcctcctcgtcgccttacccgaaccgacggtccctaccgttcccgttcccttccccgtacggcccnccccgtcgcccgtccgacggaccgacccgtaccgtccggacgacgtcccgacgtacccgcccgcccggtacggccgtccggtacccgtcggtaaccggtaaccggtaccgttacccgttaccgaacgtaccgtacggacccggttagaccgggtacgggcccgggttccggtagggaaccggtaacgggcccggtaacgagtacggnng

SEQ ID NO: 82545 - DNA, 325 bp, Homo sapiens
  misc_feature: GYAE6OF01BBJG7.36.78.H01.1.454.CMB.1.raw
  modified_base (288)..(325): a, c, t, g, unknown or other
  misc_feature (288)..(325): n is a, c, g, or t
tcagtacgctgtctcacgaccggtgctcgatttagtgtgagtagtttgggtttgggacagagttcactctcacaatcaccagcctgcaggctgaagatgtggctatttttattactgtcagcagttatttgactagtcccgtgtacactatttggccgaggggaccaagctggagctacaaacgactgtggctgcaccatctgtcttcacgttccttcccgccatctagtaacgacagtccgttaactggacggccggggtcgtggaccaagggccgactaagtaggnnnnnnnnnnnnnnnnnnnnnnnnnnnnnnnnnnnnnn

SEQ ID NO: 82546 - DNA, 706 bp, Homo sapiens
  misc_feature: GYAE6OF01APJWT.36.78.H01.1.454.CMB.1.raw
  modified_base (220)..(220): a, c, t, g, unknown or other
  misc_feature (220)..(220): n is a, c, g, or t
  modified_base (244)..(244): a, c, t, g, unknown or other
  misc_feature (244)..(244): n is a, c, g, or t
  modified_base (604)..(604): a, c, t, g, unknown or other
  misc_feature (604)..(604): n is a, c, g, or t
tcagtacgctgtctcacgaccggtgctcgatttagtgtgagtagtttgggtttgggggcagggtgtacacctgtggctctcagagaggagccttagccctggactccaaggcctttccacttggtgatcagcactgaacacagaggactcaccatggaagttggggctgaccttgggtttttccttgttgcttattttagaaggtgtccagtctcaggtncagcgtggtggagtcggtgggggngtcgttgggtccgagggcccggggggtcctggacgctctcctgtgtcgctcgtggtacttacctaactttaacaacttacgtggtacttcggtccgtcgggtcccgccgaggccgtaccggaaggggaagggtcgtagggaggtggggtacggacccaatacgtaggaacgccgaaggacggtaaggaacgtacgaacgtaactaacttaacgttaggtgttacggtaccgttccgttgggtaacgggaacggggtccctacgtttacccgaacgtaacctccgtaccgaaagggaacaccggacgaccgaccaacgttacccaccttacgtacgttacgttactcgtacgtaactaaanacgaccgacgaccgtaggaccggaccgaaccggaacggtaccgcggttacgtgttttaacgtacgtggtacggaggaagggtacggtgggttccgtttaggg

SEQ ID NO: 82547 - DNA, 844 bp, Homo sapiens
  misc_feature: GYAE6OF01B02GD.36.78.H01.1.454.CMB.1.raw
tcagtacgctgtctcacgaccggtgctcgatttagtgtgagtagtttgggtttgggggcagggtgtacacctgtggctctcagagaggagccttagccctggacctccaaggccctttccacttggtgatcagcactgaacacagaggactcacatggaagttggggctcggtaccgtttgggtttttcctttggtttgtactttaagtttttaaggaagggttcgtcccgtaagttccgttcgaagggtgccgtagtcgttgggtacgggtaggtcgggtaggggggtggtggtttccggtaccggcggggcccggggggttccaggtagtacctcgttccgtgttcgcgtccttcgtaggttacttacctaaacctttaaacaccgtttacgaggttcgttccgggttaccggtccgggttccccggaccgtacgggtacccgtaccggggaagggggaaccgggtcgggtaacgggtaagggttcggggacccggtaacgaaaacggttacgaacgggaaacgaccgttaaagggaaccggttaagggaacccgttaaggaaaactaacgtactttaaaacgttggttaaccggtaggttaacccgtgtacgggttaacgggttaaccgggaaccgtaacgtttcccaaccgtaccgttcgaaccgaacggtaacgacgaccgaccgtaccaacgtcctacgtactaacgttcgtactaccgtagaacgaagttaacgaacgtacgtacgtacggtaagaccgtaaccggacgtacgtagttcggtttagtacgtttacgacggttacggaggtagggtaagtacgggttaggtttacggg

SEQ ID NO: 82548 - DNA, 710 bp, Homo sapiens
  misc_feature: GYAE6OF01A87D7.36.78.H01.1.454.CMB.1.raw
  modified_base (420)..(420): a, c, t, g, unknown or other
  misc_feature (420)..(420): n is a, c, g, or t
tcagtacgctgtctcacgaccggtgctcgatttagtgtgagtagtttgggtttgggggcagggtgtacacctgtggctctcagagaggagccttagccctggactccaaggcctttccacttggtgatcagcactgaacacagaggactcaccagtggaagttggggctgaccttgggttttccttgttgtcttattttagaaggtgtccagtctcaggtgcagcgtgggtggaggtcggtggggggaggtcgttgggtccgacgggcccggggggtcctgagcctctctgtcgtcgtcctgtggtacttcctaaccttttaaacaacttacgtggtacttcggtccggtcgggtcccgcgacgggtccgtaccgggaagggggaacgggtcgtagggaacggttggggtacgaaccaanagtacggaaacgaccgaagagtaggaacgtcgaaagacctaattaacgtagttggtacgtacgttcgtaggttacggaacggggtacctatttacccaacccgtatacctaccgaaggacgaaccgtacggaccctaaccgaactcaacctactacgtagtactcgtacgtaacaaagtacgaactacgaccgtagaacgaccggaacgaaacggacggtacggttacgttaacttttacggttaacgttggtacggacggtagtaccgggtaagttcggtttaaacggg

SEQ ID NO: 82549 - DNA, 842 bp, Homo sapiens
  misc_feature: GYAE6OF01AYHQ1.36.78.H01.1.454.CMB.1.raw
tcagtacgctgtctcacgaccggtgctcgatttagtgtgagtagtttggggtttgggggcgagggtgtacacctgtggctctcagagaggagccttacgccctggacctccgaacggtccctttccactttggtgatcagcactgaacacagaggactcaccatggaattggggctgtaccgttgggttttccttgttgtcttattttaggaaggtgtccagtcctcgaggtcgcacgcgtgggtggtaggtcggtaggggggtacggtccgttcgggcccgacggggtcccgggggggtaccctggacgtacttccgtcctaggtcgtacgccttcgtggtacttacctaacctttaaacaccttacgtaggtacgttccggtacccgtcggggtcccaccggtacggtccgtaccggggaggggaacgggtccgtagggaggttcggggtaccgaccgtaacgtagtacggaacgacgtaaggtacggtagggtaacgtcgaaacgtaacctaacgttaacttacggttgggtaccggtaacttcggtacgggtacggtaaccggggtccttaacgttaacccaacgttacgtaccctacggaacgtacggacctaaccggaccgtaacccgtaactaccgtacctaccgtaacgttacgtacgttaccctaacgggaactttaaacgaccgtaaacggtccgttaaccgaggaaaccggacccgggtaaacccgggaactaccgggttaaccgtttaccggtttacggtttaaaccgttaggtttaccggtacgggtaagggtaaaccggtacggggtaccggttccgtttaaccgggg

SEQ ID NO: 82550 - DNA, 732 bp, Homo sapiens
  misc_feature: GYAE6OF01DR398.36.78.H01.1.454.CMB.1.raw
  modified_base (199)..(199): a, c, t, g, unknown or other
  misc_feature (199)..(199): n is a, c, g, or t
  modified_base (449)..(449): a, c, t, g, unknown or other
  misc_feature (449)..(449): n is a, c, g, or t
  modified_base (541)..(541): a, c, t, g, unknown or other
  misc_feature (541)..(541): n is a, c, g, or t
  modified_base (556)..(556): a, c, t, g, unknown or other
  misc_feature (556)..(556): n is a, c, g, or t
  modified_base (581)..(581): a, c, t, g, unknown or other
  misc_feature (581)..(581): n is a, c, g, or t
  modified_base (626)..(626): a, c, t, g, unknown or other
  misc_feature (626)..(626): n is a, c, g, or t
tcagtacgctgtctcacgaccggtgctcgatttagtgtgagtagtttgggtttgggggaggtctcagagaggagccttagccctggactccaaggcctttccacttggtgatcagcactgaacacagaggactcaccatggaattgggctgtacgttgggttttcctgttgcttatttagagtgtccagtctcgaggtncagcgtgggtggaggtcggtggggggacgtcgttcgggtaccgcggggtcccggggggtcctggacgtaccttccgtccgtgtacggtactccgttacgtggtacttacctaacccgtttaaacaacttacgtaggtactcggttcccgtcgggtcccgccgtacggtccgtacggaagggggaacgggtcgtagggtacggtgggtacgacctaatagtacggaactacgaggacgtaggaactcgaanactaatactaggtgtacggattcggtagtaggtaacggcgttactcccaacgcttaccgaactaggaacgaccgtacgtaaccgacctaacncgtaccaccttagtntacttacgagtaactaagtcgtaancggcctaaggacccgtaaaggaccgtaacgtacggtaaccgtttnttacggttaaacttcggtaaggttcgaacgggaaggtaccgggttacggtacggttttacggttaggttaacggtttggttaccttcggggttaccctttaacggg

SEQ ID NO: 82551 - DNA, 695 bp, Homo sapiens
  misc_feature: GYAE6OF01AY4IW.36.78.H01.1.454.CMB.1.raw
  modified_base (139)..(139): a, c, t, g, unknown or other
  misc_feature (139)..(139): n is a, c, g, or t
  modified_base (504)..(504): a, c, t, g, unknown or other
  misc_feature (504)..(504): n is a, c, g, or t
  modified_base (559)..(559): a, c, t, g, unknown or other
  misc_feature (559)..(559): n is a, c, g, or t
  modified_base (566)..(566): a, c, t, g, unknown or other
  misc_feature (566)..(566): n is a, c, g, or t
  modified_base (584)..(584): a, c, t, g, unknown or other
  misc_feature (584)..(584): n is a, c, g, or t
  modified_base (614)..(614): a, c, t, g, unknown or other
  misc_feature (614)..(614): n is a, c, g, or t
  modified_base (620)..(620): a, c, t, g, unknown or other
  misc_feature (620)..(620): n is a, c, g, or t
tcagtacgctgtctcacgaccggtgctcgatttagtgtgagtagtttgggtttgggggcagggtgtacacctgtggctctcagagaggagccttagccctggactccaaggcctttccacttggtgatcagcactgacncagagactcaccatggagttgggactgaccgttgggttttcctgtgtacttagtttagaaggtgtaccagtctcgaggttgcgtagtcgtgggtaggaggttccggtggggggtacgtcgtttcgggtacccgaacgggggtccccgggggggttccctaggacgtaccttccgtcgttggtacggtcgtccgtagtcggtaacctttacctaacccttttaaacaaccttacggtaggtacgttcggttcccggtcgggtcccgacccgtaggtccgttacccggggaaggggtaacgggccgttagggaacgttcggggtacgaacccaacgtagtacgacggaccgtagaggtaaggacgtnaaggtcaagtatagtggtcgtatcggtagtcggaacgggtcctaatcctactctntaccgancgtacgacggcaacctanccaactcattgtaactcagtacaacggtanaacgtncgtagacgaaacgccgaagccgtagttattacgttctaggtcgtagggtaacgaggtacggtgtccgtttaaggg

SEQ ID NO: 82552 - DNA, 845 bp, Homo sapiens
  misc_feature: GYAE6OF01BAIW1.36.78.H01.1.454.CMB.1.raw
tcagtacgctgtctcacgaccggtgctcgatttagtgtgagtagtttgggtttgggggcagggtgtacacctgtggctctcagagaggagccttagccctggactccaaggtcctttccacttggtgatcagcacgtgaacacaggagactcaccagtggaagttggggctgtaccgttgggtttttccttgttgtcttagttttaggaaggtcgtaccgagttcctcgaggtcgcgaggtcgttggggtagggtaggttccgggtggggggacggttccgttcgggtacccggacgggggtccccggggggggtccctaggacgtaccgttccgtccgttggtacgtcgtccctcgtacggtacttacctaaccctttaaacaaccgttagtggtactccggttcccggtcgggtcccgaccgacgggtcccgtaccgggagggggtaacggggtccgttagggtaacgggtcggggtaccggaaccctaaacgtacgtacgaaccggccgaaaggtaacgtaacgggtacgtacgaactaacgtaacgtacgtagttaggtcgtacttcggtaggtaaccgggtacgggtaccttaacttacccgaacctacgttcccaaacgtacggaacgtaccgacgtacccgtaacctaacctaccgtaaccttcccgtaagttacgttaacctccgtaaaccgtaaataaccggttaaccgaaccgtacggtccctaaggggaaccgtacccgggaaccgaaccgtaaccggtacgtttacgtttagtttacgtaccgttgggtaccggaaggtaaccggacgggttccggttaggtttttaacgggg

SEQ ID NO: 82553 - DNA, 258 bp, Homo sapiens
  misc_feature: GYAE6OF02GWG3U.36.78.H01.1.454.CMB.1.raw
  modified_base (255)..(258): a, c, t, g, unknown or other
  misc_feature (255)..(258): n is a, c, g, or t
tcagtacgctgtctcacgaccggtgctcgatttagtgtgagtagtttgggtttgggacagagttcactctcacaatcaccagcctgcaggctgaagatgtggcatttattactgtcagcagtatttgactagtcccgtgtacacatttggccaggggaccaagctggagctcaaacgaactgtggctgcaccatctgtcttcatcttcccgccatctgaagacagcgtactgagcgggctggcaaggcgcatagnnnn

SEQ ID NO: 82554 - DNA, 262 bp, Homo sapiens
  misc_feature: GYAE6OF02F68IL.36.78.H01.1.454.CMB.1.raw
  modified_base (257)..(262): a, c, t, g, unknown or other
  misc_feature (257)..(262): n is a, c, g, or t
tcagtacgctgtctcacgaccggtgctcgatttagtgtgagtagtttgggtttgggacgagagttcactctcacaatcaccagcctgcaggctgaagatgtggcattttattactgtcagcagtatttgactagtcccgtgtacacatttggccaggggaccaagctggagatccaacgaactgtggctgcaccatctgtcttcatcttcccgccatctgaagacagcgtactgagcgggctggcaaggcgcatagnnnnnn

SEQ ID NO: 82555 - DNA, 258 bp, Homo sapiens
  misc_feature: GYAE6OF02H68B6.36.78.H01.1.454.CMB.1.raw
  modified_base (256)..(258): a, c, t, g, unknown or other
  misc_feature (256)..(258): n is a, c, g, or t
tcagtacgctgtctcacgaccggtgctcgatttagtgtgagtagtttgggtttgggacagagttcactctcacaatcaccagcctgcaggctgaagatgtggcattttattactgtcagcagtatttgactagtcccgtgtacacatttggccaggggaccaagctggagctcaaacgaactgtggctgcaccatctgtcttcatcttcccgacatctgaagacagcgtactgagcgggctggcaaggcgcatagnnn

SEQ ID NO: 82556 - DNA, 616 bp, Homo sapiens
  misc_feature: GYAE6OF02GX8IK.36.78.H01.1.454.CMB.1.raw
  modified_base (613)..(613): a, c, t, g, unknown or other
  misc_feature (613)..(613): n is a, c, g, or t
tcagtacgctgtctcacgaccggtgctcgatttagtgtgagtagtttgggtttgggggggtccctgagactctcctgtgtagcctctggattcacctttaacaactactggatgtcctgggtccgccaggctccagggaaggggctggaatgggtggccaacatgaagccagatggaagtcagacatactatgtggactctgtgaagggccgattcaccatctccagagacagcgccaatcactcactgtatctgcaaatgaacagcctgagagccgaagacacggctgtttattactgtgcgagagagggcacttttggagtggttatgtccctttgactactggggccagggaacctggtctccgtctcctctgcttccaccaacgggcccatccgtcttccccctggccgccctgctccacggacgcacctcgtcggggccacgacggccgggcccgtcggggccttcggcccgttcgggtaccgtaacgggtaaccttacccgtttacccgaacggtaacccgacgggtaccggtaaccgttcgggaacggtcccgggggaccgttcggggaccggtaaacggggccggtaccgtaaggttacggacgngcg

SEQ ID NO: 82557 - DNA, 258 bp, Homo sapiens
  misc_feature: GYAE6OF02F851E.36.78.H01.1.454.CMB.1.raw
  modified_base (256)..(258): a, c, t, g, unknown or other
  misc_feature (256)..(258): n is a, c, g, or t
tcagtacgctgtctcacgaccggtgctcgatttagtgtgagtagtttgggtttgggacagagttcactctcacaatcaccagcctgcaggctgaagatgtggcattttattactgtcagcagtatttgactagtcccgtgtacacatttggccaggggaccaagctggagctcaaacgaactgtggctgcaccatctgtcttcatcttcccgccatctgaagacagcgtactgagcgggctggcaaggcgcatagnnn

SEQ ID NO: 82558 - DNA, 273 bp, Homo sapiens
  misc_feature: GYAE6OF02IHPH5.36.78.H01.1.454.CMB.1.raw
  modified_base (253)..(253): a, c, t, g, unknown or other
  misc_feature (253)..(253): n is a, c, g, or t
  modified_base (259)..(273): a, c, t, g, unknown or other
  misc_feature (259)..(273): n is a, c, g, or t
tcagtacgctgtctcacgaccggtgctcgatttagtgtgagtagtttgggtttgggtacgagagttcactctcacaatcaccagcctgcaggctgaagatgtggcattttattactgtcagcagtatttgacttagtcccgtgtacacatttggccaggggaccaagctggagctcaaacgaattgtggctgcaccagtctgtcttcatctcccgcatctgaagacagcgtactgagcgggctggacaaggcncatagnnnnnnnnnnnnnnn

SEQ ID NO: 82559 - DNA, 553 bp, Homo sapiens
  misc_feature: GYAE6OF02GADID.36.78.H01.1.454.CMB.1.raw
  modified_base (407)..(407): a, c, t, g, unknown or other
  misc_feature (407)..(407): n is a, c, g, or t
tcagtacgctgtctcacgaccggtgctcgatttagtgtgagtagtttgggtttggggaggtctcagagaggagccttagccctggactccaaggcctttccacttggtgatcagcactgaacacagaggactcaccatggaattggggctgacctgggttttccttgttgctattttagaaggtgtccagtctcaggtgcagctggtggagtctgggggaggcttggtccaggccgggggggtccctgagactctcctgtgtagcctctggattcacctttaacaactactggatgtcctgggtccgccaggctccgaggggaaggggctgggaagtggggtggccaacatgaagccagatggaatcagacatactatgtggactcgtgtgaagggccgattcaccntctccagagacagcgaccaatcactcactgtactctgacaaatgaacagcctagagacgccgaaagaccacggcttagtttattactggtcgacggaggaggagggctacgttttgggagttagggtttatcggtaccctttacgg

SEQ ID NO: 82560 - DNA, 260 bp, Homo sapiens
  misc_feature: GYAE6OF02GEV7K.36.78.H01.1.454.CMB.1.raw
  modified_base (256)..(260): a, c, t, g, unknown or other
  misc_feature (256)..(260): n is a, c, g, or t
tcagtacgctgtctcacgaccggtgctcgatttagtgtgagtagtttgggtttgggacagagttcactctcacaatcaccagcctgcaggctgaagatgtggcattttattactgtcagcagtatttgactagtcccgtgtacacatttggccaggggaccaagctggagctcaaacgaactgtggctgcaccatctgtcttcatcttcccgccatctgaagacagcgtactgagcgggctggcaaggcgcatagnnnnn

SEQ ID NO: 82561 - DNA, 635 bp, Homo sapiens
  misc_feature: GYAE6OF02IIX9M.36.78.H01.1.454.CMB.1.raw
  modified_base (371)..(371): a, c, t, g, unknown or other
  misc_feature (371)..(371): n is a, c, g, or t
tcagtacgctgtctcacgaccggtgctcgatttagtgtgagtagtttgggtttgggggcagggtgtacacctgtggctctcagagaggagccttagccctggactccaaggcctttccacttggtgatcagcactgaacacagaggactcaccatggaattggggctgacctgggttttccttgttgctattttagaggtgtccagtctcaggtgcagctggtggagtcgtggggggaggcgttgggtccagggccgggggggtccctggacgactctcctgtgtagcctcgtggattcacctttaacaactactggatgtccgtgggtccgccaggctccgagggagggctaggagtgggtgaccaacgntgaagccagagtggaagtcgagacatactatggtaggacttcgtaggtaggaacggggcctaacgttacccaacctacttcccgtaccgaaggtacgaaccgacggaccgaccctaaactcccaacctccgtaacttagttactcgtacgaactaaattacgaacacgccctaggaacgacgaccggaagacccgtacggtactttaggttttaacttaccggttggtacggacggaaggtacgggacgggttactttaacggg

SEQ ID NO: 82562 - DNA, 653 bp, Homo sapiens
  misc_feature: GYAE6OF02F8NRD.36.78.H01.1.454.CMB.1.raw
  modified_base (314)..(314): a, c, t, g, unknown or other
  misc_feature (314)..(314): n is a, c, g, or t
  modified_base (360)..(360): a, c, t, g, unknown or other
  misc_feature (360)..(360): n is a, c, g, or t
tcagtacgctgtctcacgaccggtgctcgatttagtgtgagtagtttgggtttggggggtcagggtcgtacacctggtgggctctcacgagaggaggcccttagcccctgggactccaaggcctttccacgttggtggactcagcgactggaacctacgagacggactccaccaactggaattggggctgacctgggttttccttgttcgctattttagaaggtgttcctagtcgtcagggtcgcagctggtggaggtctgggggagctggtccgagccggggggtcctgagactctccgtgtcgtagtccctntcgggtattcacctttaacaacttactgggatcgtcctgggttccnccagggctccagggaaggggctaggaatgggttcggccaaacatgaagccagagtcgggaagtcagaacagttactatgtggctctgtagacggggcctattcacctagttcctaccgagtacgtacacgccgtaccaatccgacgtccaccgttcgtacgtcctaggaactaaacgttgaaacctaggcccttaggacgaccgtacccggaacggaaccggaccggtacttacggttttacctttacccgtgtccggtaccggtacggacggtaacgggtcctttaaccggg

SEQ ID NO: 82563 - DNA, 585 bp, Homo sapiens
  misc_feature: GYAE6OF02I8DFC.36.78.H01.1.454.CMB.1.raw
  modified_base (583)..(583): a, c, t, g, unknown or other
  misc_feature (583)..(583): n is a, c, g, or t
tcagtacgctgtctcacgaccggtgctcgatttagtgtgagtagtttgggtttgggggggtccctgagactctcctgtgtagcctctggattcacctttaacaactactggatgtcctgggtccgccaggctccagggaaggggctggaatgggtggccaacatgaagccagatggaagtcagacatactatgtggactctgtgaagggccgattcaccatctccagagacagcgccaatcactcactgtatctgcaaatgaacagcctgagagcccgaagacacggctgtttattactgtgcgagagagggctacgttttggagtggttatgtccctttgactacgtggggccagggaccctggtctccgtctcctctcgcttccaccgaagggccccactcccgtccttccccctcggccgccctgcctcccgaggacgccaccgtccgacgacgccaccgacgcccgcccgtcgggcctcgccgtcggtaccgaaacggtacccttaccttcccacggacctaggtcccgttaacgtggaacggccgggtacgtcgggacgtaacgggccgacacgtagncg

SEQ ID NO: 82564 - DNA, 561 bp, Homo sapiens
  misc_feature: GYAE6OF02IAYL6.36.78.H01.1.454.CMB.1.raw
  modified_base (356)..(356): a, c, t, g, unknown or other
  misc_feature (356)..(356): n is a, c, g, or t
  modified_base (525)..(525): a, c, t, g, unknown or other
  misc_feature (525)..(525): n is a, c, g, or t
tcagtacgctgtctcacgaccggtgctcgatttagtgtgagtagtttgggtttgggggcagggtgtacacctgtggctctcagagaggagccttagccctggactccaaggcctttccacttggtgatcagcactgaacacagaggactcaccatggaattggggctgacctgggttttccttgttgctattttagaaggtgtccagtctcaggtgcagctggtggagtctgggggagcttgggtccaggccgggggggtccctggagactctcctgtgtagcctctggattcacctttaacactactggatgtcctgggtccgccaggctccagggagggctggatgggtgcaanatgaagccagatggaagtcagcaatactatgtgactcgtgtgaagggccaattccgacctatctaccagagaccagccgactaatcactcacttgtactctagacaaagtcgaaacagccctagacgacgacccgaagaaccgtaacggtcttaagttttaacgttcgnggttagaccggtaagacggtacggggctttaacggg

SEQ ID NO: 82565 - DNA, 672 bp, Homo sapiens
  misc_feature: GYAE6OF02IA1QL.36.78.H01.1.454.CMB.1.raw
tcagtacgctgtctcacgaccggtgctcgatttagtgtgagtagtttgggtttggggaggtctcagagaggagccttagccctggactccaaggcctttccacttggtgatcagcactgaacacagaggactcaccatggaattggggctgagctgggttttccttgttgctattttggaaggtgtccagtgtgaggtgcaattggtggagtcgtgggggaggcctcgtccagccgtggggggtccatgagactctcctgtgtagcctctgaattcccctttaggcttattggatgagcgtgggtcccgccgaggcctccgaggggaaggggctgggagtggggtggccaaacgataaagcaagagtaggaaggtagggagggagtagtgtaggaatcgtggtagaacgggtccgtttcactatcctcaaggagaccaaacgcccaaagtaacctccgtgctaatccgttagaaccaaattcggaaactgtccgtagacgtacggcccgaggaccgaccggtacttagttttaatacgtcgacggtaccggtaaggaacggaaacgggtaccggttgggggtaccccgggtttttaacgaacccgtttacggggttccgggggaaccccgttaacggggggtaaacccccttcggggtacccctaacccggg

SEQ ID NO: 82566 - DNA, 594 bp, Homo sapiens
  misc_feature: GYAE6OF02FX2JD.36.78.H01.1.454.CMB.1.raw
tcagtacgctgtctcacgaccggtgctcgatttagtgtgagtagtttgggtttgggggcagggtgtacacctgtggctctcagagaggagccttagccctggactccaaggcctttccacttggtgatcagcactgaacacagaggactcaccatggaattggggctgacctgggttttccttgttgctattttagaaggtgtccagtctcaggtgcagctggtggagtcgtgggggaggcttggtccaggccgggggggtccctggagactctcctgtgtagcctcgtggtattcacctttaacaacttactggatgtccgtgggtcccgccaggctccgaggggacggggcgtagggaagtgggtcggaccaagatggaagccaagagtagggaagtcaagactataactatggtacgactcgtggtacgaacggggccgtaattccaacctatcctaccgaagacgacacgccgaccaatccactacactgtactctagactaaatcgaaactcgacgtagagacgaccgaagacgacggtcttagtttacttacgtggttcgacggtaaggacggtacgggtcttacggg

SEQ ID NO: 82567 - DNA, 558 bp, Homo sapiens
  misc_feature: GYAE6OF02FTOJ9.36.78.H01.1.454.CMB.1.raw
  modified_base (334)..(334): a, c, t, g, unknown or other
  misc_feature (334)..(334): n is a, c, g, or t
  modified_base (368)..(368): a, c, t, g, unknown or other
  misc_feature (368)..(368): n is a, c, g, or t
  modified_base (398)..(398): a, c, t, g, unknown or other
  misc_feature (398)..(398): n is a, c, g, or t
  modified_base (455)..(455): a, c, t, g, unknown or other
  misc_feature (455)..(455): n is a, c, g, or t
tcagtacgctgtctcacgaccggtgctcgatttagtgtgagtagtttgggtttgggggcgagggtgtacacctgtggctctcagagaggagccttagcccctggactccaaggcctttccacttggtgatcagcactgaacacagaggactcaccatggaattggggctgacctgggttttccttgttgctattttagaaggtgtccagtctcaggtgcagctggtggagtcgtggggggagcgttggtccgaggccgggggggtccctggagtactctcctgtgtagcctcgtggacttcaacctttaacaacttactggatgtcctggtccnccaggctcgagggaggggctggatgggtgcaagntgaagcagataggaagtcaagacatactangtgactcgtgtaggaagggcctattcacctatcctacagacgacacgccgacctaanaccactacacttgtactcgtagacaaatgaaacagtacctagacgacgacggaacgacacggtcttagtttatacgtgtcgacggagacggacggtcttacgg

SEQ ID NO: 82568 - DNA, 592 bp, Homo sapiens
  misc_feature: GYAE6OF02HRPB4.36.78.H01.1.454.CMB.1.raw
  modified_base (590)..(590): a, c, t, g, unknown or other
  misc_feature (590)..(590): n is a, c, g, or t
tcagtacgctgtctcacgaccggtgctcgatttagtgtgagtagtttgggtttgggggggtccctgagactctcctgtgtagcctctggattcacctttaacaactactggatgtcctgggtccgccaggctccagggaaggggctggaatgggtgccaacatgaagccagatggaagtcagacatactatgtggactctgtgaagggccgattcaccatctccagagacagcgccaatccactcactgtatctagcaaatgaaacagcctgagacgaccgaagacacggtcttgtttatacgtgtgcgagagaggctacgttttggagttggttatcgtccttgactacggtcggggaccacgggacctggtcctccgtctctctcgtctcccgacgacggccctcgtcccgttcccttccccgcggcccgtcccgtcgccgtccgacggcgccaccgtccgacgacgcacgccgcccgtccgtcggcctcgtccgtcgtacgaacggtaccttaccgttaccgacgactacggtaccgtacgtacggacgggccgggtcgtagggaccgaacgggcgacgtaacgtgncg

SEQ ID NO: 82569 - DNA, 743 bp, Homo sapiens
  misc_feature: GYAE6OF02HASDO.36.78.H01.1.454.CMB.1.raw
  modified_base (741)..(741): a, c, t, g, unknown or other
  misc_feature (741)..(741): n is a, c, g, or t
tcagtacgctgtctcacgaccggtgctcgatttagtgtgagtagtttggggtttgggggggtccctgagactctcctgtgtagcctctggattcacctttaacaactactggatgtcctgggtccgccaggctccgagggaaggggctggaagtgggtggccaacatgaagccagataggaagtcagacatactatgtggactctgtggaagggccgattcaccatctccagagacagcgaccaatcactcactgtatctgacaaagtagaacaacgccgtagaagacggaccgaagaccgacggtattagtttattactggtgacggaggagagggcttacggttttaggaggttaggttacgtcggttccgtttacggtaaccgttacggtaccggggtacccggacgggtaacccgttggttacccgtcccgttcctcccgttcttcgtacccttcccgaaccggtaaccggtacccgtaccgttccccggtttcccctttcccccggtcggtccccgtccccgttcggtacccggtaccggtaaccggtaccgacccgtaccccggttaccggaacggaccgaacccgtacgtaccccggacccggccccgggttcgggtcccgtccggttacccgttacgggtaaccgttaacggtaacccttaccgtaccgaacgacgtaccgtaccggtaacgtcggagggccgggtagtacgggacgacggactacgacgtanga

SEQ ID NO: 82570 - DNA, 796 bp, Homo sapiens
  misc_feature: GYAE6OF02JQHCA.36.78.H01.1.454.CMB.1.raw
tcagtacgctgtctcacgaccggtgctcgatttagtgtgagtagtttgggtttggggaggtcgtcagagaggagccttagccctggactccaaggcctttccacttggtgatcagcactgaacacagaggactcaccatggaattgggctgacctgggtttcctgttgctatttagaggtgtccagtctcaggtgcagctggtggagtcgtgggggagtcgttggtccgagggcccggggggtccctggacgacctctccgtgtgtacgtcctcgtggtacttccaacctttaacaacttacgtaggattcgtccgtgggtcccaccgacggctaccggagggtaagggcgtaggaagtgggtcggaccaacgagtacgaacgccaagtagtagggtaacgacgtaacgactataactaagtcgtaggtaccttcgttggtacggaaacgggtcccgtaacttaccgaacccgtactacccgtaccgaaacggaacgaaccgtaacggccaacccgtaaactcctaacgtaccaacgttacgttaactcgtacgaactaaacgtacgaaaccgtacgtacccgtaaggaaccggaaccggtaaccgaaacggtaaccggtacccggggtttaacgtttaaccgttttaacggtttacgttaagggggcccggttaaacgggtaaccgggtaagggttaaccgggggtttaacctttaacccggggttttttaagggggacggttttacggggttttaaccggtttacccgggtttacccccgttttaaaccggggg

SEQ ID NO: 82571 - DNA, 753 bp, Homo sapiens
  misc_feature: GYAE6OF02IBHB7.36.78.H01.1.454.CMB.1.raw
  modified_base (258)..(258): a, c, t, g, unknown or other
  misc_feature (258)..(258): n is a, c, g, or t
  modified_base (496)..(496): a, c, t, g, unknown or other
  misc_feature (496)..(496): n is a, c, g, or t
  modified_base (752)..(752): a, c, t, g, unknown or other
  misc_feature (752)..(752): n is a, c, g, or t
tcagtacgctgtctcacgaccggtgctcgatttagtgtgagtagtttgggtttgggggggtccctgagactctcctgtgtagcctctggattcacctttaacaactactggatgtcctgggtccgccaggctccgagggaaggggctggaatggggtgccaacatgaagccagatggaagtcagacatactatgtggactctgtgaagggccattcaccatcctccagagacagcgacctaatcactcactgtactcngacaaatgaactacgcctagagacggaccgaacgtaccgacggtcgttgttttaattacgtgtggacgaaggcggaggtctacgttttggaggttaggtttatcggttccgttacgtacgtacggtcggggacccgtaacggacccgtcgttcgtccgtacgttcctcgtctcccgttacccgaccgtaacgggtcccctaccgtttcccgtccccgtttcccccgtcggggtccccncccgttccggtcccgtaacccggaggacccgttcccgaacccggttccggaaacgcccggaactacccggaccggtccccggtacccggttcgggacccgttaccggtcccggttaaccgggttaaccgaacccgggtttaaccttacccgggttacccacggtaccgtaccggttaacccggtacggttaccggggtaccggtcccggggtaccggttacgggacccggaacggtcccgacggtaacggtgccgng

SEQ ID NO: 82572 - DNA, 809 bp, Homo sapiens
  misc_feature: GYAE6OF02HJG57.36.78.H01.1.454.CMB.1.raw
tcagtacgctgtctcacgaccggtgctcgatttagtgtgagtagtttgggttggggcaggtgtacacctgtggctctcagagaggagccgttagccctggacctccgaaggcctttccacttggtgatcagcactgaacacagaggactcaccatggaattgggctgtacgttggttttccttggttgacttagttttagaaggttctaccgtagtcctacgtaggtcgctacgtcgttggtaggtacggtcggtagggggacggtcgttacgggtcccgacggggtcccggggggttccctaggacgtaccttcgtccgtgtcgtacgtccgtcgtacgtacttaccgttaaccgtttaacgtaaccgttacgtacggtacgttcggttccggtacggtcccgtaccgtacggtccgtacggtaacggggacgggtacggtacggtacggttcgggtaccgaaccgtaacgtacgtacggtacgaccgaaggtaacggtaacggtaacgtacgaacgtaactaacgttaacgtacgtacggtagtaccgttgtaacggtacggtaaccggtaccgttacgtaacccgtacgtaccgttaccgtaaccgaaggtaccgaacgtaccgtacgtaaccgtaccgtacgacctacgttacgttacgttaccgttacgtaccgttaacgtacgtaacgtaccgtacgtaccgtacgtaacggaccgtaccggtaaccgtacggtacgttacgttaccgttaacgttcggttaccgtacggtaccggttacgggtacggtcggttacgttacgg

SEQ ID NO: 82573 - DNA, 666 bp, Homo sapiens
  misc_feature: GYAE6OF02FPDBN.36.78.H01.1.454.CMB.1.raw
  modified_base (481)..(481): a, c, t, g, unknown or other
  misc_feature (481)..(481): n is a, c, g, or t
tcagtacgctgtctcacgaccggtgctcgatttagtgtgagtagtttgggtttgggggcagggtgtacacctgtggctctcagagaggagccttagccctggactccaaggcctttccacttggtgatcagcactgaacacagaggactcaccatggaattggggctgacctgggttttccttgttgctattttagaaggtgtccagtctcaggtgcagctgggtggagtcgtggggggagcgttggtccgaggccgggggggtcctggagctctcctgtgtagcctcgtggtattcacctttaacaactactggatcgtccgtcgggtccgccgaggcctccgaaggggaacggggcgtagggtaagtcggggtcggaccaaacgagtaggaaacgccgaaggagtagggaacgtcgaagacaataactagtggtacggactcgtaggtacgggtaaacgggccgtaattcccgaacctnttaccctccgaagacgacgagcccgaccaactccactcacttgtactctagaactaaagtcgaaacgacgaccttagggaacgtacggaaccggaaacggtacccgaaccggttactttaacgggtttttaataaccggttggtacggacggtaaggacgggttacggggtaccttttaacgggg

SEQ ID NO: 82574 - DNA, 786 bp, Homo sapiens
  misc_feature: GYAE6OF02IMFXM.36.78.H01.1.454.CMB.1.raw
  modified_base (591)..(591): a, c, t, g, unknown or other
  misc_feature (591)..(591): n is a, c, g, or t
tcagtacgctgtctcacgaccggtgctcgatttagtgtgagtagtttgggtttgggggcagggtgtacacctgtgctctcagagaggagccttacgccccgtggactccaacggccctttccacgttggtgatcgacgtcaacctgaacacgagtaggacctcaccgaattgggaacttggggaccttggtacccttgggttttctgttgtactagtttagacgtgtcctagtcgtcacggtgcctaggtcgtggtggtcgggtacgtgggggtacggtccgttagggtcccgggaccggtccgggggggtacctcggccgtaccttcgtccgttaggtccgtacggtccgttacgtcggtaaccttttaccgaaacctttaaaccgacggttaccccgtaggttaacccttcgggtccgttttccggacccggccggtaaccggtccgggttaaccgggaggggtacgggggtaccctaaggggtaacggtccgggtacggaacccgtaacgaacgtacgacggacgtagaggtacgagtacagtactagtacgtgcgtagacgtcgacgacggtacggtccaagtaccnccgattaccgacggtaacacggtaccagtaccgttacccaagttctaccgttggaacttcgtacacccgtaagacctaaacggttgaccacggtaaccaggtacccggacgccgttaaacgggtccttacgggttcgtaacttacgaggtacggtacgggacctaggggttacggaaccgttttcggtaaaccgg

SEQ ID NO: 82575 - DNA, 690 bp, Homo sapiens
  misc_feature: GYAE6OF02GHA0U.36.78.H01.1.454.CMB.1.raw
tcagtacgctgtctcacgaccggtgctcgatttagtgtgagtagtttgggtttgggggggtccctgagactctcctgtgtagcctctggattcacctttaacaactactggatgtcctgggtccgccaggctccgagggaaggggctggaatggggtggccaacatgaagccagatggaagtcagacatactatgtggactctgtgaagggccgattcaccatctccagagacagcgccaatcactcactgtatctgacaaatgaacagcctgaagacggacccgaagaccacgggtcttaggttttaattacgtggtgcggaaggaggtagggcttacgttttgggagttggttactcgttcccgttgacctacggtcggggaccacgggtacccttgggtcctccggttcctccgttctcgtccttacccgaaccgaacgggcccctacgttccccgttcccgttcccccgtcggtcccgtccccgtcgtcccgtccgacggacgaccgacccgtccgacgacgaccgaaccgccggcccgtccccggtcgggtccgtccggtcccggttcggtaaccgtaaccggtaccgttaacccgttacccgaacgtaccgacggtacccgttaacggtacggaccgggtccgggtaccggtacggaccggaacgggccgtacgacgtacgctg

SEQ ID NO: 82576 - DNA, 794 bp, Homo sapiens
  misc_feature: GYAE6OF02HXELT.36.78.H01.1.454.CMB.1.raw
  modified_base (155)..(155): a, c, t, g, unknown or other
  misc_feature (155)..(155): n is a, c, g, or t
tcagtacgctgtctcacgaccggtgctcgatttagtgtgagtagtttgggtttggggcagggtgtacacctgtggctctcagagaggagccttagccctggactccaaggcctttccacgttggtcgatcagcactgaacacagaggactcacangaattgggctgaccgtggtttcttgtgcttatttagaggtgtcagtctcgaggtgcgagcgtgggttggacgttcggtggggggagtcgttggtccggacggggcccgggggggttccctggacgtacctctccttggtcggtacgccttcgtcggttacttaccgtaacccttttaaaaccaaccgttaccgtggtactttcgttaccgttcggggtaccccggtccgtacgggcctaccgggtaacgggggtaaacggggccgtaggggtaaaggtgggggtacggacccaaaacgtagtaacggaaaccgacctaaggtagtaggaaaggtactaagggtaacctaagttacttaggtggttacgtaccgttacgttgggtaaccgggaaaccgggtacccttaaggtacccctacggtaactttcccgacccgtagaagtaaccgaacgaccgtaacaacctaccgtacctcgttaacttaggtaacccttgtaaccgtaaacgaaacgttcgaaacccgacgtcccgtaggaccgtaacgggtacccgaaggaacccgtcggttaaccgttttagtttaaccgtttaggtcggttaggaacggtaacgggtcgggtacggttacgttttacggg

SEQ ID NO: 82577 - DNA, 808 bp, Homo sapiens
  misc_feature: GYAE6OF02HMQZX.36.78.H01.1.454.CMB.1.raw
  modified_base (773)..(773): a, c, t, g, unknown or other
  misc_feature (773)..(773): n is a, c, g, or t
tcagtacgctgtctcacgaccggtgctcgatttagtgtgagtagtttgggtttgggggcagggtgtacacctgtggctctcagagaggagccttagccctggactccaaggcctttccacttggtgatcagcactgaacacagaggactcaccatggaagttgggctgaccgttgggttttccttgttgtcttattttagaaggtgtccagtctcgaggtgcagctggtggaggttcggtgggggagtcgtttcggtcccgacggggcccgggggggttccctggacgtaccgttccgttcccgttggttacggttaccgtcccgttcgtaggtacttttacctaaccccttttaaaaccaaaccgttaccgtaggtacgttacggtcccggttcgggttccccgccggtacggtccgtaccgggaagggggtaacggggtcgtagggtaaggttggggtacggaaccaaacgtagtacggaacgtaccgaaggtaagtagggaaacgtcgaagtaacctaagttaacttaggtcggtacggtactcgttaggtaacgggaacgggtcccttaaacgttcccaaccgttacgtacccgttaccgaaggtaccgaaccggtaccgcccgaaacccttaacgtcccaaccgtttcctaacgttcgttaacttccgtaaagtaacctaaacggtacgtaaaccgtaccgtaccgtaaggaacgggaacccgtaaccggaacgtaccggtaccgttacgtttaagtttacgttacgnggtacgaccggtagtaacgggacggttacgttagg

SEQ ID NO: 82578 - DNA, 798 bp, Homo sapiens
  misc_feature: GYAE6OF02JMW3E.36.78.H01.1.454.CMB.1.raw
tcagtacgctgtctcacgaccggtgctcgatttagtgtgagtagtttgggtttgggggcagggtgtacacctgtggctctcagagaggagccttagccctggactccaaggcctttccacttggtgatcagcactgaacacagaggactcaccatggaattgggggctgaccttgggttttccttgttgctattttagaaggtgtccagtctcaggtgcagctgggtggagtcgtgggggaggcgttcggtccgagggcccgggggggtcccgtggacgactcctccgtggtagtacgccttcgtggtacttctaactttggtagtcttagtttggagttgggtacgtcgggggtccccggcccgtaggttccgtaccggaagggggaacggggggtcgtaggggtagggttcgggggtcggggtacccaacgtagtaacgggagggggtacgggttggggttagggtaaacggaaaaaaccgttagttagggtacgggtaccgttcgtagggtcgggtccgggggtacccggtacgttaccaacccgtaacgttaccctacccgaaggtaacggaaaccgaaaccgtaaacccaaaaaccgtacctaaacgtttacgtaaccttcgtacaacgtaaagtcgggaacggtacccgtaggaagtaaccgtaccgggtaacgaaccggaccggtcgtagtttcggttaagtttgttacggtcggtaaggtacggtaacgttaagtttaacgaaacgttacgttaaaagggtttacggtaacggttggtaaccgttaaggg

SEQ ID NO: 82579 - DNA, 757 bp, Homo sapiens
  misc_feature: GYAE6OF02I1VCK.36.78.H01.1.454.CMB.1.raw
  modified_base (90)..(90): a, c, t, g, unknown or other
  misc_feature (90)..(90): n is a, c, g, or t
  modified_base (243)..(243): a, c, t, g, unknown or other
  misc_feature (243)..(243): n is a, c, g, or t
  modified_base (252)..(252): a, c, t, g, unknown or other
  misc_feature (252)..(252): n is a, c, g, or t
  modified_base (283)..(283): a, c, t, g, unknown or other
  misc_feature (283)..(283): n is a, c, g, or t
  modified_base (307)..(307): a, c, t, g, unknown or other
  misc_feature (307)..(307): n is a, c, g, or t
  modified_base (603)..(603): a, c, t, g, unknown or other
  misc_feature (603)..(603): n is a, c, g, or t
tcagtacgctgtctcacgaccggtgctcgatttagtgtgagtagtttgggtttgggggcagggtgtacacctgtggctctcagagaggancttagcctggactccaaggtcctttccacttggtgatcagcactgaacacaggaggactcacagtggaagttgggctcgaccgttgggttttccttagttgacttagttttacgaaggtgttccagtctcgaggtgcagtctgggtgacgtgngggggtacncgtttcggccgacggggcccggggggttccnggacgcttcgtccgtgtggtaccnccgttggtagtactactaccttaacaacgttagcgtattcggtcccggtcgggtacccggctacgggccgttaccgggagggggtaacggcgtaacgggtaggtgggttacccggacaacggacgttacggaacggtccaaacggtagtacgggtaaagttccgaacgtaaccgttagtaagttaagtcgtagggtaacctggtttagacgggtaacggcgttaccgtaccgaccgttactccgtacgtaacggacttacgaaccggacgttaccgtaaacgtccgtaacgtacgnttccggttatacgtcgtaaacttaagtacgtaaacgcggtaacgtaggggacgtaaccggccgtaaaaccggacggttaaccggttacttaacggttttacgttacgttgggacccgtaagggtaccggacggttaacgggttacttaaccggg

SEQ ID NO: 82580 - DNA, 778 bp, Homo sapiens
  misc_feature: GYAE6OF02I09VK.36.78.H01.1.454.CMB.1.raw
  modified_base (619)..(619): a, c, t, g, unknown or other
  misc_feature (619)..(619): n is a, c, g, or t
  modified_base (656)..(656): a, c, t, g, unknown or other
  misc_feature (656)..(656): n is a, c, g, or t
  modified_base (666)..(666): a, c, t, g, unknown or other
  misc_feature (666)..(666): n is a, c, g, or t
tcagtacgctgtctcacgaccggtgctcgatttagtgtgagtagtttgggtttggggcagggtgtacacctgtgctctcagagaggagccttagccctggactccaaggcctttccacttggtgatcagccactgaacacagaggactcaccatggaagttgggctgtaccgttgggttttccttgttgtcttagttttagaaggttgtcctagtcctgaggtcgcagtcgtcgggtggagttcggtgggggacggtcgttcgggtcccgacggggccccggggggtcctcggtacgtccttccgtccgtggtcgtaccgccgttcgtacggtacttacctaacccgtttaaactaaccgtacgtacggtcgttcggttacccggtcggtccgaccgtaggccgtaccgggtacggggacggggtacggtacgggtaaggttcgggtacggtaaccctaagtacggtaacggaccgaacgtagtacggttacggaacggtcgaagaacgtactacgtagtcggtacggacttggtacggtacggaaccgggttcttacgttaaccgacccttacgtcctaaccggaacggtaacaccgtacgaccctaacacgttaccncgttaccctagtacttacgtccgtaagacgttaacgngtaaacccgnggaacccgtagggaaccgacggaaacctccgtaaacgggttcgttaagttacccgtttagaacggtcgtaacgggtaggtacgggtacggtttaccggttagggtttaacgg

SEQ ID NO: 82581 - DNA, 821 bp, Homo sapiens
  misc_feature: GYAE6OF02JVZHZ.36.78.H01.1.454.CMB.1.raw
tcagtacgctgtctcacgaccggtgctcgatttagtgtgagtagtttgggtttggggaggtctcagagaggagccttagccctggactccaaggcctttccacttggtgatcagcactgaacacagaggactcaccatggaattggggctgacctgggttttccttgttgcttattttagaaggtgtccagtctcaggtgcagtcgtggtaggagtcgtggggggaggtcttcggtccgacgggtccggggggggtccctggacgtactccgttcctggtggtacgtccgttcgtggtacgttacctaaccgtttaaacaaacgttaccgtaggtacgttcggttcccggtaggggttccccggacgtaacggtcgtaccccgggtaagggggaaccggggtcggtacgggtaaggttcgggggtacgggtaacccgtaaacgtacgtaggtaaacggccgtaaggaacggtaagggtaacgtcgaaggtaactaacgttaaccttaagtggtacggtacttcggtaggtacgggaaacgggtcccgtaacgttccaaccgtacttaccgtaccgaaacggtacgaccgacgacccgtaaaccgtaactaccgtaacctacgtactacgttctaccgttaagtaacaaagttaacgaaccgtaccgtaccgtaacgacggaaccgggacccgtaaacggaaacccggtacgttaccgtttacgtttacgttacgttacggtaaggtaacggttaggaggtaccggttacgtttacggtttaagggaccggttttacggtacgttaccggtccgtttaacgg

SEQ ID NO: 82582 - DNA, 787 bp, Homo sapiens
  misc_feature: GYAE6OF02IVRVE.36.78.H01.1.454.CMB.1.raw
tcagtacgctgtctcacgaccggtgctcgatttagtgtgagtagtttgggtttgggggcagggtgtacacctgtggctctcagagaggagccttagccctggactccaaggcctttccacttggtgatcagcactagaacacagaggactcaccatggagttggggctgaccgttgggttttccttgttgcttattttagaggtgtccagtctcgaggtgcagcgtggtggacgtcggtgggggacgtcgttcgggtaccgacggggtcccgggggggttcctggacgtaccgtccgttccgttggtacggtacgtcccttcgttacggtacctttaccctaaaccgttttaaacctaacttacgtggtaacttcggtacccggttcggggtacccgtccgaacggtcccgtaccggggaagggggtaacgggggtccgtaggggtaacggttcgggggtaccggaaccgtaaacgtagtaacggaaccgaccgtaaggtagtaagggaaacgtacgtaacgaactaacttacgtaagttggtacgggtccttggtacgggtacgggaaccgggtaccgttacttcccgaaaccgttcttaccgtaccgtaaggaaccgtaacgaccggtaccgtaaccctaactccgtaaacccttcgtaacttacggttacttcggtaactaacgtaaactacggaacctaacgacgtacgaacggacgacccggaataacccgtggttacctttagtttacgtgtagcggtagacggtacggtcgtgtttacgg

SEQ ID NO: 82583 - DNA, 822 bp, Homo sapiens
  misc_feature: GYAE6OF02HJSNA.36.78.H01.1.454.CMB.1.raw
  modified_base (785)..(785): a, c, t, g, unknown or other
  misc_feature (785)..(785): n is a, c, g, or t
tcagtacgctgtctcacgaccggtgctcgatttagtgtgagtagtttgggtttgggggcagggtgtacacctgtggctctcagagaggagccttagccctggactccaaggcctttccacttggtgatcagcactgaacacagaggactcaccataggaagttggggctgaccgttggttttccttgttgacttattttaggaaggtgtccagtctacgtagggtgcgagcgtgggtggaggtcggtggggggacggtcgttgggtcccgacggggcccgggggggtccctgggacgaccttcctccgtggtcgtacgtccttcgtaggtactttacctaaacccgtttaaaccaaccgttacgtaggtaacgttcggtaccggttccgggttcccgacccgagggtccgtaccgggaagggggaccggggtacggtagggtaacgggttggggtaccgggaccaacgtaggtaacggaacgtaccggaggaacgtagggtaacgtacggaacgtaaacaacgtttaacgtacggtttaggtacgggtaccgttacggtacggtaggggtaaacccggggtccgttacgtaaccgacccgtaattcccgtaccggaaaggtaaccggaaccgtacggaccccgtaacccgaacgtccctaacttaccgttacgttacgttaacgtaccgtacgtaaacgtaaacgtaccgaaacgtacgtaccgtaaggacggaaccgtccggaaaccggtcggtaaccggttagtttaacgttagtttaccggnggtacgtcggaaggtacgggtaggtaccgtttacggg

SEQ ID NO: 82584 - DNA, 328 bp, Homo sapiens
  misc_feature: GYAE6OF02JDSQ3.36.78.H01.1.454.CMB.1.raw
  modified_base (146)..(146): a, c, t, g, unknown or other
  misc_feature (146)..(146): n is a, c, g, or t
  modified_base (222)..(222): a, c, t, g, unknown or other
  misc_feature (222)..(222): n is a, c, g, or t
  modified_base (255)..(255): a, c, t, g, unknown or other
  misc_feature (255)..(255): n is a, c, g, or t
  modified_base (262)..(262): a, c, t, g, unknown or other
  misc_feature (262)..(262): n is a, c, g, or t
  modified_base (265)..(266): a, c, t, g, unknown or other
  misc_feature (265)..(266): n is a, c, g, or t
  modified_base (268)..(281): a, c, t, g, unknown or other
  misc_feature (268)..(281): n is a, c, g, or t
  modified_base (283)..(328): a, c, t, g, unknown or other
  misc_feature (283)..(328): n is a, c, g, or t
tcagtacgctgtctcacgaccggtgctcgatttagtgtgagtagtttgggtttgggacagagttcactctcacaatcaccagcctgcaggctgaagatgtggcattttattactgtcagcagtatttgactagtcccgtgtacacntttggccaggggaccaagctggagctacaaacgaactgtggctgcaccatctgtcttcatctcccgcatctagaanacagcgtactgaggccggctggacaaggccganataagcnacnntnnnnnnnnnnnnnnannnnnnnnnnnnnnnnnnnnnnnnnnnnnnnnnnnnnnnnnnnnnn

SEQ ID NO: 82585 - DNA, 775 bp, Homo sapiens
  misc_feature: GYAE6OF02IWDX6.36.78.H01.1.454.CMB.1.raw
  modified_base (201)..(201): a, c, t, g, unknown or other
  misc_feature (201)..(201): n is a, c, g, or t
tcagtacgctgtctcacgaccggtgctcgatttagtgtgagtagtttgggtttgggggcagggtgtacacctgtggctctcgagagaggagccttagccctggactccaaggccttccacttggtgatcagcactgaacacagaggacttaccagtggaattgggctgacctggttttccttgttgctattttagaaggtntcgagtctcaggtgcagctggtcggagtcgtggggaggcgttggtccgagggcccggggggtaccctggagtacctctcctgtcgtagcctcgtggattccgtaacctttaaacaaccgtatacggtattcgtaccgtcgggtacccgcgaacggcctaccggaaggggaacgggctagggaagtgggtacgacgaacgtagtagaaacgtccgaagtacgtacggtaagtcgaaactacgaaagttactagttggttaggaacctcggttaggtaacgggaaccgggtccgttaacgttacccgaaccgttaaccttacgtaccccgaaagggtaaccgtaacccgtacggaaccgtaccctaaaaacggtccaaaccgttacgaacttggttaaacttccgtagaaacccttaaagtaccgaaacgtcccggacgttaagggaaaccgttaccgaaccggaaaaccctccgtaaaccgggtttctttaaccgggttttaaaccgttacgtacgggtaaccgttaacgggacggtaacgggtttaaccggtaccggtttttcggttaacgggg

SEQ ID NO: 82586 - DNA, 533 bp, Homo sapiens
  misc_feature: GYAE6OF01B8B4G.12.14.B03.1.454.CMB.1.raw
tcagatacgacgtacacgaccggtgctcgatttagtgtgagtagtttgagtttgggggaggcttggtacagcctgggggtccctgagactctcctgtgcagcctctggattcacctttagcaactatgccatgagctgggtccgccaggctccagtgaaggggctggagtgggtctcaggtattagtggtagtggtggtagcagatactacgcagactccgtgaagggccggttcagcatctccagagacaattccaagaacatgctgtatttgcatatgaacagcctgagagccgaggacacggccgtatattactgtgcgaagcttagcggttaccggctacgattggggagcgactggttcgacccctggggccagggaaccctggtcaccgtctcctcagcctccaccaaggcccatcggtccttccccctggccaccctcctccaacgacgcacctctcgggggcacagcgccctgggctgcctggtcaaggctacttcctcgtcgtatctgagcgggctggcaacgg

SEQ ID NO: 82587 - DNA, 547 bp, Homo sapiens
  misc_feature: GYAE6OF01A4A26.12.14.B03.1.454.CMB.1.raw
tcagatacgacgtacacgaccggtgctcgatttagtgtgagtagtttgagtttgggggaggcttggtacagcctggggggtccctgagactctcctgtgcagcctctggattcacctttagcaactatgccatgagctgggtccgccaggctccagtgaaggggctggagtgggtctcaggtattagtggtagtggtggtagcagatactacgcagactccgtgaagggccggttcagcatctccagagacaattccaagaacacgctgtatttgcatatgaacagcctgagagccgaggacacggccgtatattactgtgcgaagcttagcggttaccggctacgatggggagcgactggttcgaccctggggccagggaaccctggtcaccgtctcctcagcctccaccaacgggcccatccggtccttcccccctggccacccctccctcccaacgacgccaccctcgtcgggggcacgacgccggccctgggctgcctggtccaaggctacttccacgtcgtatctgacgcggctggcaggcg

SEQ ID NO: 82588 - DNA, 626 bp, Homo sapiens
  misc_feature: GYAE6OF01BVYQ8.12.14.B03.1.454.CMB.1.raw
  modified_base (215)..(215): a, c, t, g, unknown or other
  misc_feature (215)..(215): n is a, c, g, or t
  modified_base (621)..(626): a, c, t, g, unknown or other
  misc_feature (621)..(626): n is a, c, g, or t
tcagatacgacgtacacgaccggtgctcgatttagtgtgagtagttccgcgggggggaggcttggttcggcctggcgggtccctgagactctcctgcgcagcctctggattcctttttgaggattttgccatgcactgggtccggcaaggcgtccggggaggggcctgggagtgggtctcaaacaattacttggaatagtgctaccatagcctanacagactccgtgaagggccattcatcacttctagagacaacgccgagaacctccctgtatctgcagatgaacagtctgagacctgaggacacggccctgtatttctgttcaaaaggggctcgtggttcagggagtggggctttgactccgtggcccagggaaccctggtcgcggtctcctcacgcctaccaccgaaacgggccccagtccggtccttcccccgtggcccacccctccctccaagacgccaccgtcgtcgggggccacgaggcccggcccgttcggggccttcggccgtcgggtacctaaacgggtacccttaaccgtttccccgtaacggttccgttaactccgttcggaacgggccggggtcctggggaccgaaacgggcccgacgagtaacggnnnnnn

SEQ ID NO: 82589 - DNA, 588 bp, Homo sapiens
  misc_feature: GYAE6OF01BF69V.12.14.B03.1.454.CMB.1.raw
tcagatacgacgtacacgaccggtgctcgatttagtgtgagtagtttgagtttgggggaggcttggtacagcctggggggtccctgagactctcctgtgcagcctctggattcacctttagcaactatgccatgagctgggtccgccaggctccagtgaaggggctggagtgggtctcaggtattagtggtagtggtggtagcagatactacgcagactccgtgaagggccggttcagcatctccagagacaattccaagaacacgctgtatttgcatatgaacagcctgagagccgaggacacggccgtatattactgtgcgaagcttagcggttaccgctacgagttggggagcgactggttccgacccgtggggccagggaaccctggtccaccgtctcctcacgcctccaccgaacgggcccacgtccggtccttcccccgtcggcccacccctcccgtacccaacgacgcctacccgtcgtcgggggccacgacgccggcccgtgggcctcggccgtggtccaaggtacctaccgttccctacggttccgtacgtctcggacggccgggatcggcgaaggccg

SEQ ID NO: 82590 - DNA, 581 bp, Homo sapiens
  misc_feature: GYAE6OF01CNMT4.12.14.B03.1.454.CMB.1.raw
  modified_base (551)..(551): a, c, t, g, unknown or other
  misc_feature (551)..(551): n is a, c, g, or t
  modified_base (553)..(553): a, c, t, g, unknown or other
  misc_feature (553)..(553): n is a, c, g, or t
  modified_base (576)..(581): a, c, t, g, unknown or other
  misc_feature (576)..(581): n is a, c, g, or t
tcagatacgacgtacacgaccggtgctcgatttagtgtgagtagttccgcggggggggaggcttggttcggcctggcgggtccctgagactctcctgcgcagcctctggattcctttttgaggattttgccatgcactgggtccggcaagctccggggagggcctgggagtgggtctcaaacaattacttggaatagtgctaccatagcctacacagactccgtgaagggccattcatcacttctagagacaacgccgagaacctcctgtatctgcagatgaacagtctgagacctgaggacacggccctgtatttctgttacaaaagggctctggttcagggagtggggctttggactccgtgggcccgagggaacccgtggtcgcggtctccgtcacgcctccaaccgaacgggcccacgtccggtccctttcccccgtcgggccctaccccgtcccctccgtaacgacgcacccgtcgtcggggccacgacgccggccctgggcctcgcctggtaccgaaggtacctacttccgtacgtcgtactcgngngcggcgtggcaggcgtcatacgnnnnnn

SEQ ID NO: 82591 - DNA, 522 bp, Homo sapiens
  misc_feature: GYAE6OF01EGMC8.12.14.B03.1.454.CMB.1.raw
  modified_base (417)..(417): a, c, t, g, unknown or other
  misc_feature (417)..(417): n is a, c, g, or t
  modified_base (432)..(432): a, c, t, g, unknown or other
  misc_feature (432)..(432): n is a, c, g, or t
  modified_base (512)..(512): a, c, t, g, unknown or other
  misc_feature (512)..(512): n is a, c, g, or t
  modified_base (517)..(522): a, c, t, g, unknown or other
  misc_feature (517)..(522): n is a, c, g, or t
tcagatacgacgtacacgaccggtgctcgatttagtgtgagtagttccgcggggggggaggcttggttcggcctggcgggtccctgagactctcctgcgcagcctctggattcctttttgaggattttgccatgcactgggtccggcaagctccgggggagggcctggagtgggtctcaacaattacttggaatagtgctaccatagcctacacagactccgtgaagggccgattcatcacttctagagacaacgccgagaactccctgtatctgcagatgaacagtctgagacctgaggacacggccctgtatttctgttcaaaaggggctctggttcagggatggggctttgactcctggcccagggaccctggtcgcggtctcctcagcctccacaggcccatcgtcttccccngcaccctctccaagngcacctctcggggcacagcgccctgggctgcctggtcaacggctacttcctacgtcgtatctgagcgggctggcaggcgnatagnnnnnn

SEQ ID NO: 82592 - DNA, 556 bp, Homo sapiens
  misc_feature: GYAE6OF01D0QW4.12.14.B03.1.454.CMB.1.raw
  modified_base (551)..(556): a, c, t, g, unknown or other
  misc_feature (551)..(556): n is a, c, g, or t
tcagatacgacgtacacgaccggtgctcgatttagtgtgagtagttccgcggggggggaggcttggttcggcctggcgggtccctgagactctcctgcgcagcctctggattcctttttgaggattttgccatgcactgggtccggcaagctccggggaggggcctggagtgggtctcaacaattacttggaatagtgctaccatagcctacacagactccgtgaagggccattcatcacttctagagacaacgccgagaactccctgtatctgcagatgaacagtctgagacctgaggacacggccctgtatttctgttcaaaaggggctctggtttcagggatggggctttgactcctggcccagggaaccctggtcgcggtctcctcagcctccaccaagggcccatccggtccttccccctggccaccctccctccaacgacgccacctcgtcggggcacgacggccggccctgggctcggcctcggtcaacggaccttaccttcctacgtcgtatctgaggcgggctggcgaagggcgcgatacgnnnnnn

SEQ ID NO: 82593 - DNA, 593 bp, Homo sapiens
  misc_feature: GYAE6OF01BFI0Y.12.14.B03.1.454.CMB.1.raw
  modified_base (588)..(589): a, c, t, g, unknown or other
  misc_feature (588)..(589): n is a, c, g, or t
  modified_base (591)..(591): a, c, t, g, unknown or other
  misc_feature (591)..(591): n is a, c, g, or t
  modified_base (593)..(593): a, c, t, g, unknown or other
  misc_feature (593)..(593): n is a, c, g, or t
tcagatacgacgtacacgaccggtgctcgatttagtgtgagtagttccgcggggggggaggcttggttcggcctggcgggtccctgagactctcctgcgcagcctctggattcctttttgaggatttttgccatgcactgggtccggcaagctccggggaggggcctggagtgggtctcaacaattacttggaatagtgctaccatagcctacacagactccgtgaagggccgattcatcacttctagagacaacgccgagaactccctgtatctgcagatgaacagtctgagacctgaggacacggccctgtatttctgttcaaaaggggctctggttcagggactggggctttgactcctggcccagggaaccctggtcgcggtctcctcacgccctccaccgaacgggcccactccggtccttcccccgtggccacccctccctaccaacgacgccaccgtcgtcggggccacgacgccggcccgtgggcctcggccgtcggtaccgaacggtaccttaccttcccgtacgttcgtactcgtcggacggccgggtcgtgggaccgaacgggccgacgagtagcanngngn

SEQ ID NO: 82594 - DNA, 524 bp, Homo sapiens
  misc_feature: GYAE6OF01ATLFH.12.14.B03.1.454.CMB.1.raw
  modified_base (420)..(420): a, c, t, g, unknown or other
  misc_feature (420)..(420): n is a, c, g, or t
  modified_base (492)..(492): a, c, t, g, unknown or other
  misc_feature (492)..(492): n is a, c, g, or t
  modified_base (519)..(524): a, c, t, g, unknown or other
  misc_feature (519)..(524): n is a, c, g, or t
tcagatacgacgtacacgaccggtgctcgatttagtgtgagtagttccgcgggggggaggcttggttcggcctggcgggtccctgagactctcctgcgcagcctctggattcctttttgaggattttgccatgcactgggtccggcaagctccggggaggggcctggagtgggtctcaacaattacttggaatagtgctaccatagcctacacagactccgtgaagggccgattcatcacttctagagacaacgccgagaactccctgtatctgcagatgaacagtctgagacctgaggacacggcccctgtatttctgttcaaaaggggctctggttcagggatggggctttgactcctgggcccagggaaccctggtcgcggtctctcagcctcacagggcccatcgtctcccctgcnccctcctccagagcacctcgtggggcacagcggccctgggctgcctggtcaaggactacttcctacgtcgtntctgagcgggctggcaggcgcagtagnnnnnn

SEQ ID NO: 82595 - DNA, 589 bp, Homo sapiens
  misc_feature: GYAE6OF01C56RW.12.14.B03.1.454.CMB.1.raw
  modified_base (584)..(585): a, c, t, g, unknown or other
  misc_feature (584)..(585): n is a, c, g, or t
  modified_base (587)..(589): a, c, t, g, unknown or other
  misc_feature (587)..(589): n is a, c, g, or t
tcagatacgacgtacacgaccggtgctcgatttagtgtgagtagttccgcggggggggaggcttggttcggcctggcgggtccctgagactctcctgcgcagcctctggatttcctttttgaggattttgccatgcactgggtccggcaagctccggggagggcctggagtgggtctcaacaattacttggaatagtgctaccatagcctacacagactccgtgaagggccattcatcacttctagagacaacgccgagaacctccctgtatctgcagatgaacagtctgagacctgaggacacggccctgtatttctgttcaaaaggggctctggttcagggatggggctttgactcctgggcccagggaaccctggtcgcggtctcctcacgccctccaccgaacgggcccacgtccggtccttccccctcggccacccctccctccaacgacgccaccctcgtcggggccacgacggccggccccgtcggggctcggcccgttggtaccgtaaggaccttacctttccgtaccgttccgtacttccgtgacggcgggcgtgggccgaagggccgcgatganncnnn

SEQ ID NO: 82596 - DNA, 563 bp, Homo sapiens
  misc_feature: GYAE6OF01A6MSC.12.14.B03.1.454.CMB.1.raw
  modified_base (559)..(561): a, c, t, g, unknown or other
  misc_feature (559)..(561): n is a, c, g, or t
tcagatacgacgtacacgaccggtgctcgatttagtgtgagtagttccgcggggggggaggcttggttcggcctggcgggtccctgagactctcctgcgcagcctctggattcctttttgaggatttttgccatgcactgggtccggcaagctccggggagggcctggagtgggtctcaaacaattacttggaatagtgctaccatagcctacacagactccgtgaagggccattcatcacttctagagacaacgccgagaactcctgtatctgcagatgaacagtctgagacctgaggacacggccctgtatttctgttacaaaaggggctcgtggttcagggatggggctttgactccgtggcccagggaaccctggtcgcggtctcctcacgcctccaccacgggcccagtccggtccttccccgtggccgccctcgctccgaggacgccaccgtccgagacgcacacggccgcccgtgggcctcggccgtggtcaacggtacctacttccgtacgtcgtactcgtgacggcgggcgtcggacgacggcgcatagnnngc

SEQ ID NO: 82597 - DNA, 688 bp, Homo sapiens
  misc_feature: GYAE6OF01EBWMV.12.14.B03.1.454.CMB.1.raw
  modified_base (217)..(217): a, c, t, g, unknown or other
  misc_feature (217)..(217): n is a, c, g, or t
  modified_base (684)..(684): a, c, t, g, unknown or other
  misc_feature (684)..(684): n is a, c, g, or t
tcagatacgacgtacacgaccggtgctcgatttagtgtgagtagttccgcgggggggggaggcgttggttcggcctggcgggtccctgagactctcctgcgcagcctctggatttcctttttgaggatttttgccatgcactgggtccggcaagctccggggagggcctggagtgggtctcaactaattacttggaattagtgctaccatagcctanacagactccgtgaagggccgagttcatcacttcagagacaacgccgagaactccctgtatctgcagatgaacagtctgagacctgaggacacggcctgtatttctgttcgaaaagggggctcgttggttcgaggggtagtggggtcttttggactccgtcgggcccgaaggggaaccctggtacgcggtcctcgtctacgcccttccgaaccgtaacgggccccaagttcccggtaccttccccccgtcggtccaccccgttcccctaccaacgacgaccacccgttccgtcgggggcctacgacgggtccggaccccgttcgggacttcggcccgttacgggtacctaacgggtacccttaccgttacccgttaccggttcggttacgttccgtcggtaacggtccgggggtaccgtacggggtaccgaacggggtccggaccgtaacgtacggtcgagtacgtgngtcg

SEQ ID NO: 82598 - DNA, 596 bp, Homo sapiens
  misc_feature: GYAE6OF01A6MDX.12.14.B03.1.454.CMB.1.raw
tcagatacgacgtacacgaccggtgctcgatttagtgtgagtagttccgcggggagctctgggagaggagccccagccctgagattcccaggtgtttccattcagtgatcaacactgaacacagaggactcatcatggaattgggactgacctgcattttccttttggctattttaaagggtgtccagtgtgaagtgcacttggaacagtcggggggagcttggttcggcctggcgggtccctgagactctcctgcgcagcctctggtattcctttttgaggtattttgcctatgcacgtgggtccggcaagcgtccggggagggcctgggagtgggtctacaactaattacgttggaatagtgctaccatacgcctacacagactccgtagagggccgatcatcacttcagagacaacgccgacgaacctccctagtactctgcagatagaacagtctgaacgaccgtaggaacggccaaccggtccctgttatttccgtagttacgaaaaggggtccttacggtcggtacgaggggtagtcgggggtactttcggaccgttccggtagggcccctaggggtaaccccgtcgggg

SEQ ID NO: 82599 - DNA, 628 bp, Homo sapiens
  misc_feature: GYAE6OF01C2AKW.12.14.B03.1.454.CMB.1.raw
  modified_base (504)..(504): a, c, t, g, unknown or other
  misc_feature (504)..(504): n is a, c, g, or t
  modified_base (577)..(577): a, c, t, g, unknown or other
  misc_feature (577)..(577): n is a, c, g, or t
  modified_base (617)..(617): a, c, t, g, unknown or other
  misc_feature (617)..(617): n is a, c, g, or t
  modified_base (624)..(624): a, c, t, g, unknown or other
  misc_feature (624)..(624): n is a, c, g, or t
tcagatacgacgtacacgaccggtgctcgatttagtgtgagtagttcgcgggggggggagggcttggtcggcctggcgggtccctgagactctcctgcgcagcctcgtggtatttcctttttgaggtattttgccatgcactgggccggcaagcgtccggggagggcctagggagtgggtctacaaacaattactggaatgtgctaccatacgcctaacacagtactccggtagaacgggcctaattcatcacgttcaagagacaacgccgtaagaactcctgtatctgcagatgaacagtctagacactgaggacacggtacctgttatttctgttacgaaaagggctactggttacgagggagtcgggtactttgaccgtcgtcggaccgacgggtaaccctggtcgcggttctcgtcgtacgcctccgaaccgacggaccctacgtccgtccttccctcggccacccctccgtacaagacgcaaccgttggcggggtaacncgtccggccgttcggacgtccgtccgtggtaccgtaacgggtacctaccgttaccgtacgtccgtaatttcgngcgggtacggcgtggaacgtaacggccagtagtaggcagngcagttnaccg

SEQ ID NO: 82600 - DNA, 643 bp, Homo sapiens
  misc_feature: GYAE6OF01AQNMA.12.14.B03.1.454.CMB.1.raw
  modified_base (325)..(325): a, c, t, g, unknown or other
  misc_feature (325)..(325): n is a, c, g, or t
tcagatacgacgtacacgaccggtgctcgatttagtgtgagtagtttgagtttgggggaggcttggtacagcctggggggtccctgagagtctcctgtacaacctctggattcatgtttagtagtcattggatgaactgggtccgccaggctccaggggaaggggctggagtggggtggccaacataaagcaaagatggaagtgagaaatactatgtggactctgtgaagggccattcacaatctccagagacaacgccaagaactcactgtatctgacaaaataaacagcctagaaaagccgaaggacacggctgtgtatttcngtgcgaggaccgtcctacgggtgaactaaattttataccaaaccagaactaaagtttcgttacgaccaagcccgtacaacctacttactttgaacagccgtcggggaccacgggaaccctggtaccaccgtcctcctcacgtccctcccacccgaacgggcccctacgtccggttcccttcccccgtcggtccctacccctccctacccgaacgtacgtccacccgtcggtcggggacctacgacgccggcccgtcgggtcctcggccgtcggtaccaacggtaccttaccgttaccctacggtcttcgtcgtacggg

SEQ ID NO: 82601 - DNA, 611 bp, Homo sapiens
  misc_feature: GYAE6OF01DU8UY.12.14.B03.1.454.CMB.1.raw
  modified_base (318)..(318): a, c, t, g, unknown or other
  misc_feature (318)..(318): n is a, c, g, or t
  modified_base (484)..(484): a, c, t, g, unknown or other
  misc_feature (484)..(484): n is a, c, g, or t
tcagatacgacgtacacgaccggtgctcgatttagtgtgagtagtttgagtttgggggaggcttggtacagcctggggggtccctgagactctcctgtgcagcctctggattcacctttagcaactatgccatgagctgggtccgccaggctccagtgaaggggctggagtgggtctcaggtattagtggtagtggtggtagcagatactacgcagactcgtgaagggccggttcagcatctccagagacaatccaaagacacgctgtattgcatatgaacagcctgagagccggaggaccacggcctatattactgngcgaagcttaggcggttaccgcgtacgagttggggagcgtactcggttccggaccccgtggggacccgaagggaccctggtccaccgtctcctcacgcctccaaccgaacggcccactccggtcccttcccctcgccacccctccaccaagacgccgaccgtcggnggggtccacgacgccggcccgtcgggcctcggccgtcggtacgaaacgggtacctaaccgttacccgttacggttccgtaacttcgtacggtacgggaccgggtcggtcggtacgaagggtacccgg

SEQ ID NO: 82602 - DNA, 676 bp, Homo sapiens
  misc_feature: GYAE6OF01EOWWT.12.14.B03.1.454.CMB.1.raw
tcagatacgacgtacacgaccggtgctcgatttagtgtgagtagtttgagtttgggggaggcttggtacagcctggggggtccctgagactctcctgtgcagcctctggattcacctttagcaactatgccatgagctgggtccgccaggctccagtgaaggggctggagtgggtctcaggtattagtggtagtggtggtagcagatactacgcagactccgtgaagggccggttcagcatcctccagagacaattccaagaacacgctagtatttgctatatgaacagcctgagagccgaggacacggccgttataattactgtgacgaacgcttacgcggttaccggcttaacggagttaggggagcgaacgtgggtttacccgaccccgtgggggacccaacggggaaccccgtggtaccaccgttcctccgtcacgccctcccaacccggaacggccccacgttccggtacccttcccccgtcggcccacccctccctacccgaacgtaccgcctacccgtccggcgggggtaccaccgacggccccggtcccgtcggggtccgtacggccgttcgggtaccgaaacgggtaccctttaacccgtttcccgttaccggttccgttaacgttcgtacggacggtccggggccttacgggccgaacgggacccg

SEQ ID NO: 82603 - DNA, 673 bp, Homo sapiens
  misc_feature: GYAE6OF01ENY4S.12.14.B03.1.454.CMB.1.raw
  modified_base (667)..(671): a, c, t, g, unknown or other
  misc_feature (667)..(671): n is a, c, g, or t
  modified_base (673)..(673): a, c, t, g, unknown or other
  misc_feature (673)..(673): n is a, c, g, or t
tcagatacgacgtacacgaccggtgctcgatttagtgtgagtagttccggcgggggggggaggcttggttcggcctggcgggtccctgagactctcctgcgcagcctctggtatttcctttttgaggtatttttgccatgcacgtgggtccggcaagcgtccgggggagggcctggagtgggtctcaacaattacttggaatagtgctaccatagcctacacagactccgtgaagggccattcatcacttctagagacaacgccgagaactcctgtatctgcagatgaacagtctgagacctggaggacacggcctgtatttcgtgtacgaaaagggctcgtggttcagggtagtgggtctttgacgtccgtcgggcccgacggggtaacccgtcggtccggtccggtccgtcccgtcgtaccgcccgttacccgaacccgaacgggcccctacgttcccggttccctttccccccgtcggtcccctaaccccctccctacccgaacgacgacccacccgttccggtcgggggacctaccggaccggccgggtccccggtcgggccgtcggcccgtacggtaccgaacggtaccttaccgttcccgttaacgtccggttagtccgtcggacggccgggtcgtacggtacgaacggccgacacgtagnnnnngn

SEQ ID NO: 82604 - DNA, 598 bp, Homo sapiens
  misc_feature: GYAE6OF01EJGI5.12.14.B03.1.454.CMB.1.raw
  modified_base (593)..(593): a, c, t, g, unknown or other
  misc_feature (593)..(593): n is a, c, g, or t
  modified_base (595)..(598): a, c, t, g, unknown or other
  misc_feature (595)..(598): n is a, c, g, or t
tcagatacgacgtacacgaccggtgctcgatttagtgtgagtagttccgcggggggggaggcttggttcggcctggcgggtccctgagactctcctgcgcagcctctggattcctttttgaggatttttgccatgcactgggtccggcaagctccgggggaggggcctggagtgggtctcaacaattacttggaatagtgctaccatagcctacacagactccgtgaagggccattcatcacttctagagacaacgccgagaactccctgtatctgcagatgaacagtctgagacctgaggacacggccctgtatttctgttacaaaaggggctctggttcagggatggggctttgactccgtggcccagggaaccctggtcgcggtctcctcacgcctccgaccgaacgggcccacgtccggtcctttcccccgtcggcccacccctccctaccaacgacgccacccgtcgtcgggggccacgacggccggcccgtgggctcgccgtcggtccgaacggtaccttaccttcccgtaccgtcgttagtccgtggacggccgggtcgttgggacgaacgggccgacgagtacgnannnn

SEQ ID NO: 82605 - DNA, 624 bp, Homo sapiens
  misc_feature: GYAE6OF01CMS7M.12.14.B03.1.454.CMB.1.raw
  modified_base (616)..(616): a, c, t, g, unknown or other
  misc_feature (616)..(616): n is a, c, g, or t
  modified_base (619)..(619): a, c, t, g, unknown or other
  misc_feature (619)..(619): n is a, c, g, or t
  modified_base (621)..(621): a, c, t, g, unknown or other
  misc_feature (621)..(621): n is a, c, g, or t
  modified_base (623)..(623): a, c, t, g, unknown or other
  misc_feature (623)..(623): n is a, c, g, or t
tcagatacgacgtacacgaccggtgctcgatttagtgtgagtagttccggcgggggggggaggcttggttcggcctggcgggtccctgagactctcctgcgcagcctctggatttcctttttgaggatttttgccatgcactgggtccggcaagcgtccggggagggcctggagtgggtctcaacaattacttggaatagtgctaccatagcctacacagactccgtgaagggccattcatcacttcagagacaacgccgagaactccctgtatctgcagatgaacagtctgagacctgaggacacggccctgtatttctgttacgaaaagggctacgtggttcgagggagtggggctttgactccgtggcccagggaaccctggtcgccggtctcctcacgccctccaccgaacgggcccacgtccggtccttcccccgtcgggcccacccctccctacccaacgacgccaccgtccgtcgggggccacgacggccggccctcgggctcgccgtcggtaccgaacggtaccttacgttccctacggttccgtactccgtggtacggccggggtcgttacgggaccggtaaacgggcccgacgtacgtaacgctancgngngng

SEQ ID NO: 82606 - DNA, 569 bp, Homo sapiens
  misc_feature: GYAE6OF01AWV8T.12.14.B03.1.454.CMB.1.raw
  modified_base (355)..(355): a, c, t, g, unknown or other
  misc_feature (355)..(355): n is a, c, g, or t
  modified_base (474)..(474): a, c, t, g, unknown or other
  misc_feature (474)..(474): n is a, c, g, or t
tcagatacgacgtacacgaccggtgctcgatttagtgtgagtagtttgagtttgggggaggcttggtacagcctggggggtccctgagactctcctgtgcagcctctggattcacctttagcaactatgccatgagctgggtccgccaggctccagtgaaggggctggagtgggtctcaggtattagtggtagtggtggtagcagatactacgcagactccgtgaagggccggttcagcatctccagagacaattccaagaacacgctgtatttgcatatgaacagcctgagagccggaggacacggccgtatattactgtgcgaagcttagcggttaccgctacgattggggancgactggttcgacccgtggggccagggaaccctggtcaccgtctcctcacgcctccaccaacgggcccactccggtccttcccccgtggccacccctcctccaacgacgccaccgtcgnggggccacgacgccggcctgggcctcgccgtggtccaacggtacctacttccctacggttcgtactcgtcggtacgcgggctcggcgaagggccg

SEQ ID NO: 82607 - DNA, 649 bp, Homo sapiens
  misc_feature: GYAE6OF01CL5G6.12.14.B03.1.454.CMB.1.raw
  modified_base (237)..(237): a, c, t, g, unknown or other
  misc_feature (237)..(237): n is a, c, g, or t
  modified_base (248)..(248): a, c, t, g, unknown or other
  misc_feature (248)..(248): n is a, c, g, or t
  modified_base (258)..(258): a, c, t, g, unknown or other
  misc_feature (258)..(258): n is a, c, g, or t
  modified_base (262)..(262): a, c, t, g, unknown or other
  misc_feature (262)..(262): n is a, c, g, or t
  modified_base (314)..(314): a, c, t, g, unknown or other
  misc_feature (314)..(314): n is a, c, g, or t
tcagatacgacgtacacgaccggtgctcgatttagtgtgagtagtttgagtttgggggaggcttggtacagcctggggggtccctgagactctcctgtgcagcctctggattcacctttagcaactatgccatgagctgggtccgccaggctccagtgaaggggctgggagtgggtctcaggtattagtggtagtggtggtagcagatactacgcagactccggtgaagggccgttnagcatctcagngacatccaanaacncgctgtatttgcatatgaacagcctgagagccgagacacggcctatattacngtgcgaaagtcttagcggttaccggctacggagtttgggggacgcgacgttggttcccgacccgtgggggtacccagggtaacccctggtccaccgtctcctacgacgccctaccaccgaacggccctacgtccgtccttccccgtggcctacccctcctaccgaacgacgaccaccgtcggtcgggggaccaccgacggcccggtcccggtcgggtcctaccgggtcccgttggtaaccggtaacggtaaccttacccgtttaccgtacccggtttacgttaacgttcggtacggtacgggtcggtccggttacgggaccggaacgggacccgg

SEQ ID NO: 82608 - DNA, 998 bp, Homo sapiens
  misc_feature: GYAE6OF01DR3TO.12.14.B03.1.454.CMB.1.raw
  modified_base (187)..(187): a, c, t, g, unknown or other
  misc_feature (187)..(187): n is a, c, g, or t
tcagatacgacgtacacgaccggtgctcgatttagtgtgagtagttccgcggggagctctgggagaggagccccagccctgagattcccgaggtgtttccattcagtgatcaacactgaacacagaggactcatcatggaattgggactgacctgctattttcctttggtcttaagttttaagggtntccagtgtgaagtgctacgttggaacgagggtcggggggaggtcgtttgggttccggccgttcggggccgggtcccgtggacgtaccttccgtccgtgccgacacgccttcgtggtacttttccgtttttggaggttattttcgcctagtcgccgtacggtcggggtccgacgaacggtccgggtccggggggacgggtccgtggggtacggttcggggtcctaacgtaaaacttaacgtttacgttagggtaaattacggtacgtacccttaacccgtaagttaaccggtaccccttaaacgaaccgtaccggtaacccgttaccggggtaaggggaaaccggggtacccgttaacgttttccgaaacgtttacccgttaacccgtttaaccggtaacggtaaaccggtaaacccccgaaaccggtaccccgggtaaaacggttaaacccccttaccccgtttaggtttaacctaccggttaaccggaccgtaaacggtaacgtaacggtaaaccgttacggtttaacccgtaacgggaaacccggttacccggttaacgggaacccggggttaaaccccggtaacccgggttaccccgttttaacgggtttaaccgtttttaccggttaaccgggttttaaaccgggaaaaaccgggggtttccgtttaccgggtttacgggtttaaccggggtaacgggggtttacggggttccgggggtttaccgttttaccggtaaccccgggttccccgggtaaccccgggggtacccccgggtaaacccggggttaacccccggggtttccggg

SEQ ID NO: 82609 - DNA, 745 bp, Homo sapiens
  misc_feature: GYAE6OF01D4IY4.12.14.B03.1.454.CMB.1.raw
  modified_base (183)..(183): a, c, t, g, unknown or other
  misc_feature (183)..(183): n is a, c, g, or t
tcagatacgacgtacacgaccggtgctcgatttagtgtgagtagttccgcggggagctctgggagaggagccccagccctgagattcccaggtgtttccattcagtgatcaacactgaacacagaggactcatcatggaattgggactgacctgctattttcctttggcttattttaagggtntccagtgtgaagtgcacttggaacaggtcggggggagtcgttgggtcggccgtgggccgggtccctgacgactcctcctgcgcacgcctcgtggtactttccgtttttgaggtattttcgcctattgctacgttcgggccggacgaacggtccggtaccggggggagggggtcctggggtacggtcggggtcctacgaaaccgtaaatttacgttagggaaattacggtcgacctaaccagtaacgcccgtaacacgaacgaccgtccggtagggaacgggccgtattaccattacctacttcgtaacgacgaaccgaacgaccgaaacgtaacctcccgtagtactcgtacgacaagtatacgaactaggttaccgaggtaacgtaaccgttaggaacgggacccgtacccggtcccttagtttacttttcgtaccggtttaaacgggaaaaccggggttcttacggtttacgggttacggaagggggttcgttacggggttccttttacggacccgttaccggtaccggggaccccgtaacggggtaaccccgttcgggg

SEQ ID NO: 82610 - DNA, 955 bp, Homo sapiens
  misc_feature: GYAE6OF01C1MAY.12.14.B03.1.454.CMB.1.raw
tcagatacgacgtacacgaccggtgctcgatttagtgtgagtagttccgcggggagctctgggagaggagccccagccctgagattcccaggtgtttccattcagtgatcaacactgaacacagaggactcatcatggaattgggactgacctgctattttccttttggacttaagttttaaagggtgtccagtgtgaagtgctacgttggaaacgaggtcggggggagcgttgggttcggccgtgggccgggtccctgacgactcctcctgcgcacgtcctctggtactttccttttggagttattttgcctatcgcgtacgtcgggtccggactaacggtccggtaccgggggacggggccgtaggggacggttcggggttactaccgaaaacgttaaagtttaaccgtaggtaaagttaaggtctaaccgttaaccaagttaaccggtaccccttaaacaaccgtaaacggtacccgttacccgggttaacgggaaaccgggggtccctaacgttttacccgaaatttaccccgtaacgtttaccgttaaacggaaccggtaaaccgtaaacccgggaacccccgtaaacgttaaaacccccgtttcccgttaaacgggtttaaaccttccggttacggtaacccgtaaaggtaacggttaaaccggtaaaccgtaaggttcccgtaagggtaaaccggttaaccccggtaagggtaaacccggggacccgtaaacccggggttaccccgtttaacggttttacgttttaaccgggttaacgggtttaaaccggtaaaaaccggggggttctttacccgggtttaggggtttaaccggtaaggggggttaccggttacgggggtttaacccgttttacgggtaaccccgtttacccggggttacccgggtaaccccgggtaaaccgggggttaaacccccgggtttccgggg

SEQ ID NO: 82611 - DNA, 581 bp, Homo sapiens
  misc_feature: GYAE6OF01DTBNV.12.14.B03.1.454.CMB.1.raw
  modified_base (220)..(220): a, c, t, g, unknown or other
  misc_feature (220)..(220): n is a, c, g, or t
  modified_base (575)..(575): a, c, t, g, unknown or other
  misc_feature (575)..(575): n is a, c, g, or t
  modified_base (577)..(578): a, c, t, g, unknown or other
  misc_feature (577)..(578): n is a, c, g, or t
  modified_base (580)..(581): a, c, t, g, unknown or other
  misc_feature (580)..(581): n is a, c, g, or t
tcagatacgacgtacacgaccggtgctcgatttagtgtgagtagttccggcgggggggggaggcttggttcggcctggcgggtccctgagactctcctgcgcagcctctggatttcctttttgaggtatttttgccatgcacgtgggtccggcaagcgtccgggggagggcctggagtgggtctcaaacaattacttggaatagtgctaccatagcctanacagactcgtgaagggccattcatcacttcagagacaacgccgagaacctcctgtatctgcagatagaacagtctgacgacctggacggacacgggccctgttatttctgttacgaaaaggggctcgtggttcgagggtagtgggtcttcgacgtcgtcggaccgacggtaccgtggtcgcggtctccgtcacgcctccgaccgacggcctacgtccgtccttaccccgtcgccctaccctctaccaacgcgccaccgtcgcggggcacgacgccgccgtggctcgccgtggacaacgtccttacgtccgtacgtcgtcgtcgtcggacggcggtcgtggacgacgcgcagtcgnanngnn

SEQ ID NO: 82612 - DNA, 754 bp, Homo sapiens
  misc_feature: GYAE6OF01B8126.12.14.B03.1.454.CMB.1.raw
  modified_base (746)..(747): a, c, t, g, unknown or other
  misc_feature (746)..(747): n is a, c, g, or t
  modified_base (749)..(750): a, c, t, g, unknown or other
  misc_feature (749)..(750): n is a, c, g, or t
  modified_base (752)..(752): a, c, t, g, unknown or other
  misc_feature (752)..(752): n is a, c, g, or t
  modified_base (754)..(754): a, c, t, g, unknown or other
  misc_feature (754)..(754): n is a, c, g, or t
tcagatacgacgtacacgaccggtgctcgatttagtgtgagtagttccggcggggggggaggcttggttcggcctgggcgggtccctgagactctcctgcgcagcctctggtatttcctttttgaggtattttgccatgcactgggtccggcaagcgtccggggagggcctgggagtgggtctcaaactaatttacgttggaatagtgctaccatagcctacacgagactccggtggaagggccattcatcacttcagagacaacgcgaagactcctgtactctgacagatacgaaactagtctagacgaccgtggacggacgaccggtcccttagttactttctacgttacgtaaaacggggtctacgttcgggttacgaggggtagttcggggtcttttcggaccttccggtcgggacccgaacggggtaacccgtcggtccggtccggtactcccgtacgaccgcccgtaccgaaccgaccgggccgtaccgtccggtacccttcccccgtcggtacccctacccctcccgtaaccgaaccggaccgaccgtaacccgttccgggtacgggacccgtaacccggccgggtccccggtcccggtccgggtaccgttcccggtacccggtaccggtaaccggtaaccggtaaccgtttacccgttcccgttaccggttacgttaaccgtcggtacggtacgggcccgggttcgaccgggacggtaccggccgtacgtaaggtcgnngnngngn

SEQ ID NO: 82613 - DNA, 617 bp, Homo sapiens
  misc_feature: GYAE6OF01EF1AU.12.14.B03.1.454.CMB.1.raw
  modified_base (608)..(608): a, c, t, g, unknown or other
  misc_feature (608)..(608): n is a, c, g, or t
  modified_base (613)..(613): a, c, t, g, unknown or other
  misc_feature (613)..(613): n is a, c, g, or t
tcagatacgacgtacacgaccggtgctcgatttagtgtgagtagttccgcggggggggagcttggttcggcctggcgggtccctgagactctcctgcgcagcctctggattcctttttgaggattttgccatgcactgggtccggcaagctccggggagggcctggagtgggtctcaacaattacttggaatagtgctaccatagcctacacagactccgtgaagggccattcatcacttctagagacaacgccgagaacctccctgtatctgcagatgaacagtctgagacctgaggacaccggccctgtatttctgtcgaaaagggtctcgtggttcgagggatggggtctttgacctccgtcggcccgacgggtaacccgtggtcgcggttcctcctcacgcctaccaccgacgggccctagtccggttcccttcccccgcgtcccacccctccctaccgaacgtacgccacccgtcgtcgggccacgaccggccggtcccgtgggctcgcccgtggtaccgtaacgtaccttaccgttccgtacgttctctcgtcgcggtccgggtctcgggaccgtaagggcccgtacgtaaacgttcgacgngctgngacg

SEQ ID NO: 82614 - DNA, 563 bp, Homo sapiens
  misc_feature: GYAE6OF01CRTGU.12.14.B03.1.454.CMB.1.raw
  modified_base (559)..(563): a, c, t, g, unknown or other
  misc_feature (559)..(563): n is a, c, g, or t
tcagatacgacgtacacgaccggtgctcgatttagtgtgagtagttccgcggggggggaggcttggttcggcctggcgggtccctgagactctcctgcgcagcctctggattcctttttgaggatttttgccatgcactgggtccggcaagctccggggagggcctggagtgggtctcaacaattacttggaatagtgctaccatagcctacacagactccgtgaaggccgattcatcacttctagagacaacgccgagaactccctgtatctgcagatgaacagtctgagacctgaggacacggccctgtatttctgttcaaaagggctctggttcagggatgggctttgactcctggccaggaaccctggcgcggtctcctcagcctccaccaacggcccatccggtccttcccctggccacccctccctccaagacgtccaacctcgtcgggggaccacgacgaccggccccgtagggcctcgcccgtggtacgaacggtactaccttccctacgtcgttaactcgtgaggcgggctgggacaaggcgcatacgannnnn

SEQ ID NO: 82615 - DNA, 571 bp, Homo sapiens
  misc_feature: GYAE6OF01AYC2N.12.14.B03.1.454.CMB.1.raw
  modified_base (392)..(392): a, c, t, g, unknown or other
  misc_feature (392)..(392): n is a, c, g, or t
  modified_base (565)..(565): a, c, t, g, unknown or other
  misc_feature (565)..(565): n is a, c, g, or t
  modified_base (568)..(571): a, c, t, g, unknown or other
  misc_feature (568)..(571): n is a, c, g, or t
tcagatacgacgtacacgaccggtgctcgatttagtgtgagtagttccgcggggggggaggcttggttcggcctggtgggtccctgagactctcctgcgcagcctctggatttcctttttgaggatttttgccatgcactgggtccggcaagctccgggggaggggcctggagtgggtctcaacaattacttggaatagtgctaccatagcctacacagactccgtgaagggccattcatcacttcagagacaacgccgagaacctcctgtatctgcagatgaacagtctgagacctgaggacacggccctgtatttctgtcgaaaggggctcgtggtcagggagtggggtctttgactccgtgggcccagggaccctggtcgcggtctccncacgcctccacgacggccacgtccgtcctccccgtggccctaccctccctaccaacgacgaccaccgtcgtcggggccacgacggccgcccgtcggctcgccgtcggctaacggaccttaccgttccgtacgtcgtactcgtggacgcgggtcgtggacgacggcgcagtagnagnnnn

SEQ ID NO: 82616 - DNA, 813 bp, Homo sapiens
  misc_feature: GYAE6OF01B73ZJ.12.14.B03.1.454.CMB.1.raw
  modified_base (237)..(237): a, c, t, g, unknown or other
  misc_feature (237)..(237): n is a, c, g, or t
  modified_base (286)..(286): a, c, t, g, unknown or other
  misc_feature (286)..(286): n is a, c, g, or t
tcagatacgacgtacacgaccggtgctcgatttagtgtgagtagtttgagtttgggggaggcttggtacagcctggggggtccctgagactctcctgtgcagcctctggattcacctttagcaactatgacatgagctgggtccgccaggctccagtgaaggggctggagtgggtctcgaggtattagtggtagtggtggtagcagatactacgcagactccgtgaagggccggttnagcatctccagagacaattccaagaacacgctgtatttgcatatgaacngcctgagagccgaggacacggacgtatattactgtgcgaagtcttaggccggttaccggactacggtagttggggagcgtacgttcggttaccgaccccggtgggggacccgaacggggtaaccccgttcgggtaccgtacccgttccgttcccgtaccgaccggtcccctaccccgaacccggtaaaccgggcccctaacggttcccggttcccctttccccccgtcggtacccctacccccgttcccgtaacccgaaacggtacccgacccgtaacccggttccgggttaccggggggacccctaaccggacccgggtacccgggtccccccggttacgggggtcccgttacccgggtaccccggtttacgggtaacccgtaaaaccggggttacccctttaaccccggttttaccccgttaacccggggtttcccgtttaaccggttacccggttaaccggggtacgggggtaccccgggggttaccgttccgggggaaacccgtaaaccgggggtaacccggg

SEQ ID NO: 82617 - DNA, 773 bp, Homo sapiens
  misc_feature: GYAE6OF01EDJM1.12.14.B03.1.454.CMB.1.raw
  modified_base (764)..(764): a, c, t, g, unknown or other
  misc_feature (764)..(764): n is a, c, g, or t
  modified_base (768)..(768): a, c, t, g, unknown or other
  misc_feature (768)..(768): n is a, c, g, or t
  modified_base (770)..(770): a, c, t, g, unknown or other
  misc_feature (770)..(770): n is a, c, g, or t
  modified_base (772)..(772): a, c, t, g, unknown or other
  misc_feature (772)..(772): n is a, c, g, or t
tcagatacgacgtacacgaccggtgctcgatttagtgtgagtagttccggcggggggggaggcttggttcggcctggcgggtccctgagactctcctgcgcagcctctggatttcctttttgaggtatttttgccatgcactgggtccggcaagcgtccgggggagggcctgggagtgggtctacaaacaattacttggaatagtgctaccatagcctacacagactccgtgaagggccattcatcacttctagagacaacgccgaagaacctcctagatctgcagatgaacagtctagaacgacctggacggaccaccgggtccccttggttacttttcgttacggttaacgaaaacggggtcctcgttaggttacgaagggtacgttggggtactttggaccgtccgtcgggaccccgtaaggggtacccgttggtccgccggtcctcccgtacgaccgtccctaccgaacccgaaacgggtcccctaacggttcccggttcccctttccccccggtacggtcccctaaccccgttcccctaacccgaacgtaaccggtccctaacccgttccgggtacgggggaccaccggtaaccggcccgggtccccggtcgggaccgtccggtcccggttacgggtaccgtaaaccgggtacctttaacccgttacccgttaccggttaccgttaacgttccggtacgggaccgggtcggggccgttaacgggaccggaaacgggtccgaaccgttaacgtacgacgngacngngng

SEQ ID NO: 82618 - DNA, 572 bp, Homo sapiens
  misc_feature: GYAE6OF01CAB3F.12.14.B03.1.454.CMB.1.raw
  modified_base (442)..(442): a, c, t, g, unknown or other
  misc_feature (442)..(442): n is a, c, g, or t
tcagatacgacgtacacgaccggtgctcgatttagtgtgagtagtttgagtttgggggaggcttggtacagcctggggggtccctgagactctcctgtgcagcctctggattcacctttagcaactatgccatgagctgggtccgccaggctccagtgaaggggctggagtgggtctcaggtattagtggtagtggtggtagcagatactacgcagactccgtgaagggccggttcagcatctccagagacaattccaaagaacacgctgtatttgcatatgaacagcctgagagccgagacacggcgtatatactgtgcgaagcttaagcggttaccggctacgagttggggagcggacgggttcgacccgtgggccagggaaccctggtcaccgtctctcagccctccaccaacggcccagtcgtccttccccgcggccnccctcctccaacgacgcaccgtcgcggggccacgacgccggccctgggctcgccgtcggtacgaacggtaccttaccgttccgtacgttcgtactccgtaggacggccgggctacggcgaacggcgtacg

SEQ ID NO: 82619 - DNA, 709 bp, Homo sapiens
  misc_feature: GYAE6OF01BR18G.12.14.B03.1.454.CMB.1.raw
  modified_base (213)..(213): a, c, t, g, unknown or other
  misc_feature (213)..(213): n is a, c, g, or t
  modified_base (284)..(284): a, c, t, g, unknown or other
  misc_feature (284)..(284): n is a, c, g, or t
  modified_base (697)..(697): a, c, t, g, unknown or other
  misc_feature (697)..(697): n is a, c, g, or t
  modified_base (705)..(705): a, c, t, g, unknown or other
  misc_feature (705)..(705): n is a, c, g, or t
tcagatacgacgtacacgaccggtgctcgatttagtgtgagtagttccgcggggggggagcttggttcggcctggcgggtccctgagactctcctgcgcagcctctggatttcctttttgaggatttttgccatgcactgggtccggcaagctccgggggagggcctggagtgggtctcaacaattacttggaatagtgctaccatagcctanacagactcgtgaagggccattcatcacttcagagacaacgccgagaactcctgtatctgcagatacgaacngtctgacgacctgacggacaccggcctgttatttcgtacgttacgaaacgggcttcgtggttcgagggtacgtcggggctttcggactccgtcgggcccgaacgggtacccgtggtccgtcggtcctcctcgacgtcccaccgaaccgaaccgggccctacgttcccggtccttcccccgtcggcccctacccttcccgtaaccgaacgtacgccgtacccgttcggtaccgggggaccaaccggaccggcccgggtccccgtacgggtccgtaccggtcccggttacgggtacccgtaacggttaccgtttaacccgtttaccggttaccgttaccggttaccgttcggtacggtacgggtccgggtccgttacggggaccggtaacgggacccgtacgtaacgttaccggngtacgcgngcgc

SEQ ID NO: 82620 - DNA, 657 bp, Homo sapiens
  misc_feature: GYAE6OF01DLN7T.12.14.B03.1.454.CMB.1.raw
  modified_base (184)..(184): a, c, t, g, unknown or other
  misc_feature (184)..(184): n is a, c, g, or t
  modified_base (268)..(268): a, c, t, g, unknown or other
  misc_feature (268)..(268): n is a, c, g, or t
  modified_base (313)..(313): a, c, t, g, unknown or other
  misc_feature (313)..(313): n is a, c, g, or t
tcagatacgacgtacacgaccggtgctcgatttagtgtgagtagttccgcggggagctctgggagaggagccccagccctgagattcccaggtgtttccattcagtgatcaacactgaacacagaggactcatcatggaattgggactgacctgctattttccttttggctattttaaagggtntccagtgtgaagtgcacttggaacaggtcggggggagcttgggttcggcctgggcgggtccctgagactctcctgcgcagcctntggtatttcctttttgaggtattttgccatgcacgtggggtccgnaaggccgtccgggggaggggcctgggagtggggtctcaaactaattacgttggaaatggtgacctaccaatacgccctaacacgagacctccggtaggaacggggcctatttcgaactctacttacgtaagacgaaccaaccggaccgaacgtaacctcccgttagtacttcgtgacagatagaacagtcgtaggaacgtaccgtaggacggaccgaccggtcccttgttactttcgttagttacgaaaacggggtcttacggttcggttacggaggggtagttcggggttcgtttacgtaccgttaccggtccgggacccggtacgggtacccggttccgggg

SEQ ID NO: 82621 - DNA, 813 bp, Homo sapiens
  misc_feature: GYAE6OF01CGIU0.12.14.B03.1.454.CMB.1.raw
tcagatacgacgtacacgaccggtgctcgatttagtgtgagtagttccgcggggagctctgggagaggacgccccagccctgagattcccaggtgtttccattcagtgatcaacactgaacacagaggactcatcatggaattgggactgacctgcttattttcctttggcttagttttaaaggtgtccagtgtgaagtgctacgttggaacgagggtcggggggaggtcgttgggtcggccgtcgggccgggtccctgacgctccgtccgtgcgcacggtcctcgtcggtacttttccgttttagaggttattttcgcctattcgccgtacggtcgggtcccggacacgggccgggtacccggggggaggggtccgttgggtaggtcgggttcctaactaaaccgttaagttaccgttagggtaaattcgggtactaccttaaccgaagtaccggccctaacgactacgacccgtacggtcggaacgggtacctattaccacgttccgtacttacgaagtaacgaacccgtaaccggaccggaactaacccgttccgtaacgttataccgttggaaccgtaagtacgttaacgaaccctaggttaccgtacgaacggtcccgtaacgggaccgggaccggttaccccggtcttagtttacgtttaccggtaagttaaccggaaacgggttccttagggtcggttacggggtaacggttcggggttacggggttccctttaaccgggtcccccggggttaccccggggtaacccggttaaccccggggtacccggtttcgggtacccccgggg

SEQ ID NO: 82622 - DNA, 763 bp, Homo sapiens
  misc_feature: GYAE6OF01D3SQX.12.14.B03.1.454.CMB.1.raw
  modified_base (243)..(243): a, c, t, g, unknown or other
  misc_feature (243)..(243): n is a, c, g, or t
tcagatacgacgtacacgaccggtgctcgatttagtgtgagtagtttgagtttgggggaggcttggtacagcctggggggtccctgagactctcctgtgcagcctctggattcacctttagcaactatgccatgagctgggtccgccaggctcagtgaaggggctggagtgggtctcaggttattagtggtagtggtggtagcagactacgtacgcagactccgtaggaacggggtccggttnagctactcctccaagacgaactaacttaccaaagaacacgtctagttatttgacatagtagaacacgcctaggacgacgaccggaaggaccgaccggacgtaatacgttactgtacgacgtaacgtcgttaggacggttaccgacgtacgtagttggggacgcgtacgtcggtaccggacccggtggggaccgaacgggtaacccgtgggtacctacccgttctcccgtacgtaccgtccccgtacccgaacccgtaaccgggaccctaacggttcccggttaccccgttcccccgtaccggtacccctacccccgttccctaaccgaacggtaccgtcccgtaacccgttccgggtacgggggacccaccggaccgggcccgggtcccggtacgggcccgtcgggtcccgttacgggtaccgtaaccggttaaccctttaccgtttaccccgttaccggttaccgttcgtacgtacgggtacgggtaccgggtaccggtcgggtaccggaggtacccgg

SEQ ID NO: 82623 - DNA, 718 bp, Homo sapiens
  misc_feature: GYAE6OF01CYNG9.12.14.B03.1.454.CMB.1.raw
  modified_base (462)..(462): a, c, t, g, unknown or other
  misc_feature (462)..(462): n is a, c, g, or t
  modified_base (711)..(711): a, c, t, g, unknown or other
  misc_feature (711)..(711): n is a, c, g, or t
  modified_base (715)..(715): a, c, t, g, unknown or other
  misc_feature (715)..(715): n is a, c, g, or t
  modified_base (717)..(717): a, c, t, g, unknown or other
  misc_feature (717)..(717): n is a, c, g, or t
tcagatacgacgtacacgaccggtgctcgatttagtgtgagtagttccggcgggggggggaggcttggttcggcctggcgggtccctgagactctcctgcgcagcctctggatttcctttttgaggtatttttgccatgcactgggtccggcaagcgtccggggagggcctggagtgggtctcaacaattacttggaatagtgctacatagcctacacagactccgtgaagggcctattcatcacttctagacgaacaacgccgaagaacctccctgtactctgacagtatagaacagtctagacgacctaggaggaccgaccggtcccttagttacgtttacgtacggtttacgaaaacggggtctcgttacgggttacgtaagggtaggtgggtcgtttcgaccgtccgtcgggtaccccgaacgggtacccgtcgggtccgtccggttccgtccgtccnccgtaccgtacccgaaccgaaccgggcccgtcgtcccggttccccttcccccgtcgaccccctaccctccctaccgaacgaccgccgtacccgtccggtcggggtaccaccggcggcccggcccggtcgggtcgtccggtccgtacggtaccgaacggttaccttacccgtttacccgtacggttccgtacgtccgtacggcggtccgggtcggtacggaccgggaacgggcgaaccgtagtaccgtgncgtngng

SEQ ID NO: 82624 - DNA, 883 bp, Homo sapiens
  misc_feature: GYAE6OF01BPSDW.12.14.B03.1.454.CMB.1.raw
tcagatacgacgtacacgaccggtgctcgatttagtgtgagtagtttgagtttgggggaggcttggtacagcctgggggggtccctgagactctcctgtgcagcctctggattcacctttagcaactatgccatgagctggggtccgccaggctccagtggaaggggctggagtgggtctcaggtattagtggtagtgggtggtagcagatactacgcagactccggtggaacgggccggttcagcatctccagacgactaacttccgaagaacacgctgttatttgacatatagaacacgtaccgtaggacggacggaccggaagggaaccgaccgggtaccggttaattaagtttacgttagggtacggacggtaaggtaccgtttaacgggtaccgggttaacccgggtcgttaacggtaggttacggggggacggccggtacgttcggggttacccggacccgggtcgggggacccggaacgggtaccccgtgggtacctacccgttcctcccgtaccaccggtcccctacccgaacccgacgggtccctacgtcccggttaccccttccccgtccggccctacccccgtccctaaccgaacgtacgaccccgtaaccgttccggggtacgggggacccgaaccggtaaccggggtccccgggtaccccggttcggggggaccttacccgggttccccgggtttacggggtaaaccccggtaaaaccgggggtttacccccttttaaccccgggtttttacccccgggttaacggtttcccgggtttaaacgttccccggggtttaacggggacccggggggttacccgggggttacccggttaacgggggaaaccccggtaaaccggggtacccgggg

SEQ ID NO: 82625 - DNA, 752 bp, Homo sapiens
  misc_feature: GYAE6OF01DR01Q.12.14.B03.1.454.CMB.1.raw
  modified_base (744)..(744): a, c, t, g, unknown or other
  misc_feature (744)..(744): n is a, c, g, or t
  modified_base (748)..(749): a, c, t, g, unknown or other
  misc_feature (748)..(749): n is a, c, g, or t
  modified_base (751)..(752): a, c, t, g, unknown or other
  misc_feature (751)..(752): n is a, c, g, or t
tcagatacgacgtacacgaccggtgctcgatttagtgtgagtagttccggcgggggggggaggcttggttcggcctggcgggtccctgagactctcctgcgcagcctctggtatttcctttttggaggtatttttgccatgcacgtgggtccggcaagccgtccgggggagggcctggagtgggtctacaaactaattacgttggaattaggtgacctaaccgatacgcctaacacagaccgtccggtaggacgggcctattcatctacttcgagacgaaccgaaccgccgaagaacccttccgtgtaactctcgacaagatacgaaacgtagttcgtaggacgtaccgtggaacggaccgaccggtcctttagttaacttttcgtacggttaacggaaacgggtccttacgttgggttaccgaaggggtcgttggggttcctttaggacccgtccggtcgggaccccggtaacgggtaacccggtcggtcgtccggtcctcctacgaccgtcccgtaaccgaccggaccggtccctacggtccgttccccgttcccgtccggtaccctaccccgtcctaacgaacggacctaccgtacccggtcgggtaccgggccaacggccgggtacccgtccgggtcgtccgtccgtaccggttacggaccgttaacgtccttaccgttccgtacgttcgtacgttcgacgtcgggccggtcgcggtacgacggaccgtagacgttaggnacgnngnn

SEQ ID NO: 82626 - DNA, 959 bp, Homo sapiens
  misc_feature: GYAE6OF01D1FSP.12.14.B03.1.454.CMB.1.raw
  modified_base (222)..(222): a, c, t, g, unknown or other
  misc_feature (222)..(222): n is a, c, g, or t
tcagatacgacgtacacgaccggtgctcgatttagtgtgagtagttccgcggggagctctgggagaggagccccagccctgagattcccaggtgtttccatttcagtgatcaacactgaacacagaggactcatcatggtaattgggactgacctgcttatttttccttttggtacttaagttttaaagggtgtccagtgtagaagtgctacgttggaacgngggtcggggggaggtcgtttgggttccggccgtcgggccgggtccctgacgtaccttcctccgtcggcgcgacgcccttcgttggtactttttccgtttttaggtaggtttacgtttttcgcccgtaagttcggccgttaaccgggttcggggtaccccggacgtaacggggtcccggggttccgggggggaacgggggtccggttgggggtaacgggttcggggttacccttaaccgaaacgttaaacgttttacggttacggaagttacggtcgtaccttaacacgttaacacccgtaactaaccgacggtaaccgtccggtaacgggaaacggggtccctaagtttaccgactttccttaaccgttacgtaaccgtaacggaaccgtaaacccgggtaccggtaaacccggtaacccgttacccggttagttaaccttccggtacgtaccggtaacgtaaccgtcggtaaaaccgtcggttaccgtaacggtaaaccggttaaccgtacgggaaccggtaacccgtaacccgggtttacctttacggttttacgtttaacccgttaacgggtttaaaccggtaaaacggggttccgtttaaccgggttacgggtttaaccgggtaacgggggtttcgggtttaccgggggttcctttaaccgggttccccggttacccggggttaacccggggtaaccccgggttaacccggggttaaccccggtttccggggg

SEQ ID NO: 82627 - DNA, 632 bp, Homo sapiens
  misc_feature: GYAE6OF01BF1KF.12.14.B03.1.454.CMB.1.raw
  modified_base (463)..(463): a, c, t, g, unknown or other
  misc_feature (463)..(463): n is a, c, g, or t
tcagatacgacgtacacgaccggtgctcgatttagtgtgagtagttccgcgggggagctctggggagaggagccccagccctgagattcccaggtgtttccattcagtgatcaacactgaacacagaggactcatcatggaattgggactgacctgctattttcctttggctattttaaagggtgtccagtgtgaagtgcacttggaacaggtcggggggaggcttggttcggccgtggcgggtccctgagactctcctgcgcagcctctggattcctttttgaggtattttgccatgctacgtgggtccggcaagccggtccgggggaggggccgtgggaggtgggtctacaaactaattacgttaggaattagtgctacatacgacctacacacgactccggagaacgggctatcatcacttcaagagaaccaacgacgacgaacctcccgtagtactcgncagatagaactagtctaggagaaccgtggaacggaacctaccgggtccctaggtttacgtttcgtagttaaccggaaaagggtcttacggtgggttacgaaggggttagtcgggggttactttcggtacgttcccggtacgggaccccgtaggggtaccccgttcgggg

SEQ ID NO: 82628 - DNA, 642 bp, Homo sapiens
  misc_feature: GYAE6OF01DJFVS.12.14.B03.1.454.CMB.1.raw
  modified_base (273)..(273): a, c, t, g, unknown or other
  misc_feature (273)..(273): n is a, c, g, or t
  modified_base (636)..(640): a, c, t, g, unknown or other
  misc_feature (636)..(640): n is a, c, g, or t
  modified_base (642)..(642): a, c, t, g, unknown or other
  misc_feature (642)..(642): n is a, c, g, or t
tcagatacgacgtacacgaccggtgctcgatttagtgtgagtagttccgcggggggggagcttggttcggcctggcgggtccctgagactctcctgcgcagcctctggatttcctttttgaggtatttttgccatgcactgggtccggcaagctccggggagggcctggagtgggtctcaacaattacttggaatagtgctaccatagcctacacagactccgtgaagggccattcatcacttctagagacaacgccgagaactccctgtacntgcagatgaacagtctgagacctgagacacggcctgttattctgttacgaaagggtctcgtggttcgagggagtgggtctttgactccgtggccccgtaacgggaacccgtggtccgtccggtcctcctacgcgtcccctacgacccgaacgggccctagtcccggttcccttcccccgtcggacccctacccctccctaccgaaacgacgtccacccgtcggtcggggacctaccgacggccccgggtcccgtcgggaccgttcgcccgttcggtaccgaacggtaccgttaccctttacccggtacgttccgtacttacgcggtacggccgggtctgggaccgtaagggccgcgaagtcgnnnnngn

SEQ ID NO: 82629 - DNA, 650 bp, Homo sapiens
  misc_feature: GYAE6OF01A89L3.12.14.B03.1.454.CMB.1.raw
tcagatacgacgtacacgaccggtgctcgatttagtgtgagtagttccgcggggagctctgggagaggagccccagccctgagattcccaggtgtttccattcagtgatcaacactgaacacagaggactcatcatggaattgggactgacctgctattttcctttggctattttaaagggtgtccagtgtgaagtgcacttggaacaggtcggggggagcttggttcggcctgggcgggtcctgagactctcctgcgcacgcctctggtatttcctttttgagtattttgcctatcgcacgggtcgggtccggcaaggccggtccgggggaggggcctgggaggtgggtctcaactattacttggaattgtgctacagtagccctacacagactccggtgaacgggcctattcactacacttcgtaagacgtaaccaaccggccgaaacgtaaccgtccctagttactacgtcgacagtactacgaacgtagtcctaaggaacgtacccgtaggaccggtaccaccgggtcccttggttactttccgtaggttaccgaaaggggtccttacggtcgggttacggaggggttagttcggggtcctttaggacccgttccgggtcgggacccgaagggttccccggtcggg

SEQ ID NO: 82630 - DNA, 978 bp, Homo sapiens
  misc_feature: GYAE6OF01DY27U.12.14.B03.1.454.CMB.1.raw
tcagatacgacgtacacgaccggtgctcgatttagtgtgagtagttccgcggggagcgtctgggagaggagccccagccctgagattcccaggtgtttccattcagtgatcaacactgaacacagaggactcatcatggaattgggactgacctgctattttcctttggcttaagttttaaagggtgtccagtgtgaagtgcacttggaacaggtcgggggagcttggtcgcctggcggtccctgacgactcgtcctagccgcacgtcctagtggtactttaccgtttttaggaagggttatttttacggccctaagttcggacccgtaacggttccgggggtaccccggacgaaaacgggtcccggttaccgggggggaacgggggtcccgtaggggtaacggttcgggggttaccctacgtaaaaccgtaaacgttttaaccggttagggaaaacgtttaggtacggaacctttaacccgaaagttaaccggtaaccccttaaaccgaaccgtaaaggtaaaccccgtttccccggggttaagggaaaaccgggggtaccccgttaaacttttacccgaaaacgtttaccccgtaaacttttaacccgttaaacggaaccggtaaacccgtaaacccgggaaccccgggtaaacgtaaacccgttacccccgttaggttaaccttaccgttacggaaccgaaaggtaacgtaacggtaaaacccgtaggttacccgtagggtaaaccgaacccgttaagggaacgggtacccgaaacccggggtcccctttaaggttaaccgttttcgttaaacgggtttaaaccgaaaaacgggggttcctttaaggttaccgggtttaacgggtaacgggggttacggttaaccggggggtttacttttaaccgggaacccgtttaccccgggttaccggggtaacccccggtaaccgggggttaacccccggtttaccggggg

SEQ ID NO: 82631 - DNA, 603 bp, Homo sapiens
  misc_feature: GYAE6OF01AORCU.12.14.B03.1.454.CMB.1.raw
  modified_base (597)..(600): a, c, t, g, unknown or other
  misc_feature (597)..(600): n is a, c, g, or t
  modified_base (602)..(603): a, c, t, g, unknown or other
  misc_feature (602)..(603): n is a, c, g, or t
tcagatacgacgtacacgaccggtgctcgatttagtgtgagtagttccgcgggggggggaggcttggttcggcctggcgggtccctgagactctcctgcgcagcctctggattcctttttgaggattttgccatgcactgggtccgcaagctccggggagggcctggagtgggtctcaacaattacttggaatagtgctaccatagcctacacagactccgtgaagggccattcatcacttctagagacaacgccgagaactccctgtatctgcagatgaacagtctgagacctgaggacacggccctgtatttctgttcaaaaggggctcgtggttcagggagtgggctttgactccgtgggccccaggggaaccctggtcgcggtctcctcacgccctcccgacccgaacgggcccctactccggtccttccccccgtcggccctacccctccccttacccgaacgacgcccgaccctccgtcgggggacctacgacggcccggcccgtcgggtcctcgcccgtacggtcgaacggtaccttacttcccgtacgtccgtatcgtaggacgcgggcgtggcgacggcgcgatacgnnnngnn

SEQ ID NO: 82632 - DNA, 930 bp, Homo sapiens
  misc_feature: GYAE6OF01AHVZZ.12.14.B03.1.454.CMB.1.raw
tcagatacgacgtacacgaccggtgctcgatttagtgtgagtagttccgcggggagctctgggagaggagccccagccctgagacttcccaggtgtttccattcagtgatcaacactgaacacagaggactcatcatggaattgggactgacctgctattttcctttggtcttattttaagggtgtccagtgtagagtgcacgttggaacgaggtcggggggaggtcgttgggttccggccgtgggtccgggtcccctggacgtacctccgtccgtggccgcgacgtccttcgtcggttacttttcccgttttttggagggttactttttcggaccctattcggaccgtacggttcggggtccccggacgaaccgggtccgggtacccggggggacggggtccggttaggggtacgggttcggggtacctaccgtaaaacgttaacgttttacggttagggtaaagttacggtacggtaccgtaaccgtaacgttaccgtacccctaacaaccgaacgtaccgttaccggtagggaaccgggtacctaacttccgtacttaccgtaccgtttacgtaacgaaccggtaaccgtaacccggaccccggtaaacttaaaccccgttccccgttaaggttaaccttccgtacgaccgtaaacgtacgtacggtaaaccgtaggttaccgtaacggaacgtacccggtacgggaacccgggtacccgttaacccgggtccctttaaggtttaccgtttacgttaaccggtttaaccggggtaaaacggggttccgtttaccggttcggggtttacccggtaaggggggttccggtttccggggggtttacccttttaccggggtacccgtttaccccgggggttaccggggtaacccccggttaaacccggggggtacccggtttcccgggggg

SEQ ID NO: 82633 - DNA, 946 bp, Homo sapiens
  misc_feature: GYAE6OF01EC6P6.12.14.B03.1.454.CMB.1.raw
tcagatacgacgtacacgaccggtgctcgatttagtgtgagtagttccgcggggagctctgggagaggagccccagccctgagacttcccaggtgttccattcagtgatcaacactagaacacagaggactcatcagtggaattggactgacctgcttattttcctttggcttagtttaaggtgtccagttgtagaagtgctacgttggaacgagggtcggggggagtcgtttcgggttcgccgtcgggcccgggttaccctgacgacctctccgtgccgcgtacgccttgtcgttcttttccgttttagacggttattttcgacccgtagttcggacctaccggttcgggtaccccggtagtaaaccgggtccggggtcccgggggggacgggtcccggttgggggtaggttccgggttaccggtaaccgtaaaacgttaagtttaccggttaaggtaaacgttcgtaccggtacccttaccgtaacgtaaccggtacccttaacccgtaaccgtaaccggtacccgttaccgggtaacgggtaacccgggtacccttaacttcccgttaacgttcccttaacggtttaaccctaacgggaacccgtaacccgtaaccgggtacccgtaaaccggttaacccttacccgtttagttaacctccgttacgacgtaacggtactaccggaaaccgttacgttacccgaggggtaaccctaacggttagggaacccgggtaaccccggttaaccggttacccgtttacgtttaccgttttacggttaacccggttaaaccgggtaaacgggttcccgttaaacgggttcgggtttaaccgggtaacgggggttacggtttcccgggggttacgtttttaacccgggaccccggttacccgggttacccggggaaacccgggtaccgggttaacccccgggttcccggg

SEQ ID NO: 82634 - DNA, 709 bp, Homo sapiens
  misc_feature: GYAE6OF01EYCA8.12.14.B03.1.454.CMB.1.raw
  modified_base (240)..(240): a, c, t, g, unknown or other
  misc_feature (240)..(240): n is a, c, g, or t
tcagatacgacgtacacgaccggtgctcgatttagtgtgagtagttttgagtttgggggaggcttggtacagcctgggggggtccctgagactctcctgtgcagcctctggattcacctttagcaactatgccatgagctgggtccgccaggctccagtgaaggggctggagtgggtctcaggtattaggtggtagtggtggtagcagatactacgcagactccggtgaagggccggttnagcatctaccagagactaattaccaaagaaccacgctagttatttgctatagtagaacacgcctggagacggaccggaacggaccgaccggacgttaagttatttaacgtgtagacgtaacgtacgttaaggtccgggttaccggacgtaacgtaggttgggggacgcgtacggtcggttccgacccggtcggggaccgaacgggtaacccgtcggtccgtaccgtccttcccgacgtacgcccctacgaacccggacgggtaccctagttcccgttcccttcccccgtcggaccccctacccttccccgtaaccgacggtcccgtaccgtaacccgttccgggaccggggacccaacgtccgggcccggtacccgtcgggcgtccgccggtcggtaaccgaacggtaccttaccgttcccttacggtccttacgtccgtagggtcggcgggtacgcggacgaagggcg

SEQ ID NO: 82635 - DNA, 858 bp, Homo sapiens
  misc_feature: GYAE6OF01EDJVA.12.14.B03.1.454.CMB.1.raw
tcagatacgacgtacacgaccggtgctcgatttagtgtgagtagttccgcggggagctctgggagaggagccccagccctgagattcccaggtgtttccattcagtgatcaacactgaacacagaggactcatcatggaattgggactgacctgctattttccttttggcttaagttttaaagggtgtccagtgtgaagtgcacgttggaacgagggtcggggggagtcgttgggttccggccgtgggccgggtcccgtgacgtacctcctcctgccgcacgtccctcgtggttactttccgtttttaggaggttactttttcggacctagttcgtaccgtacggttcggggtaccggacgtaacggtccgggtaccggggggacggggtcccgtaggggtacggttcgggtacctaacgtaaacgttaaacgtttacggttaaggtaacgttagttccggtacctaaaccgtaacgtaccggtacccttaaaccgaacgtaacggtaacccgttaccgggagggtaaacccgggtccgtattaaccgacttacccgtaacgtttacgtaacggaacgaaacccgaaccggtaaccccggtaaacgtaaacccttcccgtagttaaccgtcgtaccgacgtaaagtacgtaacgtaacgtacgttacgtacggaacgtaccggtaggaaccgggtacctaccggttaccgttagtttaccgttacgttaacggtaacggtaaacgggttcttacgggttacggtttagggtacggggttgttaccggggtttctttacccgggtcccgttacccgggtacccgggaacccggttacccggggtcccggttacccgggg

SEQ ID NO: 82636 - DNA, 684 bp, Homo sapiens
  misc_feature: GYAE6OF01ET2U1.12.14.B03.1.454.CMB.1.raw
  modified_base (517)..(517): a, c, t, g, unknown or other
  misc_feature (517)..(517): n is a, c, g, or t
tcagatacgacgtacacgaccggtgctcgatttagtgtgagtagttccgcggggagctctgggagaggagccccagccctgagattcccaggtgtttccattcagtgatcaacactgaacacagaggactcatcatggaattgggactgacctgctattttcctttggcttatttaagggtgtccagtgtgaagtgcacgttggaacgaggtcggggggaggtcgttgggttcggcctgggccgggtccctgacgcctctcctgcgcacgcctcgtggtacttttcctttttggacggttatttttcgcctattgccgtacgttcggggtaccggcgtaaggccggtccgggggggacggggtccgtgggaggtcgggtctacaaactaatttacgttaggtaatggtcgctaaccatacgacctacacacgtaccgtccggtaggaacgggccgtattcgatcctacttcgagacgaacgacggcctaacgtaacctcccgtagttactcgtacgnaagtactacgaacgtgttactaggaacgtaccgtaggacggtaccgaccggtccttagttactttcgtagttaacggtaaacgggtcttacggttggttagggacgggtaggtacggggttcttcggtaccgtcccggacgggtacccggtaccgggtccgttcggg

SEQ ID NO: 82637 - DNA, 622 bp, Homo sapiens
  misc_feature: GYAE6OF01E2UBR.12.14.B03.1.454.CMB.1.raw
  modified_base (616)..(617): a, c, t, g, unknown or other
  misc_feature (616)..(617): n is a, c, g, or t
  modified_base (619)..(620): a, c, t, g, unknown or other
  misc_feature (619)..(620): n is a, c, g, or t
  modified_base (622)..(622): a, c, t, g, unknown or other
  misc_feature (622)..(622): n is a, c, g, or t
tcagatacgacgtacacgaccggtgctcgatttagtgtgagtagttccgcggggggggaggcttggttcggcctggcgggtccctgagactctcctgcgccagcctctggattcctttttgaggatttttgccatgcactgggtccggcaagccgtccgggggaggggcctggagtggggtctcaaacaattacttggaatagtgctaccatagcctacacagactccgtgaagggccattcatcacttcagagacaacgccgagactcctgtatctgcagatgaacagtctgacgactgaggacacgcctgtatttctgttacgaaaggggctctggttcagggagtgggctttgacgttccgtcgggcccgacggggaacccgtggtcgtcggtctccgtcacgccctccaccgacggcccagttccggtccttcccccgtggccctacccctccctaccaacgacgcctaccgtcgtcggggccacgacggccggtcccgcgggctccggccgttcgggactaaaccggtaccttacccttccgttaccgtaccgttacgtccgtaggacggccgggtcgtagggaccgaacggggtcgaccgtaagtacganncnngn

SEQ ID NO: 82638 - DNA, 818 bp, Homo sapiens
  misc_feature: GYAE6OF01DX4V8.12.14.B03.1.454.CMB.1.raw
  modified_base (808)..(808): a, c, t, g, unknown or other
  misc_feature (808)..(808): n is a, c, g, or t
  modified_base (813)..(813): a, c, t, g, unknown or other
  misc_feature (813)..(813): n is a, c, g, or t
  modified_base (816)..(816): a, c, t, g, unknown or other
  misc_feature (816)..(816): n is a, c, g, or t
tcagatacgacgtacacgaccggtgctcgatttagtgtgagtagttccgcggggggggaggcttggttcggcctggcgggtccctgagactctcctgcgcagcctctggattcctttttgaggtattttgccatgcactgggtccggcaagcgtccggggagggcctggagtgggtctcaacaattacttggaatagtgctaccatagcctacacagactccgtgaagggccgattcatcacttcagagacaacgccgagaacctccctagtatctgcaagatagaacagttctagagacctggagaccgacggtccctgttactttcgtcggttacgaaaacggggtcttacgtggttacgagggtagttcggggtctttgaccgttccgtacgggccctaacggggtaacccgttcggtccggtccgggtcttccccgtacgacgtccccttacccggaacccgaaaccggggtccccgtaacggtttcccgggttccccctttacccccccggtacgggtacccccgtacccccgttacccgttaccccgaaaagggtaccgaccccgttaacccgggttcggggttacccgggggaccccgttaaccggaccggggaacccccggggttcccccggtagggggtacccgttccggtaccccggttacgggttaacccgaaaccggggtttaccctttaaccccgtttacccggtttaccggttaccgggttacgttaccggtacggtacggggtcccgggtaacgcggggttaccgaaacgggtccgaccgtaaagttccgganagtcncgngc

SEQ ID NO: 82639 - DNA, 790 bp, Homo sapiens
  misc_feature: GYAE6OF01D0HWI.12.14.B03.1.454.CMB.1.raw
  modified_base (219)..(219): a, c, t, g, unknown or other
  misc_feature (219)..(219): n is a, c, g, or t
  modified_base (249)..(249): a, c, t, g, unknown or other
  misc_feature (249)..(249): n is a, c, g, or t
  modified_base (279)..(279): a, c, t, g, unknown or other
  misc_feature (279)..(279): n is a, c, g, or t
  modified_base (785)..(785): a, c, t, g, unknown or other
  misc_feature (785)..(785): n is a, c, g, or t
tcagatacgacgtacacgaccggtgctcgatttagtgtgagtagttccgcggggggggagcttggttcggcctggcgggtccctgagactctcctgcgcagcctctggtatttcctttttgaggtatttttgccatgcacgtgggtccggcaagcgtccggggagggcctggagtggtctcaaactaattacttggaatagtgctaaccatagccctanacagactccgtgaaggccattcatcacttnagacgacaacgccgaagacctccctagtanctgcagatagaacagtctagaagaccgtagacggaactaccggtcctagttacgtttacgtacggttaacgaaaggggtccttcgttcgggtttacgaaggggtaggttcggggttaccgtttcggaccgttccggtacgggccccggtaacggggtaacccgttcggtccggccggttccttcccgtccaccggtaccctaccccgtaaaccggaaccgggtaccccttacgtccggtttccccttccccccggtaccggtcccctaacccccgttaccccgttaacccgaaacggtaccgtaccccgtaacccgtccgggttacggggacccaccggtacgggtccccggtcccgggtacgggtaccgtccggtccgttacgggtaaccgtaaccggttacctttacccggtttaccttacgggttcttaccgtacggtcgggtaacgggccggggtactcgggtacgaccgggtaccgtaaccggttacgtacgactgtaacngcgtg

SEQ ID NO: 82640 - DNA, 832 bp, Homo sapiens
  misc_feature: GYAE6OF01BM3PF.12.14.B03.1.454.CMB.1.raw
  modified_base (820)..(820): a, c, t, g, unknown or other
  misc_feature (820)..(820): n is a, c, g, or t
  modified_base (827)..(827): a, c, t, g, unknown or other
  misc_feature (827)..(827): n is a, c, g, or t
  modified_base (830)..(830): a, c, t, g, unknown or other
  misc_feature (830)..(830): n is a, c, g, or t
  modified_base (832)..(832): a, c, t, g, unknown or other
  misc_feature (832)..(832): n is a, c, g, or t
tcagatacgacgtacacgaccggtgctcgatttagtgtgagtagttccggcggggggggaggcttggttcggcctggcgggtccctgagactctcctgcgcagcctctggtatttcctttttggaggtatttttcgcctatgcacgtcgggtccggacaaggccgtccgggggaggggcctgggaggtgggtctacaaactaattacttaggaatagtgctaccatacgcctacacagactccgtaggaacgggcctattcatcctacttctaagacgaccaacgccgaagtaaccttcctagtactccgtgacaagatacgaactcgtctaggacgtaccgtggaacgaccgtaccggtccctttagttactttcgtacggttaaccgaagggtccttcggtaggttacggagggtcggtcggggttactttacggaccgttccgggtacccgggaccggtaaccgggtacccgttcgggtcccgtccggttcctccgtaccgtacggacccctaccggaaccggtaaccgggcccctacggttcccggttccccttcccggtacccggtacccctacccccgttacccgtaaacccgacggtacccgtaccggtacccgtaccggggtccgggtaacccgcccggttacccgggcccgggttacccggttccggggtacccttcccggtaccgggttacggtaaccggtaaaccggtttaccgtttaacccgttaccggtttaaccgtcgttaaccggtcggttacgggaccgggtccgggtacgacgggtaccgacgggaccgtacggacgtacggntacgtancgngn

SEQ ID NO: 82641 - DNA, 740 bp, Homo sapiens
  misc_feature: GYAE6OF01CYKP2.12.14.B03.1.454.CMB.1.raw
  modified_base (295)..(295): a, c, t, g, unknown or other
  misc_feature (295)..(295): n is a, c, g, or t
  modified_base (311)..(311): a, c, t, g, unknown or other
  misc_feature (311)..(311): n is a, c, g, or t
  modified_base (699)..(699): a, c, t, g, unknown or other
  misc_feature (699)..(699): n is a, c, g, or t
  modified_base (736)..(736): a, c, t, g, unknown or other
  misc_feature (736)..(736): n is a, c, g, or t
tcagatacgacgtacacgaccggtgctcgatttagtgtgagtagttccggcggggggggggaggcttggttcggcctggcgggtccctgagactctcctgcgcagcctctggtattcctttttgaggtatttttgcccatgcacgtgggccggcaaggccgtccggggagggccctgggagtgggtctacaaactaattacttaggaatagtgactacatacgcctacacagtacctcgtaggaacgggccgtattcatcctacttcagagaaccaccgcgaagacctcctgtancgtgcagatacgaacnggtctgacacgtagacggacaccggtcctgttactttcgttaggttaacggaaaacgggtcttacgttacgggttacgaggggtaggtcggggttctttacggccgtttaccgtacgggtacccgtaacggggtaacccgttggtaccgtccggtcccgtaccgttaccgaccgtacccgtaccgaaccggaacggtacccgtacgtccgttacccctccccgtcggtaccctacccctacccgtaccgtaacgaccgtcccgtaccgttcggtaccgggaccaacggtaccggtacccggtcccgtacgggtcttcccgtacggtacggtaacgtacgtaccctttacgttaccgtcgttacgtacgtcgcggtcgggtcggtccgnggaacggtaccgtcggtaagacgtacggctaccgtanctgc

SEQ ID NO: 82642 - DNA, 789 bp, Homo sapiens
  misc_feature: GYAE6OF01DEMBZ.12.14.B03.1.454.CMB.1.raw
  modified_base (598)..(598): a, c, t, g, unknown or other
  misc_feature (598)..(598): n is a, c, g, or t
tcagatacgacgtacacgaccggtgctcgatttagtgtgagtagttccgcgggagctctgggagaggacgccccagccctgagattcccaggtgtttccattcagtgatcaacactgaacacagagactcatcatggaagttggactgacctgtcttatttttccgttttggtctttaagtttttaaagggtgttccgtagttgtagaagtgtcgtacgttaggaacgtagggtcggggggagtcgtttgggttccggtccgtcgggtccgggttccccgtggaacgtaccttccgtcccgtggccgcgacgtccgttcgttacggttacgtttttccgtttttaggaggtttacgttttcgacctagtcgcgtacggtcgggtaccggacgtaacgggtccggtaccgggggacgggtccgtgggtaggtcgggtactacaaacttaacgttacgtaggaattggtacacctaccgtaagtaccgtaccctacgaaccgaacgtccgtacggtagggaacggtcctaattacattacctacttacgtaagacgaaaccgacgacccgtaaacgtacccttaccgttagacttacgtnaccgagtaacgtacgaacgttagtcgtaaggaaccgtacgacggaacggtacccgttccggtccgtttaagttactttaccgtaacggttaacgggtaaaaggtccgttacggtcgggttaggacgggttacggttcgggttacctttcggccgtttaccggccgggaacccggtacggggttcccgcggg

SEQ ID NO: 82643 - DNA, 763 bp, Homo sapiens
  misc_feature: GYAE6OF01EV6X7.12.14.B03.1.454.CMB.1.raw
  modified_base (211)..(211): a, c, t, g, unknown or other
  misc_feature (211)..(211): n is a, c, g, or t
  modified_base (760)..(760): a, c, t, g, unknown or other
  misc_feature (760)..(760): n is a, c, g, or t
tcagatacgacgtacacgaccggtgctcgatttagtgtgagtagttccggcgggggggggaggcttgggttcggcctgggcgggtccctgagactctcctgcgcagcctctggtactttcctttttgaggtatttttgccatgcacgtgggtccggcaagcgtccgggggaggggcctggagtgggtctacaactaattactggaattagngctacatagcctacacagactccgtaggaacgggccattcatctacttctagagacaacgccgaacgtaacctcctgtatctgcagatagaaacagtctgagacctaggaggaccgacggtccttagtactttacgtacggttaacgaaaagggtcttacgtaggtttacggaagggtagttcggggttactttcggaccgttccgtcgggacccgaacgggtaacccgtcgggtaccgtcggtcctccctacgaccgccctaccaaccggaaccgggtaccctacgttcccggtccccgtttcccccgaccggtccctaaccccgtcccctaaaccgaaccgtaacgacccgtaaccggttcggtacggggacaccgtaccggtcccggtcccggtcggtaccgtccggtcccggtacggtaccgtaaacgttacccttaacccgttacccgttacggttccgttaacgttccggtaacggacggggtaccgggtaccggtacgggaccggtaacgggaccgttacgaaacgtacggacagtcaacgnacg

SEQ ID NO: 82644 - DNA, 887 bp, Homo sapiens
  misc_feature: GYAE6OF01B2MCT.12.14.B03.1.454.CMB.1.raw
  modified_base (252)..(252): a, c, t, g, unknown or other
  misc_feature (252)..(252): n is a, c, g, or t
  modified_base (256)..(256): a, c, t, g, unknown or other
  misc_feature (256)..(256): n is a, c, g, or t
  modified_base (259)..(259): a, c, t, g, unknown or other
  misc_feature (259)..(259): n is a, c, g, or t
tcagatacgacgtacacgaccggtgctcgatttagtgtgagtagtttgagtttgggggagcttggtacagcctggggggtccctgagactctcctgtgcagcctctggattcacctttagcaactatgccatgagcgtgggtcccgccgaggccttccaggtggaagggggtctgggaggtgggtctcaggttattaggtgggttagtgggtggtagcagattacgacgcagacctcgtagacgggtcgttnagcntcncagagacataccaagacacgcttgttatttgctatatagaacgcgtccgtggacggacggccggaaggaccgaccgggtaccgttattacgttaacggtcggtacgtacggaagtaccgttacgggtaccgggttaccggacgttacggtagggttacgggggagaccggtacggttcggttacccggtaacccgggtccggggtacccgggaaccgggttaccccggtacgggttacccgtacccgggttacccttccccgaaccgtcccgtaacccccgtacccggtaacccggggaaccccgggtacccgttaacccggttccccgggtttacccccttcccccccgggtaccgggtccccctaccccccgttaacccccgtaaccggtaaccggaccgtaccccgtaacccgggttccgggggaccggggtcccaaccgggtacccgggtcccggtacccccgggttggggaccccgttcgggttacccggtagggttaccccgaaacgggtttaccccgttacccggtttacccgttaaccgggttcccgttaaccgttcccggtacggggtacccggggtaccccggtagggtaaccgggtaaccgggaaccgggttaccgg

SEQ ID NO: 82645 - DNA, 532 bp, Homo sapiens
  misc_feature: GYAE6OF02GGJQ2.12.14.B03.1.454.CMB.1.raw
  modified_base (527)..(532): a, c, t, g, unknown or other
  misc_feature (527)..(532): n is a, c, g, or t
tcagatacgacgtacacgaccggtgctcgatttagtgtgagtagttccgcggggggaggcttggttcggcctggcgggtccctgagactctcctgcgcagcctctggattcctttttgaggattttgccatgcactgggtccggcaagctccggggaggggcctggagtgggtctcaacaattacttggaatagtgctaccatagcctacacagactccgtgaagggccgattcatcacttctagagacaacgccgagaactccctgtatctgcagatgaacagtctgagacctgaggacacggccctgtatttctgttcaaaaggggctctggttcagggatggggctttgactcctgggcccaggggaaccctggtcgcggtctcctcagcctccaccaagggcccatcggtcttccccctggcaccctcctccaacgagcacctctcggggcacagcggccctgggctgcctggtcaaggctactttctacgtcgtatctgagcgggctggcaaggcgcatagnnnnnn

SEQ ID NO: 82646 - DNA, 537 bp, Homo sapiens
  misc_feature: GYAE6OF02IDFH0.12.14.B03.1.454.CMB.1.raw
  modified_base (531)..(532): a, c, t, g, unknown or other
  misc_feature (531)..(532): n is a, c, g, or t
  modified_base (534)..(537): a, c, t, g, unknown or other
  misc_feature (534)..(537): n is a, c, g, or t
tcagatacgacgtacacgaccggtgctcgatttagtgtgagtagttccgcgggggggaggcttggttcggcctggcgggtccctgagactctcctgcgcagcctctggattcctttttgaggattttgccatgcactgggtccggcaagctccggggaggggcctggagtgggtctcaacaattacttggaatagtgctaccatagcctacacagactccgtgaagggccgattcatcacttctagagacaacgccgagaactccctgtatctgcagatgaacagtctgagacctgaggacacggcccctgtattttctgttcaaaaggggctctggttcagggatggggctttgactcctgggcccagggaaccctggtcgcggtctcctcagcctccaccaagggcccatcgtctcccctggcaccctctccagacgcacctctcggggcacgacgcggccctcgggctcgcctggtcaaggactacttcctacgtcgtatctgacgcgggctggcaaggcgcgatagnngnnnn

SEQ ID NO: 82647 - DNA, 528 bp, Homo sapiens
  misc_feature: GYAE6OF02HJWVV.12.14.B03.1.454.CMB.1.raw
  modified_base (523)..(528): a, c, t, g, unknown or other
  misc_feature (523)..(528): n is a, c, g, or t
tcagatacgacgtacacgaccggtgctcgatttagtgtgagtagttccgcggggggaggcttggttcggcctggcgggtccctgagactctcctgcgcagcctctggattcctttttgaggattttgccatgcactgggtccggcaagctccggggaggggcctggagtgggtctcaacaattacttggaatagtgctaccatagcctacacagactccgtgaagggccattcatcacttctagagacaacgccgagaactccctgtatctgcagatgaacagtctgagacctgaggacacggccctgtatttctgttcaaaagggctctggttcagggatggggctttgactcctggcccagggaaccctggtcgcggtctcctcagcctcaccaagggcccatcggtcttcccctcggcaccctcctccaagacgcacctctcgggggcacagcgccctgggctgcctggtccaaggactacttcctacgtcgtatctgagcgggctggcaaggcgcatgnnnnnn

SEQ ID NO: 82648 - DNA, 540 bp, Homo sapiens
  misc_feature: GYAE6OF02IVDMA.12.14.B03.1.454.CMB.1.raw
  modified_base (531)..(531): a, c, t, g, unknown or other
  misc_feature (531)..(531): n is a, c, g, or t
  modified_base (535)..(540): a, c, t, g, unknown or other
  misc_feature (535)..(540): n is a, c, g, or t
tcagatacgacgtacacgaccggtgctcgatttagtgtgagtagttccgcggggggggaggcttggttcggcctggcgggtccctgagactctcctgcgcagcctctggattcctttttgaggattttgccatgcactgggtccggcaagctccggggaggggcctggagtgggtctcaacaattacttggaatagtgctaccatagcctacacagactccgtgaagggccgattcatcacttctagagacaacgccgagaactccctgtatctgcagatgaacagtctgagacctgaggcacggcccctggtatttctgttcaaaaggggctctggttcagggatggggctttgactccgtggcccagggaaccctggtcgcggtctctcagcctccaccaagggcccatcggtcctccccctggccaccctccctccaagacgccaccctctgggggccacgagccggccctgggctgccctggtcaaggctacttccacgtcgtatctgacgcgggctggcaaggcgnatgnnnnnn

SEQ ID NO: 82649 - DNA, 539 bp, Homo sapiens
  misc_feature: GYAE6OF02I011Z.12.14.B03.1.454.CMB.1.raw
  modified_base (430)..(430): a, c, t, g, unknown or other
  misc_feature (430)..(430): n is a, c, g, or t
  modified_base (467)..(467): a, c, t, g, unknown or other
  misc_feature (467)..(467): n is a, c, g, or t
  modified_base (534)..(539): a, c, t, g, unknown or other
  misc_feature (534)..(539): n is a, c, g, or t
tcagatacgacgtacacgaccggtgctcgatttagtgtgagtagttccgcggggggggaggcttggttcggcctggcgggtccctgagactctcctgcgcagcctctggattcctttttgaggattttgccatgcactgggtccggcaagctccggggaggggcctggagtgggtctcaacaattacttggaatagtgctaccatagcctacacagactccgtgaagggccgattcatcacttctagagacaacgccgagaactccctgtatctgcagatgaacagtctgagacctgaggacacggccctgtatttctgttcaaaaggggctctggttcagggatggggctttgactcctggcccaggggaaccctggtcgcggtctcctcagcctccaccaacgggcccatcggtcttccccctggccnccctcctccaagcgcacctcgtggggcacagcgcccngggctgcctggcaaggactacttccacgttcgtatcgtgacgcgggcgtcggcaaggccgcagtagnnnnnn

SEQ ID NO: 82650 - DNA, 566 bp, Homo sapiens
  misc_feature: GYAE6OF02G4DF3.12.14.B03.1.454.CMB.1.raw
tcagatacgacgtacacgaccggtgctcgatttagtgtgagtagttccgcgggggagctctgggagaggagccccagccctgagattcccaggtgtttccattcagtgatcaacactgaacacagaggactcatcatggaattgggactgacctgcattttccttttggctattttaaagggtgtccagtgtgaagtgcacttggaacagtcggggggagcttggttcggcctggcgggtccctgagactctcctgcgcagcctctggattccttttgaggtattttgccatgcacgtgggtccggcaagcgtccggggagggcctgggagtgggtctcaacaattacttggaatagtgctaccatacgcctacacagactcgtgaagggccattcatcactctagagacaacgccgagaactccctgtatctgcagatgaactagtctagacgacctggacggacaccggccctgtatttcgtgttacgaaaggggtcttcgtggttacgagggtagtggggtctttggaccgtcccgtcggggacccctaggggtacccctggg

SEQ ID NO: 82651 - DNA, 752 bp, Homo sapiens
  misc_feature: GYAE6OF02HZ8KW.12.14.B03.1.454.CMB.1.raw
  modified_base (251)..(251): a, c, t, g, unknown or other
  misc_feature (251)..(251): n is a, c, g, or t
  modified_base (742)..(742): a, c, t, g, unknown or other
  misc_feature (742)..(742): n is a, c, g, or t
  modified_base (749)..(749): a, c, t, g, unknown or other
  misc_feature (749)..(749): n is a, c, g, or t
tcagatacgacgtacacgaccggtgctcgatttagtgtgagtagttccgcgggggggagggcgttggttcggccgtggcgggtccctgagactctcctgcgcagcctctggattcctttttgaggattttgccatgcactgggtccggcaagctccggggaggggcctggagtgggtctcgaacaattacttggaatagtgctaccatagcctacacagactccgtgaagggccattcatcactttcaganacaaacgtccgagaacctcctgtaatctgcagatgaacagtctgagacctgaggacacggccctgtatttcagttcgaaaagggctacgtggttacagggattcggggtctttacggacttccgtacgggcccgtaaggggtaacccgtgggttaccggcgggttcctccgttccgtaacgtcccgttcccgaacccgtaaacggggcccctaacgttcccggtaccccttttccccccgtcgggtaccccacccccgttaccgttcccgaaaccggtaacgccctaacccgttccggtccgggggttaccaaccgaccggacccggggtccgtacccggggccgttccgggtaacccgtcgggttaccgtaaacgggtacccgttaaccgtttaccccggttaacgtacccggtttaacgtccgtacgggttaaccggaccggggtccgttaccgggacgaacgggttacccgccgtaacgtacggccgngacgcgngcg

SEQ ID NO: 82652 - DNA, 344 bp, Homo sapiens
  misc_feature: GYAE6OF02HZ75W.12.14.B03.1.454.CMB.1.raw
  modified_base (308)..(308): a, c, t, g, unknown or other
  misc_feature (308)..(308): n is a, c, g, or t
  modified_base (310)..(344): a, c, t, g, unknown or other
  misc_feature (310)..(344): n is a, c, g, or t
tcagatacgacgtacacgaccggtgctcgattttagtgtgagtagtttaggggtttgggggggtgtggtggtctccactcccgccttggacggggctgctatctgcctccctggccatcacgtgggctccagtctgaggatgaggctgattattactgtgcagcatgggatgacagcctgaatggtccgtattcggcggagggaccaagctgaccgtcctaggtcagcccaaggctgcccctggtcactctgttcccaccctctctacgtcgtatcgtagacggcggcgtcggcaaggtcgcattagnannnnnnnnnnnnnnnnnnnnnnnnnnnnnnnnnnn

SEQ ID NO: 82653 - DNA, 537 bp, Homo sapiens
  misc_feature: GYAE6OF02JE9LK.12.14.B03.1.454.CMB.1.raw
  modified_base (533)..(537): a, c, t, g, unknown or other
  misc_feature (533)..(537): n is a, c, g, or t
tcagatacgacgtacacgaccggtgctcgatttagtgtgagtagttccgcgggggggaggcttggttcggcctggcgggtccctgagactctcctgcgcagcctctggattcctttttgaggattttgccatgcactgggtccggcaagctccggggaggggcctggagtgggtctcaacaattacttggaatagtgctaccatagcctacacagactccgtgaagggccgattcatcacttctagagacaacgccgagaactccctgtatctgcagatgaacagtctgagacctgaggacacggcccctgtatttctgttcaaaaggggctctggttcagggatggggctttgactcctggcccagggaaccctggtcgcggtctccgtcagcctccaccaagggcccatccggtcttcccctggccaccctcctccagagccactctggggcacagcgcctgggctcgcctggtcaagggactacgttccctacgcgtatccgtgacgcgggctggcgaaggcgcatagcnnnnn

SEQ ID NO: 82654 - DNA, 579 bp, Homo sapiens
  misc_feature: GYAE6OF02GR3YY.12.14.B03.1.454.CMB.1.raw
  modified_base (214)..(214): a, c, t, g, unknown or other
  misc_feature (214)..(214): n is a, c, g, or t
  modified_base (571)..(571): a, c, t, g, unknown or other
  misc_feature (571)..(571): n is a, c, g, or t
  modified_base (576)..(577): a, c, t, g, unknown or other
  misc_feature (576)..(577): n is a, c, g, or t
tcagatacgacgtacacgaccggtgctcgatttagtgtgagtagttccgcggggggggaggcttaaggttcggcctggcgggtccctgagactctcctgcgcagcctctggattcctttttgaggattttgccatgcactgggtccggcaagctccggggaggggcctggagtgggtctcaacaattacttggaatagtgctaccatagcctanacagactcgtgaagggccattcatcacttctagagacaacgccgagaactcctgtatctgcagatgaacagtctgagacctgaggacacggccctgtatttctgttcaaaagggctctggtcagggatgggctttgactccgtggcccagggaaccctggtcgcggtctcctcacgcctccaccaacgggcccagtccggtccttcccctggccaccctcctccaacgacgccaccgtcgtcgggggcacgacgccggcccgtgggcctcggccgtggtaccgaacggaccttaccgttccctaacgttcgttacgtccgtggacggcgggcgtcggcgaacggccgacgagtacgntcagnncg

SEQ ID NO: 82655 - DNA, 582 bp, Homo sapiens
  misc_feature: GYAE6OF02IJI1P.12.14.B03.1.454.CMB.1.raw
  modified_base (415)..(415): a, c, t, g, unknown or other
  misc_feature (415)..(415): n is a, c, g, or t
  modified_base (425)..(425): a, c, t, g, unknown or other
  misc_feature (425)..(425): n is a, c, g, or t
  modified_base (429)..(429): a, c, t, g, unknown or other
  misc_feature (429)..(429): n is a, c, g, or t
  modified_base (448)..(448): a, c, t, g, unknown or other
  misc_feature (448)..(448): n is a, c, g, or t
  modified_base (540)..(540): a, c, t, g, unknown or other
  misc_feature (540)..(540): n is a, c, g, or t
tcagatacgacgtacacgaccggtgctcgatttagtgtgagtagttccgcggggagctctgggagaggagccccagccctgagattcccaggtgtttccattcagtgatcaacactgaacacagaggactcatcatggaattgggactgacctgcatttttcctttttggcttattttaaagggtgtccagtgtgaagtgcacttggaacaggtcggggggaggcttggttcgaccgtggcgggtccctgagactctcctgcgcagcctctggtactttcctttttggaggtattttgccatgcactgggtccggcaagcgtccgggggaggggccgtgggaggtgggtctcaacaattactaggaatagtgctaccatagcctacacagactcgtgaaggcgtatcatcacttnagagacaacncganaactcctgtatctgcagangaacagtctacgagaccgtgaacggaccgacggtccctagttatttctagttacgaaagggtctacggtggttacgagggtagttcggggtntttcggacgttcccgtacgggacccgtacgggacccgtcggg

SEQ ID NO: 82656 - DNA, 567 bp, Homo sapiens
  misc_feature: GYAE6OF02F6R2R.12.14.B03.1.454.CMB.1.raw
  modified_base (263)..(263): a, c, t, g, unknown or other
  misc_feature (263)..(263): n is a, c, g, or t
  modified_base (410)..(410): a, c, t, g, unknown or other
  misc_feature (410)..(410): n is a, c, g, or t
  modified_base (448)..(448): a, c, t, g, unknown or other
  misc_feature (448)..(448): n is a, c, g, or t
tcagatacgacgtacacgaccggtgctcgatttagtgtgagtagttccgcggggagctctgggagaggagccccagccctgagattcccaggtgtttccattcagtgatcaacactgaacacagaggactcatcatggaattgggactgacctgcattttcctttggctattttaaagggtgtccagtgtgaagtgcacttggaacagtcggggggagcttggttcggcctggcgggtccctgagactctcctgcgcagcctntggattcctttttgaggtattttgccatgcactgggtccggcaaggccgtccgggggaggggcctgggagtggggtctcaacaattacttggaatagtgctaccatagcctacacagactccgtgaagggccattcatcattcaganacaacgccgaagactccctgtactctgacagatgaacngtctagacgactgagacacggtccctgttactttcgtagttacgaaggggtctcggtggttcgaggggtagtggggtactttggaccgtccggtcgggacccgtagggacccgttcggg

SEQ ID NO: 82657 - DNA, 596 bp, Homo sapiens
  misc_feature: GYAE6OF02G760S.12.14.B03.1.454.CMB.1.raw
  modified_base (323)..(323): a, c, t, g, unknown or other
  misc_feature (323)..(323): n is a, c, g, or t
tcagatacgacgtacacgaccggtgctcgatttagtgtgagtagttccgcggggagctctgggagaggagccccagccctgagattcccaggtgtttccattcagtgatcaacactgaacacagaggactcatcatggaattgggactgacctgcattttccttttggctattttaaagggtgtccagtgtgaagtgcacttggaacaggtcggggggaggcgttggttcggcctggcgggtccctgagactctcctgcgcagcctctggatttcctttttgaggtattttgccatgcactgggtccggcaagcgtccggggnggggccgtggaggtgggtctcaacaattacttggaatagtgctaccatacgctacacagactccgagaacgggccgattcatctacttctaagacgaccaacgccgagaaacctccctagtactctgcagatagaacagtctcgagaccctggaacgacaccggcccttgttactttctgttacgaaaggggtctacggttgggttacgaggggtgttcggggtctttcggaccgttccggcggggtaccccgtacggggaccccgttcgggg

SEQ ID NO: 82658 - DNA, 748 bp, Homo sapiens
  misc_feature: GYAE6OF02G01TT.12.14.B03.1.454.CMB.1.raw
tcagatacgacgtacacgaccggtgctcgatttagtgtgagtagttccgcggggagctctgggagaggagccccagccctgagattcccaggtgtttccattcagtgatcaacactgaacacagaggactcatcatggaattgggactgacctgctattttcctttggcttattttaaagggtgtccagtgtgaagtgcacttggaacaggtcgggggagcttggtcggcgtggcggtcctgagactctcctgcgcagcctgtggtactttccgtttttgaggttattttcgcctaatcgctacgttcggggtcccggacaacggtccggtccggggggaggggcccgtgggacggttggggtacctacgaaactaagtttaccgttaggaaattaggtgacctaaccgtagtacgacctaacacgaacgtacgtccggtaggaaacgggtcctaagttacaacttacctaactttacgtaaggtaacgtaaccgaaaccggacccgtaacgtaaacccttcccgtacgttaactccgttacggacgtaacgtaacgttacgaaacgtacggtacctaggtaaccgtaacccgtaggaacggtaccgtaccggtcccgttacgttacgtttaccgttacggttaacgtaaacggggtcttacggtacggttaccgtaaggggtacgttacggggtacgtttacggtaccgttacccggtccggggacccgtacgggtaacccgtcggg

SEQ ID NO: 82659 - DNA, 607 bp, Homo sapiens
  misc_feature: GYAE6OF02HN6ZT.12.14.B03.1.454.CMB.1.raw
  modified_base (600)..(601): a, c, t, g, unknown or other
  misc_feature (600)..(601): n is a, c, g, or t
  modified_base (605)..(607): a, c, t, g, unknown or other
  misc_feature (605)..(607): n is a, c, g, or t
tcagatacgacgtacacgaccggtgctcgatttagtgtgagtagttccgcggggggggaggcttggttcggcctggcgggtccctgagactctcctgcgcagcctctggattcctttttgaggattttgccatgcactgggtccggcaagctccggggagggcctggagtgggtctcaacaattacttggaatagtgctaccatagcctacacagactccgtgaagggccgattcatcacttctagagacaacgccgagaactccctgtatctgcagatgaacagtctgagacctgaggacacggcccctgtatttctgttacaaaaggggctctggttcagggatggggctttgactcctgggcccagggaaccctgggtcgcggtctcctcacgccctccaccaacgggcccagtcggtcccttccccgtcggccacccctcctaccaacgacgcctaccgtcgtcggggcacgacggccggcccgtcggggcctcggtccgttcgggtaccgtaacggacctttaccgttcccgttacgttccgttaactccgtggacggccggggtctcgggacgtaacgggcgacgtacgtacgnntcgnnn

SEQ ID NO: 82660 - DNA, 587 bp, Homo sapiens
  misc_feature: GYAE6OF02JAW4I.12.14.B03.1.454.CMB.1.raw
  modified_base (264)..(264): a, c, t, g, unknown or other
  misc_feature (264)..(264): n is a, c, g, or t
  modified_base (423)..(423): a, c, t, g, unknown or other
  misc_feature (423)..(423): n is a, c, g, or t
  modified_base (444)..(444): a, c, t, g, unknown or other
  misc_feature (444)..(444): n is a, c, g, or t
  modified_base (472)..(472): a, c, t, g, unknown or other
  misc_feature (472)..(472): n is a, c, g, or t
tcagatacgacgtacacgaccggtgctcgatttagtgtgagtagttccgcgggagctctgggagaggagccccagccctgagattcccaggtgtttccattcagtgatcaacactgaacacagaggactcatcatggaattgggactgacctgcattttccttttggctattttaaagggtgtccagtgtgaagtgcacttggaacagtcggggggagcttggttcggcctggcgggtccctgacgactctcctgcgcagcctntggattccttttgaggtattttgccatgcactgggtccggcaagcgtccggggaggggcctgggagtgggtctcaaacaatttacttggaatagtgcctaccatagcctacacagactcggtagaagggccgattcatcacttcagagacaacgccganaacctccctagtactctgcanatagaacagtctgagacctgacggaccncggacccttggtactttcgtagttacgaaacgggtctacgtggttacgaggggtgttaggggtccttttacgggacccgttcccggggacccacggggtacccgttgggtcccgg

SEQ ID NO: 82661 - DNA, 656 bp, Homo sapiens
  misc_feature: GYAE6OF02GEXG9.12.14.B03.1.454.CMB.1.raw
  modified_base (646)..(646): a, c, t, g, unknown or other
  misc_feature (646)..(646): n is a, c, g, or t
  modified_base (653)..(653): a, c, t, g, unknown or other
  misc_feature (653)..(653): n is a, c, g, or t
tcagatacgacgtacacgaccggtgctcgatttagtgtgagtagttccgcgggggggggaggcttggttcggcctggcgggtccctgagactctcctgcgcagcctctggattcctttttgaggattttgccatgcactgggtccggcaagctccggggaggggcctggagtgggtctcaacaattacttggaatagtgctaccatagcctacacagactccgtgaagggccattcatcacttctagagacaacgccgagaacctccctgtatctgcagatgaacagtctgagacctgaggacacggccctgtatttctgttacgaaaaggggctcgtggtcgagggagtggggtctttgactccgtcggcccgagggacccgtggtcgccggttctcccgtcacgcccttaccgaccgaacgggccctacgtccggttccctttccccccgtcggccctacccccgtccctaccgaaacggtacgaccctacccgtcggttaccgggggaccaccggacggcccggccccgtggggcctcggccgttcgggtaccaacgggtacctttaccgttcccgtagttcgtcgtacttcgtggacggtccgggtcgtacgggaccgtaacgggccgacgtacgttacggngactcgntcg

SEQ ID NO: 82662 - DNA, 722 bp, Homo sapiens
  misc_feature: GYAE6OF02JV7PK.12.14.B03.1.454.CMB.1.raw
tcagatacgacgtacacgaccggtgctcgatttagtgtgagtagttccgcggggagctctgggagaggagccccagccctgagattcccaggtgtttccattcagtgatcaacactgaacacagaggactcatcatggaattgggactgacctgctattttcctttggcttattttaaggtgtccagtgtgaagtgcacttggaacaggtcgggggagcttggtcggcctggcggttccctgagactcgtcctgcgcagcctcgtggtacttccgttttgagtattttgcctatcgctacgtgggtccgtacgaacggtccgtccgggggagggtccgtggggagtcgggtcctacgaaccgtaaagttaccgttggaaagtacgtgaccgtaacctaagtacgtaccgtacaactaaggtaccgtaccggtaggaaccggggtaccgtacttacgacttcctaaccgttcgtaagtacggaaaccgtaaaccgcccggtaagtaaacctcccgtacgtactcgtacgactacggtaattcggaacctaagttctaggaacgtacccgtaggtaccggaaccgtaccgggtaccctttaggttacctttcgttaacgggttacgaaacggggttcgttaccgtgggttacgtacggggtaggttcgggtacgttttcggaccgttccggtccgggacccgttaccggggaacccgttcgggg

SEQ ID NO: 82663 - DNA, 559 bp, Homo sapiens
  misc_feature: GYAE6OF02F7K6G.12.14.B03.1.454.CMB.1.raw
  modified_base (210)..(210): a, c, t, g, unknown or other
  misc_feature (210)..(210): n is a, c, g, or t
  modified_base (321)..(321): a, c, t, g, unknown or other
  misc_feature (321)..(321): n is a, c, g, or t
  modified_base (409)..(409): a, c, t, g, unknown or other
  misc_feature (409)..(409): n is a, c, g, or t
  modified_base (431)..(431): a, c, t, g, unknown or other
  misc_feature (431)..(431): n is a, c, g, or t
tcagatacgacgtacacgaccggtgctcgatttagtgtgagtagttccgcgggggagctctggggagaggagccccagccctgagattcccaggtgtttccattcagtgatcaacactgaacacagaggactcatcatggaattgggactgacctgctattttcctttggctattttaaagggtgtccagtgtgaagtgcacttggaacngtcggggggagcttggttcggcctggcgggtccctgagactctcctgcgcagcctctggattcctttttgaggtatttgccatgcactgggtccggcaagcgtccgggggngggcctgggaggtgggtctcaacaattactggaaatgtgctaccatacgctacacagactccgtgaaggccgatcgatcattctaganacaacgccgagaactcctgtanctgcagatgaacagtctgacgacctgacggacacggccctgtactttctgttacgaagggtctcgtacggttcgagggtagtggggtactttggccgttccgtcgggcccgtacgggaccccgtcggg

SEQ ID NO: 82664 - DNA, 631 bp, Homo sapiens
  misc_feature: GYAE6OF02JV0JZ.12.14.B03.1.454.CMB.1.raw
  modified_base (377)..(377): a, c, t, g, unknown or other
  misc_feature (377)..(377): n is a, c, g, or t
  modified_base (622)..(622): a, c, t, g, unknown or other
  misc_feature (622)..(622): n is a, c, g, or t
  modified_base (628)..(629): a, c, t, g, unknown or other
  misc_feature (628)..(629): n is a, c, g, or t
  modified_base (631)..(631): a, c, t, g, unknown or other
  misc_feature (631)..(631): n is a, c, g, or t
tcagatacgacgtacacgaccggtgctcgatttagtgtgagtagttccgcggggggggaggcttggttcggcctggcgggtccctgagactctcctgcgcagcctctggattcctttttgaggatttttgccatgcactgggtccggcaagctccggggaggggcctggagtgggtctcaacaattacttggaatagtgcctaccatagccctacacagacctccgtagaagggcccattcatcactttcgtagacgaccaacgccgaagaacctcccgtgtatctgcaggactgaacagtctgagacctgaggaccaccggtccctgttactttcgtgttacgaaacgggtctcgtggttcgagggtagtggggtntttcgacgttccgcggcccaagggtacccgtggtccgccggttcctccgtcgacgccctccgaaccgacgggccctacgtccggtccctccccgtcgccctacccgtcccaccgacgtcgcctaccgtcggtcgggccacgaccggccggccgtcggctcgcctcggaccgacgtaccttaccgttccgtacgttcgttacgtcgtacgggacgtccgggcgtacgcggaccgtcgccgatcggntcgcgnngn

SEQ ID NO: 82665 - DNA, 739 bp, Homo sapiens
  misc_feature: GYAE6OF02INQDR.12.14.B03.1.454.CMB.1.raw
  modified_base (270)..(270): a, c, t, g, unknown or other
  misc_feature (270)..(270): n is a, c, g, or t
  modified_base (289)..(289): a, c, t, g, unknown or other
  misc_feature (289)..(289): n is a, c, g, or t
tcagatacgacgtacacgaccggtgctcgatttagtgtgagtagttccgcggggagctctgggagaggagccccagccctgagattcccaggtgtttccattcagtgatcaacactgaacacagaggactcatcatggaattgggactgacctgcatttttccttttggcttattttaaagggtgtccagtgtagaagtgcacgttggaacaggtcggggggagcttggtcggccgtggcgggtccctggagactctcctgcgcagcctntggtatttccttttgagtnttttcgcctagtgcacgtcgggtccgacgaaggcggtaccggggggagggccgtgggaggtcggggtctcgtaaacaacgtttacgttagggaaattacggtcgtacctaccaagtacgaccctaacgaaccaggtacctccggtaggaaacgggccgtattccagttcctactttacgtaagtaacgaaccgaaaccggccgaaacgtaacctcccgtagtaaccttcgtagaccaaggtacttacgaacgtaggtactacgggaacgtaccgtaggaaccgggacctaccgggaccctttaggttacttttaccgtacgggtttaaacgaaacgggggttccttaccgttacggggttacggaacgggggttaggttcgggggttaccttttacgggacccgtttcccggaccggggtaccccggtacggggtaccccgttacggggg

SEQ ID NO: 82666 - DNA, 840 bp, Homo sapiens
  misc_feature: GYAE6OF02JJQ29.12.14.B03.1.454.CMB.1.raw
tcagatacgacgtacacgaccggtgctcgatttagtgtgagtagttccgcggggagctctgggagaggagccccagccctgagattcccaggtgtttccattcagtgatcaacactgaacacagaggactcatcatggaattgggactgacctgcattttccttttggctagttttaaagggtgtccagtgtgaagtgcacttggaactaggtcggggggaggtcgttggttccggccgtgggccgggtccctggagacctcctccgtgcgcagcctcgtggtacttcctttttggaggtatttttgcctagtcgctacgttcggggtccggcgaacggccggtcccgggggacgggggtcccgttggggacgggttcggggttcctacgaaaccgtaagtttaccgttagggtaaattacggtcgtaccttaacccgagttaacggtaccctaacgaacgtacgtaaccgtccggttaacggaacggggtacccgtagttaccactttactaccgttttaccgaaggtaacgaacccgaaaccggcccggaaacgtaaacccttccccgtaagttacctccgtgtacccgaagtaacgtacgtaaacgtagtccgttagggaacgtacccgtacgggtaaccgggaaaccgtacccgggtcccttaaggtttaccgttttacgttacccgggttttaacggaaaaccgggggtttccgtaccggttttacgggggtttaccgaaagggggttacgggtttaggggttccccgtttttaggacccggtttcccgggttacccgggggaccccgttaaccgggggtacccccgttcggggg

SEQ ID NO: 82667 - DNA, 616 bp, Homo sapiens
  misc_feature: GYAE6OF02IA0OQ.12.14.B03.1.454.CMB.1.raw
  modified_base (610)..(612): a, c, t, g, unknown or other
  misc_feature (610)..(612): n is a, c, g, or t
  modified_base (614)..(616): a, c, t, g, unknown or other
  misc_feature (614)..(616): n is a, c, g, or t
tcagatacgacgtacacgaccggtgctcgatttagtgtgagtagttccgcggggggggaggcttggttcggcctggcgggtccctgagactctcctgcgcagcctctggattcctttttgaggtatttttgccatgcactgggtccggcaagctccggggaggggcctggagtgggtctcaacaattacttggaatagtgctaccatagcctacacagacctccgtgaacgggccgattcatcacttctagacgacaacgccgagaacctccctgtatctgcagatgaacagtctgagacctgaggacacggccctgttatttcttgttacgaaaggggtctcgtggttcgagggtagtggggtctttgactccgtcgggacccgacgggtaacccgtggtcgcggtctcctcacgtcctccgaccgaacgggcccatccggttcccttccccgtcggcccacccctcctaccgaacgacgcctaccgtcgtcgggacacgacgccggtcccgtcgggcctggccgtcggtacgtaaacggtaccttaccttccgtacgtacgttactcgtcgacggtccggtacgtcggacgaacggcgacgagtacgnnntnnn

SEQ ID NO: 82668 - DNA, 692 bp, Homo sapiens
  misc_feature: GYAE6OF02GYZIL.12.14.B03.1.454.CMB.1.raw
tcagatacgacgtacacgaccggtgctcgatttagtgtgagtagttccgcggggagctctgggagaggagccccagccctgagattcccaggtgtttccattcagtgatcaacactgaacacagaggactcatcatggaattgggactgacctgcatttttccttttggcttattttaaagggtgtccagtgtgaagtgcacttggaacaggtcggggggaggcttggttcggcctggcgggtccctggagactctcctgcgcagcctctggctttccttttgaggtattttgcctatgcacgtcgggtccgcgaaggccgtcgggggagggtcctgggacgttggggtctcaaactaatttacgttagggaattacggtgaccttaaccaagtacgacctaacaacacgtaccgtccggtaggaacgggtccgtaattccaacttcctactttactaggaacgaccgaaacgccggaacgtaacctcccgttagttactcgtacgacgagtaactagaacgacgttcacggtacgaccgtaggaaccgaccgtaccggtacccttaggttacttttcgtacgttaaccggaaggggttccttcggttcgggttaccggaggggtacgttcgggggttactttacggtaccgtcccggtacggggtccccgtaacggggtaccccgtcgggg

SEQ ID NO: 82669 - DNA, 591 bp, Homo sapiens
  misc_feature: GYAE6OF02IP56N.12.14.B03.1.454.CMB.1.raw
  modified_base (583)..(584): a, c, t, g, unknown or other
  misc_feature (583)..(584): n is a, c, g, or t
  modified_base (588)..(589): a, c, t, g, unknown or other
  misc_feature (588)..(589): n is a, c, g, or t
tcagatacgacgtacacgaccggtgctcgatttagtgtgagtagttccgcggggggggggaggcttggttcggcctggcgggtccctgagactctcctgcgcagcctctggatttccttttttgaggattttgccatgcactgggtccggcaagctccggggagggcctggagtgggtctcaacaattacttggaatagtgctaccatagcctacacagactccgtgaagggccattcatcacttcagagacaacgccgagaacctccctgtactctgcagatagaacagtctgagaccctgaggacacggccctgtatttctgttcaaaaggggctctggttcagggagtgggctttgactctgggcccagggaaccctggtcgcggtctcctcacgccctccaccaacgggcccacgtccgtccgtttcccccgtcgccacccctcctccaagtaccgtaccctccgtcgggggccacgacgccgggacccgtcgggcctcgccgttggtacgaacggtacctacgttccctacgtcgttactgtgacgcgggccgtggaccgacggcgcgagtacgcgtnntcgnncg

SEQ ID NO: 82670 - DNA, 590 bp, Homo sapiens
  misc_feature: GYAE6OF02FVF9O.12.14.B03.1.454.CMB.1.raw
  modified_base (582)..(582): a, c, t, g, unknown or other
  misc_feature (582)..(582): n is a, c, g, or t
  modified_base (585)..(585): a, c, t, g, unknown or other
  misc_feature (585)..(585): n is a, c, g, or t
  modified_base (587)..(588): a, c, t, g, unknown or other
  misc_feature (587)..(588): n is a, c, g, or t
tcagatacgacgtacacgaccggtgctcgatttagtgtgagtagttccgcggggggggaggcttggttcggcctggcgggtccctgagactctcctgcgcagcctctggattcctttttgaggattttgccatgcactgggtccggcaagctccggggaggggcctggagtgggtctcaacaattacttggaatagtgctaccatagcctacacagactccgtgaagggccgattcatcacttcagagacaacgccgagaactccctgtatctgcagatgaacagtctgagacctgaggacacggccctgtatttctgttcaaaaggggctctggttcagggatggggctttgctccgtgggcccagggaaccctggtcgcggtctcctcacgcctccaccgaacgggcccagtccggtcccttcccccgtggccctaccctcctccaacgacgccaccctcgtcggggccacgacgccggcccgtgggcctcggccgtcggtacaacgggtaccttaccgttccctacgttcgtactccgtcggacggtccgggcgtcggacggacggccgacgagtacgntcnanncg

SEQ ID NO: 82671 - DNA, 810 bp, Homo sapiens
  misc_feature: GYAE6OF02I56PC.12.14.B03.1.454.CMB.1.raw
  modified_base (322)..(322): a, c, t, g, unknown or other
  misc_feature (322)..(322): n is a, c, g, or t
tcagatacgacgtacacgaccggtgctcgatttagtgtgagtagttccgcggggagctctgggagaggagccccagccctgagattcccaggtgtttccattcagtgatcaacactgaacacagaggactcatcaatggaattgggactgacctgctattttcctttggcttattttaaggtgtcctagtgtgaagtgcacgttggaacaggtcggggggaggcgttgggttcggcctgggcgggtccctgagacctctctgcgcagcctctggtactttcctttttaggaggttatttcgcctatcgctacgtgggtccgnaagtccggtcggggagggccgtgggagtcggtcctacgaaactaagttttaccgtagggtaaattacggtacgaccgttaacccagttaaccggcccttaaccgaaccgtagttaaacccgtaccgggttacggggtaaaccgggggtcccgttaaatttaccaccgtttaccttaaccgttttacccggtaaaggtaccggaaacccgtaaacccgggtacccggttaaacgaaacccccgttttacccggtaccggttaaccttaccggttacgtacggttaacgacgttaaaggtaacccgtaagttcgttaacggacccggtaacggacggtaacggaacccgtcccgggttaaccgtttaggttaccgtttacgttaacgttaacgggaacggttccgtacggttggttaacggtacgggtacggttcgggtcttacggtaccggtacccgcggggtaacccgtaccgggtacccgttcgggg

SEQ ID NO: 82672 - DNA, 776 bp, Homo sapiens
  misc_feature: GYAE6OF02FU6AJ.12.14.B03.1.454.CMB.1.raw
  modified_base (351)..(351): a, c, t, g, unknown or other
  misc_feature (351)..(351): n is a, c, g, or t
  modified_base (385)..(385): a, c, t, g, unknown or other
  misc_feature (385)..(385): n is a, c, g, or t
tcagatacgacgtacacgaccggtgctcgatttagtgtgagtagttccgcggggagctctgggagaggagccccagccctgagattcccaggtgtttccattcagtcgatcaacactgaacacagaggactcatcatggaattgggactgacctgctattttccttttggcttattttaaagggtgtccagtgtgaagtgcacttggaacaggtcgggggaggcttggttcggccttgggcgggtccctgagactctcctgcgcagcctctggtactttcctttttgacggtattttgcctatgctacgtcggggtccggcgaaggccggtccgggggagggccgtagggnggtgggtcctcgaaactaatttactggaatagtncgtacagtacgacctacacgacgtaccgtccggtaggaacgggcctattaccgtactctacgtttactaaggaacgaaccgtaaacccggaccgtaaacgtaaacccttcccgttaggttaactccgttacgacgtaagtaactagaaaccgtaggttacctaacgggaccgtaccggttacggaacgggtaccgtaacccgggttaccttacggtttaccgttttaccgttacgggtttaaacggtaaacggggtccgtttaaccgggtttcgggttaacggtacgggggttaacgggtttacgggggtttaccgttttaccgggtacccggtttaccccgggtttaccggggacccccggttaaccggggtaaccccggtttcccgggg

SEQ ID NO: 82673 - DNA, 611 bp, Homo sapiens
  misc_feature: GYAE6OF02IVDH4.12.14.B03.1.454.CMB.1.raw
  modified_base (477)..(477): a, c, t, g, unknown or other
  misc_feature (477)..(477): n is a, c, g, or t
tcagatacgacgtacacgaccggtgctcgatttagtgtgagtagttccgcggggagctctggggagaggagccccagccctgagattcccaggtgtttccattcagtgatcaacactgaacacagaggactcatcatggaattgggactgacctgcattttccttttggctattttaaagggtgtccagtgtgaagtgcacttggaacaggtcggggggagcttggtcggctgggcgggtccctgagactctcctgcgcagcctctggtattcctttttgaggtattttgtcatgcacgtcgggtccgcaacgcggtccgggggaggggcctgggaggtgggtctacgaaactaatttacgttagggaattagtgactaaccatacgcctacacacgactccgtagaacggccgtattacactcacttctagagacaaccgccgaacgacctccctagtactctacgcagatgaacngtctagacgtaccgtaggacgacgaccggtcccttagttactttcgtacgttacgaacggggtcttcggttggttcgaaggggtgtaggggttcttacggtcgttaccgtcgggaccccgagggtaccctcggg

SEQ ID NO: 82674 - DNA, 620 bp, Homo sapiens
  misc_feature: GYAE6OF02FK81W.12.14.B03.1.454.CMB.1.raw
  modified_base (306)..(306): a, c, t, g, unknown or other
  misc_feature (306)..(306): n is a, c, g, or t
  modified_base (376)..(376): a, c, t, g, unknown or other
  misc_feature (376)..(376): n is a, c, g, or t
tcagatacgacgtacacgaccggtgctcgatttagtgtgagtagttccgcgggggagctctgggagaggagccccagccctgagattcccaggtgtttccattcagtgatcaacactgaacacagaggactcatcatggaattgggactgacctgcattttcctttggctattttaaagggtgtccagtgtgaagtgcacttggaacaggtcggggggaggcttggttcggcctggcgggtccctgagactctcctgcgcagcctctggtattccttttgaggtatttgccatgcactgggtccgnaacgcgtccgggggagggcctgggaggtgggtctcaacattactggaatgtgctacatacgacctacacngtactccgtgaacgggccatcatcactctagagacacgccgagactcctagtactctgcagactgaacagtctagacgtacctaggacggtaccgaccggtcccttagttactttccgtacgttaacggtaaacggggtccttacggttcgggttaaccggaggggtaacggttcggggttaccgttttacggacccgttaccggtaccggggtaccccgtaacggggaaccccgttccggggg

SEQ ID NO: 82675 - DNA, 788 bp, Homo sapiens
  misc_feature: GYAE6OF02IQVMD.12.14.B03.1.454.CMB.1.raw
  modified_base (278)..(278): a, c, t, g, unknown or other
  misc_feature (278)..(278): n is a, c, g, or t
tcagatacgacgtacacgaccggtgctcgattttagtgtgagtagttccgcgggggagctctgggagaggagcccccagccctgagattcccaggtgtttccattcagtgatcaacactgaacacagaggactcatcatggaattgggactgacctgctatttttccttttggcttaattttaaagggtgtccagtgtgaagtgcacgttggaacaggtcggggggagtcttggttcggcctgggccgggtcctgacgactctcctgcgcacgcctcngtatttccttttgagtatttgcctatgcacgtcgggccggacaagtccggtccgggggagggtccgtagggagtgggtctacgtaaacgtaacgtttacgttaggaatagtcgtactaacgtatacgacctaacgacacgacttaccggtaggaaaccgggtccgtaagtttaccactttcctaaccgttttacgtaaacgaaggtaaaccgaaaccccggtacccggtaaacgttaaacccgtcccgttaaggtaacttaccgttagtaaccgaacgtaagttacgaaacgtacgtcttaacggaacgtccgtaagggacggtaaacccgtacgggtacccttaggtttaacttttcggttaacgttaacccgggtaaaaggggttccgttaccggttcgggggtttaagaacggggggttaacgttacggggggtttaacctttacgggtacccgtttaccccggggacgggttaacccccggtaacggggtaaccccggttcggggg

SEQ ID NO: 82676 - DNA, 705 bp, Homo sapiens
  misc_feature: GYAE6OF02FYGE0.12.14.B03.1.454.CMB.1.raw
  modified_base (359)..(359): a, c, t, g, unknown or other
  misc_feature (359)..(359): n is a, c, g, or t
  modified_base (517)..(517): a, c, t, g, unknown or other
  misc_feature (517)..(517): n is a, c, g, or t
tcagatacgacgtacacgaccggtgctcgatttagtgtgagtagttccgcgggggagctctgggagaggagccccagccctgagattcccaggtgtttccattcagtgatcaacactgaacacagaggactcatcatggaattgggactgacctgctatttttccttttggcttattttaaagggtgtccagtgtgaagtgcacttggaacaggtcggggggaggtcgttgggttcggccgtgggccgggtccctgacgacctctcctgccgcacgcctctggtactttcctttttgaggtattttgcctatcgcacgtcggggtcccggcaacggcggtccggggacggggcctgggnggtgggtctcaactaattacgttaggaatagtcgctacatacgcctacacagtacctaccggtagaacgggtccgtattcactcctactttacaagacgaaccgaacggccgaacgaacctcccgtagtactccgtgtacagataggaactagtccgngaacgtaccgtaggacggaccgtacccgggtacctttagttacgtttacgttaggttaaccgtaacgggggttccttcggttacgggttaaccggaagggggttcggttacggggtaccgttttaccggaccccgggttacccccgggggtaacccggtaccggggttaccccgttcggggtcccggg

SEQ ID NO: 82677 - DNA, 586 bp, Homo sapiens
  misc_feature: GYAE6OF02IKHVS.12.14.B03.1.454.CMB.1.raw
  modified_base (312)..(312): a, c, t, g, unknown or other
  misc_feature (312)..(312): n is a, c, g, or t
  modified_base (374)..(374): a, c, t, g, unknown or other
  misc_feature (374)..(374): n is a, c, g, or t
  modified_base (421)..(421): a, c, t, g, unknown or other
  misc_feature (421)..(421): n is a, c, g, or t
  modified_base (435)..(435): a, c, t, g, unknown or other
  misc_feature (435)..(435): n is a, c, g, or t
  modified_base (453)..(453): a, c, t, g, unknown or other
  misc_feature (453)..(453): n is a, c, g, or t
  modified_base (459)..(459): a, c, t, g, unknown or other
  misc_feature (459)..(459): n is a, c, g, or t
tcagatacgacgtacacgaccggtgctcgatttagtgtgagtagttccgcggggagctctgggagaggagccccagccctgagattcccaggtgtttccattcagtgatcaacactgaacacagaggactcatcatggaattgggactgacctgcatttttccttttggcttatttttaaagggtgtccagtgtgaagtgcacttggaacaggtcgggggagcttggtcgcctggcggtcctgagactctcctgcgcacgcctctggtatttcctttttgaggtatttttgcctatgcacgtgggtcccggnaacggcgtaccgggggaggggcctgggaggtcgggtctcaaactaatttacttggaatagtnctacatcgcctacacagacctcgtagaacgggcctattcatcacttntagacacacgcganactcctgtatctgcaganacaacngtcagacgacctgagacacgccttagtatttcgtagttacgaagggtcttacgtgggttcaaggggtacttcgggggttactttacggaccgttccggtcgggacccggtacgggtacccgttcggg

SEQ ID NO: 82678 - DNA, 684 bp, Homo sapiens
  misc_feature: GYAE6OF02GPZ0Q.12.14.B03.1.454.CMB.1.raw
  modified_base (467)..(467): a, c, t, g, unknown or other
  misc_feature (467)..(467): n is a, c, g, or t
  modified_base (491)..(491): a, c, t, g, unknown or other
  misc_feature (491)..(491): n is a, c, g, or t
  modified_base (496)..(496): a, c, t, g, unknown or other
  misc_feature (496)..(496): n is a, c, g, or t
tcagatacgacgtacacgaccggtgctcgatttagtgtgagtagttccgcgggggagctctgggagaggagccccagccctgagattcccaggtgtttccattcagtgatcaacactgaacacagaggactcatcatggaattgggactgacctgcattttcctttggctattttaagggtgtccagtgtgaagtgctacgttggaaccaggtcgggggggaggtcttgggttccggccgtgggccgggtccctggagctctccgtgcgccagcctctggtattcctttttgaggtattttcgcctaagtcgcgacgttcgggtcccggtcaacggcggtccggggggagggggcccgtagggacggtcggggtacctcgaactaactttacgttagggaattaggtacgccttaaccagtacgacctacaacgagactcggagaacgggccattcactctactcanagacaacgcccgagtacctcccgnttacncgtgacagtactagaactacggtcttacgacgtaccgttaggacggtaccaccggtcccttagggtttacctttgttacgttaaccgtaacggggtcgttacggttgggttaccggaggggtacggttaggggtcgtttacggacgttcccgggttcgggtacccggtaccgggtacccggttacggg

SEQ ID NO: 82679 - DNA, 595 bp, Homo sapiens
  misc_feature: GYAE6OF02IIQGS.12.14.B03.1.454.CMB.1.raw
  modified_base (212)..(212): a, c, t, g, unknown or other
  misc_feature (212)..(212): n is a, c, g, or t
  modified_base (341)..(341): a, c, t, g, unknown or other
  misc_feature (341)..(341): n is a, c, g, or t
  modified_base (592)..(592): a, c, t, g, unknown or other
  misc_feature (592)..(592): n is a, c, g, or t
  modified_base (594)..(595): a, c, t, g, unknown or other
  misc_feature (594)..(595): n is a, c, g, or t
tcagatacgacgtacacgaccggtgctcgatttagtgtgagtagttccgcggggggggaggcttggttcggcctggcgggtccctgagactctcctgcgcagcctctggattcctttttgaggattttgccatgcactgggtccggcaagctccggggaggggcctggagtgggtctcaacaattacttggaatagtgctaccatagcctanacagactccgtgaagggccgattcatcacttctagagacaacgccgagaacctcctgtatctgcagatgaacagtctgagactgaggacacggccctgtatttctgttcaaaggggctctggtcagggntgggcttgactcctgggcccagggaacctggtcgcggtctcctcagcctccaccgaacgggcccatccggtccttccccctggccaccctcctaccaacgacgccacctcgtcggggccacgacgccggccctggggctcggcccgttggtaccgaacggtaccttactttcccgttacggttaccgttattccgtaggacgggtcggggcgtacgggccgaaacgggccgtacgaacgtaggcgcgtacngnn

SEQ ID NO: 82680 - DNA, 633 bp, Homo sapiens
  misc_feature: GYAE6OF02G6WI3.12.14.B03.1.454.CMB.1.raw
  modified_base (625)..(625): a, c, t, g, unknown or other
  misc_feature (625)..(625): n is a, c, g, or t
  modified_base (628)..(628): a, c, t, g, unknown or other
  misc_feature (628)..(628): n is a, c, g, or t
  modified_base (631)..(633): a, c, t, g, unknown or other
  misc_feature (631)..(633): n is a, c, g, or t
tcagatacgacgtacacgaccggtgctcgatttagtgtgagtagttccgcggggggggaggcttggttcggcctggcgggtccctgagactctcctgcgcagcctctggattcctttttgaggattttgccatgcactgggtccgcaagctccggggaggggcctggagtgggtctcaacaattacttggaatagtgctaccatagcctacacagactccgtgaagggccattcatcacttctagagacaacgccgagaacctccctgtatctgcagatgaacagtctgacgacctgaggacacggccctgtactttctgttacgaaaaggggtctcgtggttacaggggtagtcggggtctttggactccgtgggcccacgggaacccgtgggtacgcggttcgtcctacgacgtccctccgaacccgaacgggccctacgtccggttcccttcccccgtcgtccctaccccgtaccctaccgaacgacgcctacccgtccggtcggggccacgacgcccggcccgtcgggcctcggccctggtacgaacggtaccttacgttcccgtacgtcgtacgttccgtcgacggcgggtcgtcggtacgacggccgacgtacgtacgngtnctnnn

SEQ ID NO: 82681 - DNA, 591 bp, Homo sapiens
  misc_feature: GYAE6OF02FE3SA.12.14.B03.1.454.CMB.1.raw
  modified_base (357)..(357): a, c, t, g, unknown or other
  misc_feature (357)..(357): n is a, c, g, or t
tcagatacgacgtacacgaccggtgctcgatttagtgtgagtagtttgagtttgggggaggcttggtacagcctggggggtccctgagactctcctgtgcagcctctggattcacctttagcaactatgccatgagctgggtccgccaggctccagtgaaggggctggagtgggtctcaggtattagtggtagtggtggtagcagatactacgcagactccgtgaagggccggttcagcatctccagagacaattccaagaacacgctgtatttgcatatgaacagcctgagagccgagacacggccgtatattactgtgcgaagcttaggcggttaccggctacgagttgggggancgacgtggttccgacccgtggggacccaggggaaccctggtccaccgtctcccgtcacgccctccaccgaacgggcccaacgttccggtcccttcccccgtcggccaccccgttcctacccgaacgacgccaccgtccgtaggggccacgacgccggcccgtggctcgcctggtcaacggcttaccttcctaccgtcgttactcgtacgacggccgggcgtcggacgtaggccg

SEQ ID NO: 82682 - DNA, 607 bp, Homo sapiens
  misc_feature: GYAE6OF02GEK4P.12.14.B03.1.454.CMB.1.raw
  modified_base (182)..(182): a, c, t, g, unknown or other
  misc_feature (182)..(182): n is a, c, g, or t
tcagatacgacgtacacgaccggtgctcgatttagtgtgagtagttccgcggggagctctgggagaggagccccagccctgagattcccaggtgtttccattcagtgatcaacactgaacacagaggactcatcatggaattgggactgacctgcattttcctttggctattttaaagggtntccagtgtgaagtgcacttggaacaggtcggggggagcttggttcggcctgggcgggtcctgagactctcctgcgcagcctctggattcctttttgaggtattttcgcctatcgctacgtggggtcccggacaaggccgtccggggggaggggccctgggaggtggggtcctcgaaactaatttaccgttggaatagtgctacatagcctacacagcctcgtgaacggccattcatcacttcagagacaacgccgaatacctccctagtactcgtcgtacagtatacgacagtctagagacccgtggagaccaccgggtccttgtactttacgtgttacgaaggggtcttcggtggttacgaggggtagttcggggtacttttggacgttcccggtgggtaccccgtacgggaacccgttcgggg

SEQ ID NO: 82683 - DNA, 587 bp, Homo sapiens
  misc_feature: GYAE6OF02GJA22.12.14.B03.1.454.CMB.1.raw
  modified_base (347)..(347): a, c, t, g, unknown or other
  misc_feature (347)..(347): n is a, c, g, or t
  modified_base (401)..(401): a, c, t, g, unknown or other
  misc_feature (401)..(401): n is a, c, g, or t
  modified_base (582)..(582): a, c, t, g, unknown or other
  misc_feature (582)..(582): n is a, c, g, or t
  modified_base (585)..(585): a, c, t, g, unknown or other
  misc_feature (585)..(585): n is a, c, g, or t
  modified_base (587)..(587): a, c, t, g, unknown or other
  misc_feature (587)..(587): n is a, c, g, or t
tcagatacgacgtacacgaccggtgctcgatttagtgtgagtagttccgcgggggggggaggcttggttcggcctggtgggtccctgagactctcctgcgcagcctctggattcctttttgaggattttgccatgcactgggtccggcaagctccggggagggcctggagtgggtctcaaacaattacttggaatagtgctaccatagcctacacagactccgtgaagggccattcatcacttcagagacaacgccgaagaacctccctgtatctgcagatgaacagtctgagacctgaggacacggccctgtatttctgttacaaaaggggctctggttcgagggngtggggtctttgactccgtcggcccgacgggaacccgtggtcggcgtctcctcncgcctccaccgacggcccacgtccggtccttcccccgtcggccctaccctccctaccaacgacgccacccgttcggcggggcacgcggccggcccgcgggcgtcgccgtcggacgtaaggtaccttacttccgtccgttcgtactcgtgacggcggcgtcggacgacggccgacacgtgangcngn

SEQ ID NO: 82684 - DNA, 518 bp, Homo sapiens
  misc_feature: GYAE6OF02JLKJR.12.14.B03.1.454.CMB.1.raw
  modified_base (236)..(236): a, c, t, g, unknown or other
  misc_feature (236)..(236): n is a, c, g, or t
  modified_base (242)..(242): a, c, t, g, unknown or other
  misc_feature (242)..(242): n is a, c, g, or t
  modified_base (277)..(277): a, c, t, g, unknown or other
  misc_feature (277)..(277): n is a, c, g, or t
  modified_base (279)..(279): a, c, t, g, unknown or other
  misc_feature (279)..(279): n is a, c, g, or t
  modified_base (282)..(282): a, c, t, g, unknown or other
  misc_feature (282)..(282): n is a, c, g, or t
  modified_base (293)..(293): a, c, t, g, unknown or other
  misc_feature (293)..(293): n is a, c, g, or t
  modified_base (310)..(310): a, c, t, g, unknown or other
  misc_feature (310)..(310): n is a, c, g, or t
  modified_base (322)..(322): a, c, t, g, unknown or other
  misc_feature (322)..(322): n is a, c, g, or t
  modified_base (328)..(328): a, c, t, g, unknown or other
  misc_feature (328)..(328): n is a, c, g, or t
  modified_base (389)..(389): a, c, t, g, unknown or other
  misc_feature (389)..(389): n is a, c, g, or t
  modified_base (433)..(433): a, c, t, g, unknown or other
  misc_feature (433)..(433): n is a, c, g, or t
  modified_base (437)..(437): a, c, t, g, unknown or other
  misc_feature (437)..(437): n is a, c, g, or t
  modified_base (446)..(446): a, c, t, g, unknown or other
  misc_feature (446)..(446): n is a, c, g, or t
  modified_base (454)..(454): a, c, t, g, unknown or other
  misc_feature (454)..(454): n is a, c, g, or t
  modified_base (458)..(458): a, c, t, g, unknown or other
  misc_feature (458)..(458): n is a, c, g, or t
  modified_base (460)..(460): a, c, t, g, unknown or other
  misc_feature (460)..(460): n is a, c, g, or t
  modified_base (468)..(468): a, c, t, g, unknown or other
  misc_feature (468)..(468): n is a, c, g, or t
  modified_base (473)..(473): a, c, t, g, unknown or other
  misc_feature (473)..(473): n is a, c, g, or t
  modified_base (481)..(481): a, c, t, g, unknown or other
  misc_feature (481)..(481): n is a, c, g, or t
  modified_base (483)..(483): a, c, t, g, unknown or other
  misc_feature (483)..(483): n is a, c, g, or t
  modified_base (487)..(487): a, c, t, g, unknown or other
  misc_feature (487)..(487): n is a, c, g, or t
  modified_base (494)..(494): a, c, t, g, unknown or other
  misc_feature (494)..(494): n is a, c, g, or t
  modified_base (498)..(498): a, c, t, g, unknown or other
  misc_feature (498)..(498): n is a, c, g, or t
  modified_base (506)..(506): a, c, t, g, unknown or other
  misc_feature (506)..(506): n is a, c, g, or t
  modified_base (509)..(509): a, c, t, g, unknown or other
  misc_feature (509)..(509): n is a, c, g, or t
  modified_base (512)..(512): a, c, t, g, unknown or other
  misc_feature (512)..(512): n is a, c, g, or t
  modified_base (514)..(515): a, c, t, g, unknown or other
  misc_feature (514)..(515): n is a, c, g, or t
tcagatacgacgtacacgaccggtgctcgatttagtgtgagtagttccggggaggggcctggagtgggtctcaacaattacttggaatagtgctaccatagcctacacagactccgtgaagggccgattcatcacttctagagacaacgccgagaactccctgtatctgcagatgaacagtctgagacctgaggacacggccctgtatttctgttcaaaagggctgtgtacgaggngtggtntcgctcgtcgccgacggacgtggcgcgtctccgcncnccnccacgacgccngtccgtcctccgcgccncctccacacgcncctacncggcggcacgcggccgccgcgtcgcgcgagacgacgtacttacgtcgtacgtactcgtcgnggcggtcggtcgacggacgtacgggccacgtacgtagctacggngcgngcgagcgcngtacgcgngcgngngacgctcncgcgngcgcgcgngngcgngacgcgngtcnctcgcgcncgngcncnncgc

SEQ ID NO: 82685 - DNA, 718 bp, Homo sapiens
  misc_feature: GYAE6OF02I1ZXQ.12.14.B03.1.454.CMB.1.raw
  modified_base (178)..(178): a, c, t, g, unknown or other
  misc_feature (178)..(178): n is a, c, g, or t
  modified_base (277)..(277): a, c, t, g, unknown or other
  misc_feature (277)..(277): n is a, c, g, or t
  modified_base (707)..(707): a, c, t, g, unknown or other
  misc_feature (707)..(707): n is a, c, g, or t
  modified_base (715)..(715): a, c, t, g, unknown or other
  misc_feature (715)..(715): n is a, c, g, or t
tcagatacgacgtacacgaccggtgctcgatttagtgtgagtagttccgcggggggggaggcttggttcggcctggcgggtccctgagactctccgtgcgcgagcctctggatttcctttttgaggattttgccatgcactgggtccgcaagctccggggagggcctggagtgggtcncaacaattacttaggaatagtgctaccatagcctacacagactccgtgaagggccattcatcactttctagagacaacgccgaagaacctccctgtacnctgcagatagaacagtctcgacgacctagacggacaccggcccttacggttatttcgtagttaaccgaaaacggggccttacgttcgggttccgtaaggggtaggttccgggggttctttacggaccgttccggtaccgggtaccccgaacgggtaaccccgttcggggtaccggtcggtacccgtccgttaccgaacgtccccgtacccgaaccggaaccgggtccctacgtcccggttcccgttaccccgtcggacccgtaccctcccggtaccacgtaacgccaccgtcggtcggcctacgaccgccggccgtcggcgtccgtccgtacggtacgtaaccggtccttaacccttacgtaccgttacggtacgttcgacggtacggccggtcggacgtaccgaacgggtccacggtaacgcggtaccncgtgcgtntac

SEQ ID NO: 82686 - DNA, 728 bp, Homo sapiens
  misc_feature: GYAE6OF02FIMNX.12.14.B03.1.454.CMB.1.raw
  modified_base (709)..(709): a, c, t, g, unknown or other
  misc_feature (709)..(709): n is a, c, g, or t
  modified_base (716)..(716): a, c, t, g, unknown or other
  misc_feature (716)..(716): n is a, c, g, or t
  modified_base (725)..(725): a, c, t, g, unknown or other
  misc_feature (725)..(725): n is a, c, g, or t
tcagatacgacgtacacgaccggtgctcgatttagtgtgagtagttccgcgggggggggaggcttggttcggcctggcgggtccctgagactctcctgcgcagcctctggattcctttttgaggattttgccatgcactgggtccgcaagctccggggagggcctggagtggctcaacattacttggaatagtgctaccatagcctacacagacctccgtgaacgggccgattcatcaccttctagagacacgcgagacctccctgtactctgcagatgaacagtctggacctggacggtacgaccgtcccgtgtacgtttctcgttacgaaacggtacgttcgttcggttacgacgggtaggttacggggcttttacgacgtccgttcggggacccggaacggtacccgtacgggtcggcggttccgtaccctcgtacgccgtcctaaccggacggtaccctacgtccgttaccgtttcccccgtaccggtccaccccttacccctaccgaaaggtaccggacctaacccggtccggttccgggggacaacccgtaccgggccgggttacccgtcgggccgttcgcccggtttacgggtaccgaacgttaacccgttacctttacccgggacgtttcggttaccttaccgtaggggtcgaaccgggttcgtcggtaaccggtacggcccggggtaactaacggtacgnggtaccncgagtccgntcg

SEQ ID NO: 82687 - DNA, 624 bp, Homo sapiens
  misc_feature: GYAE6OF02J1IDS.12.14.B03.1.454.CMB.1.raw
  modified_base (168)..(168): a, c, t, g, unknown or other
  misc_feature (168)..(168): n is a, c, g, or t
  modified_base (214)..(214): a, c, t, g, unknown or other
  misc_feature (214)..(214): n is a, c, g, or t
  modified_base (278)..(278): a, c, t, g, unknown or other
  misc_feature (278)..(278): n is a, c, g, or t
  modified_base (417)..(417): a, c, t, g, unknown or other
  misc_feature (417)..(417): n is a, c, g, or t
  modified_base (464)..(464): a, c, t, g, unknown or other
  misc_feature (464)..(464): n is a, c, g, or t
  modified_base (479)..(479): a, c, t, g, unknown or other
  misc_feature (479)..(479): n is a, c, g, or t
  modified_base (624)..(624): a, c, t, g, unknown or other
  misc_feature (624)..(624): n is a, c, g, or t
tcagatacgacgtacacgaccggtgctcgatttagtgtgagtagttccgcggggggggaggcttggttcggcctggcgggtccctgagactctcctgcgcagcctctggattcctttttgaggtattttgccatgcactgggtccgcaagctccggggagggcctggngtgggtctacaacattacttggaatagtgactaccatagcctacanagactccgtgaacggtccgattcatctacttctagagaccacgccgagaacctccctgtactcngacagatagaacagtctgaacgaccgtgaaggaccaccggtccctaggttactttcagttaaccgaagggtcttcgtggttacgagggtggtcggtacttgacctccgcggacctacgggacctggcgacgttcgcctnaccgccctccgacgtacgggccctacgtaccggtcctcccgcgcccncctccgtacacgacnccgacgtcggtcggacacgtacgccggtccgtcggctcggtcgtaccggtcgaaccgtccttaaccgttcctacggtacgtacgtccgtggacggtacggcggttacggacggtacggcgtaacgacgtacgtagctcgagtcgn

SEQ ID NO: 82688 - DNA, 595 bp, Homo sapiens
  misc_feature: GYAE6OF02IBVLQ.12.14.B03.1.454.CMB.1.raw
  modified_base (284)..(284): a, c, t, g, unknown or other
  misc_feature (284)..(284): n is a, c, g, or t
  modified_base (301)..(301): a, c, t, g, unknown or other
  misc_feature (301)..(301): n is a, c, g, or t
  modified_base (371)..(371): a, c, t, g, unknown or other
  misc_feature (371)..(371): n is a, c, g, or t
  modified_base (378)..(378): a, c, t, g, unknown or other
  misc_feature (378)..(378): n is a, c, g, or t
  modified_base (412)..(412): a, c, t, g, unknown or other
  misc_feature (412)..(412): n is a, c, g, or t
  modified_base (417)..(417): a, c, t, g, unknown or other
  misc_feature (417)..(417): n is a, c, g, or t
  modified_base (420)..(420): a, c, t, g, unknown or other
  misc_feature (420)..(420): n is a, c, g, or t
  modified_base (583)..(583): a, c, t, g, unknown or other
  misc_feature (583)..(583): n is a, c, g, or t
  modified_base (591)..(591): a, c, t, g, unknown or other
  misc_feature (591)..(591): n is a, c, g, or t
  modified_base (593)..(593): a, c, t, g, unknown or other
  misc_feature (593)..(593): n is a, c, g, or t
tcagatacgacgtacacgaccggtgctcgatttagtgtgagtagttccgcgggggggggaggcttggttcggcctggcgggtccctgagactctcctgcgcagcctctggattcctttttgaggatttttgccatgcactgggtccggcaagctccgggggaggggcctggaggtgggtctcaaacaattacttggaatagtgctaccatagcctacacagacctccggtagaagggccgattcatcacttctagagacaacgccgagaacctccctgtactcngcagatgaactacgtcnggacgacctggaggaccacgggccccttagttattttcgtgttaacgaaagggtctcgtggttcgagggngtgggtntttgctccgcggccgaggaccgtgcgtcgtctcncgacnccnccacgacggcctacgtccgtcctcccgtcgccctccctccaccacgcgcctaccgtccggtcgggacacgaccggccgtccgtcggcgtacgtccgtcggactaacgtaccttacttccgtacgtctcgtcgtcggacgtcggcgtacggacgacgcgacgtnaggcagcncngc

SEQ ID NO: 82689 - DNA, 791 bp, Homo sapiens
  misc_feature: GYAE6OF02JMPYA.12.14.B03.1.454.CMB.1.raw
  modified_base (761)..(761): a, c, t, g, unknown or other
  misc_feature (761)..(761): n is a, c, g, or t
tcagatacgacgtacacgaccggtgctcgatttagtgtgagtagttccgcgggagctctgggagaggagccccagccctgagattcccaggtgtttccattcagtgatcaaacactgaacacagaggactcatcatggaattgggactgacctgactactttttcctttggctttaagtttttaaacgggtgtccaggttgtgaacgttgctacgttggaaacgacgggtcgggggggaggtcctttgggttccgggtccgtggggtaccggggttcccctaggacggtaccttccgtacccgttggccggacagttccccttacgttgggttacttttccgtttttggacggtttaacgtttttcgccgtaattcgtacctacggttccggggtccggtacgtaacggtccgggtaccgggggtacggggtccgtcgggtaggttccgggtactaccgaaacgtaacgttacttaggtaagtacgtcggacctacgagtacgctacagctcgtacgtagaacgctattcactctaccgttagtaacgataaccggaaccgtacgaacttaccgtacccgttagtacgtcctagccgtaagtcgtaacgtaaacctcggtactaggaccgtaccgtagggaccgttaaccggccgttacccgttagtttaaacttccggtttaagaaacggtaaccgggttgttaaccggtgggttacacggggtttaagtccggttacgttttacggcccggttccgggnggttaaccccggtacgggttacccctaggg

SEQ ID NO: 82690 - DNA, 1180 bp, Homo sapiens
  misc_feature: GYAE6OF02FY5OE.12.14.B03.1.454.CMB.1.raw
tcagatacgacgtacacgaccggtgctcgatttagtgtgagtagttccgcgggggggggaggcttggttcggcctggcgggtccctgagactctcctgcgcagcctctggattcctttttgaggattttgccatgccactgggtccggcaagcgtccggggagggcctggagtgggtctcaacaattacttggaatagtgctaccatacgcctacacagtcctccgtgaacgggccgattcatctacttactagacgaacaacggccgaacgaaccttccccgtagttactccgtgaccgtagtacgtacgaaactacggttaccgtacggtaaccgtaccgttacgggaaccggtacccgaaccccgggttccccgttttaacggttttaaccgttttttccggtttaacgggtttaaccccgggtaaaaaacggggggtttccccttacgggtttttacgggggtttaaccgggtaagggggtttaacggggtttccggggggtttaccgtttttaacccggggttaaccgtttacccccggggtttaccccggggtaaccccccggtaaaccggggggtttaaacccccggttcggggtttacccggtttccccgggtttaccccggtttaaccccgttacccgggtaacccggtttacccccgttaaaccccccggtaaccccggggtaaaaccccggggtacccccgttaaacccgggtttaccccccggggtttttccccccgtttaccccccccggggtttaccggggttacccccccgttaaccccccggttttacccccggtaaacccgtaaaccccgggtaaacccgtaccccccggggttaaacccccgggtttccgggggttaacccgggggacccgtaacccgggttaccccggggtaacccccggggttaccccgggttccgggggttacccggttacccgggtaaccccgggtttccggggtaaaccccgggttaaacccggtttaaccgtttaaaccccgggtttacccggttaacccggtttcccgggttacccggttaaccggttacccggggaacgggggttaccccggggtccgggtaccggggtaacccgggttaacccggggaaccgggtttacccgtaaacggtccggtaaaggtcccggtagcccgggtagtacgg

SEQ ID NO: 82691 - DNA, 684 bp, Homo sapiens
  misc_feature: GYAE6OF02JEVHT.12.14.B03.1.454.CMB.1.raw
  modified_base (148)..(148): a, c, t, g, unknown or other
  misc_feature (148)..(148): n is a, c, g, or t
  modified_base (274)..(274): a, c, t, g, unknown or other
  misc_feature (274)..(274): n is a, c, g, or t
  modified_base (292)..(292): a, c, t, g, unknown or other
  misc_feature (292)..(292): n is a, c, g, or t
  modified_base (678)..(678): a, c, t, g, unknown or other
  misc_feature (678)..(678): n is a, c, g, or t
  modified_base (681)..(681): a, c, t, g, unknown or other
  misc_feature (681)..(681): n is a, c, g, or t
tcagatacgacgtacacgaccggtgctcgatttagtgtgagtagttccgcgggggggggaggcttggttcggcctggcgggtccctgagactctcctgcgcagcctctggattcctttttgaggattttgccatgcactgggtccggnaagctccggggaggggcctgggagtgggtctcaacaattacttggaatagtgctaccatagcctacacagactccgtgaacgggccgattcatcacttctagacgacaacgccgtagaactcccgngtatctgcagatagaacngtctgacactgagacacggcctgtattcgtagtacgaaacgggctcgtggttacagggatggggtactttgacgttccgtcggaccgaacgggtacctaggtccgtcggtctccctcgacgaccctaccgaccgaacgggcccagttcccgttacccgttcccccgtggaccctacccctaccgtaacccgtaaggaccgtcccgtaacccgtcgggtcggggaccaaccggtaccggcccggtacccgtcgggcgttaccggccgttaccggtaaccgtaaccggtaacgtttacccgttaccgttaaccgttaccgtaacgttccgacggacgggtcgggccggtacggtaccggaaccggccgtacgtaaccgtgacgcgtancgngcg

SEQ ID NO: 82692 - DNA, 761 bp, Homo sapiens
  misc_feature: GYAE6OF02HWHVR.12.14.B03.1.454.CMB.1.raw
  modified_base (621)..(621): a, c, t, g, unknown or other
  misc_feature (621)..(621): n is a, c, g, or t
  modified_base (631)..(631): a, c, t, g, unknown or other
  misc_feature (631)..(631): n is a, c, g, or t
tcagatacgacgtacacgaccggtgctcgatttagtgtgagtagttccgcggggagctctgggaggaggagccccagccctgagattcccaggtgtttccattcagtgatcaacactgaacacagaggactcatcatggaattgggactgacctgctattttccttttggacttaagttttaaagggtgttccgtagttgtagaagtgactacgttggaaactagggtcgggggggaaggtcgttgggttccggccgtcgggccggggttcccctggacgtacttccgtccgtgaccgcacgtcctgtaggttacttttccgttttagaggttagttttcgcctaagttcgacctacggttacggggtcccggacgaacggtccggttacccgggggggaacggggtccgtaggggacggttcgggtactaccgtaaacgtaacttaccgttaggaactaggtaccaccgtaacctagtaacgtacccttaacgacgacgtacgtaccggtaggaaaggggtcccttagtaccaattcctaacgttcgtaagaacgtaacaccggtcgaacgtaaacctccggtataacgtcgctaacgtagactagaacgtcgtcgtaanaccggttacnggaacgacccgtaccgtccgtttatagtttcgacggttaaagacggttcgttacggtcgttacggaggggtacttggggtacctttaccggctccggggtaccggaacccggttacggaccgttccgggg

SEQ ID NO: 82693 - DNA, 792 bp, Homo sapiens
  misc_feature: GYAE6OF02JV2NP.12.14.B03.1.454.CMB.1.raw
  modified_base (470)..(470): a, c, t, g, unknown or other
  misc_feature (470)..(470): n is a, c, g, or t
tcagatacgacgtacacgaccggtgctcgatttagtgtgagtagttccgcggggggggaggcttggttcggcctggcgggtccctgagactctcctgcgcagcctctggatttccttttgaggtatttgccatgcactgggtccgcaagccgtccggggagggcctggagttgggtctcaaacaatttacttggaattacgtgcctaccatagcctacacgatacgtccgtggaacgggcctattccatctacttctagagacaacgcgaagtactccgtgtatccgtgtcacgatacgtaacagttacgtagacgtacccgtggtacggaaccaaccggtccccttaggttactttccgttaggttaaccgtaaagggcttcgtacggttcgaggggtacgttcgggtacgtttcgaccgttcggtaccggacccgtaacggtaacccgtgggtaccgtcgggtttccncccgttacgtaccgtcccttaacccggaacccggtaaacggtccccgttacgtacccgggtttacccctttccccccggtaccggtccccgtaacccctaccccggttaccgaaacggtccgtaacccgtcccgttaccgggttccggggaaccacggtaacccggtcccgggtcccgtaacgggtcccttccggggccctacgggtaaccgaacgttacccgttaccgtttcccgtacggtttaccgtacgttcgtacggacggtccgggtaacggtcggcgaacggtcgtaaccgtacgtacggctaacgcgacgatccg

SEQ ID NO: 82694 - DNA, 761 bp, Homo sapiens
  misc_feature: GYAE6OF02HLPHL.12.14.B03.1.454.CMB.1.raw
  modified_base (241)..(241): a, c, t, g, unknown or other
  misc_feature (241)..(241): n is a, c, g, or t
tcagatacgacgtacacgaccggtgctcgatttagtgtgagtagtttgagtttgggggaggctttggtacagcctgggggggtccctgagactctcctgtgcagcctctggattcacctttagcaactatgccatgagcgtgggtccgccaggctccagtagaaggggctggagtgggtctctggtattagtggtagtggtggtagcagatactacgcagactccgtaggaagggccgttnagcatctaccagagacaattccaaagaacacgctgtatttgcatatagaacagccgtagagagaccggaaggaccgaccggaccgtattattactgtagacgaagtacttaggtaccgggttaccggacgtaacgtaggttagggggacgtccggacgttcgggttcccgaacccccgggtggggacccggaaccggggaaccccgttggtacccgtaccccggttcctacccgtaccgaccgtccccgtaccccaacccgggaaaccgggccccgtaaccggttcccgggttcccctttacccccggccggtaccccgtaccccccttaccctaacccgaacgtaccgtaccctacccgtcgggtaccggggaccaccggaccggtccccggtcccgggtccgggtccgtccggtccgttacggggtacctaacgggtaccctttaccggttacccgtttaacggtacgtttacttcggtacggcgggtaccgggccgtacggggacgaacgggtcccg

SEQ ID NO: 82695 - DNA, 949 bp, Homo sapiens
  misc_feature: GYAE6OF02H66SD.12.14.B03.1.454.CMB.1.raw
  modified_base (937)..(937): a, c, t, g, unknown or other
  misc_feature (937)..(937): n is a, c, g, or t
  modified_base (942)..(942): a, c, t, g, unknown or other
  misc_feature (942)..(942): n is a, c, g, or t
tcagatacgacgtacacgaccggtgctcgatttagtgtgagtagttccgcggggggggggaggcttggttcggcctggcgggtccctgagactctcctgcgcagccctctggatttccttttttggaggtattttgccatgcacgtgggtccggcaagccgtccgggggaggggcctggaggtgggtctacaaacaattacttaggaatagtcgactaccatagcctacacagactccggtaggaagggccaattcatacgtacttactaagagtaacaaaccggtaccgaagtaaaccctccttaggtaacttcgtcgacgaagtaacgtagaaaccagtaccgtagaacgaccgtacggaggaaccgaaccggtccccgttagttacttttacgttacgttaacggaaaacggtccgttacggttacggtttaccggaagggggtaggttagggggttacgtttacggtaccgttaccggtacccggggtaccccgtaaacgggggtacccgggttacgggtaaccgggtcccgggttacccgttacccgttcggaacccgttacccgaaccccggtaaaccccgggaaaccgggtacccccggtaaacggttttcccccgggttacccccgttttacccccccggtccccgggttaccccctaacccccgtaccccgtttaaccggaaaaccgggacccgtacccgtaaaccccggttaccggggttacccgggggaacccgaacccggtacccggggtaccccggggtcccgggttaccgggtcccggtacccggtaccgggttccgggtaaaccggtaaccggtaacccgttttacctttaccgggttaccgttaccgtaaccgttaccgtacgggaaccgggttccgggaaccggttacgggacggtacggtaccgtacggtaagtcgtangtacncgtgacg

SEQ ID NO: 82696 - DNA, 887 bp, Homo sapiens
  misc_feature: GYAE6OF02G59F8.12.14.B03.1.454.CMB.1.raw
  modified_base (382)..(382): a, c, t, g, unknown or other
  misc_feature (382)..(382): n is a, c, g, or t
tcagatacgacgtacacgaccggtgctcgatttagtgtgagtagtttgagtttgggggaggcttggtacagcctggggggtccctgagactctcctgtgcagcctctggattcacctttagcaactatcgccatgagctgggtccgccaggctccaggtggaaggggctgggaggtgggtctacgaggttattaggtggtagtggttggtagcagatactacgcagacgtccgtaggaacgggtccggttcagcacgttcctaccgaagagactaacgttaccaaagaacacgacgttagttaacttttgctaattagtagaaactagccgttaggacggaacggccggaacggacgaccgggtaccgtaattacgtttacnggtgacgtaacgtacgttaggaccggtttaccggactacggtaggttcgggggagtcggtaacggtcggttacccggtacccgtcgggggaacccgaaccggggtaacccgttcgggtaccctaaccggttccgtaccctccggaacccgtcccgttaacccaaaccggtaccggggtaccctacggttacccgggttcccctttacccccggtacgggtacccctacccccgttacccgtacccgaaacgtacccgaacccgttacccgttccgggttaccgggggtacccgtaaccgaccggggtccccgggtacccggttcggggtacccttccgggttaacccgggttccggggtttaacccgaaaccggggttttaacccgttacccggttttaaccccggtttaaccgggttaacccgtttaaccgggttaccccgttagggtaaccggggttccccgggggttacgggtacccggggtaaccggtacggggtaacccg

SEQ ID NO: 82697 - DNA, 722 bp, Homo sapiens
  misc_feature: GYAE6OF02GIVSU.12.14.B03.1.454.CMB.1.raw
  modified_base (259)..(259): a, c, t, g, unknown or other
  misc_feature (259)..(259): n is a, c, g, or t
  modified_base (280)..(280): a, c, t, g, unknown or other
  misc_feature (280)..(280): n is a, c, g, or t
tcagatacgacgtacacgaccggtgctcgatttagtgtgagtagttccgcggggaggctcgtgggagaggagtccccagccctgagattcccaggtgtttccagttcagtgatcaacgactgaacacagaggactcatcatggaattgggactgacctgctattttcctttggacttagttttaaaggtgtccagtgtagaagtcgcacgttggaactaggtcggggggagtcttgggtcggctgggcgggtccctganacctctcctgccgcagtcctntggtatttccgttttgagtattttcgcctatgctacggtcgggtccgacaacggtccgtaccgggggaggtccgttacgggagttcgggtctacgactaaagttaccgttgggaaataggtcgtaccctaacgtacgacgtacccgtagtaacacggtaccttccgggtaaggaacgggccctaagtttccgaactctaccgtttacgacgtaacgaacccaaacgggtcccgaaacggttaaccctccggttaagtacgtacttaccggtacgaacggtacttacggaaacttcggtacctaaggccgtacgtaggtacgaccgtcgtcgttagttacttctaggtacgtaagggttcctaggttggtaccggagggttacggtcgggttaccttacggtccggttaccggtccgggtaacccggcgggttacccgtcggg

SEQ ID NO: 82698 - DNA, 505 bp, Homo sapiens
  misc_feature: GYAE6OF01A5EMT.22.57.F02.1.454.CMB.1.raw
tcagacatacgcgtcacgaccggtgctcgatttagctcgatatagttgggtttgggaggctggtctcactttgtgcaggagtcagacccagtcaggacacagcatggacatgagggtccccgctcagctcctggggctcctgctgctctggctcccaggtgccaagtgtgacatccagatgacccagtctccttccaccctggctgcatctgtaggagacagagtcaccatcacttgtcgggccagtcagaatattaatagttggttggcctggtatcagcagaaaccagggaaagcccctatactcctgatccacaaggcgtctactttagaaagtggggtcccatcaaggttcagcggcactggatctgggacagaattcactctcaccatcaacagctgcagcctgatgatttggactaacttactactgaccaaccgtatacgtacttattcggtcaccgttcggccaagggcacgactaggacattaaacgactgtggtc

SEQ ID NO: 82699 - DNA, 509 bp, Homo sapiens
  misc_feature: GYAE6OF01BTW53.22.57.F02.1.454.CMB.1.raw
  modified_base (483)..(483): a, c, t, g, unknown or other
  misc_feature (483)..(483): n is a, c, g, or t
  modified_base (503)..(503): a, c, t, g, unknown or other
  misc_feature (503)..(503): n is a, c, g, or t
tcagacatacgcgtcacgaccggtgctcgatttagctcgatatagttgggtttgggggagtcagacccagtcaggacacagcatggacatgagggtccccgctcagctcctggggctcctgctgctctggctcccaggtgccaagtgtgacatccagatgacccagtctccttccaccctggctgcatctgtaggagacagagtcaccatcacttgtcgggccagtcagaatattaatagttggttggcctggtatcagcagaaaccagggaaagcccctatactcctgatccacaaggcgtctactttagaaagtggggtcccatcaaggttcagcggcactggatctgggacagaattcactctcaccatcaacagccctgcagcctgatgatttggctaacttactactgaccaacgtattacgtacttattccggtctaccttcggcccaagggacacgactggagattaaacgactgnggctgcacctatctgtcttnattccc

SEQ ID NO: 82700 - DNA, 500 bp, Homo sapiens
  misc_feature: GYAE6OF01D912A.22.57.F02.1.454.CMB.1.raw
  modified_base (484)..(484): a, c, t, g, unknown or other
  misc_feature (484)..(484): n is a, c, g, or t
tcagacatacgcgtcacgaccggtgctcgatttagctcgatatagttgggtttgggaggctggtctcactttgtgcaggagtcagacccagtcaggacacagcatggacatgagggtccccgctcagctcctggggctcctgctgctctggctcccaggtgccaagtgtgacatccagatgacccagtctccttccaccctggctgcatctgtaggagacagagtcaccatcacttgtcgggccagtcagaatattaatagttggttggcctggtatcagcagaaaccagggaaagcccctatactcctgatccacaaggcgtctactttagaaagtggggtcccatcaaggttcagcgcactggatctgggacagaattcactctcaccatcaacagcctgcagcctgatgatttggctaacttactactgaccaacgtatagtacttatcgtctaccttcggaccaagggcacgactagganattaaacgactgtggc

SEQ ID NO: 82701 - DNA, 553 bp, Homo sapiens
  misc_feature: GYAE6OF01A6F1S.22.57.F02.1.454.CMB.1.raw
  modified_base (546)..(546): a, c, t, g, unknown or other
  misc_feature (546)..(546): n is a, c, g, or t
tcagacatacgcgtcacgaccggtgctcgatttagctcgatatagttgggtttgggggagtcagacccagtcaggacacagcatggacatgagggtccccgctcagctcctggggctcctgctgctctggctcccaggtgccaagtgtgacatccagatgacccagtctccttccaccctggctgcatctgtaggagacagagtcaccatcacttgtcgggccagtcagaatattaatagttggttggcctggtatcagcagaaaccagggaaacgcccctatactcctgatccacaaggcgtactactttagaaagtgggtacccatcaaggttcagcggcacgtggatctgggacaggaattcactctcaccatacaacagcctgcagcctgatgatttggactaacttactactgacccaacgtatagtactttactttccggtactacccgtttcggacctaacggggacaaccggtacgtaggagtaacttaaaacggtaactggtaggtcctagaccaccgtattccttagttccttctnttccccg

SEQ ID NO: 82702 - DNA, 505 bp, Homo sapiens
  misc_feature: GYAE6OF01B5W8N.22.57.F02.1.454.CMB.1.raw
  modified_base (377)..(377): a, c, t, g, unknown or other
  misc_feature (377)..(377): n is a, c, g, or t
  modified_base (493)..(493): a, c, t, g, unknown or other
  misc_feature (493)..(493): n is a, c, g, or t
  modified_base (499)..(499): a, c, t, g, unknown or other
  misc_feature (499)..(499): n is a, c, g, or t
tcagacatacgcgtcacgaccggtgctcgatttagctcgatatagttgggtttgggggagtcagacccagtcaggacacagcatggacatgagggtccccgctcagctcctggggctcctgctgctctggctcccaggtgccaagtgtgacatccagatgacccagtctccttccaccctggctgcatctgtaggagacagagtcaccatcacttgtcgggccagtcagaatattaatagttggttggcctggtatcagcagaaaccagggaaagcccctaatactcctgatccacaaggcgtctactttagaaagtgggtccatcaaggttcagcggcacgtggatctgggacagaattcactctcaccatcaacngcctgcagccctgatgatttggactaaacttactactgacccaacgtatagtacttattcgtctaccttcggcaaggcacgactgagaattaaacgactgtggctgcacgtatctntcttcnttcccg

SEQ ID NO: 82703 - DNA, 572 bp, Homo sapiens
  misc_feature: GYAE6OF01CR3LW.22.57.F02.1.454.CMB.1.raw
tcagacatacgcgtcacgaccggtgctcgatttagctcgatatagttgggtttgggaggctggtctcactttgtgcaggagtcagacccagtcaggacacagcatggacatgagggtccccgctcagctccgtggggctcctgctgctctggctcccaggtgccaagtgtgacatccagatgacccagtctccttccacctggctgcatctggtaggagacagagtcaccatcacttgtcgggccagtcaagaatattaataggttggtgctggtatcgagcaagaaaccagggaaacgccctaatacctcctagactccaacgaaggccgttacttaaacgtttaaggaaaacggttcgggggtaccctagtaccgtaagggttcaacggtcggactacgtggtactcgtacggggacaagtaacttcactctacacctatacaacacgcctgaccagcctgatgtatttcggactaactactactacgacctaaccgtatacgttacttacgtcgtactaccgtcggacgaacggtcacgacgtaggtaactattaaacgactggtgacg

SEQ ID NO: 82704 - DNA, 501 bp, Homo sapiens
  misc_feature: GYAE6OF01B9WNQ.22.57.F02.1.454.CMB.1.raw
  modified_base (466)..(466): a, c, t, g, unknown or other
  misc_feature (466)..(466): n is a, c, g, or t
  modified_base (479)..(479): a, c, t, g, unknown or other
  misc_feature (479)..(479): n is a, c, g, or t
  modified_base (497)..(498): a, c, t, g, unknown or other
  misc_feature (497)..(498): n is a, c, g, or t
tcagacatacgcgtcacgaccggtgctcgatttagctcgatatagttgggtttgggggagtcagacccagtcaggacacagcatggacatgagggtccccgctcagctcctggggctcctgctgctctggctcccaggtgccaagtgtgacatccagatgacccagtctccttccaccctggctgcatctgtaggagacagagtcaccatcacttgtcgggccagtcagaatattaatagttggttggcctggtatcagcagaaaccagggaaagcccctatactcctgatccacaaggcgtctactttagaaagtggggtccccatcaaggttcagcggcactggatctgggacagaattcactctcaccatcaacagccctgcagccctgatgatttggctaacttactactgccaacgtatagtacttattcggtctaccttcggcaagggacacgactgganattaaacgactgnggctgcacatctgtcttnntcc

SEQ ID NO: 82705 - DNA, 540 bp, Homo sapiens
  misc_feature: GYAE6OF01ERMLK.22.57.F02.1.454.CMB.1.raw
tcagacatacgcgtcacgaccggtgctcgatttagctcgatatagttgggtttgggggagtcagacccagtcaggacacagcatggacatgagggtccccgctcagctcctggggctcctgctgctctggctcccaggtgccaagtgtgacatccagatgacccagtctccttccaccctggctgcatctgtaggagacagagtcaccatcacttgtcgggccagtcagaatattaatagttggttggcctggtatcagcagaaaccagggaaagcccctatactcctgatccacaaggcgtctacttttagaaagtggggtcccatcaaggttcagcggcactggatctgggacagaattcactctcaccatcaacagcctgcagccctgactgattttgggacctaaacgtttactactgacccaaccgttataacgttactttattccggtctaccctttcggaccaagggaccacgactacgggagtaattaaaacgacttaggtcggctaggccaccatctagtcttcacttccc

SEQ ID NO: 82706 - DNA, 510 bp, Homo sapiens
  misc_feature: GYAE6OF01B44VP.22.57.F02.1.454.CMB.1.raw
tcagacatacgcgtcacgaccggtgctcgatttagctcgatatagttgggtttgggaggctggtctcactttgtgcaggagtcagacccagtcaggacacagcatggacatgagggtccccgctcagctcctggggctcctgctgctctggctcccaggtgccaagtgtgacatccagatgacccagtctccttccaccctggctgcatctgtaggagacagagtcaccatcacttgtcgggccagtcagaatattaatagttggttggcctggtatcagcagaaaccagggaaagccctatactcctgatccacaaggctctactttagaaagtggggtccatcaaggttcagcgcactggatctgggacagaattcaatctcaccatacaacagcctgcagcctgatgatttggactaacttactactcgacctaaccgtatagtacttattcgtctaccgttcggaccaagggcacgtactaggaagattaaacgacgtgtggtacg

SEQ ID NO: 82707 - DNA, 513 bp, Homo sapiens
  misc_feature: GYAE6OF01D65NY.22.57.F02.1.454.CMB.1.raw
  modified_base (294)..(294): a, c, t, g, unknown or other
  misc_feature (294)..(294): n is a, c, g, or t
  modified_base (393)..(393): a, c, t, g, unknown or other
  misc_feature (393)..(393): n is a, c, g, or t
tcagacatacgcgtcacgaccggtgctcgatttagctcgatatagttgggtttgggaggctggtctcactttgtgcaggagtcagacccagtcaggacacagcatggacatgagggtccccgctcagctcctggggctcctgctgctctggctcccaggtgccaagtgtgacatccagatgacccagtctccttccaccctggctgcatctgtaggagacagagtcaccatcacttgtcgggccagtcagaatattaatagttggtggcctggtatcagcagaaaccagggaanccctatactcctgatccacaaggctctactttagaaagtgggtcccatcaaggttcagcggcactggatctgggacagaattcactctcaccatcaacngcctgcagcctgatgatttggctaacttactactgccaacgtatacgtacttattccggtctaccgttcggaccaaggggccacggactagggtacgaactttaaacggacttggtggtc

SEQ ID NO: 82708 - DNA, 536 bp, Homo sapiens
  misc_feature: GYAE6OF01A9AHU.22.57.F02.1.454.CMB.1.raw
tcagacatacgcgtcacgaccggtgctcgatttagctcgatatagttgggtttgggggagtcagacccagtcaggacacagcatggacatgagggtccccgctcagctcctggggctcctgctgctctggctcccaggtgccaagtgtgacatccagatgacccagtctccttccaccctggctgcatctgtaggagacagagtcaccatcacttgcgggccagtcagaatattaatagttggttggcctggtatcagcagaaaccagggaaagcccctatactcctgatccacaaggcgtctactttagaaagtgggtcccatcaaggttcagcggcactggatctgggacagaattcactctcaccatcaacagcctgcagcctgatgatttggactaacttactactcgacctaaccgtattacgtactttacgttccggtactaccgttcggaccaaggggaccaacggacgtggaagtaacttaaacggacgtggtacggctagaccacctatactgtccttcgcttcccg

SEQ ID NO: 82709 - DNA, 527 bp, Homo sapiens
  misc_feature: GYAE6OF01AI99T.22.57.F02.1.454.CMB.1.raw
  modified_base (293)..(293): a, c, t, g, unknown or other
  misc_feature (293)..(293): n is a, c, g, or t
tcagacatacgcgtcacgaccggtgctcgatttagctcgatatagttgggtttgggaggctggtctcactttgtgcaggagtcagacccagtcaggacacagcatggacatgagggtccccgctcagctcctggggctcctgctgctctggctcccaggtgccaagtgtgacatccagatgacccagtctccttccaccctggctagcatctgtaggagacagagtcaccatcacttgtcggccagtcagaatattatagttggtggcctggtatcagcagaaaccagggaanccctatactcctgactccacaaggctctacttagaaagtgggtccatcaaggttcagcgcacgtggatcgtgggacagaattcactctcacatcaacacgcctgcagcctgatgatttcggacctaactttactacgtcacccgtaacgtatacgttacttacttccggtactaccgttcggaccgtaagggaccacgaacgtcggtaagtacgttaaacgacgttgtggtacg

SEQ ID NO: 82710 - DNA, 549 bp, Homo sapiens
  misc_feature: GYAE6OF01BF4AW.22.57.F02.1.454.CMB.1.raw
  modified_base (295)..(295): a, c, t, g, unknown or other
  misc_feature (295)..(295): n is a, c, g, or t
tcagacatacgcgtcacgaccggtgctcgatttagctcgatatagttgggtttgggaggctggtctcactttgtgcaggagtcagacccagtcaggacacagcatggacatgagggtccccgctcagctcctggggctcctgctgctctggctcccaggtgccaagtgtgacatccagatgacccagtctccttccaccctggctgcatctgtaggagacagagtcaccatcacttgtcgggccagtcagaatattaatagttggttggcctggtatcagcagaaaccagggaanccctatactcctgatccacaaggctctacttagaaagtggggtcccatcaaggttcagcggcactggatctgggacagaattcactctacaccatcaacagcctaacagcctgatgtatttggacctaacttactacctacgaccctaaaccgttatacgttaaccttagttccggtcctaacccgtttcggacccgtaaggggaccaaccggactagggaacgtaacttaaacggaacttggtacggctacgg

SEQ ID NO: 82711 - DNA, 533 bp, Homo sapiens
  misc_feature: GYAE6OF01EZ0SM.22.57.F02.1.454.CMB.1.raw
  modified_base (218)..(218): a, c, t, g, unknown or other
  misc_feature (218)..(218): n is a, c, g, or t
  modified_base (290)..(290): a, c, t, g, unknown or other
  misc_feature (290)..(290): n is a, c, g, or t
  modified_base (524)..(524): a, c, t, g, unknown or other
  misc_feature (524)..(524): n is a, c, g, or t
tcagacatacgcgtcacgaccggtgctcgatttagctcgatatagttgggtttgggaggctggtctcactttgtgcaggagtcagacccagtcaggacacagcatggacatgagggtccccgctcagctcctggggctcctgctgctctggctcccaggtgccaagtgtgacatccagatgacccagtctccttccaccctggctgcatctgtagganacagagtcaccatcacttgcggccagtcagaatattaatagttggtgctggtatcagcagaaccgaggaacnccctatactctgactccacaaggctctaattagaaagtcgggtaccatcgaaggttcagcggacacgtggactcgtagggacagtaattcactctacaaccatacaacgcgtcctagccagcctagatgtatttcgactaacttactactcgtaccaacttatacgtactttacgtccgtacctaccgttccggaccaacgggaccacggacgtaggaacgtaacttaaaccgnttggcggtc

SEQ ID NO: 82712 - DNA, 543 bp, Homo sapiens
  misc_feature: GYAE6OF01EXGJU.22.57.F02.1.454.CMB.1.raw
  modified_base (297)..(297): a, c, t, g, unknown or other
  misc_feature (297)..(297): n is a, c, g, or t
tcagacatacgcgtcacgaccggtgctcgatttagctcgatatagttgggtttgggaggctggtctcactttgtgcaggagtcagacccagtcaggacacagcatggacatgagggtccccgctcagctcctggggctcctgctgctctggctcccaggtgccaagtgtgacatccagatgacccagtctccttccaccctggctgcatctgtaggagacagagtcaccatcacttgtcgggccagtcagaatattaatagttggttggcctggtatcagcagaaaccagggaaacnccctatactcctgatccacaaggctctacttagaaagtggggtccatcaaggttcagcggcactggatcgtgggacagtaattcactctcaccatcaacagcctgcagcctgatgatttggactaacttactactcgaccctaacgtatacgttacttacgttccggtacctacccgtttcggtacaaacggggtacaaccggtacgtagggtaacgtaacttaaaaccggacttggtcggtaccg

SEQ ID NO: 82713 - DNA, 574 bp, Homo sapiens
  misc_feature: GYAE6OF01EFU6Z.22.57.F02.1.454.CMB.1.raw
  modified_base (546)..(546): a, c, t, g, unknown or other
  misc_feature (546)..(546): n is a, c, g, or t
tcagacatacgcgtcacgaccggtgctcgatttagctcgatatagttgggtttgggggagtcagacccagtcaggacacagcatggacatgagggtccccgctcagctcctggggctcctgctgctctggctcccaggtgccaagtgtgacatccagatgacccagtctccttccaccctggctgcatctgtaggagacagagtcaccatcacttgtcgggccagtcagaatattaatagttggttggcctggtatcagcagaaaccagggaaacgcccctatactcctgatccacaaggcgtctactttagaaagtgggtaccatcaaggttcagcggcactggatcgtgggaacagaattcactctacaccatcaacagcctgcagcctgatgtatttggactaaacttactacgtcgaccctaaccgttatacgttaacttacgttccggtactaccgtttaccggaccgtaacgggacctaacggaccgtagggaaacgtaacttaaaccggaacgttcggtaggtctacggaccaaccgtnttaccttagttccttgtactttaccccg

SEQ ID NO: 82714 - DNA, 531 bp, Homo sapiens
  misc_feature: GYAE6OF01A6ZWO.22.57.F02.1.454.CMB.1.raw
  modified_base (401)..(401): a, c, t, g, unknown or other
  misc_feature (401)..(401): n is a, c, g, or t
tcagacatacgcgtcacgaccggtgctcgatttagctcgatatagttgggtttgggaggctggtctcactttgtgcaggagtcagacccagtcaggacacagcatggacatgagggtccccgctcagctcctggggctcctgctgctctggctcccaggtgccaagtgtgacatccagatgacccagtctccttccaccctggctgcatctgtaggagacagagtcaccatcacttgtcgggccagtcagaatattaatagttggttggcctggtatcagcagaaaccagggaaacgcccctatacctcctgatccacaaggcgtctactttagaaagtgggtcccatcaaggttcagcggcactggatcgtgggacagaattcactctcaccatccaacncgcctgccagcctgatgtatttggactaacttactactcgaccctaacgtatagttacttagttccggtacctaccgttcggaccaagggaccacgactaggaacgaacgttaaacgacttggtggtacg

SEQ ID NO: 82715 - DNA, 543 bp, Homo sapiens
  misc_feature: GYAE6OF01D3R1S.22.57.F02.1.454.CMB.1.raw
  modified_base (102)..(102): a, c, t, g, unknown or other
  misc_feature (102)..(102): n is a, c, g, or t
  modified_base (534)..(534): a, c, t, g, unknown or other
  misc_feature (534)..(534): n is a, c, g, or t
tcagacatacgcgtcacgaccggtgctcgatttagctcgatatagttgggtttgggggagtcagacccagtcaggacacagcatggacatgagggtccccgntcagctcctggggctcctgctgctctggctcccaggtgccaagtgtgacatccagatgacccagtcctccttccaccctggctgcatctgtaggagacagatcaccatcacttgcggccagtcagatattaatgttggtgcctggtatcagcaagaaaccgagggaaacgcccctatacctctgactccaacaaggtctacttaactttaagaaagtcgggtccatacgaaggttcagcggcacgtggatcgtgggaacagtaattcactctacacctatcaacacgcctagcagtcctgatgtattggactaacttacactcgacctaagtatagttaccttagtccgtacctaccgttacggaccgaacggactaacgagtaggaacgtaaagtaaacgtagtgacggtcacgacactatactgttctcncgttacccc

SEQ ID NO: 82716 - DNA, 533 bp, Homo sapiens
  misc_feature: GYAE6OF01EXKLY.22.57.F02.1.454.CMB.1.raw
  modified_base (527)..(527): a, c, t, g, unknown or other
  misc_feature (527)..(527): n is a, c, g, or t
tcagacatacgcgtcacgaccggtgctcgatttagctcgatatagttgggtttgggggagtcagacccagtcaggacacagcatggacatgagggtccccgctcagctcctggggctcctgctgctctggctcccaggtgccaagtgtgacatccagatgacccagtctccttccaccctggctgcatctgtaggagacagagtcaccatcacttgtcgggccagtcagaatattaatagttggttggcctggtatcagcagaaaccagggaaagcccctatactctgatccacaaggcgtctactttagaaagtgggtccatcaaggttcagcggcactggatcgtgggacagaattcactctcaccatcaacacgcctgccaagccctagatgtatttggactaactttactactcgacctaaccgtatacgtacttattccggtactacccttacgggccaagggaccacgtagtaggagtaattaaacggacttggaggctagccaacctatctgttccttcnttcccg

SEQ ID NO: 82717 - DNA, 562 bp, Homo sapiens
  misc_feature: GYAE6OF01DED27.22.57.F02.1.454.CMB.1.raw
tcagacatacgcgtcacgaccggtgctcgatttagctcgatatagttgggtttgggggagtcagacccagtcaggacacagcatggacatgagggtccccgctcagctcctggggctcctgctgctctggctcccaggtgccaagtgtgacagtccagatgacccagtctccttccaccctggctgcatctgtaggagacagagtcaccatcacttgccggccagtcagaatattatagttggttgcctggtatcagcagaaaccagggaaagcccctattactcctgactccacgaaggcgttctaacgtttaggaaaacgtcggggtcccatacgaaggttcagccggacacgtggatcgtagggaacagaactttcgactctacaccatacaacagcctgccagcctgatgatttggactaacttctacgtgaccctaacgtattagtactttagttaccgtctaccgttcggacctaacgggacacgacgtggaacgtaagttaacgtaaccgtgtaggtcctacgcaaccgtacttacttgttcttccagttccccg

SEQ ID NO: 82718 - DNA, 546 bp, Homo sapiens
  misc_feature: GYAE6OF01CH1HB.22.57.F02.1.454.CMB.1.raw
  modified_base (270)..(270): a, c, t, g, unknown or other
  misc_feature (270)..(270): n is a, c, g, or t
tcagacatacgcgtcacgaccggtgctcgatttagctcgatatagttggatttgggggagtcagacccagtcaggacacagcatggacatgagggtccccgctcagctcctggggctcctgctgctctggctcccaggtgccaagtgtgacatccagatgacccagtctccttccaccctggctgcatctgtaggagacagagtcaccatcacttgtcgggccagtcagatataatagttggtgcctgtatcagcagaaaccagggaaancccctatactcctgatccacaaggcgtctactttagaagtgggtcccatcaagttcagcggcactggatcgtgggacagattcactctcaccatcaacagcctgcagcctagatgtatttggactaacgttactactcgacctaaaccgtataacgtaactttacgttaccggttctaacccgtttcggaccaagggaccacggtaacgtgggtaagtaaacgttaaacgaacgttggtcgggactcggactacccagttcctcgttcttcgtacc

SEQ ID NO: 82719 - DNA, 572 bp, Homo sapiens
  misc_feature: GYAE6OF01AP57T.22.57.F02.1.454.CMB.1.raw
  modified_base (295)..(295): a, c, t, g, unknown or other
  misc_feature (295)..(295): n is a, c, g, or t
  modified_base (515)..(515): a, c, t, g, unknown or other
  misc_feature (515)..(515): n is a, c, g, or t
tcagacatacgcgtcacgaccggtgctcgatttagctcgatatagttgggtttgggaggctggtctcactttgtgcaggagtcagacccagtcaggacacagcatggacatgagggtccccgctcagctcctggggctcctgctgctctggctcccaggtgccaagtgtgacatccagatgacccagtcctccttccaccctggctgcatctgtaggagacagagtcaccatcacttgtcggccagtcagaatattaatagttggtggcctggtatcagcagaaaccagggaacncccctatactcctgactccacgaacggcgttacttaacgtttaaggaaacggttcgggggtacccaagtaccgtaacggttcgaacggccggactacgtgggactcgtacggggactaaggtaacttccaccttctaccaccaactaccaaacgacgtccctgacacgcctagatgtagtttcgactaacttactactcgacctaacgtatacgtacttnttcgactaccgttcggacaaggcacgtacgagtaacgtaataaacgactgtggtacc

SEQ ID NO: 82720 - DNA, 521 bp, Homo sapiens
  misc_feature: GYAE6OF01AD92K.22.57.F02.1.454.CMB.1.raw
  modified_base (275)..(275): a, c, t, g, unknown or other
  misc_feature (275)..(275): n is a, c, g, or t
  modified_base (291)..(291): a, c, t, g, unknown or other
  misc_feature (291)..(291): n is a, c, g, or t
  modified_base (296)..(296): a, c, t, g, unknown or other
  misc_feature (296)..(296): n is a, c, g, or t
  modified_base (380)..(380): a, c, t, g, unknown or other
  misc_feature (380)..(380): n is a, c, g, or t
tcagacatacgcgtcacgaccggtgctcgatttagctcgatatagttgggtttgggggagtcagacccagtcaggacacagcatggacatgagggtcccccgctcagctcctggggctcctgctgctctggctcccaggtgccaagtgtgacatccagatgacccagtctccttccaccctggctgcatctgtaggagacagagtcaccatcacttgtcgggccagtcagaatattaatgttggttggcctggtatcagcagaaaccagggaaancccctatactcctgancccanaaggcgtctactttagaaagtggggtcccatcaaggttcaggcggcacgtggatcgtgggacagacttcactcacacatcaacngcctgcagcctgactgtattcggctaacttcctatcgacctaacgtatacttacttattcggtctaccgtcggaccaagggacaacggctggagtaattaacggactgtggctgaccaccgtatctagtccttgcttcccg

SEQ ID NO: 82721 - DNA, 554 bp, Homo sapiens
  misc_feature: GYAE6OF01B1GTV.22.57.F02.1.454.CMB.1.raw
  modified_base (217)..(217): a, c, t, g, unknown or other
  misc_feature (217)..(217): n is a, c, g, or t
  modified_base (417)..(417): a, c, t, g, unknown or other
  misc_feature (417)..(417): n is a, c, g, or t
tcagacatacgcgtcacgaccggtgctcgatttagctcgatatagttgggtttgggaggctggtctcactttgtgcaggagtcagacccagtcaggacacagcatggacatgagggtccccgctcagctcctggggctcctgctgctctggctcccaggtgccaagtgtgacatccagatgacccagtctccttccacctggctgcatctgtagganacagagtcaccatcacttgtcgggccagtcagaatattaatagttggtgctggtatcagcagaaaccagggaacgccctatactcctagactccacaagcgtactacgttaagaaacgtcggggtacccagtactaaggttcacggcggactacgtgggactcgtaggggaacagtaacttcactctacaccatacaacngcctgcctagcctgatgatttggactaacttactactcgacctaactatacgttacttagtccgtactccgttaccggaccaagggacccacggtacgtacgggtaacgtaagttaaaccggtacttggtcggtccg

SEQ ID NO: 82722 - DNA, 553 bp, Homo sapiens
  misc_feature: GYAE6OF01DNG3H.22.57.F02.1.454.CMB.1.raw
tcagacatacgcgtcacgaccggtgctcgatttagctcgatatagttgggtttgggggagtcagacccagtcaggacacagcatggacatgagggtccccgctcagctcctggggctcctgctgctctggctcccaggtgccaagtgtgacatccagatgacccagtctccttccaccctggctgcatctgtaggagacagagtcaccatcacttgtcgggccagtcagaatattaatagttggtgctggtatcagcagaaacaggaaacgccctatactctgatccacaaggctactacttagaaagtgggtccatcgaaggttcagcgcactggatcgtagggacagtaatcactctacaccatcaacacgcctgcagcctagattgatttggactaaacttactacgtcgaccaaaccgttataacgttaactttagttccggtactaccgttcggacctaaacgggcaacggaactaggaacgtaattaaaacggacttggtacggctacggaccaaccgtacttactcgttaccttcgactttccccg

SEQ ID NO: 82723 - DNA, 560 bp, Homo sapiens
  misc_feature: GYAE6OF01D07GH.22.57.F02.1.454.CMB.1.raw
  modified_base (275)..(275): a, c, t, g, unknown or other
  misc_feature (275)..(275): n is a, c, g, or t
  modified_base (433)..(433): a, c, t, g, unknown or other
  misc_feature (433)..(433): n is a, c, g, or t
  modified_base (549)..(549): a, c, t, g, unknown or other
  misc_feature (549)..(549): n is a, c, g, or t
tcagacatacgcgtcacgaccggtgctcgatttagctcgatatagttgggtttgggggagtcagacccagtcaggacacagcatggacatgagggtccccgctcagctcctggggctcctgctgctctggctcccaggtgccaagtgtgacatccagatgacccagtctccttccaccctggctgcatctgtaggagacagagtcaccatcacttgtcgggccagtcagaatattaatagttggttggcctggtatcagcagaaaccagggaaancccctatactcctgatccacaggcgtctactttagaaagtgggtcccagtcaaggttcagcgcactgatcgtgggacagatcatctcaccatacaacacgcctagcagcctgatgatttgactaacttacactagacccaacgttatagttaactttnttccggtactacccgttacggaccaaggggaccaacggtactgggaacgtattaaaaccggacgtaggtacggtccgttggaccctaaaccgtcttaccgttccgtttacgttccnctttacccccg

SEQ ID NO: 82724 - DNA, 560 bp, Homo sapiens
  misc_feature: GYAE6OF01DLUM9.22.57.F02.1.454.CMB.1.raw
  modified_base (198)..(198): a, c, t, g, unknown or other
  misc_feature (198)..(198): n is a, c, g, or t
  modified_base (276)..(276): a, c, t, g, unknown or other
  misc_feature (276)..(276): n is a, c, g, or t
  modified_base (296)..(296): a, c, t, g, unknown or other
  misc_feature (296)..(296): n is a, c, g, or t
  modified_base (532)..(532): a, c, t, g, unknown or other
  misc_feature (532)..(532): n is a, c, g, or t
  modified_base (543)..(543): a, c, t, g, unknown or other
  misc_feature (543)..(543): n is a, c, g, or t
  modified_base (553)..(553): a, c, t, g, unknown or other
  misc_feature (553)..(553): n is a, c, g, or t
tcagacatacgcgtcacgaccggtgctcgatttagctcgatatagttgggtttgggggagtcagacccagtcaggacacagcatggacatgagggtccccgctcagctcctggggctcctgctgctctggctcccaggtgccaagtgtgacatccagatgacccagtcctccttccacctggctgcatctggtagganacagagtcaccatcacttgtcgggccagtcagaatattaatagttggttgcctggtatcagcaagaaaccagggaacnccctatactctgactccaanaggctatacttaagaaggtgggtacccataccgaaggttcaggcggctactggactcgtagggacagtaattccactcgtacacctaatacaacacgtcctagcaacgcccttaggaattggtaactttgggaccttaaaccgttactactacgaccctaacggtattacgttaacttagttacgtacctaccgttccgacgtaacggactagacgtaggataagtaacgactggngctcgcacgtntactgtcttntctcccg

SEQ ID NO: 82725 - DNA, 548 bp, Homo sapiens
  misc_feature: GYAE6OF01DTOBU.22.57.F02.1.454.CMB.1.raw
  modified_base (197)..(197): a, c, t, g, unknown or other
  misc_feature (197)..(197): n is a, c, g, or t
  modified_base (416)..(416): a, c, t, g, unknown or other
  misc_feature (416)..(416): n is a, c, g, or t
  modified_base (539)..(539): a, c, t, g, unknown or other
  misc_feature (539)..(539): n is a, c, g, or t
tcagacatacgcgtcacgaccggtgctcgatttagctcgatatagttgggtttgggggagtcagacccagtcaggacacagcatggacatgagggtccccgctcagctcctggggctcctgctgctctggctcccaggtgccaagtgtgacatccagatgacccagtctccttccaccctggctgcatctgtagganacagagtcaccatcacttgcgggccagtcagaatattaaatgttggttgctggtatcagcaagaaaccaggaaagcccctatactcctgatcacaaggcgtctactttagaaagtcgggtccatcaaggttcagcgcacgtggatcgtgggacagaattcaactctacaccatcaacagcctgcagccctgactgtatttcggactaacgttacacttnaccctaaacgtacttaaggtaactttagttaccggtactaaccgttaccggccgtaaacgggacacggtaactacggagtaattaaaacgacgttgtaggctagtcaacctatactgtccttnaacttcccg

SEQ ID NO: 82726 - DNA, 556 bp, Homo sapiens
  misc_feature: GYAE6OF01ESS1X.22.57.F02.1.454.CMB.1.raw
  modified_base (218)..(218): a, c, t, g, unknown or other
  misc_feature (218)..(218): n is a, c, g, or t
  modified_base (291)..(291): a, c, t, g, unknown or other
  misc_feature (291)..(291): n is a, c, g, or t
  modified_base (303)..(303): a, c, t, g, unknown or other
  misc_feature (303)..(303): n is a, c, g, or t
tcagacatacgcgtcacgaccggtgctcgatttagctcgatatagttgggtttgggaggctggtctcactttgtgcaggagtcagacccagtcaggacacagcatggacatgagggtccccgctcagctcctggggctcctgctgctctggctcccaggtgccaagtgtgacatccagatgacccagtctccttccaccctggctgcatctgtagganacagagtcaccatcacttgtcggcagtcagatattaatagttggtgctggtatcagcagaaaccagggaaacnccctatacctcngactccacagctctacgttagaagtcgggtaccagtcaaggttcagcggactacgtggatcgtagggactagtaacttcgactctacaccatacaacacgcctgcacgtctgatcgtattcggactaacttacgtactacgtacctaaccgtattaacgtacttacgttccgtaccttaccgttcggtacgaacgggtacctaccgggtaagtacggtaacgtaacgttaaacgtacgttcggtacggtaccg

SEQ ID NO: 82727 - DNA, 550 bp, Homo sapiens
  misc_feature: GYAE6OF01BTQ1U.22.57.F02.1.454.CMB.1.raw
  modified_base (386)..(386): a, c, t, g, unknown or other
  misc_feature (386)..(386): n is a, c, g, or t
tcagacatacgcgtcacgaccggtgctcgatttagctcgatatagttgggtttgggggagtcagacccagtcaggacacagcatggacatgagggtccccgctcagctcctggggctcctgctgctctggctcccaggtgccaagtgtgacatccagatgacccagtctccttccaccctggctgcatctgtaggagacagagtcaccatcacttgtcggccagtcagaatattaatagttggtggctgtatcagcagaaacgaggaaacgcccctatactcctgactccaacaaggcgtactactttagaaaggtcgggtcccagtcaaggttcagcggcacgtggatcgtagggacagtaacttcactctacaaccatacaacncgacctgcagcctagatgtatttcggactaacttactactcgacctaacgtatacgtacttattcgtactaccgttcggacgaaggaccacgacgtaggacgtaagttaaacgacgttaggtacggtcttagacctactacttctagtttcttcctacttcccg

SEQ ID NO: 82728 - DNA, 532 bp, Homo sapiens
  misc_feature: GYAE6OF01DC9WB.22.57.F02.1.454.CMB.1.raw
  modified_base (102)..(102): a, c, t, g, unknown or other
  misc_feature (102)..(102): n is a, c, g, or t
  modified_base (511)..(511): a, c, t, g, unknown or other
  misc_feature (511)..(511): n is a, c, g, or t
  modified_base (524)..(524): a, c, t, g, unknown or other
  misc_feature (524)..(524): n is a, c, g, or t
tcagacatacgcgtcacgaccggtgctcgatttagctcgatatagttgggtttgggggagtcagacccagtcaggacacagcatggacatgagggtccccgntcagctcctggggctcctgctgctctggctcccaggtgccaagtgtgacatccagatgacccagtctccttccaccctggctgcatctgtaggagacagagtcaccatcacttgcggcagtcagaatattaatagttggttgctggtatcagcagaaaccaggaaacgccctatacctcctagactaccaacaaggctacttaactttaagaaaggtcgggtaccagtacgaaggttcaggcggcacgtggatcgtaggacagtaattcactctacacctatacaacagcctgacagctagatagtattagactaacttacactcgacctaacgtatagttacttatcgtctaccgttcgactaaggacacgtactaggataagtaaacgtatggtagctagacacgtnttctagttccttncgttcccg

SEQ ID NO: 82729 - DNA, 809 bp, Homo sapiens
  misc_feature: GYAE6OF01BNQB4.22.57.F02.1.454.CMB.1.raw
tcagacatacgcgtcacgaccggtgctcgatttagctcgatatagttgggtttgggaggttggtctcactttgtgcaggagtcagacccagtcaggacacagcatggacatgagggtccccgctcagctcctggggctcctgctgctctggctcccaggtgccaagtgtgacatccagatcgacccagtctccttccaccctggctgcatctagtaggagacagagtcaccatcacgttggtccggccagtacaagtaattaattaagttaggttggttcggtccgttaggtactcgagacgaacgaaaaccgaacgggaaacgtacccccctaagtacctaccgtagaacttaccgaacgaacggtccgttacgttaacgtttaacggaaacggttcggggtaccctaagtacgtaacggttaccgaacggcggtaccgtacgtacggtaacgttcggtacggggacctaacggtaactttacccgtaaccttaccgtaaccctaaccctaacgtaccctaaaaccggtaccgtaccccgttacggaaccctacggtacccgttacggtaacgtttaacggttaaccgttttacggtaaccctttaaaccgtttacccgtaaccgttacccggtaaccccttaaaccggttaaccgttaacggtttaaccctttaccggtttacccggttacccgttaacccggttaccgggtaacccgtaaacggggtacccgtaaaccggtaccggttaacgggtaaaccgttaaacgttaaaccgggtaacgttcgggtaacggtccgttaaccg

SEQ ID NO: 82730 - DNA, 543 bp, Homo sapiens
  misc_feature: GYAE6OF01BLRFY.22.57.F02.1.454.CMB.1.raw
  modified_base (397)..(397): a, c, t, g, unknown or other
  misc_feature (397)..(397): n is a, c, g, or t
tcagacatacgcgtcacgaccggtgctcgatttagctcgatatagttgggtttgggaggctggtctcactttgtgcaggagtcagacccagtcaggacacagcatggacatgagggtccccgctcagctcctggggctcctgctgctctggctcccaggtgccaagtgtgacatccagatgacccagtctccttccaccctggctgcatctgtaggagacagagtcacatcacttgtcgggccagtcagaatattaatagttggtggcctggtatcagcagaaaccagggaagccctatactctgatccacaggctctacttagaagtcgggtccatcaaggttcagcggcacgtggatcgtaggggacagtaattcgacttctccaccatacaacngccctgccagccctagactggtactttgggacctaactttactaccgtgaccctaacgtataacgttacttacgttcggtacctaccgttcggacccgtaagggccacggtactcgggtaataacgttaaacgcttggtcggtacg

SEQ ID NO: 82731 - DNA, 628 bp, Homo sapiens
  misc_feature: GYAE6OF01AM4H2.22.57.F02.1.454.CMB.1.raw
  modified_base (199)..(199): a, c, t, g, unknown or other
  misc_feature (199)..(199): n is a, c, g, or t
  modified_base (304)..(304): a, c, t, g, unknown or other
  misc_feature (304)..(304): n is a, c, g, or t
  modified_base (601)..(601): a, c, t, g, unknown or other
  misc_feature (601)..(601): n is a, c, g, or t
tcagacatacgcgtcacgaccggtgctcgatttagctcgatatagttgggtttgggggagccagacccagtcaggacacagcatggacatgagggtccccgctcagctcctggggctcctgctgctctggctcccaggtgccaagtgtgacatccagatcgacccagtcctccttccaccctggctgcatctggtaganacagagtccaccatccacgttggccggccagtcaagtaattattaagtagttggttggccttggtatcagacaagaaacgaggaacgcccctatactcctagacnccgaacgaggcgtacttacgttaagaacggtcgggtaccaagtcgtaaggttcaggccggtacacgtggactcgtaggacagtaacttcactctaccactataccaactacgcctagacgacgtcctagatacgttatttacggactaaactttccgtacgaccgtaacccgtaacgttaataacggtttactttacggttaccggtaccttacccgtacgggacccaagggtaccaacggtacgtaggtaaacgtaaacgtaaccgtacgtaggtacggccttacgaccttaacgnttacctagtttcttacgtccttacccg

SEQ ID NO: 82732 - DNA, 748 bp, Homo sapiens
  misc_feature: GYAE6OF01CGUYO.22.57.F02.1.454.CMB.1.raw
tcagacatacgcgtcacgaccggtgctcgatttagctcgatatagttgggtttgggggagtcagacccagtcaggacacagcatggacatgagggtccccgctcagctccgtggggctcctgctgctctggctcccaggtcgccaagtgtgacatccagatcgacccagtcctcccttcccacccgtggctgcatcgtggtaaggagacagacgtcacctatctacgttcggtccgggccagtcaagtaattaattaagtaggtttggttggtcctggtatcagacaagaaaccgagggaacgcccctaatacctcctgactaccaacgaacggtcttacgttaacgtttaaggaaacggttccggggtaccctaagtacgtaacgggttacacggacggacctaacggtggaacgtcggtaacgggaactaagtaacctttcgaaccttcacctaacctacgtaaccaacgtaccggtcctcgaccacggtccctaaggtatagtacggtttacgaaccttaaccgtttaccgtacgtaccggaacccttaaacgttacgtttaacgttaacgtttaccgttcccggtaccccttaaccggttaccggggaaccgaaacgggtacaaacccgggtagttaacgggaaaggtaaaaccgtttaaaaccggtagtccgggtacggtaccgtaccggaccttaaaccgtacttcgttacccgtttaccttccgttaaccctttcccccgg

SEQ ID NO: 82733 - DNA, 581 bp, Homo sapiens
  misc_feature: GYAE6OF01EFIBQ.22.57.F02.1.454.CMB.1.raw
  modified_base (294)..(294): a, c, t, g, unknown or other
  misc_feature (294)..(294): n is a, c, g, or t
  modified_base (436)..(436): a, c, t, g, unknown or other
  misc_feature (436)..(436): n is a, c, g, or t
tcagacatacgcgtcacgaccggtgctcgatttagctcgatatagttgggtttgggaggctggtctcactttgtgcaggagtcagacccagtcaggacacagcatggacatgagggtccccgctcagctcctggggctcctgctgctctggctcccaggtgccaagtgtgacatccagatcgacccagtctcccttccaccctggctgcatctgtaggagacagagtcaccatcacttgtcggccagtcagaatattaatagttggtgctggtatcagcagaaaccagggaacnccctatactctgactccagaggctctacgtttagaaaggtcgggtacccatcgtaaggttcaggccggcacgtgggattcgtggggaacaaggaacttcacgttcctacaacctatccaaacgacgcctagcacgtccgtanattgtactttggaactaaccgttactacgtcgaccctaacgttatacgttacgttagttccggtacctaccgttcgggaccgtaaacgggacctaaccggtagtacgggtaacgtaaacgtttaaaccggacgtggtggtacccg

SEQ ID NO: 82734 - DNA, 637 bp, Homo sapiens
  misc_feature: GYAE6OF01CSJU6.22.57.F02.1.454.CMB.1.raw
  modified_base (102)..(102): a, c, t, g, unknown or other
  misc_feature (102)..(102): n is a, c, g, or t
  modified_base (202)..(202): a, c, t, g, unknown or other
  misc_feature (202)..(202): n is a, c, g, or t
  modified_base (428)..(428): a, c, t, g, unknown or other
  misc_feature (428)..(428): n is a, c, g, or t
tcagacatacgcgtcacgaccggtgctcgatttagctcgatatagttgggtttgggggagtcagacccagtcaggacacagcatggacatgacgggtccccntcagctccgtggggctcctgctgctctggctcccgaggtgccaagtgtgacactccagatcgacctagtctcctccaccctggctgcattctggtagganacagagccaccatctacgttggcggacagtacaagtaatattaagtagttggtgtctggatcagacaagaacgaggaaccacctatacctcgtatactaccgacgaacgtccgttactaacgttaacggaaacgggttcgggtaccctaagtacggaacggttcacggtcggactagtgactcggaaggactacgaattcacttacactacgatacaacgcgtacnacgactgtctagtagacgtttacgacgttaacttactacgtaccgtaaccttaacgttacgttaacgtttaccttaggtttcccggtacctaccgggttacggaaccgttaaacgggaccaccgtaaggcccggtaagtaaacgttaacgaacgtttggaacgtctaaccgtacctaattcctattacgtacccttagtccttaccccg

SEQ ID NO: 82735 - DNA, 579 bp, Homo sapiens
  misc_feature: GYAE6OF01D2X9P.22.57.F02.1.454.CMB.1.raw
tcagacatacgcgtcacgaccggtgctcgatttagctcgatatagttgggtttgggggagtcagacccagtcaggacacagcatggacatgagggtccccgctcagctcctggggctcctgctgctctggctcccaggtgccaagtgtgacatccagatgacccagtctccttccaccctggctgcatctggtaggagacagagtcaccatcacttggtccgggccagtcagtaattattaataggttggttggccttggtatcagacaagaaaccgagggaaacgcccctatactcctgactccacgaggcgtactacttagaaagtggactccatcaaggttcagcggcacgtggatcgtgggactagacgttcactcgtccaacctatacaacgacgcctgaccgacgcctagtatgttagttacggtactaacttactacctacgaccctaacgtatacgttacttacgttccgtactaccgttacgaccgaggaccaacggacgtcgggaataacgttaaacggtacttggtcggctacggacctaccgtaacgttcttcgttccttctacccg

SEQ ID NO: 82736 - DNA, 592 bp, Homo sapiens
  misc_feature: GYAE6OF01DPL8Z.22.57.F02.1.454.CMB.1.raw
  modified_base (294)..(294): a, c, t, g, unknown or other
  misc_feature (294)..(294): n is a, c, g, or t
  modified_base (315)..(315): a, c, t, g, unknown or other
  misc_feature (315)..(315): n is a, c, g, or t
tcagacatacgcgtcacgaccggtgctcgatttagctcgatatagttgggtttgggaggctggtctcactttgtgcaggagtcagacccagtcaggacacagcatggacatgagggtccccgctcagctcctggggctcctgctgctctggctcccaggtgccaagtgtgacatccagatcgacccagtctccttccaccctggctgcatctgtaggagacagagtcaccatcacttgtcggccagtcagaattattaatagttggtgctgtatcagcaagaaaccgaggaacnccctatactcctgactccaanaacggtctacttaactttaaggaaacggtcgggtacccagtacgtaaaggttcacggccggactacgtggtactacgtacggggaactaagtactacctactcctaccacctaactacaaccacgccttgaccagcctagactgttattacggactaaccgttactaccgtacgaccctaacgtattacgttaactttacgttaccgtacctaccgtccggaaccgaagggtacctacggtactaggtaactaaacttaaacggtactgtcggtacc

SEQ ID NO: 82737 - DNA, 546 bp, Homo sapiens
  misc_feature: GYAE6OF01E4D4Z.22.57.F02.1.454.CMB.1.raw
  modified_base (219)..(219): a, c, t, g, unknown or other
  misc_feature (219)..(219): n is a, c, g, or t
  modified_base (294)..(294): a, c, t, g, unknown or other
  misc_feature (294)..(294): n is a, c, g, or t
  modified_base (393)..(393): a, c, t, g, unknown or other
  misc_feature (393)..(393): n is a, c, g, or t
tcagacatacgcgtcacgaccggtgctcgatttagctcgatatagttgggtttgggaggctggtctcactttgtgcaggagtcagacccagtcaggacacagcatggacatgagggtccccgctcagctcctggggctcctgctgctctggctcccaggtgccaagtgtgacatccagatgacccagtcctccttccaccctggctgcatctgtagganacagagtcaccatcacttgtcgggccagtcagaatattaatagttggtgctggtatcagcagaaaccagggaacnccctatactctgatccacaggctctacttagaagtcgggtccatcaaggttcagcggcacgtggatcgtgggacagaacttcactctcaccatccaacncgcctgcacgcctgatgtagtttcggacctaacttactactacgacctaacgtataacgttacttacgttccggtacctaccgttccgggaccgtaaacgggcctacggtaacgtagggtaaactaacgttaaaccgacgttggtcggtaccg

SEQ ID NO: 82738 - DNA, 843 bp, Homo sapiens
  misc_feature: GYAE6OF01BR0M3.22.57.F02.1.454.CMB.1.raw
  modified_base (164)..(164): a, c, t, g, unknown or other
  misc_feature (164)..(164): n is a, c, g, or t
  modified_base (171)..(171): a, c, t, g, unknown or other
  misc_feature (171)..(171): n is a, c, g, or t
  modified_base (183)..(183): a, c, t, g, unknown or other
  misc_feature (183)..(183): n is a, c, g, or t
tcagacatacgcgtcacgaccggtgctcgatttagctcgatatagttgggtttgggaggctggtctcactttgtgcaggagtcagacccagtcaggacacagcatggacatggacgggtccccgctcagctccgtgggctcctgctgctctggctcccgaggtncaagtgngacatccatacncgaccctcgtctcctccacctggctgctatcgtgtaggagacagactcaaccagtcctacgttcggtaccgggacctaaggtccaaagtaaattaagtttaagttaagggttagggttcggtccgttaggtaataccgagaaccgaaacggaaaaccgtaaacgggaaaccgtaccccttaagtaacccgttcgacgtaacctaaccgaaacggaaacggttcgttacctttaaaggtttaacggaaaacggggttccggggtacccaagttacgtaaacgggttaccgtacgggaccgttaaccgaacgtttagggaacgtttccgggaaggggtaacctaagggttaaacctttaccctaaccgtaccttaacccgaaaccgttaacctaaaccaaacgttaccgggacccttacgacgtaaaccgtccgaagttaagtacgttaagtttaccggaaccttacctttaaacctacggttaaccgtaacccgttaaaccgttagttaacgtttaaaccctttacgggttacccgttaaccggaccccggttttaaccggggaacccgtaaacggggtaaaccccgaacgggtaaacggttaacggtaaaaccggttaaaacgttaaaacccgggtacgtttacgggttacggaacccgg

SEQ ID NO: 82739 - DNA, 562 bp, Homo sapiens
  misc_feature: GYAE6OF01BK7XS.22.57.F02.1.454.CMB.1.raw
  modified_base (373)..(373): a, c, t, g, unknown or other
  misc_feature (373)..(373): n is a, c, g, or t
tcagacatacgcgtcacgaccggtgctcgatttagctcgatatagttgggtttgggggagtcagacccagtcaggacacagcatggacatgagggtccccgctcagctcctggggctcctgctgctctggctcccaggtgccaagtgtgacatccagatgacccagtctccttccaccctggctgcatctgtaggagacagagtcaccatcacttgtcgggccagtcagaatattaatagttggttgcctggtatcagcagaaccagggaaacgcccctatactctgatccacaggctctactttagaaagtgggtcccatcgaggttcagcgcactggatgtgggacagaattcacttctcaccatacaacngcctgccagccctgatgactttgggactaacttactactcgaccctaaccgttataacgttactttaacgttccggtacctacccgtttaccggaccaagggaccaaccgacgtagggaagaagttaaaaccgtacgttaggtcggtcctcgaccaccgtaacttcgttagttccttcgtacttccccg

SEQ ID NO: 82740 - DNA, 831 bp, Homo sapiens
  misc_feature: GYAE6OF01EO0LS.22.57.F02.1.454.CMB.1.raw
tcagacatacgcgtcacgaccggtgctcgatttagctcgatatagttgggtttgggggagtcagacccagtcaggacacagcatggacatgagggtccccgctcagctccgtggggctcctgctgctctggctcccaggtgaccaagtgtgacatccagatcgacccagtcctcccttcccacccgtggctgctatcgtggtaaggagacagacgtccaaccatctacgttggtccgggaccagtacaagtaattaagttaagttaggtttgggttcggaccgttaggtatccgaaggacaaacggaaaaccgaagggggaaaaccctccccttaattacccgtcccgtaagaccttaacccgaacgtaaacggtcccgtttaactttaaacggttttaaggtaaaaccgggttccgggtaacccctaagttaccggttaaaggttccgaagggtccggaactaccggtggtaacttcgggtacgggaaactaggttaactaccgaccttaccgactaaaccctacgttaacaaaccgtccggtccttagggaaccacgtaccgtaaggtaacttacgggtaacgtttacggaacctttaaaccgtttactaccgttaacccgaaaccctttaaacggttacgttaaacgttttaccgtttaccggtttacccggtaccgttaacccgttaccgggtaacggtaaaaccgggtacctaacgggtaccgtaaagggtaacgttaaaactttaaaccgggaccgttgggtaccggtcgttaccgaacctaacccgttgttacgtttacctttccttaaacgccgtttaccccg

SEQ ID NO: 82741 - DNA, 601 bp, Homo sapiens
  misc_feature: GYAE6OF01DAN82.22.57.F02.1.454.CMB.1.raw
  modified_base (199)..(199): a, c, t, g, unknown or other
  misc_feature (199)..(199): n is a, c, g, or t
  modified_base (274)..(274): a, c, t, g, unknown or other
  misc_feature (274)..(274): n is a, c, g, or t
  modified_base (586)..(586): a, c, t, g, unknown or other
  misc_feature (586)..(586): n is a, c, g, or t
tcagacatacgcgtcacgaccggtgctcgatttagctcgatatagttggggtttgggggagtcagacccagtcaggacacagcatggacatgagggtccccgctcagctcctggggctcctgctgctctggctcccaggtgccaagtgtgacatccagatgacccagtcctccttccaccctggctgcatctgtagganacagatcaccatcacttgcggcagtcagaatattaatagttggtgcctggtatcagcaagaaaccgagggaaacncccctatactctgactccagacggtctactaacgtttagaaacggtcggggtaccctgtaaggttcaggccgactacgtggactcgtgggaacagtaattcactctacaactataccaacgacgccctagacctacgtcctagtattaggtaactttcggaccttaaacgttacctacgtacgaaccctaaaccgtattacgtacttacgttccggtacctaccgttcggacgtaacgggactacggacgtggaaacgtacgttaaacggacgttgggtagcgtgacctactcgttacttcgtactttaccngttcccgttaccccg

SEQ ID NO: 82742 - DNA, 598 bp, Homo sapiens
  misc_feature: GYAE6OF01CLV8H.22.57.F02.1.454.CMB.1.raw
  modified_base (236)..(236): a, c, t, g, unknown or other
  misc_feature (236)..(236): n is a, c, g, or t
  modified_base (267)..(267): a, c, t, g, unknown or other
  misc_feature (267)..(267): n is a, c, g, or t
tcagacatacgcgtcacgaccggtgctcgatttagctcgatatagttgggtttgggggagtcagacccagtcaggacacagcatggacatgagggtccccgctcagctcctggggctcctgctgctctggctcccaggtgccaagtgtgacatccagatgacccagtctccttccaccctggctgcatctgtaggagacagagtcaccatcattgcgggccagtcagaatattaanagttgtgctggtatcagcagaaacaggaacnccctatactcctagatccaacaaggcgtactaacgtttaagaaaggacgggtaccatacaaggttcacggcggacacgtgatcgaggaacagaacttcactctacaaccatacaacagcctgacagacctgaactgtagttcggactaaagtttacctactcgaccctaaacgttattaacgttaacttacgttaccggttaccgtacctttaccggaccgtaaagggaccaacgggtaacttacgggaaacggttaaattaaaaccggaacgttaggtacgtacgtacggaaccctaaccgtactacttgtacgttccgtacttaccccg

SEQ ID NO: 82743 - DNA, 560 bp, Homo sapiens
  misc_feature: GYAE6OF01B5R5H.22.57.F02.1.454.CMB.1.raw
tcagacatacgcgtcacgaccggtgctcgatttagctcgatatagttgggtttgggaggctggtctcactttgtgcaggagtcagacccagtcaggacacagcatggacatgagggtccccgctcagctcctggggctcctgctgctctggctcccaggtgccaagtgtgacatccagatgacccagtctccttccaccctggctgcatctgtaggagacagagtcaccatcacttgtcgggccagtcagaatattaatagttggttggcctggtatcagcagaaaccagggaaacgccctatactcctgatccacaggctctactttagaaagtggggtcccatcaaggttcagcggcactggatcgtgggacagaattcactctccaccactacaacacgcctgcagtctgatgtatttgctaacttactactacgtaccctaaccgttattacgttactttacgttacggtacctacccgtttccgggacccgtaaacggggaccaaccggacgttacgggtaacgtaagttaaaacggtaacgttggtgggtaccg

SEQ ID NO: 82744 - DNA, 750 bp, Homo sapiens
  misc_feature: GYAE6OF01EUVXV.22.57.F02.1.454.CMB.1.raw
  modified_base (96)..(96): a, c, t, g, unknown or other
  misc_feature (96)..(96): n is a, c, g, or t
  modified_base (195)..(195): a, c, t, g, unknown or other
  misc_feature (195)..(195): n is a, c, g, or t
  modified_base (526)..(526): a, c, t, g, unknown or other
  misc_feature (526)..(526): n is a, c, g, or t
  modified_base (581)..(581): a, c, t, g, unknown or other
  misc_feature (581)..(581): n is a, c, g, or t
tcagacatacgcgtcacgaccggtgctcgattagctcgatatagttgggtttgggaggctggtctcactttgtgcaggagtcagacccagtcaggnacacagcatggacatggacgggtccccgcctcgacgcctccgtcgggtcgtccctcgtcgtcgtcctcgtcggccgtcccgacggtcgaccgaacgtgntacgtaccactccacgactcgtacccctacgtcctcccgtcccgtacccgtcggctcgcagtacgtagacgagacgacgtacgtaccgtacctacgtacgaccgtcgtacggtaccgtaacgtacgtaacgtaagttaacgttacgttacggcttatttaaaacggtaccgtacggttaacgtgccccgacggtaaccgaacccggtaaaaccaacgggtaaacccgtaccccggtaaacgtacccacgtaacgtaacgtaccgtaacgtacgtacgtaacgtacggttacgtacgtacgtacgtacgtacgtacgtacgtacgtacggtnactacggtacggtacgtacgtacgaactacgtactacctaactaccacctacccncctaccgtaaccgtaccgtaccgtacgtacgtacgtaccgtacgtacgtacgttacgttaacgtacgtaacctaccgtaccgtaccgtaaccgtaccgttaccgttacgttaccgttaccgttaccgtaccgtaccgtaccgtacgaccgaacggtacgtaacggtacg

SEQ ID NO: 82745 - DNA, 945 bp, Homo sapiens
  misc_feature: GYAE6OF01E58KD.22.57.F02.1.454.CMB.1.raw
tcagacatacgcgtcacgaccggtgctcgatttagctcgatatagttgggtttgggaggctggtctcactttgtgcaggagtcagacccagtcaggacacagcatggacatgacgggtccccgctcagcctcctggggctcctgctgctctggctcccaggtcgccaagtgtgacatccagatcgacccagttcctcccttcccaccctggctgcatcgtggtaggagacagacgtccacctatcctaccgttcggccgggacctaggtaccgaagtaattaactttaaagttaggtttcgggttacgggtccttaggtactacgaacggaccgaaacggaaaaccccggaacggggtaaaacccgtccccctttaaacgtaaccccttaccccgttacggtaaccttaaccccgaacggtaaaccgggttcccggttaaccttttaaaccggttttaaacgggtaaacggggtttacccggggggttacccctaaacgtttacccgggtaaacgggtttaccggaacgggtcccgggtaccgtacggttacgggtacgttaccgggttacggggaaacctaacggtaaccttcccgtaaccctttcccgtaaacccgaacccttaacgtaacccgaaaccgtccccggtaccgtaccggtaacccgtaccgtccgtaacggtaactttagggttaacccgtttcgggtaaacccttaacccgttttaaccgtaacccgttacccggaaacccgtttaaacccggttaacgtttaaccggtttaaaccgttttaccggtttcccggtaacccccgtttaacccgggttaacccgggaacccccgggttaaaaacggggtaccctaaccggggttaaaccggttaaacgggtaaaccgtttaaaaccggttaaacccggttacggttaccggtaccgggtaacccg

SEQ ID NO: 82746 - DNA, 825 bp, Homo sapiens
  misc_feature: GYAE6OF01APPDD.22.57.F02.1.454.CMB.1.raw
  modified_base (219)..(219): a, c, t, g, unknown or other
  misc_feature (219)..(219): n is a, c, g, or t
tcagacatacgcgtcacgaccggtgctcgatttagctcgatatagttgggtttgggaggctggtctcactttgtgcaggagtcagacccagtcaggacacagcatggacatgagggtccccgctcagctcctggggctcctgctgctctggctcccaggtgccaagtgtgacatccagatgacccagtcctccttccaccctggctgcatctgtagganacagcgtcaccatctacttggtccggccagtacaagtaattattaagtaggtttggttggccttggtatcgaagtacgaacggaaaccgggaacgtaccctaatacctccgtagacctaccgaacgaacggtccgtacttaacgtttaaggaacggtccgggtaccctaagtacgtaacggttcacggcggactacgtaggtacgtcgtagggacacgtacttaccacctactacacctactaaccaacgtacgtaccgtacgaccgtaccgtaccgtagtacgttacggttacgtttacgggtaaccttaaaccgtttaccctaaccgtacccgtaaaccccgttaaaccggttaacgtttaacccgtttaaacccgttttaccggtttacccggtttaaccccgttaaccccgggttttacccgggtaaacccggttaaaccggggggttaaaccccgttaaacccgggggtttaaaacccccgggttttaaacggggggttaaaaacccggtttttaaaaacccccgggttttaaaaaaccgggggtaaccccgggtttttaaccgggggttaaccggggttaacccccggttaaaacccggg

SEQ ID NO: 82747 - DNA, 661 bp, Homo sapiens
  misc_feature: GYAE6OF01B0JSW.22.57.F02.1.454.CMB.1.raw
  modified_base (282)..(282): a, c, t, g, unknown or other
  misc_feature (282)..(282): n is a, c, g, or t
  modified_base (373)..(373): a, c, t, g, unknown or other
  misc_feature (373)..(373): n is a, c, g, or t
tcagacatacgcgtcacgaccggtgctcgatttagctcgatatagttgggtttgggggagtcagacccagtcaggacacagcatggacatgagggtccccgctcagctcctggggctcctgctgctctggctcccaggtgccaagtgtgacatccagatgacccagtcctccttccaccctggctgcatctgtaggagacagagtcaccatcacttggcgggccagtcaagaattattaagtagttggttgccttaggtatcagcaagaaaccaagggaacncccctatactcctgactaccacgaaggtctactacgttaagaacgtcggggtaccctagtacgaaggttcgaggcgcacgtggtacgtcgngggaactagtaacttcactcgtaccaaccataccacacgtctcgacacgacccgtgacttaggtacgtttcgggaaccttaaaccttaccgttaccgtacgtaacccgtaaaccgtttaataacgttttaaccttacgtttacccggtaccttacccggttaccgggaacccttaacgggaacctaaccggtacggtaacgggtaaacgttaaacgttaaacggaacgttgggtaccggcttacgaccctaacgtacgttcgttagttaccttcgtctttacccccgg

SEQ ID NO: 82748 - DNA, 651 bp, Homo sapiens
  misc_feature: GYAE6OF01BLO8X.22.57.F02.1.454.CMB.1.raw
  modified_base (295)..(295): a, c, t, g, unknown or other
  misc_feature (295)..(295): n is a, c, g, or t
tcagacatacgcgtcacgaccggtgctcgatttagctcgatatagttgggtttgggaggctggtctcactttgtgcaggagtcagacccagtcaggacacagcatggacatgagggtccccgctcagctcctgggctcctgctgctctggctcccaggtgccaagtgtgacatccagatgacccagtcctccttccaccctggctgcatctggtaggagacagagtcaccatcacttgtcggccagtcagtaatataatagttggtgcctggtatcagcaagaaaccgaggaacnccctatacctcctagactaccaacgaacggtccttacttaacgtttaaggaaacgggttcggggtacccctaagttacgaaacggttcaacggtcgactaccggtggacgtcggtaggggactaaggtaacttccactttccacaaccgtactaccaactacgacccttaacgaccgtccgtagtacttagttacgtttacggaccttaaacgtttaccctaacgtacccgtaacccttaaacgttacttaacgttacccgttaggtttacccgtacctaacccggttccggacccgtaaagggaccacggtacgtaggtaacgtaaacggttaaacgtaccgtaggtcggctacg

SEQ ID NO: 82749 - DNA, 663 bp, Homo sapiens
  misc_feature: GYAE6OF01CV25P.22.57.F02.1.454.CMB.1.raw
  modified_base (224)..(224): a, c, t, g, unknown or other
  misc_feature (224)..(224): n is a, c, g, or t
  modified_base (324)..(324): a, c, t, g, unknown or other
  misc_feature (324)..(324): n is a, c, g, or t
tcagacatacgcgtcacgaccggtgctcgatttagctcgatatagttgggtttgggaggctggtctcactttgtgcaggagtcagacccagtcaggacacagcatggacatgagggtccccgctcagctcctggggctcctgctgctctggcctcccaggtgccaagtgtgacatccagatcgacccagtcctcccttcccaccctggctgcatctggtagganacagatcaccatcacttgcgggacagtacaagtaatattaataggttggttggcctggtatcgagacaagaaaccgaggaaaccgtccctatacctctanactaccagaacggcgtacttactttaaggaaacggttcgggtaccctaagtacgtaacgggttcacggtcggactacggtggtatcggtgggaacaagtacttaccgacttacctacctaccaataccaacctacgacccttaggacctcgtcctaggacttaggtaacgttttacgacctttaaacctttacgtacgtaccgtacccgtaaaccggttataacgttaaccttttacgttacccggttaccgttacccggttaccgggacccgtaaacgggaccctaacgggtacgttaacggaaacgttaaacgtaaacgtaacgtggtacggtaccg

SEQ ID NO: 82750 - DNA, 556 bp, Homo sapiens
  misc_feature: GYAE6OF01AZ2WF.22.57.F02.1.454.CMB.1.raw
tcagacatacgcgtcacgaccggtgctcgatttagctcgatatagttgggtttgggggagtcagacccagtcaggacacagcatggacatgagggtccccgctcagctcctggggctcctgctgctctggctcccaggtgccaagtgtgacatccagatgacccagtctccttccaccctggctgcatctgtaggagacagagtcaccatcacttgtcggccagtcagatattaatagttggttggcctggtatcagcagaaccaggaagcccctatactcctgactccacaaggcgtctactttagaaagtggggtcccatcaaggttcagcggcacgtggatctggggacaggtaattccgactcctccgacctactacaacagccctgcacgtcctagtactgtagtttggtactaacttaacctactcgaccaaccgttatacgttaactttattcggtacctaccgttacggccctaagggaccacgactaggactaacgttaaacggaacttggtaggcctgaccacgtactcgtattcttcagttcccc

SEQ ID NO: 82751 - DNA, 577 bp, Homo sapiens
  misc_feature: GYAE6OF01BRIME.22.57.F02.1.454.CMB.1.raw
tcagacatacgcgtcacgaccggtgctcgatttagctcgatatagttgggtttgggggagtcagacccagtcaggacacagcatggacatgagggtccccgctcagctcctggggctcctgctgctctggctcccaggtgccaagtgtgacatccagatgacccagtctccttccaccctggctgcatctgtaggagacagagtcaccatcacttgtcggccagtcagaatattaatagttggttggcctggtatcagcaagaaaccagggaaacgcccctatacctcctgactccacaaggcgtactacttaagaagtgggtacccatcgaaggttcaggcgcacgtggatcgtggacagaattcactctacacatacaacacgcctgcagcctagattgtagtttacggactaaacttacctacgtcgaaccctaacgttattacgttaacctttacgttccggtacctacccgttcggaccgaagggaccaacggtacgtacgggaagtaacgttaaacggacgtggtacggtctacgaccacctacgttccttagtcctttcgcgtttccccg

SEQ ID NO: 82752 - DNA, 699 bp, Homo sapiens
  misc_feature: GYAE6OF01EXWF5.22.57.F02.1.454.CMB.1.raw
  modified_base (226)..(226): a, c, t, g, unknown or other
  misc_feature (226)..(226): n is a, c, g, or t
tcagacatacgcgtcacgaccggtgctcgatttagctcgatatagttgggtttgggaggctggtctcactttgtgcaggagtcagaccccagtcaggacacagcatggacatgagggtccccgctcagctccgtggggctcctgctgctctggcctcccgaggtgccaagtgtgacatccagatcgaccctagtcctccctccacccgtggctgcatctgtagganacgagagtcaccactctacgttggtccgggcctagtacaagtaattaattaagtaggtttggttacggccttaggttatccgaaggaccaacggaaacccgaggggtaaaaccctcccctaattaaccctccgtacgtaactacccgaacgtaacggtccgttaacttaacgtttaaggaaacggttccgggtaccctagtacgtaacggttcaggtaccgacgtaacgtggtacttcggtagggactaacgtacttaccgtacttcctacgaacctactacaaccgacgtacctacgaccacgtacctagacgttcgtagtttacggaaccttaaccgttacgtaccgttaccgaacccttaacgttaattaaccgttacgttaccgtttacccgtaccgtacccggttacccggaacgaacggtaccacggtacgtaggtaacgtaacgttaaacgacgttaggtcgtacg

SEQ ID NO: 82753 - DNA, 1144 bp, Homo sapiens
  misc_feature: GYAE6OF01C9RAK.22.57.F02.1.454.CMB.1.raw
tcagacatacgcgtcacgaccggtgctcgatttagctcgatatagttgggtttgggaggctggtctcactttgtgcaggagtcagacccagtcaggacacagcatggacatgacgggtccccgctcagctccgtggggctcctgctgctctggcctcccgaggtgccaagtgtgacatccagatcgacccagtcctcctccaccgtggctgctatcgtaggtaggagacagtacgtccacctataccgtacgttcggtccggacctaggtacaaggtaaatttaagtttaagtaggtttcgggttcggtaccgttagggttactacgaacgtaccgaaacggaaaacccgaaacggggtaaacccgtaccccctttaacgtaacccgttacccgtaacgtaaacccgttaccccgaaaaccggtaaaccggggttcccgtttaaaccgttttaaaccggtttttaaaaggggtaaaacccgggggtttccccgggggttaaccccctaaaaggttttaacccggtaaaaccgggggttttaccgaaacggggttccccgggtaaccgtttaaacggggttcgggtttaaaccggtttacccggggttaaccggggggtaaaaccttaaacccgggttaaacttttaaccccggtaacccccgttttaccctaaaccccggtaaaccccttaaaccggtaaccccttaaaaaaccggccccggtttaccccgttaccggggaaacccttaaccgggttaaccccggtttaaagggttaaacgttttaaccccggggttttaacgggtttttaaccccgggtaaaacctttaaaacccccgttttttaaccccgggtttaaacccggttaaaccccggttaaaacccccgggtttaaaaccgttttaaccggttttaaaccggtttttaaaccccggtttttacccgggttttaaacccccggggttaaaccccgtttttaaacccccccgggttttaacccggggggaaaacccccggttaaaaacccgggggttacccaaaaaccccgggggtttcgggtttaaaaaccggggttaaaacgtttaaaaaaccccggttttaaacccggggtaaccgttttcggggggttaccccggtaaaccgg

SEQ ID NO: 82754 - DNA, 540 bp, Homo sapiens
  misc_feature: GYAE6OF01ARPTT.22.57.F02.1.454.CMB.1.raw
  modified_base (366)..(366): a, c, t, g, unknown or other
  misc_feature (366)..(366): n is a, c, g, or t
tcagacatacgcgtcacgaccggtgctcgatttagctcgatatagttgggtttgggaggctggtctcactttgtgcaggagtcagacccagtcaggacacagcatggacatgagggtccccgctcagctcctggggctcctgctgctctggctcccaggtgccaagtgtgacatccagatgacccagtctccttccaccctggctgcatctgtaggagacagagtcaccatcacttgtcgggccagtcagaatattaatagttggttggcctggtatcagcagaaaccagggaaagcccctatactcctgatccacaaggcgtctacttagaaagtggggtcccatcaagtcagcgcactggatcngggacagaatcactctcacatcaacacgcctgcacgcctagatgatttggactaaccttactactcgaccaaacttataacgttaacttagttaccggtctacccgttcgggacccaaacgggccaacggtactacgggaaacgtaacgttaaaaccgaacgttggcggtaccg

SEQ ID NO: 82755 - DNA, 754 bp, Homo sapiens
  misc_feature: GYAE6OF01D0PE0.22.57.F02.1.454.CMB.1.raw
  modified_base (103)..(103): a, c, t, g, unknown or other
  misc_feature (103)..(103): n is a, c, g, or t
tcagacatacgcgtcacgaccggtgctcgatttagctcgatatagttgggtttgggggagtcagacccagtcaggacacagcatggacatgacgggtccccgntcagctcctggggctcctgctgctctggctcccaggtcgccaaggtgtgacatccagactcgacccagttcctccttcccacccgtggctgcatcgtggtaggagacagagtccactatctacgttgcgggcagtcagtaattattagtaggttggtcgcttaggtctcgagacaaggaaaccgaggaaccgtcccctaataccgtactacgactaccgacgtaacggtcttacttaacgtttaacggaacgggtcgggtaccctagttacgacggttacgacggtacggtccaggttcggagtacgtacgggaacgtaactaactttcccgacttcctaacctaacctaacttacccaacgaccgtacccgtacgacgtaacgtcccgttagtaacgttacggttaacgtttacgggtaacctttaaaccgttaccgttaaccgttaccgtaacccgttaaacgttacgtttaacgtttaaccgttttaccgtttacccggttaaccgttacccggttaacccgggtaaccgtaaaccggggtaccgtaaccggtaaccggttaacggtaaacggtaaacgttaaccggtaacgtacggtacggtacgtacgactacgtacttacgttacgttccttcgtaccttccccg

SEQ ID NO: 82756 - DNA, 666 bp, Homo sapiens
  misc_feature: GYAE6OF01AFMI3.22.57.F02.1.454.CMB.1.raw
  modified_base (298)..(298): a, c, t, g, unknown or other
  misc_feature (298)..(298): n is a, c, g, or t
  modified_base (389)..(389): a, c, t, g, unknown or other
  misc_feature (389)..(389): n is a, c, g, or t
tcagacatacgcgtcacgaccggtgctcgatttagctcgatatagttgggtttgggaggctggtctcactttgtgcaggagtcagacccagtcaggacacagcatggacatggagggtccccgctcagctcctggggctcctgctgctctggctcccaggtgccaagtgtgacatccagatcgacccagtcctccttccaccctggctgcatcgtgtaggacgacagagtcaccatcacttggccggcagtcagaatataatagttggtgctgtatcagcaagaaaccgagggaaacncccctaatacctccgtagaactcccaagaacggtccgttacttaacgtttaaggaaacgggttcggggtaccctaagtaacgaacggtttnacggtccggaccacggttaggaattccggtaacggggaactaacggtaactttcaacgttccctaccaaacctaacttaccaaaccaccgacctacgaccaagtcctagtattacgtacgttcgtaacctaacgttactaaccctacgtaacccttaaaccgtattaacgttacttacgttccggtaacctacccggttaccgggaccgaaacgggtccctaaacggtacgtaacgggtaaacgttaaacttaaaaccggacgttggtcggtaaccg

SEQ ID NO: 82757 - DNA, 694 bp, Homo sapiens
  misc_feature: GYAE6OF01CDQ9Y.22.57.F02.1.454.CMB.1.raw
tcagacatacgcgtcacgaccggtgctcgatttagctcgatatagttgggtttgggaggctggtctcactttgtgcaggagtcagacccagtcaggacacagcatggacatgagggtccccgctcagctcctggggctcctgctgctctggcctcccaggtgccaagtgtgacatccagatcgacccagtctcccttccaccctggctgcatctgtaggagacagagtcaccatcacttggtccggcctagtacaagtaattagttaattaggtttgggttcgtccgttggtatcgagacaacgaaaccggaagggaaacctcccttaataccctccgtacgactacccaacgtaaggtccgttacttaacgtttaacgaaacgggttcgggtaccctagtacgtaacggttcgaacggtcggaccgtacgtggtacgtcggtagggaacgtaagtaaccttccgtaaccttacctacccgaacctaactaccaaacgaccgtacctacgacctacgccgttgacgttagtacgtttacggaccttaaccttacgtaccttaccgaacccgttaaccgtacgttaacgttaccgttacgttccggttaccttaacccgttccgggaccgtaaacggggacctaacgggtacgtaggtaacggtaacttaaaccggtaacgttcggtacgtacgg

SEQ ID NO: 82758 - DNA, 862 bp, Homo sapiens
  misc_feature: GYAE6OF01AXLDK.22.57.F02.1.454.CMB.1.raw
tcagacatacgcgtcacgaccggtgctcgatttagctcgatatagttgggtttgggaggctggtctcactttgtgcaggagtcagacccagtcaggacacagcatggacatggacgggtccccgctcagcctccgtggggctcctgctgcctctggcctcccgaggtcgaccaaggtgtgacatccagatcgaccctagtcctcccttcccacccgtggcctgcctatcgtggtaggagacagtactcaccatctacgttggccggccaggtcaagtaattaagtttaagttaggtttggttacggtccgttaggtactacgacggacgaaacggaaaccgaaacgggaaaccaccccgttaatacctcgtacgactacccgagtaacggtcctacgttaacgtttaaggaacgggttcgggtaccctaagtacgtaacgggttacgacggtaccgacgtaacgtggtaaccgttcggtaacggggtaacctaaggttaacctttccctaaccttacccgtaaccctaaacccgtaacctaacccgtaacccgaccggttacccgtcggaaccccgttacggcccgtttaaggtacgttttacgggttaacgtttaccgggtaaaccctttaaacccgttttaaccgttaaccccggttaacccggttaaaccccgttaaacccggtttacgttttaaaccggtttaacccgttttaaccgggttccccggttaaccccgtttaacccggggttacccggggtaaaacccggaacggggtaaccccaaccgggtttacggttaaacggtaaaccggttaaaacccgttaaacgggtaacccgtttgggtaacccggtaccgg

SEQ ID NO: 82759 - DNA, 543 bp, Homo sapiens
  misc_feature: GYAE6OF01A8VFR.22.57.F02.1.454.CMB.1.raw
  modified_base (425)..(425): a, c, t, g, unknown or other
  misc_feature (425)..(425): n is a, c, g, or t
tcagacatacgcgtcacgaccggtgctcgatttagctcgatatagttgggtttggggaggctggtctcactttgtgcaggagtcagacccagtcaggacacagcatggacatgagggtccccgctcagctcctggggctcctgctgctctggctcccaggtgccaagtgtgacatccagatgacccagtcctccttccaccctggctgcatctgtaggagacagagtcaccatcacttgtccgggccagtcagaatattaatagttggttggctggtatcagcagaaaccagggaacgccctatacctcctgactccacaaggcgtactactttaagaagttcggggacccatcaaggttcaggcgacactggatcgtagggacagtaattcactctcaaccataccaagcgcctgcacgctagntgtatttgactaacttactactcgacctaaccgtataacgttacttcgttaccgtcacccgttcggaccgaagggccacggtacgtcggtaactaacttaaaccgacgtggtcggtcg

SEQ ID NO: 82760 - DNA, 585 bp, Homo sapiens
  misc_feature: GYAE6OF01BF0YS.22.57.F02.1.454.CMB.1.raw
  modified_base (254)..(255): a, c, t, g, unknown or other
  misc_feature (254)..(255): n is a, c, g, or t
  modified_base (272)..(272): a, c, t, g, unknown or other
  misc_feature (272)..(272): n is a, c, g, or t
tcagacatacgcgtcacgaccggtgctcgatttagctcgatatagttgggtttgggggagtcagacccagtcaggacacagcatggacatgagggtccccgctcagctcctggggctcctgctgctctggctcccaggtgccaagtgtgacatccagatgacccagtctccttccaccctggctgcatctgtaggagacagagtcaccatcacttgtcggccagtcagtaatattaatagttggtgcctggtannagcaagaacgaggaacnccctatactcctgactccacgaacggtctacttaacgtttaagaaacggtcgggtaccctatacgtaaggttccaggcggacagtggatcgtagggacagtaatccactcacaccataccaacagtccctagacctacgcctagacttgtacgttacggacctaacttacctacgtccgaaccctaacgttataacgttacttacgttccgtacctaccgttcggaccgaagggtaccacggtacgtaggaacgtaacgtaaacgcgttggacggtctacgcacctattccgttagtccttctcgttaccccg

SEQ ID NO: 82761 - DNA, 653 bp, Homo sapiens
  misc_feature: GYAE6OF01BTHRV.22.57.F02.1.454.CMB.1.raw
  modified_base (398)..(398): a, c, t, g, unknown or other
  misc_feature (398)..(398): n is a, c, g, or t
tcagacatacgcgtcacgaccggtgctcgatttagctcgatatagttgggtttgggggagtcagacccagtcaggacacagcatggacatgagggtccccgctcagctcctggggctcctgctgctctggctcccaggtgccaagtgtgacatccagatgacccagtctccttccaccctggctgcatctgtaggagacagagtcaccatcacttgcgggccagtcagaatattaagtgttggtgcctggtatcagcagaaaccagggaacgcccctatacctcctgactccacgaggtctacttactttaaggaaggtcgggtacccagtacgaaggttcaggtccgcacgtggactcgtagggacagtaacttccactctaccaacctatacaacncgtcctgacacgtcctagattcgtacgtttcggacttaacttaccgtacgtaccgtaaccctaaccgttaattaacgttaccgtttaacgttacccggttaccctaacccggtttaccgggaacccgtaaacggggtaccctaaccggtaacggtaggtaaacggtaaacgtttaaaacggtacggttgggttaccggtcttacggacccctacgtacgttccgttaacgtttccttaccgtccgtttaccccgg

SEQ ID NO: 82762 - DNA, 560 bp, Homo sapiens
  misc_feature: GYAE6OF01BGRHA.22.57.F02.1.454.CMB.1.raw
  modified_base (219)..(219): a, c, t, g, unknown or other
  misc_feature (219)..(219): n is a, c, g, or t
  modified_base (222)..(222): a, c, t, g, unknown or other
  misc_feature (222)..(222): n is a, c, g, or t
  modified_base (398)..(398): a, c, t, g, unknown or other
  misc_feature (398)..(398): n is a, c, g, or t
tcagacatacgcgtcacgaccggtgctcgatttagctcgatatagttgggtttgggaggctggtctcactttgtggcaggagtcagacccagtcaggacacagcatggacatgagggtccccgctcagctcctggggctcctgctgctctggctcccaggtgccaagtgtgacatccagatgacccagtctccttccaccctggctgcatctgtagganacngagtcaccatcacttgtcggccagtcagaatattaatagttggtgcctggtatcagcagaaacagggaacgccctatactcctagactccacgaagcgtctactttagaagtgggtcccatcaaggttcacgcgcacgtggatcgtgggacagaattcactctacacactacaacngacctgccacgtcctgacttgtacgtttcggacttaaccttactacgtcacccgtaaccgttattaacgttactttacgttacgttacctaccgttccgggacctaaggggaccgaacgtacggtacggtaaatacgtttaaaacggaccgttggtgggtac

SEQ ID NO: 82763 - DNA, 769 bp, Homo sapiens
  misc_feature: GYAE6OF01AT9PK.22.57.F02.1.454.CMB.1.raw
  modified_base (219)..(219): a, c, t, g, unknown or other
  misc_feature (219)..(219): n is a, c, g, or t
  modified_base (234)..(234): a, c, t, g, unknown or other
  misc_feature (234)..(234): n is a, c, g, or t
tcagacatacgcgtcacgaccggtgctcgatttagctcgatatagttggggtttggaggctaggtctcgactttgtgcacggaggtctagaccctagtcaggtacacagcgatggacagtggacgggtccccggactcagctcctggggcctcctgctgctctggctccagtgcgagtgtgacatccagatgacccagtcctcctccaccgtggtcttncatctagtaaggaanaacaagtacgtcacctagtccacgttcggtacgggaaccaaggtaccaacgtaacttaacgttaacttacggtttaggtttcggtaccgttaggttaacttaccggtacggtaccgtaaccggaaacccgtaacgggtaaaccgtcccccgttaagtacccgtaccgtaacgaaccgttcccggaacggtaacgggtaccgttaccgtttaaacggtttacggtaaaccggtcccggggttaaccctaaacgttaccgtaaacgggttacgaccggtaccggacctaccggtagggtacctacggtagggtactaagttaacgttactaacctttcgtaccacgtaacactaaccgtacgtacctacgacctaccgtcctacgttacgtacggttacgttacggtaactaacgttacgtacggtaccgtaaccgtaacggttacgttacgttacttcgttaccgtacccgtacccgtcggtaccgtaacggtaccacgtaacgtcgtaacgtaacgttaacagttcgtagtaccg

SEQ ID NO: 82764 - DNA, 808 bp, Homo sapiens
  misc_feature: GYAE6OF01BHP16.22.57.F02.1.454.CMB.1.raw
  modified_base (771)..(771): a, c, t, g, unknown or other
  misc_feature (771)..(771): n is a, c, g, or t
tcagacatacgcgtcacgaccggtgctcgatttagctcgatatagttgggtttgggggagtcagacccagtcaggacacagcatggacatgagggtccccgctcagctcctggggctcctgctgctctggctcccaggtgccaagtcgtgacatccagatgacccagtctccttccacctggctgcatctgtaggagacagagtcaccatcacgttgtccggccagtcagtaatagttaatagttggtacgtccgtggtatcaggacaacgaaaccgaaggaaacgtcccctaatacctccgtgtactccgaacgaaggtcctacttacgtttaaggaaacgggttcggggtacccctagttaccgtaagggtttcgacggccggtacgtacgtagggacgttaccgtacgggaacctaagtaacgttccgtaacttccctaccaaccgtactaccaaaccgtcgtccccgtagaccgaacggttccccgttaaggtaacgttacggtaacgttttcgggaacccttaaacgtttacccgttaaccggttaaccggtaaccccgttaaaccccggtttaagtttaaccggtttaaccctttaacgggttttaccccgggttaacccttaacccggggtttacccggtaaacccggtaaacggggtaccccgtaaaccggggttaacccggttaagggtaaaacgtaaacccggtttaaaaaccgggtaaccggttcggtaaccgggtcctaccggttacccaacccgtttnttaccggttcgttaccctttccgaaccctttccccgg

SEQ ID NO: 82765 - DNA, 756 bp, Homo sapiens
  misc_feature: GYAE6OF01EN07J.22.57.F02.1.454.CMB.1.raw
  modified_base (102)..(102): a, c, t, g, unknown or other
  misc_feature (102)..(102): n is a, c, g, or t
  modified_base (198)..(198): a, c, t, g, unknown or other
  misc_feature (198)..(198): n is a, c, g, or t
  modified_base (299)..(299): a, c, t, g, unknown or other
  misc_feature (299)..(299): n is a, c, g, or t
tcagacatacgcgtcacgaccggtgctcgatttagctcgatatagttgggtttgggggagtcagacccagtcaggacacagcatggacatgagggtccccgntcagctcctggggctcctgctgctctggctcccaggtgccaagtgtgacatccagatgacccagtcctccttccaccctggctgcatctgtagganacagagtccaccatcacgtttggccgggcctagtcaagtaattattaagttaggtttggttaggccttggtactcgagtacaagaaaccgaagggaaaccnccccttaattacctcctagactaccgaagaacggtccttacttaacgtttaaggaaaggttccgggtacccctaagttaccgtaaacggttcgaacggccggtactaaccgtgggtaactcggtagggaaacctaaggttaactttcccgaacgtttcctaaccgaaccctaattaccgaaacgacgtccctacgacgaccgtccctagtaagttggttaacgttttcggaactttaaccgtttactaaccgttccgaaacccgttaaaccgttataacgtttaccgtttaacgttacccgggtaccttacccggttaccggacggtaaacgggtaccctaacggtacgttaagggaacttaaaccgttaaaaccggtacgtttacggtacgggtcctacggtaccctaaacccgttagttacccgttacgttaccgtttacctacgtttacccccg

SEQ ID NO: 82766 - DNA, 915 bp, Homo sapiens
  misc_feature: GYAE6OF01DKPG4.22.57.F02.1.454.CMB.1.raw
tcagacatacgcgtcacgaccggtgctcgatttagctcgatatagttgggtttgggggagtcagacccagtcaggacacagcatggacatgagggtccccgctcagctcctggggctcctgctgctctggctcccaggtgccaagtgtgacatccagatgacccagtctccttccaccctggctgcatctgtaggagacagagtcaccatcacttggcggccagtcagtaatattaagtagttggttggcctggtatcgagacaagaaaccgagggaaacgcccctatactcctagactaccaacgaacggtccgttacttaacgttttaaggaaaacgggttcggggtacccctaagttaccgtaaacgggtttccgaacgggtcccgggtaccgtaaccgttacggggtaacgttccggtaacgggggaaacctaaaggtaaactttcccgtaaacccttccgttaacccaaaccctaacttaacccgaaaacccgtaaccggtccccgttacggacccgtaaacgggtccccgttaagggtaaacgtttacgggtttaacgttttttaccggggaaaccctttaaaacccgttttaaacccgttaacccgtttaacccgggtaaacccccgtttaaaaccccgggtttaaatttaaacccggtttttaacccgtttttaaaccggttttaccccggggttaccctttaaacccccgggttttacccgggaaacccgggtaaaccgggggtacccgtaaacccgggttaaccggttaaggggtaaaccggttaaaacggtttaaaaacccggtaaccggtttagggtaccgggttcccttaacgggtaccctaaaacccgttcgtttacccgttaccggttttacccttacccgttaccgtttacccccccgg

SEQ ID NO: 82767 - DNA, 588 bp, Homo sapiens
  misc_feature: GYAE6OF01A46OM.22.57.F02.1.454.CMB.1.raw
  modified_base (275)..(275): a, c, t, g, unknown or other
  misc_feature (275)..(275): n is a, c, g, or t
  modified_base (376)..(376): a, c, t, g, unknown or other
  misc_feature (376)..(376): n is a, c, g, or t
tcagacatacgcgtcacgaccggtgctcgatttagctcgatatagttgggtttgggggagtcagacccagtcaggacacagcatggacatgagggtcccccgctcagctcctggggctcctgctgctctggctcccaggtgccaagtgtgacatccagatgacccagtctccttccaccctggctgcatctgtaggagacagatcaccatcacttgtcgggccagtcagaatattaatagttgttggcctggtatcagcaagaaccagggaaacncccgtatactcctgactccacaaggctactacttagaagtcgggtccatcgaagtcaggtcggcagtgatcgagggactagattcactctcaccatcaacngcctcgcacgctgagtgtagttcgactaacttacctactcgaacctaacgttactaagttacttacgttccggtactacccgttaccgggacgtaaacgggtccaaacggtacctagggtaaaaccgtaagttaaaaccgggtacgttaggtaccgggtcgttacggaacctacccgtagttcccgttagtacctttcctacgtttcccccg

SEQ ID NO: 82768 - DNA, 770 bp, Homo sapiens
  misc_feature: GYAE6OF01EERJM.22.57.F02.1.454.CMB.1.raw
  modified_base (200)..(200): a, c, t, g, unknown or other
  misc_feature (200)..(200): n is a, c, g, or t
  modified_base (740)..(740): a, c, t, g, unknown or other
  misc_feature (740)..(740): n is a, c, g, or t
tcagacatacgcgtcacgaccggtgctcgatttagctcgatatagttgggtttgggggagtcagacccagtcaggacacagcatggacatgagggtccccgctcagctcctggggctcctgctgctctggctcccaggtgccaagtgtgacatccagatgacccagtcctccttccaccctggctgcactcgtgtagganacgagacgtcacactcgtacgttcggccgggacctagtacaagtaattaaatttaacgtaggtttgggttacggaccgttggtactcgaagaccgtaaacggaaaacccgtaaggggaaaccgtcccccttaacgttacctaccgtacgtaactaccccgaacgaaacgggttccttaactttaaccggtttaagggtaaacgggttaccgggtaccccttaagtaaccgtacggtttacgacggtaccggtactacgtaggtacgttcggcgggtaaactagtaacttaccgcttactacccgaacgactaccaacctacgtaccctagaccgtaacgtccgtaagacgtttaggacgttttacggaaccttaaaccgtttaacgtaccgttaccgaacccgtttaaccgttaagttaaccgtttaccgtttacgttacccgtaccgtacccgtttaaccggaccgtaacgggactaaccgtaggtacaaacggttaacttaaaccggacgttaggacgtcttaccgaccctaacggtntaccgttacttaccgtttctacggttcccc

SEQ ID NO: 82769 - DNA, 554 bp, Homo sapiens
  misc_feature: GYAE6OF01DQBH9.22.57.F02.1.454.CMB.1.raw
  modified_base (530)..(530): a, c, t, g, unknown or other
  misc_feature (530)..(530): n is a, c, g, or t
tcagacatacgcgtcacgaccggtgctcgatttagctcgatatagttgggtttgggaggctggtctcactttgtgcaggagtcagacccagtcaggacacagcatggacatgagggtccccgctcagctcctggggctcctgctgctctggctcccaggtgccaagtgtgacatccagatgacccagtctccttccaccctggctgcatctgtaggagacagagtcaccatcacttggcggccagtcagaatattaatagttggtgctggtatcagacaacgaaaccgagggaaacctccctaatacctaccgtagaactccaacgaagggtctacttacgtttaagaaacgggttcgggtaccctaatacgtaaaggttcaagggcggactacgtggtactcgtaggggacaagtaacttcactctacacatacacacgctagcagctgatgtagttcgactaaacttactctcgaccctaacgtatacgttaacttatccgtctaccgtcgacgaagggtcaacgtanagggaataacttaaagactgtggc

SEQ ID NO: 82770 - DNA, 784 bp, Homo sapiens
  misc_feature: GYAE6OF01CNN3N.22.57.F02.1.454.CMB.1.raw
  modified_base (163)..(163): a, c, t, g, unknown or other
  misc_feature (163)..(163): n is a, c, g, or t
tcagacatacgcgtcacgaccggtgctcgatttagctcgatatagttgggtttgggagggctggtctcactttgtgcaggagtcagacccagtcaggacacagcatggacatgacgggtccccgctcagctcctggggctcctgctgctctggctcccaggtnccaagtcgtgactactccagacgtcgacccgagtcctccttccacccgtcggcctgccagtccgtgtacggacgacgagtagtcaccgtatactacttcggtcggctagtcaacggtaaattaacttaagtaggttacggttacggtacccctaggttacttacgtaacggtaacgaacggaaaacccggaacggggtaaaacctaccccggtttaacttaccgttacccgtacggtaacctaccgtaaccgtaacggtaccgttacttaacggtttaaacggtaaacggttcggggttaccctagtaacgtaaccggttccgacggccgtactacgtaggtcgttacgtcggaacctaaggtaaccttaccgtacctaccgtaccgaacctacgttaaccaaactacgtccttacggacgtcgaccgtttagaccttgttaacgttcggtaaacctaacctttaccgtaaccgtaccgtaaccgttaaccgttgttaaacggtttactttaccgtttaccgggtacccttaacccggttcgggaaccgtaaccggggtaaccgtaacccgtacggttaacggtaaccttaaacgttacgtaaccgttggtcccggtaacc

SEQ ID NO: 82771 - DNA, 615 bp, Homo sapiens
  misc_feature: GYAE6OF01ELS14.22.57.F02.1.454.CMB.1.raw
  modified_base (221)..(221): a, c, t, g, unknown or other
  misc_feature (221)..(221): n is a, c, g, or t
  modified_base (299)..(299): a, c, t, g, unknown or other
  misc_feature (299)..(299): n is a, c, g, or t
  modified_base (313)..(313): a, c, t, g, unknown or other
  misc_feature (313)..(313): n is a, c, g, or t
  modified_base (454)..(454): a, c, t, g, unknown or other
  misc_feature (454)..(454): n is a, c, g, or t
tcagacatacgcgtcacgaccggtgctcgatttagctcgatatagttgggtttgggaggctggtctcactttgtgcaggagtcagacccagtcaggacacagcatggacatgagggtcccccgctcagctcctggggctcctgctgctctggctcccaggtgccaagtgtgacatccagatcgacccagtcctccttccaccctggctgcatctgtagganacagacgtcaccatctagttgtcggccagtcagtaatattatagttgttggctgtatcagacaggaaaccagggaacnccctatactccgtnactaccaacgtaacgtcgtacttaacgttaggaaacggttcggggtacccaagtcgtaaacggttccaaggtccggacacgtaggtactcgtagggtacaagtacgttacaccgtacttacaacctatacaaccacgtccngtacacgtcctgtactgtatttcggaccttaaacttctacgtcgaccttaacgtattagttaccttagttaccggtaccttacccggttccggaccgtaaacggggacctaacggtaacgtacgggtaaacgtaacttaaaacggacggttgtcggtaccg

SEQ ID NO: 82772 - DNA, 542 bp, Homo sapiens
  misc_feature: GYAE6OF01E3Z1S.22.57.F02.1.454.CMB.1.raw
  modified_base (418)..(418): a, c, t, g, unknown or other
  misc_feature (418)..(418): n is a, c, g, or t
tcagacatacgcgtcacgaccggtgctcgatttagctcgatatagttgggtttgggaggctggtctcactttgtgcaggagtcagacccagtcaggacacagcatggacatgagggtccccgctcagctcctggggctcctgctgctctggctcccaggtgccaagtgtgacatccagatgacccagtcctccttccaccctggctgcatctgtaggagacagagtcaccatccacttgtcgggccagtcagaatattaatagttggttggcctgtatcagcaacgaaaaccgagggaaacgacccctatacctcctagactaccacaaggcgtacttaacgtttaagaaacggtcggggtcccagtacgtaaggttcagcggcagtgatcgtgggacagatcactcacacatcaacncgctgcacgcctagatgtattacggactaactactactcgaccaacgtatagtacttagttccggactaccgttcggaccgaacgggcaacgtagtaggaataacgtaaacgacgttgtggtac

SEQ ID NO: 82773 - DNA, 658 bp, Homo sapiens
  misc_feature: GYAE6OF01EEJJH.22.57.F02.1.454.CMB.1.raw
  modified_base (125)..(125): a, c, t, g, unknown or other
  misc_feature (125)..(125): n is a, c, g, or t
tcagacatacgcgtcacgaccggtgctcgatttagctcgatatagttgggtttgggaggctggtctcactttgtgcaggagtcagacccagtcaggacacagcatggacatgacgggtcccccgntcagcctccgtggggcctcctgctgctctggcctcccgaggtgccaagtgtgacatccagatcgacccagtccttccctccacctggctgctatctaggtaaggagaccagtacgtccaacctatcctacgttcggccgggaccaagtcaagtaaattattaagtgttgggttcgcgttaggtatcgagcgaaacgaaaccggaggaacctccctatacctcctgaactcccgaaacgacggtacctacttaacgttaaggaaacgttcggtacccagtacgtagggttcaggtcggactacggtggactcgggtacgggaacaacggtacctctaccttaccctacctaaccactacaaccgcgacctacgccgacgtcctagtattagtacttacggtacttaaccgttactaccgtaccgtacccgtaacgttattaccgttacgttacgttccgtaccgttaaccgttcggtaacgaacggtactaccggtagtacggtacaaacgtaaaccgtacgtggtacgtaccg

SEQ ID NO: 82774 - DNA, 724 bp, Homo sapiens
  misc_feature: GYAE6OF01C61N0.22.57.F02.1.454.CMB.1.raw
  modified_base (713)..(713): a, c, t, g, unknown or other
  misc_feature (713)..(713): n is a, c, g, or t
tcagacatacgcgtcacgaccggtgctcgatttagctcgatatagttgggtttgggaggctggtctcactttgtgcaggagtcagacccagtcaggacacagcatggacatgacgggtccccgctcagctccgtggggcctcctgctgctctggctcccgaggtgccaagtgtgacatccagatgacccagtcctcctccacctggctgcatctgagagacagatcacatcacgttgccggacagtcaagaatattaagtagttggttggcctggtatcgagacaagaaaccgagggaaactccctaatacctcctagactaccaacgaacggtcgttaccttaaacgttttaaggaaaacgggttcggggtacccctaagtaccgtaaaacgggttcaacggaccgggtacctaacgtgggtaaacttccgggttagggggaacctaagggtaaactttaccaaccgttccctaaccgtaacccgtaacttaacccaaaaccgccggttacccgttacgaccgtaacgggtcccttagtaagttacggttaacgttttacggaaccttaaactttacccgtaacgtaccgtaacccgttaaaccgttaagttaaccgttaacgttttacgttacccgggttacctacccgtttacgggacccgtaaacgggtaccgtaacgacggttacggaaacgttaactaaacggtacngggttcggtac

SEQ ID NO: 82775 - DNA, 838 bp, Homo sapiens
  misc_feature: GYAE6OF01BVSXQ.22.57.F02.1.454.CMB.1.raw
  modified_base (126)..(126): a, c, t, g, unknown or other
  misc_feature (126)..(126): n is a, c, g, or t
tcagacatacgcgtcacgaccggtgctcgatttagctcgatatagttggggtttggggaggctggtctcactttgtgcaggagtcagacccagtcaggacacagcatggacatggacgggtcccgntcagctcgtgggctctgctgctcgtcggcctcccgaggtcgacctaagtggtgacagtccgaagtactcgacccgtagttcctcccttacccgcccgtggtctcgacctagttcgtagggtaggaacgaactaggactaccaacctagttaccgttacgttcgggtacccgggacctagtacgtaaggtaaaagtttaagtttaaacggtttcggggtttacggggttccggtaccgttagggtaccttacgaacgaccggtaaaacggaaaacccgggtaaggggaaaccctacccctataacccggtctacgaccgtaccaacggtaacggtccgttaacgtttaacggtaacgggtaacgggttaccgggtacctacgttaacggtaacggtcggaacggccggtacgtaaccggtaggtaacgtccgggaagggtaactaacggttaacttacccgtaccttacctaacccgtaacctaccgtaactaaccgtacgtaccgtaccgacctaccggtacgtacggttaatacgggttacgttacggttaaccttaaccgtaacgttacccgtacgttaaccgttaaaccgttaagttaccgtttaacgttaccgttccgttaacccggtaccgtacgggtaacgtaacgggactaccggggtagttaaccgtaaaggttaaccgtaacgttacggtggttaggtaaccg

SEQ ID NO: 82776 - DNA, 816 bp, Homo sapiens
  misc_feature: GYAE6OF01DUCJ8.22.57.F02.1.454.CMB.1.raw
tcagacatacgcgtcacgaccggtgctcgatttagctcgatatagttgggtttgggaggctggtctcactttgtgcaggagtcagacccagtcaggacacagcatggacatgacgggtcccgctcagctcctggggctcctgctgctctggctccaggtcgccaagtgtgactatccgagatcgacctagtcctccttaccacccttggctcgctactctggtaaggacgaccgaggacgtccaaccgtatccgtacgtttggcccgggacctacgtacaacgtaaattaagttaaacgttacggtttcgggttacggtaccgttagggttaactacgtaacggaacgtaaacggtaaaaaccggaacgggggtaaaacctcccccttaagtacccgttaccgtaacgaaccttacccgaaacggtaacgggtcctttacgttaacgtttaaacgggaaacgggtttccggggtaccctaagttaccgtaagggttaccgacgggtccggtacctacggtacggtacgttaccgggtacggggaaacttaacggtaactttaccgtaccttaccgtacctaacctaacgtaacctaaacccgtacgtaccgttcgaccgtacgtacctaggttactacggttacgttacgaccttaaaccgtttactaccgttaccgaaccgttaacgttagttaaccgtttactttaccgttccggttaccttaaccggttccggaaacccggtaacgggtaaccgaaccggttacggtaacgggtaaacgttaaacggttaaacgtaacgttgggtacgtaccg

SEQ ID NO: 82777 - DNA, 716 bp, Homo sapiens
  misc_feature: GYAE6OF01A8GPF.22.57.F02.1.454.CMB.1.raw
  modified_base (166)..(166): a, c, t, g, unknown or other
  misc_feature (166)..(166): n is a, c, g, or t
  modified_base (183)..(183): a, c, t, g, unknown or other
  misc_feature (183)..(183): n is a, c, g, or t
tcagacatacgcgtcacgaccggtgctcgatttagctcgatatagttgggtttgggggagtcagacccagtcaggacacagcactggacatgagggtccccgctcagctcctgggctcctgctgctctggctcccaggtgccaagtgtgacatccagatcgacccngtcctcccttccacccnggctgcatctgtaggacacagacgtcacgatctacgttggtaccgggccagtccaagtaattaattaagtgttcggttggccgttgtatcgagacaagaaaccgagggaaccgacccctaatacctcctagactaccaacgaacggtctacttacgttaagaacggtcgggtaccagtacgtaacggtcgacggcggtacgtaacgtcggtagtcggtacgggaacgtaaggtaacttacgaccttacctacctaacctacacctaacaccgtctacggaccacggttactacggtaacgtcgtaagtttacggaacttaaccgttactacccgtaaccgaccggttaaccttaagttaacgtttaacttacggtttacccgtaccggttacccggttaccgggaactaacgggccctaaacgggtacgtaacgggtaaactaaaccgggttaaacggtaacgttacgggtacgtccgaccgtacccgtaaaccttctacgtttacgttaccttcccgtacgtttaccccccg

SEQ ID NO: 82778 - DNA, 579 bp, Homo sapiens
  misc_feature: GYAE6OF01BOM0Y.22.57.F02.1.454.CMB.1.raw
  modified_base (255)..(255): a, c, t, g, unknown or other
  misc_feature (255)..(255): n is a, c, g, or t
  modified_base (257)..(257): a, c, t, g, unknown or other
  misc_feature (257)..(257): n is a, c, g, or t
  modified_base (260)..(260): a, c, t, g, unknown or other
  misc_feature (260)..(260): n is a, c, g, or t
  modified_base (272)..(272): a, c, t, g, unknown or other
  misc_feature (272)..(272): n is a, c, g, or t
  modified_base (364)..(364): a, c, t, g, unknown or other
  misc_feature (364)..(364): n is a, c, g, or t
  modified_base (379)..(379): a, c, t, g, unknown or other
  misc_feature (379)..(379): n is a, c, g, or t
  modified_base (547)..(547): a, c, t, g, unknown or other
  misc_feature (547)..(547): n is a, c, g, or t
tcagacatacgcgtcacgaccggtgctcgatttagctcgatatagttgggtttgggggagtcagacccagtcaggacacagcatggacatgagggtccccgctcagctcctggggctcctgctgctctggctcccaggtgccaagtgtgacatccagatgacccagtcctcccttcccaccctggctgcatctgtaggagacagagtccaccatcacttggtccgggccagtcagaatattatagttgtgctgtntnagnagaacaggaacncccctatactcctgactccacgaagctactacttagaagtcgggccagtcaaggttcacgcggcacgtggatcgtaggactagactcactcnccaaccataccaacncgtcctgccacgctagatgtattacggacttaaccttactactaccgaccttaaccgtattacgttctttacttccggtactacccggttcgaacccgtaagggacctacgacgtaggacgtaaacgttaaacggacgttaggtacggtctaccggtcctaacccgtnttaccgttacgttccttccgtacgttcccccg

SEQ ID NO: 82779 - DNA, 721 bp, Homo sapiens
  misc_feature: GYAE6OF01COTL5.22.57.F02.1.454.CMB.1.raw
  modified_base (104)..(104): a, c, t, g, unknown or other
  misc_feature (104)..(104): n is a, c, g, or t
  modified_base (233)..(233): a, c, t, g, unknown or other
  misc_feature (233)..(233): n is a, c, g, or t
  modified_base (268)..(268): a, c, t, g, unknown or other
  misc_feature (268)..(268): n is a, c, g, or t
  modified_base (332)..(332): a, c, t, g, unknown or other
  misc_feature (332)..(332): n is a, c, g, or t
  modified_base (337)..(337): a, c, t, g, unknown or other
  misc_feature (337)..(337): n is a, c, g, or t
  modified_base (477)..(477): a, c, t, g, unknown or other
  misc_feature (477)..(477): n is a, c, g, or t
  modified_base (498)..(498): a, c, t, g, unknown or other
  misc_feature (498)..(498): n is a, c, g, or t
  modified_base (611)..(611): a, c, t, g, unknown or other
  misc_feature (611)..(611): n is a, c, g, or t
tcagacatacgcgtcacgaccggtgctcgatttagctcgatatagttggggtttgggggagtcagacccagtcaggacacagcatggacatggacgggtccccntcagcctccgtggggcctcctgctgctcgtgggcctacccgaggtcgacccaaggttgtagtactatcccgaagactcggacccctagttcctcccttacccaccgtgggctgctagtcgtggtagganacgagcgtacacctatcgacgttggccggctagtnaagtatattagtggttggtcgctggtatcagacgaacggaaacgacggtaacgccctatctacncgtanaccgtacgagtacgtcgtaagttaggtaacggtcggttaccggtactaggtaacggtcgtaggaccggtacgtacgtacggtacgttcggtacggacgtaacttaacgtacccgtacgtactacctacctactacaaccncggtacctcgacggacctagngtactgtaccgttagtaccgttaaactactcgaacctcgtaactacgttacgttacttaccggttactaccggtaccgttaccggacggtaaacccgggtataacccggggtntacgggtaaacggttaagggtaaaccgtacggttacgggtcgtttaccggaacctccgtaacccgttaaccgttcgtttaacctaccggtcccgttaccttaacccccgg

SEQ ID NO: 82780 - DNA, 542 bp, Homo sapiens
  misc_feature: GYAE6OF01CAZPK.22.57.F02.1.454.CMB.1.raw
  modified_base (295)..(295): a, c, t, g, unknown or other
  misc_feature (295)..(295): n is a, c, g, or t
  modified_base (412)..(412): a, c, t, g, unknown or other
  misc_feature (412)..(412): n is a, c, g, or t
  modified_base (418)..(418): a, c, t, g, unknown or other
  misc_feature (418)..(418): n is a, c, g, or t
  modified_base (421)..(421): a, c, t, g, unknown or other
  misc_feature (421)..(421): n is a, c, g, or t
  modified_base (511)..(511): a, c, t, g, unknown or other
  misc_feature (511)..(511): n is a, c, g, or t
  modified_base (514)..(514): a, c, t, g, unknown or other
  misc_feature (514)..(514): n is a, c, g, or t
  modified_base (526)..(526): a, c, t, g, unknown or other
  misc_feature (526)..(526): n is a, c, g, or t
  modified_base (531)..(531): a, c, t, g, unknown or other
  misc_feature (531)..(531): n is a, c, g, or t
tcagacatacgcgtcacgaccggtgctcgatttagctcgatatagttgggtttgggggagtcagacccagtcaggacacagcatggacatgacgggtccccgctcagctccgtggggctcctgctgctctggcctcccgaggtgccaagtgtgacatccagatcgacccagtcctcccttccacccgtggctgtatctggtaggagacagtacgtccacctatctacgttcggtccggccagtacaagtaattattaagtgttggtcgctgtatcgagacaagaaccgaggaacnccctatctccgtagactccaacgtacggtcgtacttacgttaagaacggtcggtaccatacgtagtcgaggccgactacgtggatcgtaggactagtactcactcacactatacacncgcctnacncgctgatggtacttgactactacactcgactaacgtatacttactcgtcgactccgtcgacgaggcacgagtagataacgtaagtcgtgnacncgctagtctctntctcncgttccctccg

SEQ ID NO: 82781 - DNA, 780 bp, Homo sapiens
  misc_feature: GYAE6OF01E4PMF.22.57.F02.1.454.CMB.1.raw
  modified_base (175)..(175): a, c, t, g, unknown or other
  misc_feature (175)..(175): n is a, c, g, or t
tcagacatacgcgtcacgaccggtgctcgatttagctcgatatagttgggtttgggaggctggtctcacttttgtgcaggagtcagacccagtcaggacacagcatggacagtggacgggtcccccgctcagcctccgtgggccttcctgctgctccgtcggcctcccgaggtcnccgaagtgtacgacactaccgagtactccgaccctcgttccttccttcccgaccgtgctgacctacgttcgagaaggaacgacgacgtaccgtaccaaccctagttaccgttcggttaccggccgaaccgtagtaacgtaattaacgttagtttaaggtttcgggtttggtcccgttaggtagtacgaccgtaacgaacgaaaccgtaaaccgaaccgtaccctaacctacgttaccctaacgaccgtaaccgtaaccgtaaccggtaaccgtttacgttaaacggttaaacggtacggtaaccgtttcggaacgttaacgtaaccggttacgaacggtccggtaccgaacggtttcggtacgtacggttaacgacgtaacgtacttactaccgactacccgtacaactacgacgacgcgacgtacgacgtccgagttacgtattacgttacgtacttaaccgtaactccgttaacgtaccttaaacgttacgtaacgtttaccgttccggttacgtaaccgttaccggtaccgtaacggaaccgtaacgtaaccgttaggaacgtaacggtaaacgtaaccgttaccgacgtccgtacgtaccg

SEQ ID NO: 82782 - DNA, 701 bp, Homo sapiens
  misc_feature: GYAE6OF01CPQWL.22.57.F02.1.454.CMB.1.raw
  modified_base (107)..(107): a, c, t, g, unknown or other
  misc_feature (107)..(107): n is a, c, g, or t
  modified_base (175)..(175): a, c, t, g, unknown or other
  misc_feature (175)..(175): n is a, c, g, or t
  modified_base (205)..(205): a, c, t, g, unknown or other
  misc_feature (205)..(205): n is a, c, g, or t
  modified_base (219)..(219): a, c, t, g, unknown or other
  misc_feature (219)..(219): n is a, c, g, or t
  modified_base (404)..(404): a, c, t, g, unknown or other
  misc_feature (404)..(404): n is a, c, g, or t
  modified_base (473)..(473): a, c, t, g, unknown or other
  misc_feature (473)..(473): n is a, c, g, or t
  modified_base (530)..(530): a, c, t, g, unknown or other
  misc_feature (530)..(530): n is a, c, g, or t
  modified_base (553)..(553): a, c, t, g, unknown or other
  misc_feature (553)..(553): n is a, c, g, or t
  modified_base (646)..(646): a, c, t, g, unknown or other
  misc_feature (646)..(646): n is a, c, g, or t
  modified_base (667)..(667): a, c, t, g, unknown or other
  misc_feature (667)..(667): n is a, c, g, or t
tcagacatacgcgtcacgaccggtgctcgatttagctcgatataggtttggggtttgggggagtcagacccagtcaggacacagcatggacatggagggtcccccgntcagctcgtgggctcctgctgctcgtggactcccgaggtcgaccaagtgtgacactccagatcgaccngtcctcctcaccgtggctgcatcgtggagnacgagactcacctntacctacgttcgcgggaccagttacagaattagttagtaggttggttacggtccttagggtactcgagacgaaacgaaaccgaaggggtaacctcccgtaatacctaccgtcgaactcccgaagaacggtccttacgttaacttaagggaacgttcggggtaccagtacgtaacggttgaacggngtaacctgggtacgacgtacgtacgggacgtaacgtattaccctattacccaactacacttaccaaacncggtacccgtaggtacgaccgttagacgttaacgttcttaccggtaataacccttanacccgtacgtaacctaacggttntaaccgtttacttacgttaccggtaccgttaccgtccgggtaacgaaccggtaccacggtaacgtgggaaacttacgttaaacgcgtaaggtnacggtccgaccgtaaccgttntcggttactaccggttctcggtcccttaacccgg

SEQ ID NO: 82783 - DNA, 768 bp, Homo sapiens
  misc_feature: GYAE6OF01ER5QK.22.57.F02.1.454.CMB.1.raw
  modified_base (126)..(126): a, c, t, g, unknown or other
  misc_feature (126)..(126): n is a, c, g, or t
  modified_base (167)..(167): a, c, t, g, unknown or other
  misc_feature (167)..(167): n is a, c, g, or t
  modified_base (669)..(669): a, c, t, g, unknown or other
  misc_feature (669)..(669): n is a, c, g, or t
  modified_base (750)..(750): a, c, t, g, unknown or other
  misc_feature (750)..(750): n is a, c, g, or t
tcagacatacgcgtcacgaccggtgctcgatttagctcgatatagttgggtttgggaggctggtctcactttgtgcaggagtcagacccagtcaggacacagcatggacatcggacgggtccccgntcagcctccgtggggctccgtgctgctctggctccaggtcnccaagtgtgacatccagtatacgaccctagttccttcccttccgacccgtggccttgacctatcgtaggtaaggacgaccgtagacgtaccaacgtactccgtacgtttggcccgggtactacggttccaaagtaaacttaagtttaacgtacggtttcgggttaccggccgttagggttactacgaggaccgtaaacggaaacccggtaaggggaaaccctccccgtaagttacccgtacctacggtaacctaccggaacgtaacgggttacccttacgtttaaacgtttaacgggaaacgggttccgggtaccctagttaccgtaaaggtccacgggtaccgctaacggttcggtaacttcggacggtaactaagttaacctccgtacttaccgaccgtaacctaacgtaccgtaaaccgtcgacccttagaaccgtacgtccgtagtacttgtaaccggtttcgaacctttagtaccgtactaccgtacctaacgttanaacgttgttaccgttacgtacccttaccggttcggaaaccgacggtacctacgtacggtacggtaaagttaacgttaaacncggtttgccgttaaccgg

SEQ ID NO: 82784 - DNA, 698 bp, Homo sapiens
  misc_feature: GYAE6OF01D74UB.22.57.F02.1.454.CMB.1.raw
  modified_base (524)..(524): a, c, t, g, unknown or other
  misc_feature (524)..(524): n is a, c, g, or t
tcagacatacgcgtcacgaccggtgctcgatttagctcgatatagttgggtttgggaggctggtctcactttgtgcaggagtcagacccagtcaggacacagcatggacatgacgggtccccgctcagctccgtggggctcctgctgctctcggcctcccgaggtcgaccgtaaggttcgtacgacctactaccgagtacgtccgacccctagttcccttacccttcccacccgtggtcctcgactactcgtaggtaggacgacgagacgtccaacctataccgtacgtttcggccggtaccaaggtacaaaggttaaatttaagtttaaggttacgggtttcgggtcggttccgtaggttactaccgaacgtaccggaaaacgaaaccggaaggggtaaaccctccctaatacctctacgaactccaacggtacgtaccttactaacgtttaagggaacggtccgtacccagtaccgtaacggtcgacgcgtactagtcgtactcggacgtactacgtatccnctcaccatacacaaccgacgtctagacacgtcctagattgtactactaactacttacgtacctacgaacgtaattaccgtattaacgttcgtaccgtacccgttaccggtaccggaacgtacgggacttacggagttaacggtaactaaacgttaaccggtgtgggtactccgg

SEQ ID NO: 82785 - DNA, 943 bp, Homo sapiens
  misc_feature: GYAE6OF01C2BWP.22.57.F02.1.454.CMB.1.raw
  modified_base (100)..(100): a, c, t, g, unknown or other
  misc_feature (100)..(100): n is a, c, g, or t
  modified_base (165)..(165): a, c, t, g, unknown or other
  misc_feature (165)..(165): n is a, c, g, or t
tcagacatacgcgtcacgaccggtgctcgatttagctcgatatagttgggtttggggagtcagacccagtcaggacacagcatggacatgagggtccccnctcagctcctgggctcctgctgctctggcctcccaggtgccaagtgtgacatccagactgacccngtcctccttccacctggctcgcattcgtgtagagacagagtccaacctatcctaacttggtccgggacctaggtacaagtaaattagtttaagtaggttagggttcggtaccgttagggttacttaccgaacgtaccgtaaacggaaaaccgaacggggtaaaacctccccgtaacgttacctaccgtagtaacctacccaaaccggtaacggtccgttaacctttaacggtttaacgggtaaaccgggttaccggggttaacccacgttaaccggtaacggtttcgaacggtccggtaaccgtacgttacggtaacgttccggtaagggaaacgttacggtaaaaccttcgtaaacgttccctaacctaaacctaactaccgaaacccgtacggtcccgtttaacggacccgtaaccggttaccccgttaaggtaacgtttaaacgggtttacgtttttacccgggaaaccgtttaaacccgtttttaaccgaaaccggttttaccgtaaaccccgttaaaccggtttaacgttaacgttttaaaccgttttacgttaaccccgggtttaaccgttaccccgggtttaacccgggaaaccgggttaaaccgggtacccgtaaaacgggttaaccggttaaagggaaaccgttaaaaccggtttaaaaccggtaaaccgggtttaggtttaacccgggaccgtttaacccgaaccccgttacctttaaccggtttccgtttaccggtttaacctaccccgtttaccgttaacccccgg

SEQ ID NO: 82786 - DNA, 699 bp, Homo sapiens
  misc_feature: GYAE6OF01BD1WW.22.57.F02.1.454.CMB.1.raw
  modified_base (124)..(124): a, c, t, g, unknown or other
  misc_feature (124)..(124): n is a, c, g, or t
  modified_base (165)..(165): a, c, t, g, unknown or other
  misc_feature (165)..(165): n is a, c, g, or t
tcagacatacgcgtcacgaccggtgctcgatttagctcgatatagttgggtttgggaggctggtctcactttgtgcaggagtcagacccagtcaggacacagcatggacatgacgggtccccgntcagctccgtggggctcctgctgctctggctcccgaggtcnccaagtgtgacatccagatcgacccagtcctccttccaccctggctgctagtcgtagtaggagtacagtacgtacaccatccacgttcggtcgggcccaaggtccaagtaattagttaaacgttaggttggttcggccttagggtactcgtagaccaaacggaaaactaaggggaacctcccctaatacctccgtagactaccgaagaaccggtcgttaccttaacggtttaaggaaacgggttccgggtaacccctagtacggtaaggtcaacgggtccgactacggtcgggatccggtaagggacagtaacttccaactccgtacaaccgtactaccgaaactaccgtcctagcctacgtacctcggtaataccggttagtttacggaacccttaacgttacgtaccttaacggacccttaaagtattaacgttctttacgtcccggtaccgtacccggttcggaaccggtaagcccgtacggtaaacgtcgggtaaaacgttaacgttaaacggcgttcgggaaggttccc

SEQ ID NO: 82787 - DNA, 662 bp, Homo sapiens
  misc_feature: GYAE6OF01EDA3L.22.57.F02.1.454.CMB.1.raw
  modified_base (324)..(324): a, c, t, g, unknown or other
  misc_feature (324)..(324): n is a, c, g, or t
tcagacatacgcgtcacgaccggtgctcgatttagctcgatatagttgggtttgggaggctggtctcactttgtgcaggagtcagacccagtcaggacacagcatggacatgagggtccccgctcagcctcctggggctcctgctgctctggctcccaggtgccaagtgtgacatccagatgacccagtcctccttccaccctggctgcatctaggtaggacgacagagtcacctatcacgttggtccgggcctagtaccagtaaattattaaagtagtttggttggaccttgggttatcgaagcaagaaaccgagggtaaacnccctatacctcctagactaccacgaaggtcgtacttactttaaggaaacggttcggggtacccaagtacgtaaggttcaaggacgacaacgtggaacttcggtaggggaactaagtaacttcacgttacctaccgacctaataccaaccgacgacctacgaccacgtaccgtacgtactcggtacgttttacggaaccttaaccgttactaccgtacgtacccgaaccgttataacgtttacttacgtttccggtacctacccgttaccgggaccgtaaacggggtaccaaccggtagtacgggtaaactaaaccgttaaacgacgtggtcggtaccg

SEQ ID NO: 82788 - DNA, 791 bp, Homo sapiens
  misc_feature: GYAE6OF01DCRXI.22.57.F02.1.454.CMB.1.raw
  modified_base (235)..(235): a, c, t, g, unknown or other
  misc_feature (235)..(235): n is a, c, g, or t
tcagacatacgcgtcacgaccggtgctcgatttagctcgatatagttgggtttgggaggctggtctcactttgtgcaggagtcagacccagtcaggacacagcatggacatgagggtccccgctcagctccgtggggctcctgctgctctggcctcccgaggtgccaaggtgtgacatccagatcgaccctagtcctcccttcccacccgtggctcgctattcgtaggtaggaanacgagacgtacaccattcctacgttcggtccggacctaagtacaagtaaattaacttaagttaggttcggttaggccgttaggtatacgaacgtaacgaacggaaaaccggaacgggaaacctccccttaataccttaccgtagaacctacccgaaacgtaacggtccgttaacttaacggtttaacgggaaacgggttcccgggtacctaagtaacggtaacggttacgacggccggtactacgttggacgttcggaggaactaacgtactcctactacaccaactactaaccacgtacgtcctacgacgtacgtacgttagtacgttacgttacgttacggtaaccttaaacccgttacgttacccgtaccggtaaacccctttaaacggttacgttaaccgttttaaacccgttcccggttaacccggtttacccgtaaccccgggttaaccggtaaaccccggggtaaacgggtacccgtaaaccggttacggtaaacgggtaaaacttaaaacccgggttaaacgtaaacggtgggttaaccggtaacccg

SEQ ID NO: 82789 - DNA, 883 bp, Homo sapiens
  misc_feature: GYAE6OF01BUXRS.22.57.F02.1.454.CMB.1.raw
  modified_base (133)..(133): a, c, t, g, unknown or other
  misc_feature (133)..(133): n is a, c, g, or t
  modified_base (786)..(786): a, c, t, g, unknown or other
  misc_feature (786)..(786): n is a, c, g, or t
tcagacatacgcgtcacgaccggtgctcgatttagctcgatatagtttggggtttggggaggtctggtctctactttgtgcaggagtcagacccagtcaggacacagcagtcggtacagtggacggtccccgngtaccagtcctcggtgggtccttccgtgcctcgtctcgtcggtacctacccgaggtcgaccgtaaggtcgtcgaactactacgaggtactccgtacctaccgttccttccctacccaccgtggcttagccgtcgttactaggaacggtaaccacgtaacgtacctaccaaacgtcgtaccgttacggttccgggtacggtaccgtaacggtaacgtaaattacgttaacggtttaacgttaggggttacgggttacggtccgtagggttagtaaccggacggtaacctaaacgggtaaaccggtaacggttaacccttacccgtaagtaccgttacggtaccgtacttaacccgtaaaccggtacgttacccgtttaacgttaccgtaaagggtaaccggttacggtaccctagttaacccggtacggttagtaccggtaccgacgtacggtacgtactacgggtacgacggtaattaaccgttcgtaccttaccgtaactaaccgtaccgtaaccgtaaccgtcgtacgtacccgaacgtccgtaccgggtttaatcccgtttcggttaacgttccttaaaccgttaagttcccgtaacggttaacccttaacggttaacgttaccgtaaaccgttacgttaaccccggttnttaaccccgggtaagtacccgggaaagttccgggtaaaccgtgggttaacggtaacggtaaacccttaacggttacgtacgtcggacccgttaacgg

SEQ ID NO: 82790 - DNA, 735 bp, Homo sapiens
  misc_feature: GYAE6OF01DD0EQ.22.57.F02.1.454.CMB.1.raw
  modified_base (123)..(123): a, c, t, g, unknown or other
  misc_feature (123)..(123): n is a, c, g, or t
  modified_base (164)..(164): a, c, t, g, unknown or other
  misc_feature (164)..(164): n is a, c, g, or t
  modified_base (237)..(237): a, c, t, g, unknown or other
  misc_feature (237)..(237): n is a, c, g, or t
tcagacatacgcgtcacgaccggtgctcgatttagctcgatatagttgggtttgggaggctggtctcactttgtgcaggagtcagacccagtcaggacacagcatggacatgacgggtccccntcagctcctggggctcctgctgctctggcctcccgaggtcnccaagtgtgacatccagatcgaccctagtcctcctccaccgtggctcgcatcgtgagacacagacgtcaactntcacgttcggccgggacctagtactaagtaaattagttaaagttaggttgggttacggtccgtaggttactacgaacgacgaaacggtaaaaccgacgggtaaacctacccgttaataccgtaccgtacgacgtacccaaacggtaacggtcgttaccttaacgtttaaacggtaaacggttccggggtaccctacgtacgtaaacggttcgacggtcggacgtacggtaggtactacggtacgggaactaagtaacgttacctacgtcctaacccgtaacctaacgtaaacctaaccgacgtcccgtagacctacgtcccgtagtacgttcgtaggtttacgacttaaaccttaccgttacgtactacccgttaacttacgttacgtttaaccgtttcgttacccgttccgtaacccggtaccggaaccggtaaacggtaccgtaccggtacgttaacggtaacgtaaacgtttaacggaacgttcggtggtacccg

SEQ ID NO: 82791 - DNA, 818 bp, Homo sapiens
  misc_feature: GYAE6OF01B4RGL.22.57.F02.1.454.CMB.1.raw
  modified_base (185)..(185): a, c, t, g, unknown or other
  misc_feature (185)..(185): n is a, c, g, or t
tcagacatacgcgtcacgaccggtgctcgatttagctcgatatagttggggtttgggaggctggtctcactttgtgcaggagtcagacccagtcaggacacagcagtggacatggacgggtccccgctcagcctccgtcggggcctcctgctcgctcgtcggcctcccaggtcgaccaagtgtanacagtaccagataccgaaccctacgtccttcccttaccacccgtgtaccgtagaccattcgtaggtacggaagtacgaacgtacgtaccgaacctagtacctaacgttcggaccggtacccgaagttaaccaaagtaaaattaacgttaaagttaggttacggtacggtaccgttaggtactacgagaaccgaaacgtaaaccggaaggtaacccgacccgtaataccgtaccttagaaccttaccgaacgaacggtcttacgtaaacgtttaagggaaacgtaccggggtacctaacgtaacggtaacgtaccggagaccggttacgacgtaacggtacgtacggttacgggaacttaagtaaccgttactacccgttacgtaccctaaaccgaacgtaaccaaccgtaccgtacgaccgtaccgtaccgagtaacggtacgttaacgttaccgtagtaaccctaacgttaaccgtaacgaccgtaaacccgtaagtaacgttaaggttaacctttaaccgttaccggttaaaccgtacccgggtaaccggtaaacggtaaacgacccggtaaacgtaagaaccgggtttaaaacgaaccggttaaacgtacgggttactgggttaaacccg

SEQ ID NO: 82792 - DNA, 749 bp, Homo sapiens
  misc_feature: GYAE6OF01DSEO0.22.57.F02.1.454.CMB.1.raw
  modified_base (227)..(227): a, c, t, g, unknown or other
  misc_feature (227)..(227): n is a, c, g, or t
  modified_base (288)..(288): a, c, t, g, unknown or other
  misc_feature (288)..(288): n is a, c, g, or t
  modified_base (341)..(341): a, c, t, g, unknown or other
  misc_feature (341)..(341): n is a, c, g, or t
tcagacatacgcgtcacgaccggtgctcgatttagctcgatatagttgggtttgggaggctggtctcactttgtgcaggagtcagacccagtcaggacacagcatggacatggacgggtccccgctcagcctccgtggggctcctgctgctcgtggcctcccaggtcgccaagtgtagacatccagatcgaccctagtcctcctccaccctggctgcatctggaganacgagagtcaccatcacgttgcggaccagtcaagtaatattaatggttgtcggactggtancagacgaacgaaaccgagggaaacctccctaatacctacgtagactaccgaanacggtctacttaacgtttaaggaacggttcgggtaccctaagtacgtaaaggttcgacggtaccgcgtaacgtggaacgtaccggtagggaacctaacgtaacgttacctactaccgtaccgtaaccaacgttacaaaccgtacgtaacccgtaacgaccgtaccgtacgtaagttacgttaagtttacggtaaaccttaaccgtttaaccgttaaccgttaccgtaacccgttaaacccgttaacgtttaaccggtttaaccttttaccgttaacccgggtacccgttaacccggtttacccgggaaacccggtaaaagggggttaccctaaacccgggttaagttaacgggaaacgtttaaaaccgttaaaaacggtaccggttaacggtcgggtacctaacccgg

SEQ ID NO: 82793 - DNA, 798 bp, Homo sapiens
  misc_feature: GYAE6OF01AX8ZR.22.57.F02.1.454.CMB.1.raw
tcagacatacgcgtcacgaccggtgctcgatttagctcgatatagttgggtttggggaggctggtctcactttgtgcaggagtcagacccagtcaggacacagcatggacatggacgggtccccgctcagctcctggggcctcctgctgcctgtcggctcccaggtcgccaagtgtgacatccagatcgacccagtctcccttccaccgtggctgcatcgtggtagagacagtactccaccatctacgttcgccgggccagtcaagtaattaacttaagttggtttaggtcggtctacggttatacgagacaaacgaaaaccgaacgggaacctccccttaacgtaacctccgtacgaacctacccgaacgtaacggtccgttactttaaacgtttaacgggaaaccggtcggggtaccccctaagtaacccggttaaggttccgacggtaccggtactacggtcggtacgttacggaacgggtaagtacgtacttaccaccttactaccctaaccgtaacctaaaccaacccgtaaccggtaccgtaccggtacccgtaacgttcccgtacgtaacttttaacgtacgttttaaccggaacctttaacccgtttaaccgttaaccgtacccgtaacccgtaaaccgtttaacgttaaacgtttaacccggttacgtttaccccggtaccgttaaccccggttacccgggttaacccggaaaccgggttacccgaaaccgggtacgttaacgggtaaacgttaaacgttaaacccggtaacggttacggtacggtacg

SEQ ID NO: 82794 - DNA, 1151 bp, Homo sapiens
  misc_feature: GYAE6OF01BIBBS.22.57.F02.1.454.CMB.1.raw
  modified_base (103)..(103): a, c, t, g, unknown or other
  misc_feature (103)..(103): n is a, c, g, or t
  modified_base (140)..(140): a, c, t, g, unknown or other
  misc_feature (140)..(140): n is a, c, g, or t
  modified_base (224)..(224): a, c, t, g, unknown or other
  misc_feature (224)..(224): n is a, c, g, or t
tcagacatacgcgtcacgaccggtgctcgatttagctcgatatagttgggtttgggggagtcagacccagtcaggacacagcagtggacatgagggtccccgntcagctccgtggggctcctgctgctgtgctccaggtncaagtgtgacatccagactcgaccctagttcctcccttccaccgtggctgcattcgtggtaaggacgaacgagacgtccaactntcctacgttcggtacgggaccaggtacaagtaactttaagtttaaagttagggttttgggtcggttccgttagggttactaccgaacggtaccgtaaacggaaaaacccggttaacggggaaaaccccgttaccccttaaaccgttacccgttacccgtacggttaaacccttaccccggtaaaaccggtaaaccggggttacccggttttaaaccttttaaaccggggttttttaaaacggggaaaaaccccgggggttttccccggggggttaaacccctttaaacgggttaaaccccgggtttaaacggggtttacccggtaaccggggaccccgggttaacgttaaacccggggtttaaggggttaacccgggtttaccgggttaaaacgggggtaaaccgttaaaccgggtttaaacccttttaaacccgtaaacccgtttccctttaaaaccccggaaacccctttaacgttaaaccccgaacccggttaaccggtccgttaaaccccgggtaaccttaccggggtacccctttaaacggtaaggttttaaccggtttaaccgttttacccgggtaaaccctttaaaaccggtttacccgtttaaaccccggtacgttaaaaacccccgggttaacgtttttaaacggtttaacccgttaaacccggttttttaaccggttacccgggttaaacccctttaaccccggggttaacccgggtaaaccggggttaaaaccccggggtaccttaaaccccggggttaagggttaaaccgggggtttaaaaacgttaaaacccggttaaacgtaacggggtttaacggtccgggggttaaccccttaacccgggttaccttaaaccccgtttctttacccggtttaactttccccttttccgggtaccctttaacccccccgggg

SEQ ID NO: 82795 - DNA, 495 bp, Homo sapiens
  misc_feature: GYAE6OF02I7Q1P.22.57.F02.1.454.CMB.1.raw
tcagacatacgcgtcacgaccggtgctcgatttagctcgatatagttgggtttgggaggctggtctcactttgtgcaggagtcagacccagtcaggacacagcatggacatgagggtccccgctcagctcctggggctcctgctgctctggctcccaggtgccaagtgtgacatccagatgacccagtctccttcaccctggctgcatctgtaggagacagagtcaccatcacttgtcgggccagtcagaatattaatagttggttggcctggtatcagcagaaccagggaaagcccctatactcctgatccacaaggcgtctactttagaagtgggtcccatcaaggttcagcggcactggatctgggacagaattcactctcaccatcaacagcctgcagcctgatgatttggactaacttactactgccaacgtatagtacttattcgtcaccttcggaccaagggcacgatggagtattaacgactgtggc

SEQ ID NO: 82796 - DNA, 498 bp, Homo sapiens
  misc_feature: GYAE6OF02GXC0B.22.57.F02.1.454.CMB.1.raw
tcagacatacgcgtcacgaccggtgctcgatttagctcgatatagttgggtttgggggagtcagacccagtcaggacacagcatggacatgagggtccccgctcagctcctggggctcctgctgctctggctcccaggtgccaagtgtggcatccagatgacccagtctccttccaccctggctgcatctgtaggagacagagtcaccatcacttgcgggccagtcagaatattaatagttggttggcctggtatcagcagaaaccagggaaagcccctatactcctgatccacaaggcgtctactttagaaagtggggtcccatcaaggttcagcggcactggatctgggacagaattcactctcaccatcaacagcctgcagcctgatgatttggcaacttactactgccaaccgtatagtacttattcggtcaccttcggccaagggcacgactggagattaacgaactgtggctgcaccatctgtcttcatccc

SEQ ID NO: 82797 - DNA, 497 bp, Homo sapiens
  misc_feature: GYAE6OF02HFZ7A.22.57.F02.1.454.CMB.1.raw
tcagacatacgcgtcacgaccggtgctcgatttagctcgatatagttgggtttgggggagtcagacccagtcaggacacagcatggacatgagggtccccgctcagctcctggggctcctgctgctctggctcccaggtgccaagtgtgacatccagatgacccagtctccttccaccctggctgcatctgtaggagacagagtcaccatcacttgtcgggccagtcagaatattaatagttggttggcctggtatcagcagaaaccagggaaagcccctatactcctgatccacaaggcgtctactttagaaagtggggtcccatcaaggttcagcggcactggatctgggacagaattcactctcaccatcaacagcctgcagcctgatgatttggcaacttactactgccaaccgtatagtacttattcggtcaccttcggccaagggacacgactggagattaacgaatgtggctgcaccatctgtcttcatc

SEQ ID NO: 82798 - DNA, 501 bp, Homo sapiens
  misc_feature: GYAE6OF02IUPRL.22.57.F02.1.454.CMB.1.raw
tcagacatacgcgtcacgaccggtgctcgatttagctcgatatagttgggtttgggaggctggtctcactttgtgcaggagtcagacccagtcaggacacagcatggacatgagggtccccgctcagctcctggggctcctgctgctctggctcccaggtgccaagtgtgacatccagatgacccagtctccttccaccctggctgcatctgtaggagacagagtcaccatcacttgtcgggccagtcagaatattaatagttggttggcctggtatcagcagaaaccagggaaagcccctatactcctgatccacaaggcgtctacttagaaagtggggtccatcaaggttcagcggcactggatcgtgggacagaattcactctcacatcaacagcctgcagcctgatgatttggactaacttactactgaccaacgtatacgtacttattcgtctaccgttcggccaagggacacgatggacattaacgactgtgtcg

SEQ ID NO: 82799 - DNA, 561 bp, Homo sapiens
  misc_feature: GYAE6OF02HCKCN.22.57.F02.1.454.CMB.1.raw
  modified_base (377)..(377): a, c, t, g, unknown or other
  misc_feature (377)..(377): n is a, c, g, or t
tcagacatacgcgtcacgaccggtgctcgatttagctcgatatagttgggtttgggggagtcagacccagtcaggacacagcatggacatgagggtccccgctcagctcctggggctcctgctgctctggctcccaggtgccaagtgtgacatccagatgacccagtctccttccaccctggctgcatctgtaggagacagagtcaccatcacttgtcgggccagtcagaatattaatagttggttggcctggtatcagcagaaaccagggaaagcccctatactcctgatccacaaggcgtctactttagaaagtggggtccatcaaggttcagcggcactggatcgtgggacagaattcactctcaccatcaacngcctgcagcctgatgatttggactaacttactactcgacctaacgtatacgttacttattcggtactaccgttcggaccaaacgggaccaacgtactagggagtaacgttaaaccggaacgttaggttacggcttacggacctaacccgtaacttccgttacgtttcctttccaactttccccg

SEQ ID NO: 82800 - DNA, 516 bp, Homo sapiens
  misc_feature: GYAE6OF02HU2IV.22.57.F02.1.454.CMB.1.raw
tcagacatacgcgtcacgaccggtgctcgatttagctcgatatagttgggtttgggggagtcagacccagtcaggacacagcatggacatgagggtccccgctcagctcctggggctcctgctgctctggctcccaggtgccaagtgtgacatccagatgacccagtctccttccaccctggctgcatctgtaggagacagagtcaccatcacttgtcgggccagtcagaatattaatagttggttggcctggtatcagcagaaaccagggaaagccctatactcctgatccacaaggcgtctactttagaaagtgggtccatcaaggttcagcgcactggatcgtggacagaattcactctcacatcaacagcctgcagcctgatgatttggactaacttactactgacctaacgtatagtacttattcggtctaccttcgaccaagggacacgactaggacgtaattaacggaactggtaggctacgccaccattcctagttcttacattcccg

SEQ ID NO: 82801 - DNA, 514 bp, Homo sapiens
  misc_feature: GYAE6OF02IHKZR.22.57.F02.1.454.CMB.1.raw
tcagacatacgcgtcacgaccggtgctcgatttagctcgatatagttgggtttgggaggctggtctcactttgtgcaggagtcagacccagtcaggacacagcatggacatgagggtccccgctcagctcctggggctcctgctgctctggctcccaggtgccaagtgtgacatccagatgacccagtctccttccaccctggctgcatctgtaggagacagagtcaccatcacttgtcgggccagtcagaatattaatagttggttggcctggtatcagcagaaaccagggaagccctatactcctgatccacaaggcgtctactttagaaagtggggtcccatcaaggttcagcgcactggatctgggacaggaattcaactctcaccatcaacagcctgcagccctgatgatttggactaacttactactgaccaaaccgtatagtacttattcggtctaccgttcggaccaagggaccacgactggagtaacttaaacgaattgaggtcc

SEQ ID NO: 82802 - DNA, 506 bp, Homo sapiens
  misc_feature: GYAE6OF02F2P1V.22.57.F02.1.454.CMB.1.raw
  modified_base (274)..(274): a, c, t, g, unknown or other
  misc_feature (274)..(274): n is a, c, g, or t
  modified_base (492)..(492): a, c, t, g, unknown or other
  misc_feature (492)..(492): n is a, c, g, or t
  modified_base (495)..(495): a, c, t, g, unknown or other
  misc_feature (495)..(495): n is a, c, g, or t
  modified_base (501)..(501): a, c, t, g, unknown or other
  misc_feature (501)..(501): n is a, c, g, or t
tcagacatacgcgtcacgaccggtgctcgatttagctcgatatagttgggtttgggggagtcagacccagtcaggacacagcatggacatgagggtccccgctcagctcctggggctcctgctgctctggctcccaggtgccaagtgtgacatccagatgacccagtctccttccaccctggctgcatctgtaggagacagagtcaccatcacttgcgggccagtcagaatattaatagttggttggcctggtatcagcagaaaccagggaaancccctatactcctgatccacaaggcgtctactttagaaagtgggtcccatcaaggttcagcggcactggatctgggacagaattcactctcaccatcaacagcctgcagcctgatgatttggctaaacttactactgaccaaccgtatacgttacttattcggtctaccgttcggaccaagggccaacgactggagattaacgactgtcggctgcacntcngtcttnattcc

SEQ ID NO: 82803 - DNA, 529 bp, Homo sapiens
  misc_feature: GYAE6OF02JJ7G7.22.57.F02.1.454.CMB.1.raw
tcagacatacgcgtcacgaccggtgctcgatttagctcgatatagttgggtttgggggagtcagacccagtcaggacacagcatggacatgagggtccccgctcagctcctggggctcctgctgctctggctcccaggtgccaagtgtgacatccagatgacccagtctccttccaccctggctgcatctgtaggagacagagtcaccatcacttgtcgggccagtcagaatattaatagttggttggcctggtatcagcagaaaccagggaaagcccctatactcctgatccacaaggcgtctactttagaaagtggggtcccatcaaggttcagcggcactggatctgggacagaattcactctcaccatcaacagcctgcagcctgatgattggctaacttactactgacctaacgtatactacttattcggtacaccgttcggacctaaagggacacgtacgtacggagtaagttaaacgaacgttgtaggcctagacctaccatcctagttcttacacttcccg

SEQ ID NO: 82804 - DNA, 498 bp, Homo sapiens
  misc_feature: GYAE6OF02F4I54.22.57.F02.1.454.CMB.1.raw
  modified_base (482)..(482): a, c, t, g, unknown or other
  misc_feature (482)..(482): n is a, c, g, or t
tcagacatacgcgtcacgaccggtgctcgatttagctcgatatagttgggtttgggggagtcagacccagtcaggacacagcatggacatgagggtccccgctcagctcctggggctcctgctgctctggctcccaggtgccaagtgtgacatccagatgacccagtctccttccaccctggctgcatctgtaggagacagagtcaccatcacttgtcgggccagtcagaatattaatagttggttggcctggtatcagcagaaaccagggaaagcccctatactcctgatccacaaggcgtctactttagaaagtggggtcccatcaaggttcagcggcactggatctgggacagaattcactctcaccatcaacagcctgcagcctgatgatttggctaacttactactgccaacgtatagtacttattcggtcaccttcggccaagggcacgactggagataacgaactgtgctgcacntctgtcttcattcccg

SEQ ID NO: 82805 - DNA, 522 bp, Homo sapiens
  misc_feature: GYAE6OF02HIHU7.22.57.F02.1.454.CMB.1.raw
  modified_base (500)..(500): a, c, t, g, unknown or other
  misc_feature (500)..(500): n is a, c, g, or t
tcagacatacgcgtcacgaccggtgctcgatttagctcgatatagttgggtttgggaggctggtctcactttgtgcaggagtcagacccagtcaggacacagcatggacatgagggtccccgctcagctcctggggctcctgctgttctggctcccaggtgccaagtgtgacatccagatgacccagtctccttccaccctggctgcatctgtaggagacagagtcaccatcacttgtcgggccagtcagaatattaatagttggttggcctggtatcagcagaaaccagggaaagcccctatacctcctgatccacaaggcgtctactttagaaagtggggtcccatcaaggttcagcggcactggatcgtgggacagaattcactctcaccatcaacagcctgcagcctgatgatttggcaactttactactgaccaaccgttatacgttacttattccggtcaccgtttcggcctaacgggaccacggactaggganacgttaaacgactggtggctcg

SEQ ID NO: 82806 - DNA, 555 bp, Homo sapiens
  misc_feature: GYAE6OF02IY7PJ.22.57.F02.1.454.CMB.1.raw
  modified_base (416)..(416): a, c, t, g, unknown or other
  misc_feature (416)..(416): n is a, c, g, or t
tcagacatacgcgtcacgaccggtgctcgatttagctcgatatagttgggtttgggggagtcagacccagtcaggacacagcatggacatgagggtccccgctcagctcctggggctcctgctgctctggctcccaggtgccaagtgtgacatccagatgacccagtctccttccaccctggctgcatctgtaggagacagagtcaccatcacttgtcgggccagtcagaatattaatagttggttggcctggtatcagcagaaaccagggaaagcccctatactcctgactccacaaggctctactttagaaagtgggtccagtcaaggttcagcggcactggatcgtggacagaattcactctcacctatcaacagtcctgcagcctgatagtacgttggactaacttactacncgtacctaacgtatagtacttattcgtactaccttcggaccgtaagggacacgtacgtaggtacgtaagttaaaccggaacttaggtcggtactcgtacctaaccgtacttccgtggttacccttaccgactttacccg

SEQ ID NO: 82807 - DNA, 533 bp, Homo sapiens
  misc_feature: GYAE6OF02IJH54.22.57.F02.1.454.CMB.1.raw
tcagacatacgcgtcacgaccggtgctcgatttagctcgatatagttgggtttgggaggctggtctcactttgtgcaggagtcagacccagtcaggacacagcatggacatgagggtccccgctcagctcctggggctcctgctgctctggctcccaggtgccaagtgtgacatccagatgacccagtctccttccaccctggctgcatctgtaggagacagagtcaccatcacttgtcggcagtcagaatattaatagttggttggcctggtatcagcagaaaccagggaaagcccctatactcctgatccacaaggcgtctactttagaaagtggggtcccatcgaaggttcagcggcactggatcgtagggacagaattcactctcaccatcaacagcctgcacgcctgactgatttggactaacgttactactagaccctaaacgtattaagtactttagttccggtactaccgttcggaccgaaggtaaccacgtactacggagtaacttaaacggaactgtaggtac

SEQ ID NO: 82808 - DNA, 516 bp, Homo sapiens
  misc_feature: GYAE6OF02H76XO.22.57.F02.1.454.CMB.1.raw
  modified_base (275)..(275): a, c, t, g, unknown or other
  misc_feature (275)..(275): n is a, c, g, or t
  modified_base (510)..(510): a, c, t, g, unknown or other
  misc_feature (510)..(510): n is a, c, g, or t
tcagacatacgcgtcacgaccggtgctcgatttagctcgatatagttgggtttgggggagtcagacccagtcaggacacagcatggacatgagggtccccgctcagctcctggggctcctgctgctctggctcccaggtgccaagtgtgacatccagatgacccagtctccttccaccctggctgcatctgtaggagacagagtcaccatcacttgtcgggccagtcagaatattaatagttggttggcctggtatcagcagaaaccagggaaancccctatactcctgatccacaaggcgtctactttagaaagtggggtcccatcaaggttcagcggcactggatcgtgggacagaattcactctcacatcaacagcctgcagcctgatgattttggactaactttactactgacccaaacgtatagttactttattcgtactaccgtttcggacctaagggactacgactggagacttaaacgactgtggctgcacatctgtcttcnttcccg

SEQ ID NO: 82809 - DNA, 560 bp, Homo sapiens
  misc_feature: GYAE6OF02H4EXQ.22.57.F02.1.454.CMB.1.raw
  modified_base (416)..(416): a, c, t, g, unknown or other
  misc_feature (416)..(416): n is a, c, g, or t
  modified_base (428)..(428): a, c, t, g, unknown or other
  misc_feature (428)..(428): n is a, c, g, or t
tcagacatacgcgtcacgaccggtgctcgatttagctcgatatagttggggttttggggaggctggtctcactttgtgcaggagtcagaccccgagtcgaggaacgacagacagtggacatgagggtccccgctcagctcctggggctcctgctgctctggctcccaggtgccaagtgtgacatccagatgacccagtctccttccaccctggctgcatctgtaggagacagagtcacatcacttgtcgggccagtcagaatataatagttggttggcctggtatcagcaaggaaaccagggaaacgcccctatacctcctgactccaacaggctactacttagaagtcgggtccatacaaggttcagtcggacacgtggactcgtagggacagaattcaactctacacatacacngcctgcagcctnatgtagttggactaactttactactacgacctaacggttacttaagtactttatccggtacctaccggttacggaccgaacgggtactaccgtacgtacggaacgtaacgttaaaccgacgtacggtggtac

SEQ ID NO: 82810 - DNA, 626 bp, Homo sapiens
  misc_feature: GYAE6OF02IRWBA.22.57.F02.1.454.CMB.1.raw
  modified_base (273)..(273): a, c, t, g, unknown or other
  misc_feature (273)..(273): n is a, c, g, or t
tcagacatacgcgtcacgaccggtgctcgatttagctcgatatagttgggtttgggggagtcagacccagtcaggacacagcatggacatgagggtccccgctcagctcctgggctcctgctgctctggctcccaggtgccaagtgtgacatccagatgacccagtctccttccaccctggctgcatctgtaggagacagagtcaccatcacttgtcgggccagtcagaatattaatagttggttggcctggtatcagcagaaacagggaaanccctatactctgatccacaaggcgtctactttagaaagtgggtccatacaaggttcagcgcactggatctggacagaaatcgactcgtacacctacgtacaacgacgacctcgcacgtccgtacgtagtacgtagttagtacgaacttaacttactaccgtaccctaaaccgtaaccgttaacgttacgtttaacttacggttaccgtaccgttacccgtaccgtaaaccggtacgaaccgtaaccgtagggtaacggtaacgttaaaaccggtaaacgttaccggttagggtaccgttacgtaaccgaccgttacctaacgttaccgtactttacccgtactttaaccccgg

SEQ ID NO: 82811 - DNA, 534 bp, Homo sapiens
  misc_feature: GYAE6OF02FTJSW.22.57.F02.1.454.CMB.1.raw
tcagacatacgcgtcacgaccggtgctcgatttagctcgatatagttgggtttgggggagtcagacccagtcaggacacagcatggacatgagggtccccgctcagctcctggggctcctgctgctctggctcccaggtgccaagtgtgacatccagatgacccagtctccttccaccctggctgcatctgtaggagacagagtcaccatcacttgtcgggccagtcagaatattaatagttggttggcctggtatcagcagaaaccagggaaagcccctatactcctgatccacaaggcgtctactttagaaagtggggtcccatcaaggttcagcggcactggatcgtgggacagaattcactctcaccatcaacagcctgcagcctgactgatttggactaacttactactgccaaacgtatagttacttattcggtctaccgttcggacctaagggaccaacgactggagtaattaaacggtaactggtacggcttagaccacctattcctagttcttacgtacttcccg

SEQ ID NO: 82812 - DNA, 549 bp, Homo sapiens
  misc_feature: GYAE6OF02JW576.22.57.F02.1.454.CMB.1.raw
  modified_base (197)..(197): a, c, t, g, unknown or other
  misc_feature (197)..(197): n is a, c, g, or t
  modified_base (263)..(263): a, c, t, g, unknown or other
  misc_feature (263)..(263): n is a, c, g, or t
  modified_base (328)..(328): a, c, t, g, unknown or other
  misc_feature (328)..(328): n is a, c, g, or t
tcagacatacgcgtcacgaccggtgctcgatttagctcgatatagttgggtttgggggtagtcgagacccagtcaggacacagcatggacatgagggtcccgctcagctcctgggctcctgctgctctggctcccaggtgccaagtgtgacatccagatgacccagtctccttccaccctggctgcatctgtagganacagagtcaccatcacttgcggcagtcagatattatgttgtgctgtatcagcagaaccagggaacncccctatactcctgactccacaaggctactactttagaaagtcgggtccatcgaaggttcagcgnacgtggatcgtggacagattcactcacacatcacagcctgcacgcctagacgttgactttggaccttaacgttactaccgttcgaacctaccgttatacgttacttagttccgtactaccgttcggaccaaacggactacgtacgtaggacgtaacttaaccgacgttacggtggtacctacgacctaaccgtattccgtagtcctttaccacgtttcccg

SEQ ID NO: 82813 - DNA, 608 bp, Homo sapiens
  misc_feature: GYAE6OF02I7OJ5.22.57.F02.1.454.CMB.1.raw
  modified_base (199)..(199): a, c, t, g, unknown or other
  misc_feature (199)..(199): n is a, c, g, or t
  modified_base (236)..(236): a, c, t, g, unknown or other
  misc_feature (236)..(236): n is a, c, g, or t
  modified_base (364)..(364): a, c, t, g, unknown or other
  misc_feature (364)..(364): n is a, c, g, or t
  modified_base (380)..(380): a, c, t, g, unknown or other
  misc_feature (380)..(380): n is a, c, g, or t
tcagacatacgcgtcacgaccggtgctcgatttagctcgatatagttgggtttgggggaggtcgagacccagtcacggacacagcatggacatgagggtccccgctcagctcctgggctcctgctgctctggctcccaggtgccaagtgtgacatccagatgacccagtctccttccaccctggctgcatctgtaaggngacagacgtcaccatcacttgcgggccagtcagaatnttaatcgttgttggcctggtatcagcagaaccagggaaagccctatactcctgatccacaagcgtctactttagaaagtcggggtcccatcaaggttcagcggcacgtggatctgggacagattcacnctcacatcaacagctncagcctgatgatttggctaacttactaacgttgaccctaaaccgtacttacgttaacgtttaacttccgggttacctaacccgttttcgggacccgtaaacgggtacccgaacgtaccgttaccggagtaaacgttttaaaccggaaacgttcggttaacgggtccttaccgggactaaccccggtaacgttaccttacggtttccctttacgtaaccttttcccccg

SEQ ID NO: 82814 - DNA, 538 bp, Homo sapiens
  misc_feature: GYAE6OF02ITKOQ.22.57.F02.1.454.CMB.1.raw
  modified_base (393)..(393): a, c, t, g, unknown or other
  misc_feature (393)..(393): n is a, c, g, or t
tcagacatacgcgtcacgaccggtgctcgatttagctcgatatagttgggtttgggaggctggtctcactttgtgcaggagtcagacccagtcaggacacagcatggacatgagggtccccgctcagctcctggggctcctgctgctctggctcccaggtgccaagtgtgacatccagatgacccagtctccttccaccctggctgcatctgtaggagacagagtcaccatcacttgtcggccagtcagaatattaatagttggttggcctggtatcagcagaaaccagggaaagcccctatactcctgatccacaaggctctactttagaaagtgggtccatcaaggttcagcgcactggatcgtgggacagaattcactctcacatcaacngcctgcagcctgatgtatttggactaacttactactcgaccaaccgttataacgttacttacgttcggtactaccgtttcggtacctaagggtacctaacggtacttagggaacgtaacgttaaaccggaacttggtaggtaccg

SEQ ID NO: 82815 - DNA, 507 bp, Homo sapiens
  misc_feature: GYAE6OF02JJJ69.22.57.F02.1.454.CMB.1.raw
  modified_base (370)..(370): a, c, t, g, unknown or other
  misc_feature (370)..(370): n is a, c, g, or t
  modified_base (380)..(380): a, c, t, g, unknown or other
  misc_feature (380)..(380): n is a, c, g, or t
  modified_base (495)..(495): a, c, t, g, unknown or other
  misc_feature (495)..(495): n is a, c, g, or t
tcagacatacgcgtcacgaccggtgctcgatttagctcgatatagttgggtttgggggagtcagacccagtcaggacacagcatggacatgagggtccccgctcagctcctggggctcctgctgctctggctcccaggtgccaagtgtgacatccagatgacccagtctccttccaccctggctgcatctgtaggagacagagtcaccatcacttgtcgggccagtcagaatattaatagttggttaggcctggtatcagcagaaaccagggaaagcccctatactcctgactccacaaggcgtactactttagaaagtggggtcccatcaaggttcagcggcactggatcgtggacagaattcacttcncacatcaacngcctgacagcctagatgattggacaactttactactcgactaaccgtatagtacttattcgtcacttcggacagggacacgactggataataacgactgtagctgacacatcctntcttcattcccg

SEQ ID NO: 82816 - DNA, 548 bp, Homo sapiens
  misc_feature: GYAE6OF02I7AIF.22.57.F02.1.454.CMB.1.raw
  modified_base (197)..(197): a, c, t, g, unknown or other
  misc_feature (197)..(197): n is a, c, g, or t
tcagacatacgcgtcacgaccggtgctcgatttagctcgatatagttgggtttgggggagtcagacccagtcaggacacagcatggacatgagggtccccgctcagctcctggggctcctgctgctctggctcccaggtgccaagtgtgacatccagatgacccagtctccttccaccctggctgcatctgtagganacagagtcaccatcacttggtcgggccagtcagaatattaatgttggttggcctggtatcagcagaaaccagggaaacgcccctatacctcctagactccacaaggcgtctactttagaagtcgggtccatcaaggttcagcgcactggatcgtaggacagaattcactctcacatcaacacgcctgacagctgatgattggactaacttactactcgacctaacgtatacgttacttacttcggtacctaccgttccggaccgtaagggaccacgacgtagggagttaacgtaaacgtaacgtcgtaggtaccgtcgaccgtactattccgtacgtccttctattccccg

SEQ ID NO: 82817 - DNA, 507 bp, Homo sapiens
  misc_feature: GYAE6OF02GV2Z8.22.57.F02.1.454.CMB.1.raw
  modified_base (467)..(467): a, c, t, g, unknown or other
  misc_feature (467)..(467): n is a, c, g, or t
tcagacatacgcgtcacgaccggtgctcgatttagctcgatatagttgggtttgggggagtcagacccagtcaggacacagcatggacatgagggtccccgctcagctcctggggctcctgctgctctggctcccaggtgccaagtgtgacatccagatgacccagtctccttccaccctggctgcatctgtaggagacagagtcaccatcacttgtcgggccagtcagaatattaatagttggttggcctggtatcagcagaaaccagggaaagcccctatactcctgatccacaaggcgtctactttagaaagtggggtcccatcaaggttcagcggcactggatctgggacagaattcactctcaccatcaacagcctgcagcctgatgatttggctaacgttactactgaccaacgtatagtacttattcggtctaccgttcggccaagggcaacgactgganattaacgaatgtaggctcgcacatctgtcttcgattcccg

SEQ ID NO: 82818 - DNA, 723 bp, Homo sapiens
  misc_feature: GYAE6OF02GFL9G.22.57.F02.1.454.CMB.1.raw
  modified_base (131)..(131): a, c, t, g, unknown or other
  misc_feature (131)..(131): n is a, c, g, or t
tcagacatacgcgtcacgaccggtgctcgatttagctcgatatagttgggtttggagggctgggtctcccacctttggttcgcgaggtagtcagtacccagtcaggacacagcatggacatgagggtcccntcaggcttccgtgggctcctgcgttcgtctctggtcttacccgaggtcgcctaagtggtggacatccagagtggaccctagtcgtccttccaccgtggctcgcgtactcgtaggtacggacaccagagtccaccgatccacgttgtccggaccctagtctagtaattattaattagttggttcggccgttggtactcgagcgtacgaaaccggaaggaacgcccgtaatactctcgactaccataaggtacgtacttaacgttaagaaacgttacgggtacctagttactaaggtttacaacggtacggtacctacggtagggtaacgtcgtacgggtactaacgtaacgttcctaacgtcccgtaccgaacctaacgtaccaaacgacgtacccgtagtacctacgtccttacgaagttcggtacttacggaccttaacgttaccgtacgtacgaacccgtaacgtactacggttacttacgtttaccgtaccttaccggtttcgggaaccgtaacggggtaaccgtaaccggtacggtacggtaacggtaaaccggtttaaaccggtaacggttggtaccggtaaccggg

SEQ ID NO: 82819 - DNA, 524 bp, Homo sapiens
  misc_feature: GYAE6OF02GIGDN.22.57.F02.1.454.CMB.1.raw
tcagacatacgcgtcacgaccggtgctcgatttagctcgatatagttgggtttgggggagtcagacccagtcaggacacagcatggacatgagggtccccgctcagctcctggggctcctgctgctctggctcccaggtgccaagtgtgacatccagatgacccagtctccttccaccctggctgcatctgtaggagacagagtcaaccatcacttgcggccagtcagaatattaatagttggttggcctggtatcagcagaaaccagggaaagcccctatactcctgatccacaaggcgtctactttagaaagtgggtcccatcaaggttcagcggcactggatcgtgggacagaattcactctcaccatacaacagcctgcagcctgatgatttggactaacttactactcgacctaaccgtatacgttacttagttcggtctaccgttcggaccgaagggacacgactggagtaattaaacgaactgtacgggctcgcacctatcctatcttacattcccg

SEQ ID NO: 82820 - DNA, 537 bp, Homo sapiens
  misc_feature: GYAE6OF02IOFKP.22.57.F02.1.454.CMB.1.raw
  modified_base (490)..(490): a, c, t, g, unknown or other
  misc_feature (490)..(490): n is a, c, g, or t
tcagacatacgcgtcacgaccggtgctcgatttagctcgatatagttgggtttgggggagtcagacccagtcaggacacagcatggacatgagggtccccgctcagctcctggggctcctgctgctctggctcccaggtgccaagtgtgacatccagatgacccagtctccttccaccctggctgcatctgtaggagacagagtcaccatcacttgtcgggccagtcagaatattaatagttggttggcctggtatcagcaagaaaccagggaaagcccctaatactcctgatccacaaggcgtactactttagaaagtggggtccatcaaggttcagcggcactggatcgtgggacagaattcaactctcaccatcaacacgcctgcagcctgatgatttggactaacttactactcgacaaaccgtattacgtaactttattccggtactaccgtttacggaccaaacggggacaaccgactaggganaacgtttaaaacgactagtggctgaccacatctagtcttacgatccc

SEQ ID NO: 82821 - DNA, 523 bp, Homo sapiens
  misc_feature: GYAE6OF02GZUIN.22.57.F02.1.454.CMB.1.raw
  modified_base (276)..(276): a, c, t, g, unknown or other
  misc_feature (276)..(276): n is a, c, g, or t
tcagacatacgcgtcacgaccggtgctcgatttagctcgatatagttgggtttgggaggctggtctcactttgtgcaggagtcagacccagtcaggacacagcatggacatgagggtcccccgctcagctcctggggctcctgctgctctggctcccaggtgccaagtgtgacatccagatgacccagtctccttccaccctggctgcatctgtaggagacagagtcaccatcacttgtcgggccagtcagaatattaatagttggtgctggtatnagcagaaccagggaagcccctaatacgtcctgatccacagcgtctactttagaaagtgggtccatcaaggttcagcgcactggatcgtggacagaattcactctacacatcaacagcctgcacgcctgatgtatttgactaacttacgtactacgacctaaccgttatagttacttattccggtctaccgttcggaccgaacgggacacgacgtacggagtaacttaaacggaacttaggtagtacg

SEQ ID NO: 82822 - DNA, 707 bp, Homo sapiens
  misc_feature: GYAE6OF02H15JM.22.57.F02.1.454.CMB.1.raw
  modified_base (163)..(163): a, c, t, g, unknown or other
  misc_feature (163)..(163): n is a, c, g, or t
  modified_base (220)..(220): a, c, t, g, unknown or other
  misc_feature (220)..(220): n is a, c, g, or t
tcagacatacgcgtcacgaccggtgctcgatttagctcgatatagttgggtttgggaggctggtctcactttgtgcaggagtcagaccccagtcaggacacagcatggacatgagggtcccccgctcagctcctggggctcctgctgctctggctcccaggtnccaagtgtgacatccagatgacccagtctccttccaccctggctgcatctgtagganacagagtcaaccatccacttggtcggccagtcagaatattaatagttggttggcttgtatcagcaagaaaccgaggaacacccctatactcctagataccacgaggtctacttaacttaaggaaagttcggggtaccagttaccgaaaggttcgaggtacggccgtacgtcgggtagttaccgttaggggaaccgtaacggtaactttacccgaacttccgtaaccaacctactacccaaaccgaccgtacccgttcggaccaaccgtccgtttacgaatttacggttaacgttttacgggaacccttaaccgtttaacccttaacgtacccggtaacccgtaaacccgttattaacgtttaaccgtttaaccgtttccggttacccttaacccggtttcccgggaacccgtaacggggaaccctaaccggtacgttaacggtacggtaaacctttaaaaccgggtaacgttccgggtacggtaccg

SEQ ID NO: 82823 - DNA, 571 bp, Homo sapiens
  misc_feature: GYAE6OF02HADVC.22.57.F02.1.454.CMB.1.raw
  modified_base (276)..(276): a, c, t, g, unknown or other
  misc_feature (276)..(276): n is a, c, g, or t
  modified_base (377)..(377): a, c, t, g, unknown or other
  misc_feature (377)..(377): n is a, c, g, or t
tcagacatacgcgtcacgaccggtgctcgatttagctcgatatagttgggtttgggggagtcagacccagtcaggacacagcatggacatgagggtccccgctcagctcctggggctcctgctgctctggctcccaggtgccaagtgtgacatccagatgacccagtctccttccaccctggctgcatctgtaggagacagagtcaccatcacttgtcgggccagtcagaatattaatagttggttgcctggtatcagcaagaaaccagggaaacncccctatactcctgactccacaaggctctacttagaaagtgggtccatcaaggttcagcggcactggatcgtgggacagaacttcactctcaccatcaacncgcctgacacgcctgatgtattggactaactttactacgtcgacctaaccgtattaacgtactttagttccgtacctaccgttcggaccgtaaacgggacctacgacgttagggacgttaacgttaaaaccggacgttggtacggtacttacgacctaaccctagttccttacggtcctttacctaccttcccg

SEQ ID NO: 82824 - DNA, 591 bp, Homo sapiens
  misc_feature: GYAE6OF02IO44L.22.57.F02.1.454.CMB.1.raw
  modified_base (371)..(371): a, c, t, g, unknown or other
  misc_feature (371)..(371): n is a, c, g, or t
tcagacatacgcgtcacgaccggtgctcgatttagctcgatatagttgggtttgggggagtcagacccagtcaggacacagcatggacatgagggtccccgctcagctcctggggctcctgctgctctggctcccaggtgccaagtgtgacatccagatgacccagtctccttccaccctggctgcatctgtaggagacagagtcaaccatcacttgtcgggccagtcagaatattaatagttggttggctgtatcagcagaaccgaggaaacgccctatactcctgactccacgaaggctctaactttagaaaggtcggggtccagtcaaggttcagcggcacgtggatcgtaggacagtaattcactcncaaccatacaacacgcctgacagcctagacttgagttttcggacttaaacttacgtactacgaccctaaacgttaattaacgttaacctttagttcccgttactacccgttcgtaacccgaaagggacctaacggtacgtaggacttaacgttaaacggaacgttcggtacggtccttaggaacctacctacgttcgttcgttaccttactaccttaccc

SEQ ID NO: 82825 - DNA, 593 bp, Homo sapiens
  misc_feature: GYAE6OF02JDIJU.22.57.F02.1.454.CMB.1.raw
  modified_base (292)..(292): a, c, t, g, unknown or other
  misc_feature (292)..(292): n is a, c, g, or t
  modified_base (298)..(298): a, c, t, g, unknown or other
  misc_feature (298)..(298): n is a, c, g, or t
tcagacatacgcgtcacgaccggtgctcgatttagctcgatatagttgggtttgggaggctggtctcactttgtgcaggagtcagacccagtcaggacacagcatggacatgagggtccccgctcagctcctggggctcctgctgctctggctcccaggtgccaagtgtgacatccagatgacccagtctccttccaccctggctgcatctgtaggagacagagtcaccatcacttgtcggccagtcagaatattaatagttggttggctggtatcagcagaaccaggaacnccctanactctgactccacaggctctaacttagaaagtcgggtacccagtcgaacggttcagcggcacgtggatcgaggacagtaacttcactctcaccatacaacacgcctgacacgcctgatggtatttcggactaactttactacgtacgtaccgtaaaccgtattaacgttaaccgtttacgttaccgttactaacccggtttccggtaaccggtaaaccgggtaaccgtaaccggtaacgttacgggtaaacgtaaacccggtttaaaaccggaacgttacgggtacggtaacccg

SEQ ID NO: 82826 - DNA, 524 bp, Homo sapiens
  misc_feature: GYAE6OF02HKZIT.22.57.F02.1.454.CMB.1.raw
  modified_base (217)..(217): a, c, t, g, unknown or other
  misc_feature (217)..(217): n is a, c, g, or t
  modified_base (293)..(293): a, c, t, g, unknown or other
  misc_feature (293)..(293): n is a, c, g, or t
  modified_base (396)..(396): a, c, t, g, unknown or other
  misc_feature (396)..(396): n is a, c, g, or t
tcagacatacgcgtcacgaccggtgctcgatttagctcgatatagttgggtttgggaggctggtctcactttgtgcaggagtcagacccagtcaggacacagcatggacatgagggtccccgctcagctcctggggctcctgctgctctggctcccaggtgccaagtgtgacatccagatgacccagtctccttccaccctgctgcatctgtagganacagagtcaccatcacttgcggccagtcagaatattaatagttggtggcctggtatcagcagaaaccagggaaacncccctatactcctgactcacaaggctctacttagaaagtgggtaccagtacaaggtcagcggcacgtggatctgggacagaattcactctcaccatacaacancctgcagtcctagatgtatttggacctaacttactactgacctaacgtatagttacttattacgtctacccgttcgaccgtaaggacaccggtacgtggaagtaacgttaaacgacgttagtggtacg

SEQ ID NO: 82827 - DNA, 525 bp, Homo sapiens
  misc_feature: GYAE6OF02GDAWJ.22.57.F02.1.454.CMB.1.raw
  modified_base (393)..(393): a, c, t, g, unknown or other
  misc_feature (393)..(393): n is a, c, g, or t
  modified_base (406)..(406): a, c, t, g, unknown or other
  misc_feature (406)..(406): n is a, c, g, or t
tcagacatacgcgtcacgaccggtgctcgatttagctcgatatagttgggtttgggaggctggtctcactttgtgcaggagtcagacccagtcaggacacagcatggacatgagggtccccgctcagctcctggggctcctgctgctctggctcccaggtgccaagtgtgacatccagatgacccagtctccttccacctggctgcatctgtaggagacagagtcaccatcacttgtcgggccagtcagaatattaatagttggttggcctggtatcagcagaaaccgagggaaacgccctatactcctgactccacagctctacttagaagtgggtccatcaaggttcagcgacactggatcgtggacagaattcactctacacatacaacngctgcagcctagntgattgactaacttactactcgacctaacgtataacgtacttacttcgtcctaccgttcggacctaacgggcctaacggactagggaactaacttaaaccggaacgttggtaggtaccg

SEQ ID NO: 82828 - DNA, 581 bp, Homo sapiens
  misc_feature: GYAE6OF02G2A7Y.22.57.F02.1.454.CMB.1.raw
  modified_base (567)..(567): a, c, t, g, unknown or other
  misc_feature (567)..(567): n is a, c, g, or t
  modified_base (574)..(574): a, c, t, g, unknown or other
  misc_feature (574)..(574): n is a, c, g, or t
tcagacatacgcgtcacgaccggtgctcgatttagctcgatatagttgggtttggggaggctggtctcactttgtgcaggagtcagacccagtcaggacacagcatggacatgagggtccccgctcagctcctggggctcctgctgctctggctcccaggtgccaagtgtgacatcccagatgaccccagtcctccttccaccctggctgcatctgtaggagacagagtccaccatcacttgtcgggccagtcagaatattaatagttggttggcctggtatcgagcagaaaccgagggaacgcccctaatacctcctgactccacaaggtctacttactttaagaaaggtcgggtacccattcgaaggttcagccggtcacgtggacttcggtagggacagtattcgactctaccacattacaacacgtcctgccagcctgtactgtagtttcgactacttaactaccgtacgaccctaaacgttattaacgtactttacgttccggtactacccggttaccggaccaacggggtaccacggtacgtgggaactaacgtaaaccgngttacgnggtaccg

SEQ ID NO: 82829 - DNA, 563 bp, Homo sapiens
  misc_feature: GYAE6OF02GJXI3.22.57.F02.1.454.CMB.1.raw
  modified_base (367)..(367): a, c, t, g, unknown or other
  misc_feature (367)..(367): n is a, c, g, or t
tcagacatacgcgtcacgaccggtgctcgatttagctcgatatagttgggtttgggggagtcagacccagtcaggacacagcatggacatgagggtccccgctcagctcctggggctcctgctgctctggctcccaggtgccaagtgtgacatccagatgacccagtctccttccaccctggctgcatctgtaggagacagagtcaccatcacttgcgggccagtcagaatattaatagttggttggcctggtatcagcagaaaccagggaaagcccctatactcctgatccacaaggcgtactactttagaaagtcggggtccagtcaaggttcagcggcactggatctgggacagaattcactcncaccatacaacagcctagcagcctgagtgtattcggactaacttactacctcgaccctaacgttatacgttaacttacgttcgtactacccgtttcggaccaaacgggaaccacggacgtagggagtaacttaaacggaacgttaggtcggcgtacgacctaacctacgttactcggttaccttacgatttccccg

SEQ ID NO: 82830 - DNA, 580 bp, Homo sapiens
  misc_feature: GYAE6OF02IPW4T.22.57.F02.1.454.CMB.1.raw
  modified_base (394)..(394): a, c, t, g, unknown or other
  misc_feature (394)..(394): n is a, c, g, or t
tcagacatacgcgtcacgaccggtgctcgatttagctcgatatagttgggtttgggggagtcagacccagtcaggacacagcatggacatgagggtccccgctcagctcctggggctcctgctgctctggctcccaggtgccaagtgtgacatccagatgacccagtctccttccaccctggctgcatctgtaggagacagagtcaccatcacttggtcgggccagtcagaatataatagttggttggcctggtatcagcaagaaaccgagggaaacgcccctaatacctcctgactccacgaaggctactaactttagaaaggtcgggtaccatacgaaggttcaggcggactacgtggatcgtaggacagtatcactctcacatacaacacnctgcagcctgatgtattgactaacttactactcgacctaacgtatacgttacttacgttccgtacctaccgttcggaccgtaaacggggacctaacgggtacttagggtactaacgtttaaaccggaacgttaggtacggtactacggacctaacgtattccgttacggttacctttcacttcccg

SEQ ID NO: 82831 - DNA, 566 bp, Homo sapiens
  misc_feature: GYAE6OF02G4J48.22.57.F02.1.454.CMB.1.raw
  modified_base (377)..(377): a, c, t, g, unknown or other
  misc_feature (377)..(377): n is a, c, g, or t
tcagacatacgcgtcacgaccggtgctcgatttagctcgatatagttgggtttgggggagtcagacccagtcaggacacagcatggacatgagggtccccgctcagctcctggggctcctgctgctctggctcccaggtgccaagtgtgacatccagatgacccagtctccttccaccctggctgcatctgtaggagacagagtcaccatcacttgcgggccagtcagaatattaatagttggttgcctggtatcagcagaaaccagggaaagcccctatactcctgactccacaaggctctactttagaaagtcgggtcccatcaaggttcagcggcactggatcgtggacagaattcactctacaccatcaacancctgcacgcctgatgtatttggactaacttactactcgacctaacgtatacgttacttacttcggtactaccgttcggacctaagggaccacgtacgtaggacgtaacttaaacggaacttaggtacggtccttacggacctaacccgtacgttaccgttcggtttacctttaccgtactttacccccg

SEQ ID NO: 82832 - DNA, 579 bp, Homo sapiens
  misc_feature: GYAE6OF02F0NN0.22.57.F02.1.454.CMB.1.raw
  modified_base (274)..(274): a, c, t, g, unknown or other
  misc_feature (274)..(274): n is a, c, g, or t
tcagacatacgcgtcacgaccggtgctcgatttagctcgatatagttgggtttgggggagtcagacccagtcaggacacagcatggacatgagggtccccgctcagctcctggggctcctgctgctctggctcccaggtgccaagtgtgacatccagatgacccagtctccttccaccctggctgcatctgtaggagacagagtcaccatcacttgcgggccagtcagaatattaatagttggttggcctggtatcagcagaaaccagggaaancccctatactctgactccacaaggctctactttagaaaggtcggggtacccatcaaggttcagcggacactggatcgtagggactaagaattcactctacaccatacaacacgcctgcacgcctagatgtatttcggacttaaccttactacctacgacctaaaccgttacttagttaacttacgttccgtacctacccgttcgggaccaaacgggactacgacgttaggagtaacgttaaaccggtaacgtcggtcggaccgtacgacctaccgttattccgttcgtccttacctacttccccg

SEQ ID NO: 82833 - DNA, 535 bp, Homo sapiens
  misc_feature: GYAE6OF02GBYB9.22.57.F02.1.454.CMB.1.raw
  modified_base (275)..(275): a, c, t, g, unknown or other
  misc_feature (275)..(275): n is a, c, g, or t
  modified_base (349)..(349): a, c, t, g, unknown or other
  misc_feature (349)..(349): n is a, c, g, or t
tcagacatacgcgtcacgaccggtgctcgatttagctcgatatagttgggtttgggggagtcagacccagtcaggacacagcatggacatgagggtccccgctcagctcctggggctcctgctgctctggctcccaggtgccaagtgtgacatccagatgacccagtctccttccaccctggctgcatctgtaggagacagagtcaccatcacttgcgggccagtcagaatattaatgttggttggcctggtatcagcaagaaaccagggaaacncccctatactcctgactccaacaaggctctactttaggaagtcgggtccatcaaggttcagcgcacgtgatcgngggacagaattcactctcaccatcaacagcctgcagcctgatgtattcgctaacttactactcgacctaacgtatacgttacttacgttcggtacctaaccgttcggaccgaagggaccacgacgtggagtaacgttaaacgacgttagtcggactgaccacattccgtgtccttactacttcccg

SEQ ID NO: 82834 - DNA, 575 bp, Homo sapiens
  misc_feature: GYAE6OF02FM6A3.22.57.F02.1.454.CMB.1.raw
tcagacatacgcgtcacgaccggtgctcgatttagctcgatatagttgggtttgggaggctggtctcactttgtgcaggagtcagacccagtcaggacacagcatggacatgagggtcccccgctcagctcctggggctcctgctgctctggctcccaggtgccaagtgtgacatccagatgacccagtctccttccacctggctgcatctgtaggagacagagtcaccatcacttgtcggccagtcagaatattaatagttggttgcctggtatcagcagaaaccgagggaaacgcccctaatactcctgactccacagctactactttagaagtgggtcccatcaaggttcagcgcacgtggactcgtgggacagtaatcactctacaccatacaacagacctgaccagccctagtactcgtagttttcggaccttaaccttacctaccgttacgacccgtaaaccgttaattacgttaactttacgttccggtacctaccgtttccggaaccgtaacgggacctaaccgtacgtacggacgtaaacgttaaacgacgttaggtacggtaccg
